United States Patent 10,724,096 (METHODS AND COMPOSITIONS FOR INHIBITING AND TREATING NEUROLOGICAL CONDITIONS) - sequence listing, part 13

SEQ ID NO: 43 - DNA, 304582 bp, Homo sapiens
ggtaaaactgacatgaatttgcacatttgaaaggctcatcactccttcataagatagacagttattctcagcttctgaactgaaacttcacgagtgggattatcagagtaaaaggactttttagttcttcggtattgaaacccctttaaacaggatgtaagttctccctacgtcatcaacaacgaatagcacacgtgctgtacagtgaaagttagaatgatacgcttcttaattgcagaagtattcccgtcaaaagacaataaagcatattttggaagaagtgggactctagtaaaaacacacagacctgaaagcagtgcattaattattttattaatttcttctttttacattatgggaaacattcatctatttacaatatttttttgttcacacacaatctaggtaaataagcctatgaaattccaattcataaagccataaaaatgttcccacccctccatctgaaggctttcaaatgaatcttttttttccaaaccaaaataatttttaaaaattacatttgggaattcagatatgctagtgatttacattccagttatttaaaatatgcatctagacatgttttaaaaaagaaatggtaaattcacaaggataaggcttaaatgaaagtggtaatgcacagtaaaacattaaggaaacatctataaataacagaaatatattacaataaattagttctatttaccatttcaaatattaaaaatctttaatccatttcttcatctctctttacaaaaaggttatgtgaattgtatggaaacatctgcaaaaaatataataaatacttaatttctttgaacgttttttgatgtgggagacaaacttcttttgtaatccccccctccccaagaaaatgcccaacacctttataccaaagttaaacaaaataagtaatttttcagggtacatacattttccattacgaactaaaaaacatttctacaaattacatcaaaaagaacaatgtaacaaaggttatgctcatgaatgtcagtttcaggggtcaagcagcattgtgtggggtcatgttctaacaccaataattagctttttataaagtgtttgtacaatttaaattgtattttcaaggaaggcaaagatcatgatgccctgtaggccttgagctaaaagatttaaaattcttaccaaaaatagcttatgaatatacaaatgccgttcacttagacaagataaataggccttctcttgtctctctttaaaatatcatgggctaaattagtttccaaagaaaatattgtaggatgatcttgagtcgtattagaaatctatttcttaatccaaatctcaactctacctcagggcacggagctgtaattgtgagcatgggtcttgggatgaacgctgcttctttcatattaatctgtgagttccaagtcattctcagtattgaatgtgaccataggctacccaagtggcagttggccctactcgatgcaagctttgtgtgacttttaattgctgctacaaggtaaagaaaaggtgtattctttttaaaactagcaaatacttgaagctcaaaatctctgtatgctccaatttcacaaagcactttgagtgctttgttcaccctagttaaaagttggttcgttggtttcaaaataagtgagtagcccttttcttgtaaaccacagcagtaaacatttgtgccctgtttataaaggtagctcaaagcatcgatggctctgagaggtagcgaattctctagtggttttagaatatgtccgtgaaaatatctgttgctagaacccatcacctctcttaatttcataagtaaaattaaattagcacctggctatgagagtgtattattttaaaaagcttctctggtgcaagcatgtttgatgtatgtttttaaaagtctttcgtttttaatttctaatgctttaggatgttagctggacataaaatgccattgatacttaagattgccacatcctaagtgtttaaactgtgacgagtaagggcatttaaagacaacttcagctagacaccgatgcatactgcccatcaatcaagactaaaaatctaaatcaacactctctgccaaaagccttgacttctttcagtgtttatgaatcatgactccccccacctcttcatggctgttgaccctggcaggtcgagtttcttctctcactacctggaacctcaagatgacagcggcagctcttttgaatgaggcagcatgtctattggggcaaaaatttattttagccatttgacacaggacagaatcctatgctaggtattactggactctgcagtagtgagaggagatgaaaggagaaaatatatctgaaatacgaactacttgggttaaaatagacggatgtgtagcattcaaagggatggtaggaaaacccaaactcttctccaaaaacagccttgctgccatttacagcgctttataagcagatatgtacttatatatgtggaatcaggtaggcccacctggatggacacttaacaaattaatagaaccaacactttccctttaaaaacagccgccacgacaacaatataaatatacacagtacaataagagttgagaaaacatttcaggtctagattttcttaataatagaacaaaaaaatcccttatgtagtatactaaaccatcagtgcctcctttgccttgcttcatgttattgcctttcagaatagattaatttccctgaaagatcgaatttacaatcttctgctgattgagacatttgaagctgtgattgatgaagtaacagtgaggcagtttgtgcagctgtgagtgtgcaggtgcccccagcacctgcagatttcgcttctcccatccttgctacacatccaggtcccccacccccaggccaggcttggtcccctctctctgtgtccctcatggattccagtgagatggtgtgatttctgaggttgggaataaagtgctccatctgcttttttaaaagaataaccatttaggggaaataaagggaatcggaggcctagtttctttcacgtggaagacggtaagtcccaaaggatcaccctgtgatactggatttctgaaataccctatggttttatattgctgaacagactagctcgagagaactgaggacggcgggtgacctaaaggcatcacttctacacaggtgggtttggctttgcccagaaaataaagggttggatctcagtatgaggcagggcgacggcatcaggacagggggcgaagctcggtgaagaaggagatgggcaaacgggtacgggaagtggggggctgaggggggcccggggggcggctcctgcgaggtggacaactacaccgcgacagtggaagtcaccgagctcgggagcggacgggctcggagggggagaggcagccggcagaggagcggccgggggaggaggggacagatgcttggcggcggcggccgggctgcggggcgctcagagccgggtctgcgcctcggggatgtagatctcgatgctctcggcgctctcggtggccgagttctggcggacggacgcggcgcgcttggcggccatcaggcgcttgcgggcctcctggcgctgcgagctctccagcgagcgctcccggatcagcggcgcggggcccttcgccggcttctttggcactggaggaggggcccttctctcctgatcaaagcagaaggttcaggacattacacagcttctcaggacaagcttgggaaaaactgggataggtcagtagttagaacacacagttttttacctaggggtggttagttctgatctgcacactgcatatctacttttttcttcattattctggcttgggcattcaaaagatgcagaaaaaaaaaaatcccggtaagcttaaggcccagggtaaggctgggttgcagaactaggtctctccaagggaaggaagtgggtattttaaaggccccctgcggaaagcctgcggctcccagcacattgagtgcggttctctctggagactccagactcctcctggtgccagagatgggccaggaagcagcggctgcagcagcatcttagaacccctgcatcccctctaaggatgcaagtcaccgggtgcaagcttggttcagagcttaaaaacatctccgctctgtccccggcccgcccaccgtccccttcccaccaaacctaaataaacagaggaggaagaagagatatcagattgtgttctttagctttgttggtgctacaccaggttagacccttttgcacaccacacacgaacacacaagcaatatacaatatacagggtcacgggagagggaggccattgatatttcctacactcgagagttaattaagtcagttccaaggtgactctgactaggggcctcgggataactgtggtggcccaggaagcaattccaatcacaggggcagaaactgtgccatgaaaagttgacacaggatgaaagaggtcattcctcttatcagcagcaaactatgaaatgggcggatattttcaatgccactgcaaaaacaaaagacagtcatctctttggcattaaaaaaaatgcagcaggaaagaatggcgtctagaccacaaaggatttttaggcaaagaaggttgaagttgtagactgtgaaagggtgcacataaaactgatgttttcattttaaataaaataccctccattctcataaaatgaagcgtgaacattatcttaaaatatagtttcggtgattctccaaagagtactctttgtatcttaacaccaatgctcagcacagcaattcctccctgcttgccagagcaagtgcctagttcaacttctcaccctggagctaccccaccggctgtctaaggtggagtctgtgtggcttaaaagagaaaaaaggagagcctggagtgcaaactatattctcccaactctgattgtgcttgttcatttttctcctcaggttcatggggtgatgaaaagctctgatcacaggcaaagtccattaaaaaccgtaaaaatcaagctaactaatgatttactatgtaaatatcaataggttacatatatcaattcttagcatctcttcttttagacattttaaatcttcattgtggaataactcagtggatatttttagaaatatgaatattggatattttttagtcattttcctttccttatacatttggattttttaaacaatgattactattattattattattgagacaagctctcgctctgtcacccaggctggagtgcagtggcgcaaccacggctcactgcagactcaaactctccgagttcaagcaatcctcccacctcagcctcccaagtagctggcactacaagtgtgtaccaccacgcccagctaatttttgtactttttgtagagacggcgtttcaccatattgttgcccaggctggttttgaactcctggactcaagtgatccacccgcctcagcctcccaaagtgctgggattacagacatgagccaccatgcccagccaacaatgattatttaaaaaaaaaaaaaaaaaattagatgcatcagctctggaaactaaattaccagtatgtgtgcatttgtagtgttttcttaaaataagactgatttaaagcttatctagcagatagttttaaacacagattaaagaaaactagattgggtacaaatgtttggcttcccaagtgagaggccacatgtacatcaacagtactttccaacttaacactacgacccccattttgatggtgacagaattggaaacgggggacagtgatgagagcatcaccctcctgtcacttacagatggtcccttgggactggatttttcctgggagaccattgaccccaagaaccctgaaaacatgatatgcggtagcagaatggattagattgctgttagctttctggtaggtgaggggacctgaaaagaacagggccaccagcatttcaagggaacagccattccaattttcagaggttgattctcttggaattatttgacctgaggccataggaaagcaaagggttaaaaaagtcacgtttgacatgccagcctggggagctggacattggatacccgtgtgagcctcgtggaacaccataatcaaatgtgaaaattagagttgattaattaaagtaaaagaatttaagtctttatttctaaactgatgcatgaggaccccagtgagcaatattccccaaggcaaatcaaccaaaagcaaaactgttttgaaaaaaaaaaaaaaaaaaaacccaacatttatgtaattactgtgaaactttatggtatatatttttagacttgaacaacagtaatttctttattactatatttatgaaatgattatcaaagtcagttatttttcagggcatcctatttttcttgaaaacacatcctaggggtgtaaggaagttgaactcttgttctatggattcatgcactgaagatgtcatttattttagtttaaaaagcaaaatggaggcagttccttccagtgactaaaatggtttaacttaaagtttaattaacaaaaaaagccacattcccattttccaattcacaaagacaggtttttctttaaaaatatgcctgaaacatattacagataatatcccaaatgattactatgtaaacattgtcattacaatgaaattaatatgatatcagctccatttcacattgtaaacagcaggactgaatgcagaagcctatttagactgtccagtgtttgtgcaggtttttaaatgaaccatacaaaatctacattgttctaccttcttgtcaagaggatccatctgtttccaattattggcctttaactgatgaagttcatcaaatttcatactaatattttctatggacaactgcagcatgtcccaaaaccccgccaaatcctgggaggtgggtcttggatgagcattaggattctgcacaagagaaagaaaaacattcatgctttagaagcaattcttgacaagcacagggccaaaaaggcattttcaaatatttcaaacaacataaggaggactagttccttttggttttccgacacgaggtaaaagtgaggttacaaatgttaattttatacactcatccgtttgagtcagtgattctcaaatgtcaaggttgtaaaactcttctgttgtgataccacatctatcaattcaatatggtatgggggaagggtctaaacatatgaaaaattccagaatgtgtgatctactacaggacgtattttaaaacaccatattcaaatgaaaatgacatttctgaaaaaaaaaatacagtgtattattattagagtttgtattccactacatgccatacaatttattcagagaacagataaggaatctaaaataagattagtttaaatattcatgttaagtaaaacacaaatgattagtaataaaatattggatgttccaagcactatgtgtttaataattaagatgtttactaatataggaagtaattttatcataggaagtaattttatcatatgactgctttgacaaaatcatttgaaaattcattcattttaaattgaccataaaataatatagcaaatgtgagaacacattatctctacatacatctctacatctatatgtctgtaatgacccatttgctaagtgatagtaaacattcttcagtgtttcaggattgactttctttgccccatccacatatccctgataccagaacatataaacctgaatttatatgccctaagacaggaaaaacacagctaggagactgaaaatatcatactctttgttaattactacctgcagcagtagctaaaggcattcatgattagacgggtggcagcctccatatgtcaagagatcctagctggtatctgttttggtgacctcttggtatttcaggcaactggacagactgtgaaactccatgtcctatgataacacgaggccagtgtatgcttttaaaactaacccctaataaaaatgatatcagaattttggaaagtacaaggttgaagaccatcaaaataatggattggaaagacattttaagtccttgggtgcaccagtattattggcctacctcaaaataaaaataaatgaagtctgggcgtggtggctcatgcctgtaatcccagcactttgggagtccgaagtgggtggatcacctgaggtcaggagttcgagaccagcctggccaacatggcaaaaccccatctctactgaaaatacaaaaataatccaggcacgatggtgcacacctgtaatcccagctgctcaggaggctgaggcaagagaatcgcttggacctgagaggcggagattgcagtgagccaaggttgtgccattgcactccagcctgggtgacaagagcgacattctgtctcaaaaataaataaataaacagatagatagatagatatatttataaatttatagttcctaaagtgcccaaaagttctaaagttcattagaagaaataaattttaaagtttataaagttttttttagtttactaaatcagaatactacagagaaaccctttcattaattcagacatcgttagaatagattttaatactgaatcagacacttacaaactttaaaacttattttttaaatgaactttagaattattaggcactttgggaactataaatttatagatatatctgtttatttatttatttttgagacatagcgtcgctcttgtcgcccacgctggagtgcaatggtacaatctcagctcactgcaacctctgcctcccaggttcaagcgactctcctgcctcagcctcctgagtaactgggattacaggtgtgtgccaccatgcctggctaatttttgtgtttttttgtagagatggggtctcacattgttgctcaggctggtcttgaactcctggccacaagatcctcctgcctcgacctcccaagtgctgggattacaggtacaagccacttcgccccgccagtgttttcttgaatgtatttaactctgtataatgggcaactcgttcccttctcataaagaatctctttgctcccacatcattaagaagatagatagagaaacagagagaaagcgtttagcctcagccattctccaaatcagtgagtcatgtgacataccatgcacaacagtggcagctcactccttaatccaagacatgctgccttggagaccagaggtgggtgctggaggggagagtggggagagccaagggaggctggggtccttggtttagttacgttggaagaggccaacttttgtctactcattctaagcctgggagtctagttaggataatgagtaagtgttttcaaaatagagctatgatttttctcctcagaataggaactcaagaaaggaagctgggtctggttctgaccaatcatggtgccactttcatgcagctgtggaccaggccactgtgcctcctggggcaaaggagcatggagctgagtctgctccatgagcaggagtagtgaactcaaatcctgggtaggatgtataaggattgtggttgaatagactgggatttgaatcttggctctgccttttaccatggggctgtgaacaagtttcttagcttttccgtgcccattttcctcatctgtaaactgtcattaaaatgtcactatcgggccgggcgagttggctcatgcctataatcccagcactttggaaggccgaggcgggaggatcacaaggtcaggagttcgagaccagcctggccaatatgatgaaaccctgtctctactaaaaagataaaaaattagctgggtgtcgtggtgggcgcctatagtcccagctactcgggaggctgaggcaggagaattgcttgaacccgtgaggcagagattgcaatgagctgagtttgcgccactgcactcccagcctgggcaacagagtgagactccctctaaaaaaaaaaaaaaaaaaaaaagtcactatcaactccatgtgttctttttgagcatgtaaccagcccagaaatctaaacgctttcagcagggtgtcaggcacatgttaggctcttgacttttttctggaggggcctggtttgaccagcattgcgactgtcttcccccattgtgcctcagtctacctaaaatatgagaagcacattttaccacctatgcccttctagtggccaaggaatgtgagcccatcaagaactaggaaacatcaaaagctggctttaaggaggttaacattttctagaaatctgcaaatttttgggccaggtgcggtggctcacacctgtaatcccaacactttgggaggccgaggagggtggatcacctgaggtcaggagtgcaagatcagcctagccaacatggtgaaaccccgtctctactaaaaatacaaaaaattagctgggtgtggtggcgggtgcctgtaaacccagctacttgggaggctgaggcaggagaatagcttgaaccaggaggtggagattgcagtaagccaagatcacgccactgccctccagcctgggcaacaagagtgaaactcggccgggcatggtggctcacgcctgtaatcccaacactttcggtggccgaggcgggcagatcacctgaggtcaggagtccgagaccagcctgaccaacatggagaaaccctgtctctactaaaaatacaaaattggccggctgtggtggcgcatgcctgtaatcccagctactcgggagggtgaggcaggagaacctcttgaacccaggaggcggaggttgcagtgagccgagattgcgccattgcactccagcctgggcaacaagagtgagactccgtctcaaaaaaaaaaaaaaaaaaaaaaaagtggaactccatgtcaaaaaaaaaaaaaagaaatctgcaaatttttcaaaacttttgtttgcaatttcatctttaaaatatgtacaatgtttacactcttcttcataatatacttgctcatcacatatttcttttaacaaggtatgttgtgttttccctgtatcgtgtacacatggacttccttatgtacctattcttcatgtacatgtttgagcaacacggctttatataagctttcttatatttaaagcacagagaatcatgttaattgagatctgtgacacattagcaagtttgcaaattaacaggagttctgtacctggcccacagctgaagcttgatagaatactcgttggtttaaattcacttattaatacatttactaatataaatgatctcataagccagaataaatttctgaaaaattggaagaagggtgagtttattttttctgagagagggaaaacaaattataaacgtgtgtgtatggggcagggggtgggagggtgtgcgaatagccctaaggagagattacaaagagaaaagagggatggagactaccaccttttccatactttatattttctctcggttgatccctgtctacataaatttctttcagtctgtatttctccttgttaacaagaagtggttaaaactccaaaactggccaagtgcgatggcgtgcctgtaataccagcactttgggaggccaagatgggaggatcatgaggtcaggagtttgagactatcctggctaacaccatgaaaacccgtctctactaaaacaaaacaaaacaaaacaaaacaaaacaaaacaaaacaaaaaattagctgggcatggtggcatgcacctgtagtcccagctactcggaggctgaggcaggagaatcgcttgaacctgggaggcagaggttgcagtgagccgagccgagatcgtgccattgcactccagcctggacaacagagcgagactccatctcaaaacaaaaacaaaaacaaaaacaaaccctcaaaaatcatgcctgtcaattgttggggataaaagaaaaacaaaaaacctctaagatcatattttaagtaatttagattgctaataattgtcttcacttgccaaaaggtaaacaaattgcttttcattttctttgttttagatccagcttgaccaacaattgagcaataaaagctattcttgaaggtttttttttttttttttttttggagatgaagtctcactctgtcccccaaactagagtgcaatgaacctcagctcgctgcaacctccgcctcctgggttcaagtgattctcctgcctcagcctcctgagtagctgggattataggcacctgccaccatgcccagctaatttttgtatctttagtagagacagggttttgccatcttggccaggctggtctcgaactcctgacctcaggtgatccgtctgccttggcctcccaaagtgctgggattacaggcgtgagccattgcgcccagcctgttttgctttgtttttgcatgtccaagaaggatgaattcttcatttgtttcaagaagatcaaatctacactttgtgatgcccttgacttctagctcttgaattaaaacagagaactcagattaggaaatagtcattgactgctattttagaaagaaaatcactatccaaaatgattttttttgggcaatattatttttgaaatatcaagctgcttcatattttgataagaacaataaaatcagaaaagctatgtgaaagccaggaaaatggaaaattttcagttacaaaagaagcaggaaataattttaacttgactgaattttttctaagattatttaagtgaaaaataaatattttaattttaagacaatcaggaaataagattcatcagaaaattctctgttccaagtgagagactccaatggaccttgacttggttcaaaatcagttttactttagttgggccagtcttggtgacatgttcttctcatggcactagcagggaaattgtagaaggagagtgttacctaccaggttttcttcacacagttctctgaactggtagaatttctgggccatgagaagttgggcactgcccactgcggttcggatttttcctagaactggaaagagcaaacatacgagaaatttacacatcatgcttcattgttgagatttagtctggtaaagcaaagaggaagttatgctgtaataattagggaaaatggcacacacacacactgaacactcatgcccacccagacagcccaatcactgttgtcaccctgttggtctgtgtcacagaggctcctgggttaaagtaataaaatcaacttggaaaaacacatgctcctcctgcatatttcttgggagcaatggagttttccagcactgatgttaccaagaactggatgttaccaagagaagaggcaaacagttgttgcttttttttttttttaaacttcctttaccgcaaggatgaatttcaagtgtttaccagtatagctctggattgatggagtcagccgtcatggtcggctggcttgtttttctaaaacaagcccaaacacaaggaaagcagtactaaactagagggggaatctcttggcactcaccatatcccatccacatcctttcttatttttccggagctcagccactggtaccgtcaggaaagagctgtggctgattaaaatattttctaaggagcgaacatgttcagcctgtggcctagaaaacgccagggccgtcccagcttttacactctgcagcccaatcattttgttaatatagggtgaattccctaggcactgtgctgaaaatctccgtctctgcaagcaggctacttcttgtctccccagcagtctaaggcacctttcagctgcctgcaggcgtgctcagaccgagcggagctgctttccgctgagcaatgcccagctctgcagtgtccctggggctcgcctgcaccctttgggactgggtgcagctgccctgctacccaccagggtgttcttaacatgctctcatggtcgggaaggaatcaaaaactagagcaggagaacttctcacaagagcacttgcctctctggaaatcttcacgggatgatatagtacaggatttaagcaatcctgttgttctgaatttacggagccaggtacccgagtggaataagcctttctcaacctcattccccacacattctgagcgacggaaactgaagaataagaaactccattctggcccagggttttctagcaatttgctcctttatttgttttaaactgctaggctagataatggtttctgatgcacattctacctaggcgttactcaagtatttcagcgttcccacaagtcactcagtgcatttatatttcctctaatatgtcaccagccacaccaaacagctcacagacagatatttgccccctccctccgtgatctcgagggggtctcccttgacagctgtctagcagcaatttcttaggcctaagtttttaacaatttttctgctctgcttttaaaatctcttgggatggttatccttttcctctttaactaataaatcaattgtgcaagacctcctctccttttcttaacatccccagaaaggacagcttatggagacacagggcctgagtgggccagagtcctcaatagctactgcctggacaagtcactatctctactttcccatccgtaaaatggggctaatggtacctatctggagggttgttgggaaggttaaaagcgttagtgtatttgaattgcttaggactgtgttggatttacagtaagtacttaataattatttgttattatctaggatcagaaacctctacctcttctatgggtgtgcccactgtgagagccacacttgccctggctaggagagaaaaggaaaaaacaaagtctggatgatctaaggtgactggacatcttggtctcctgggacaggtatgctctctgggtgacctgttccagctccaagaaggtatatggagcaggcacttcctaagtgagcatgtggctgtaggtaagctctgaggtttatggaaacctctgaattatcttgctgaagggtaggactgtgagatcggcaaatctcagaatgaatcctgggaggttatgaccagggtacctaggtctccactttgatggctgggttccatagctcctgggagctatcgcagaaactccagctattctgacttacctaaaaactttgagctgatggttctcaattatgtctgatgcctgagctatataatagactgccataataaaagtaactgagtaagacagtgattctcaaaagaggagacagcactgttctaagccattattagggcaacatgcaaccacacaagttggggctaagtcagatgtcttctcaaaagtaaaacaagggatatctttcttcattcagcatggcctggcaagagccctggcaaagtatctggggtggagttgtggcccttctctttcccgggcttttgccgtcatgttccttgcatggaaattccctactggctccaggatacttgcaattcctgtgtccaggagatgaccgttcctaggcccagggtggggagatgactgcttgggcctagaatgagatcatgaaacagggaggcttgggagaagcagatgacaactcatatttccttgtcctccacactttcttttccggagaactaaaaactcactttaattttaagaaagaagctgtaatggaggttttttttgttttgttttgttttgttttattttttttccattagacactcactctgtgtgtgaggtaagttctttcttccaaaagtaaatttcacatttgttgcacatgccttgaggaagttgaaattaataaacaataaatggtaaacaccagtagaagtaaaaagtggaaataaaaagactgaaagttgataaagaaatgaaatgaagaagaaagaagcatctcgatgttgttttgaaactactctaaaatgttcaataccaaccttcacggtggaaaaaaaaaaaacagttggctctctgtttccatgggttttgcatctgtgagttaaaccaatgttgggtctcactatgtggcccaggctggtcttgaactcctgggctgaagcaatcctcttgcctcagcctcccaaagtgctgggattacaggtatgagccactgcatcctgctgaatttgttttctttttcccttttctctcactcctatgaaatgaagccctacagataaaatatatgttctccactcctatcccattccttttcatccccagaggaaaccattgcagtagagaatgactatttcagtcccatcactgaattcataaggtctcttttctggtcctggaaaggtgatcgctaagggtcattttgagtgttagactggggcaatctcaccagcacagtagcacccatagtcaacatcagcagattttctctgaaagttagaatgggggttttaaagctctatgggtgttgagttgatctctttcacattctggtcatgctttttttttttttacagattgttcaacccagatgtggttaacagtttttgccacccatctcccttagggcacattcaaatgcatcttacagaataattttctctgctgtgtcagccaggcaagccgtttaaccatgactcataccatctatttgtgtaatacttaatcagataataagccttgtattgctgggcagttctttttacataagtaaatctagcctccccagacaccgtataggcacctgatggtgaggcttatagactcctccctttcctttctttccccagctactctgttaatctgtccctcagtggaagtacaaaacaaaacagaaaatgcagttgaatgggattcttcctatttaagaagtaagcactctttataaactcccccacttataattcttcaaacctctcaccccacaacagatatttaagaagacccacaatagagagtacaggcctgggttagtgaatcacataaagtcaggaggaacttttgggaggcctttgtgaacatgtgtttacttaaattatcatcacttagtatttcaaaactcacaaacaggcatctaattagatcctcgcaggaccctgtgaggcagagcagataacttcatttgaaaaaacttgtactcaaactacaaagtttcttccccacggacatctgctgtggccaatccccgtcttctgaccccagtctatttgggctctcttctctctaacactcgcagaaaattgcgtctgaatctacttaagtggaagctatccgagtgtgatttccttcttttttttctttactgtggtaagaacacttaacatgaaatctaccctcttaacaaatatttaagtgcacaatatagttttgttaatggtggcgcagcgttgtacagcagatctcgagaacttattcaccttgcataactttagatccactggacagcaattcccctttccctttccctctccctctacatcatggcacccaccgttccactctctgtttcctgagttttgactattttaagatacatcatataagcagaatcatgcagcatttgttctccagtgactggcttattccacttagcatatagtcctccaggctcatccatgttgttgcatatggcagaatttccttctttttcaaagctgaataatatttcattgtatgtttataccacattccatttatccactgagtgtgatttctgtttatttatgtgtttatttatttatgaatgaggtctcactgtgttgtccaggctggaggacagtggctattcataggcatgaacatggggtcctatagccctgaactccttgccacagccttctgagcagctgggactgcaggcatgcaccactatgccaggctgcatgtaatttctttatcaacatttcccagccagtgccaatggataggggtgagtggcataataagtcagtgggagagttggaagaaattcgccaagcctgatcactgtcccacattaggaagcaagagcaaagcacatccatctacctgaagtgactggcaggcaaggcaatttcaatcctgaacagaaaagaggaaccagggacaccttgaaagagatggtgggtgtttcaagctctttttttcttttacagattatgtgtcataatgagaagcagagaacaactatgttggctgtgggaaaggggagtcttttatgcaatctatgatttgaaatctcctgactacattcaaagacccagccatttagaagagagcatacctcctctttcccactgacctctgtgggataggttgttattttgagaaaaggaggtagtataagaggcacaaggatgaagagaaaaaacactttcctttaaccctcccagtgggtctatggcaaagctgcaaggagtttcagtgtgctggtgatctttttgctgagttaaaatcaggattacaaatccttaagcataattagcatatgcatcctttcctatttcaagaggagttaggtctctagaactaaaaaggcagacgtgctcatttctctgactgcttcttttttttttttttgagacaagagtctcactctgtcacccaggctggagtgcagtggcacgatctcggctcactgcaacctccaactcccgagttcaagtgattctcctgcctcagcctcccgagtagctgggattacaggcatgagccactgtgccctgcctctctgactgcttctaattcttacatgatgctacacctaactccacgatcatcagaccttactttaaggcctcagaaacagagaagaatagacatatttcttataccctcaaagtaggttccctgaagcctggatacgacagacacccctgcaatggattacctctgactggctccccgtggtgaaggttactacggtagatatgctacatagaactcgtcacatttttctgccacctacactataattcacctagtatgtttcattttagtctaactttctctctgggcaatacaggcatgcctcagacatattgtgggtttagttccagaccactacaataaatgaatatcacaataaagtgagtcacatgaattttttgtttcccagtgcatataaaagttatgtttacactatactgtagtctgttaagtgtgtcatagcataatgtcacaaaaaagtacctaatactttattgctaaaaaatgctaatggtaatctgagccatcagcaagtcataatcttcttgcggagggagggtcttgcctcgatgtggatggctgctgtgatcaaggtggtagttgctaaaggtaggggtggctgtggcaatgtctctttttaaaataaatttttttttcactttgtattttttgtagagacaggatctcgctatgttgcccaggctggtctcaagcttctggcctcaagcgatccactcatcttggactcccaaactgctgacattacaggcatgagtcactgccccggctggctgtgacaattttaaaaataagacaacaatgaagtttgccacatcaattgacttttcctttcatgaaaggtttctctgttgcgtgcaatatttgtttgacagcattttacccacagtaaaacttttttcaaaattggagtcaaggggccgggcgcggtggctcacgcctgtaatcccagcactttgggaggccaaggtgggtggatcacgaggtcaggagatcgagcccatcctggctaacacggtgaaaccccgtctctgctaaaaaatagaaaaaattagccaggcgtggtggcgggcactgtagacccagctactcaggaggctgaggcaggagaatggcttgaacccaggaggcggagcttgagtgagccaagatcatgccactgcactccagcctgggcaacagagcgagattccatctcaaaaaaaaaaaaaaaaaattggagtcaaggctgggcgtggtggctcacgcctgtaatcccagcactttgggaggccaagataggaggattgcttgagcccaggagttcgagaccagcctaggcaacatggcaaaaccccatctctactaaaaatacgaaaaattagtcggcctggtggcacatccctgaagtcccagctactcaggaggctgagttgggaggatcacctgagcctgggaagttgagtctgcagtgagccgtgattgtgccaccgcactccaatctgggcaacagaggagaccctgtctcaaaaaaaaaaaaaaaaaaaaaagggagtcaaaatcctctcgaagcttaccactatattatcaactaagttgatgtaatattctaaagcctttgtggtcatttcaacagtgttcgcagcatcttcaccaagagtagattccatctcaagaaactactttcttggctcatccataagaagtaactactcctctgttcaagtttgatcatgaaattatagcaattcagtcacatttacaggcttcacttcgcattctagttctcttgcactttttaccacatctgcagtttcttcctccactgaagtcttgaacccctcagtcatccacgaaggttggaatcaacctctaaactcctgctaatgttgatattttgaccttttcccatgaatcataaatgttcttaatggcgtctagaatggtgattcctttccagaagtttttcttttttttttaatttttaaattattttttcaaatttttttgggtgcacggtgtataaatttatggggtacaggagatgttttgatacaggcatgcactgtgaagtaagcacatcatggagaatggggtatccatcccctcaagcaatcccctcaagcatttatcctttggattacaaataatcctccagaaggttttcaatggactttgcccaggtccatcagaggactcactatctatggcagatatagccttatggaatgtatttttaactaagaagacttgcaagtccaaatgactctttgatccgtaggctgtggaatggatgtcgtattcctctgttttcacgctactgataaagacatacctgagactaggtaattcataaaacagcgatgcttaatggactcacagttccacatggctggggaggcttcagtcatggtggaagatgaaaggcacgtcttacatggtggtagacaagagagaatgatgatagacaagcgaaaggggaaacgccttataaaatcatcagatctcataagacttattcactaccatgagaacagtataggggaaccacccccatgatttaatcatctcccatcaggtccctcccacaacatatgggaattatggaggctacagttcaagatgagatttggatggggacacagccaaaccaaatcagatgtcatgtttgcaggcatgaaaacaactttcatctccatgtacatctctatcagagctcttggttgactaggtgcattgtcagtgagcagcaatattttggaagaaatctttttttctgagccataggtctcaacagtaggcttaaagtgtacagtaaaccatgctgtgaatagagatactctcatctaggctctgttgttctacttatagagcacactttataagagcacacaaatttagcataatttttaagggccgtaggcttttcagaatggtaaatgagctttggcttcgacttcaagtcaccaggtgcctgagcccctaacaagagagtgagcctgtcctttgaagctatgaaagacctacatggcatctcctgccaatagaaggctgttttgtctacattgaaaatctgttgtttagtgtaatcatcttcatcaatgatcttagctagatcttctggataacttactgcagcttctccatcatcactaggaattcaccttgcattatattacagagacagtttctttctttaaactccatgaaccaacgattgctagcttcaaacttttcttcttcagcttcctcacctctctcagctttcatagaattgaagagagttggccgggcgcggtggctcatgcctgtaatcccagcactttgggaggctgaggcgggtgggttacctgaggtcaggaggtcgagacaagcctgaccaacatggtgaaaccaagtctctactaaaaatacaaaattagtcaggcacggtggcgcatgcctgtaatcccagctactcaggaggctgaggcaggagaatcacttgaacccgggaggcagaggttgcagtgagccgagatcgtgccattgcactccagcctgggcaacaagagagaaactctgtctcggaaaaaaaaaaaaaagaagagagtcacaatgtgtctctgattaagctttggcttaagggaatgttgtgcctggtttgttcttctctccagaccactcaaacttcatccatatcaacaaaaaggctgtttcgcttccttatcatttgtatgttcacttgggtagcacttttcatttccttcaagaagttttcctttgtattcacaacttggctatctggcacaaaaagcctagcttctggcttattttgacttttgacatgccttcctaactaagcttaatcatttattgcttttgattaaaagtgacagattgtaactcttcatttgaacacatagaggccattattgggttattaattggcctaatttgaatattattgtgactcaaggcataggaaggcctgaggagagggagagagatgggaatggcaggtcggtggagcagtcagaacataaacaccatttattgattaagttcacagtcttatatgggcacggttcatggagctccaaaacaattacaatagtaacatcaaggatcactgatcacaaatcaccatagcagatagaataataatgaaaacacttgaaatattgtgagaattaccaaagtctgacacaaaaacagaaaatgagcatatgcttttgaaaagatggtgctggtagacttggtcaactcagggttgccacaaaccttcaatttgtttaaaaaaaaaaaaaagcagtgtcttcaaagtgcaataaagcaatgccaataaaatgaggtacacctgtgtgtgggaaaaagtgtaggtgtggggtcaggaacaatcagctcaccaattaccagctattgatcttgggaaagttgatcagactcagactctttttcctttaatggccataatatcatctccatagcattgctgattacttaatggaataatataggtaaacgtgagaatgcagtaggaattctaactcctataactgatctacattctttagttcttgggcatttacctaaaaggtggcagtatccaaaaaaggacatgatttctcctgcaaatcttcacactccaacctccctccccagtagtgtggactaatttgatgtccttttttgctgactttaattcaggcagattttcacaagtgtcactgattggtgaataatttctttttttatgagtataagaaatccataacaatttttcaggggctcagattttagtgcctctctgtataatctagcacagtttcccccagccatcagagctagaacagtggccaactggctgctgggtgacagacacacagaggagacaggaccttaaagcacactggacattcaatcagagccttgctcggaaaacagactcactgcaaaacgaagggtcagagcccaccttaagaatggcagcttctatggcaaaacaaggtccaccttcaggtacagagatgatggcagataaaccccactagcctgtacagctatagtcccatcgtattttccagattgtgcttagccatgtgacttgatgacaccataaaccaatggtccccaaacttggctgatccttcactgctgcccgttagtcctttgcaatgtatttggttacctccctctctaactctaatttcctgaatcttatccattctcaactcaacccctattccctcatcttcaacaaccttgcctcctatgagatgaaaatggagggaatcaggcatgaacactgctgtgatttggatgatagtgtctcctccaaaatatatgttgaaactgaatccccaaggcaataacaataagcggtggggcattaggaggtgattaagtcatgagagctcggctgtcctgaatgaggttagtgcctttattaaaggactcaaggttgaagggaccgcctcttgcccttctgaccctactgccatgcaaggacacagggtttgtcccctctggaggatgcagcaacaggcctcatcttggaagcagagagcagccctcaccagacacacaacctgctggcaccttgatcttggatttctccgcaactagagtaatgagaagtaaatttgtattatttaaaaattacccagtcttgagcattaggacaaatacctaaagcatgtggggcttaaaacctagatgacaggttgataggtgtggcaaaccaccctggcacatgttcacctatgtaacaaacctgcacgttcagcacatgtatcccagaacttaaagtaaaatttaaaaaaaaattacccagtctttggtattttgttggagcaacacaaacaaacaaagacaaatagtcttaatgttctgtgtctcttaatactcttcccccaccaattccctaaacctttctgcccccaccctagtgtcttctctacacccactattcccatctacgtgtgtccttggtctgattctctccctgctaccctgaggccttgctgtgtgagccactccctctctccgaactccttctgccagtgccttacctgagatgtctggcagcatcctcaagtctttcccattctaagtggggcaactcctcccaacctcatggtcccctccagctaacataaaattcctcttctccccctgttattcgctgaattgcattttcctaaaatttacatgtagaattcctaacctccagtacctcagaatgtgactctggagataacgttcttaaagaggtgattaaattacaatgaggtcattctcatgggccctaatccactacgactgatgtccttataagaactggagatgagaacacagacacacacacagaggggagaatcagggaaagggtggtggactgcaagccaaggagagcgacctgaggggaaaccagccccttgatctcgaacttccagcctccaaaactgtgagaaaattaatttctcctgtttaagtgacctgttccatgggtactttattatggcagccttagcaaattattacattccctttaaatccccattctccaaagggcagcatgccttcgctctcgtatttcttctgctctccattgtctccactccctgcagcccagctgcctccaccctcttcaccttctggactctgcctttggcacagaggaaactcagatcccctgggtctcccaacaacgctctctggctgactctgcccttccccgattctgccttccctgtgcttggtagaatttctctcactccaccttgtaaatgttgaacacaaaatgtaatcctgagctcacttctccactcacttccctcattccactttctcgaatttgtgactccactgtgtactgaccccagacgctttagaggagcatgtgtaaccactagctcaacacctcctgtctccccaaatctgtgttcccctcaggattcccttgttgattacaattaggggtacaaggcttgatcaatccatccatagtgtaaatgttatccatcccttgccaatcttggagattgggtttcattaagggaactatagggttttcttatctcatgtaattctcatgctgacaacttttccttggttcccctgctccatatgataagccccagcccccttcagcagggcaggtgcaggccaagctgtccagtttctctctgctgactccttcggtgctccaagcgcccacggcttcccaaatcccccaaggtctttctctcctgagtgtcttcttcacaccaagcactaagctgagactgtctcttccctttggtgccctaggcaagcccctctccctgtatctagcaaagtcctcatccttatgattcagcttgggtgcaccttgccagaaagccttacctcctttcacctctccctcctcactgctcctaaaattcccctgcatagctgtctctgccttttcctcattcttttcaacatgttctgttaatatgtcagatttccgaccagaatgtgagctctttgatggcctagactgtgcccatgtaactaactcctattatctccactgaaggaatatgctttgaaattaactgagttatttacagattctatatcaaccagaaaaacaaactacctgtgatattctgatccttgagcattctaattctttagggttttatcatgtctagcaccactttttaattatagtgttgactaattagctgatatagtcttagctggggtattattcctcttgcattgctgtttgtcatgcaatagttgtagtgactagcctggaaaagtcacaccatctaggataagttgagttgtgtttgtggatgatgaattatatttccttatattcaagttttgcctttttttttttacccacttgcctttttctttcttgctttttttttttttttttttagacagagtttcacgcttgttgcccaggctggagtgcaatagtaccatgtcggctcactgcaacctccgcctcccggattcaagtgattctcctgcctcagcctcccgagtagctgggattacatgcgcgtgccaccacgcccagctaatttttgtatttttagtagagacggggtttcaccatcttggtcaggctggtctcaaagtcctgacctcaagtgatctgcccacctcagcctctcaaagtgctgggattacaggtgtgagccgctgtactcggcctcccacctagctttttcccccaatgttgtagactttaggggtgaagaaagagaaagggaattttaaaagtgggtctatccacttactttaaagacacgtgcagtcaactcttttttttttttttttttggagacctcattctgtcgcccaggctgcagtgaagtggcccaatctcggctaactgcaacctccgccttccgggttcaggcaattctcccacctcagcttcccaagtagctgggactataggggcccaccaccactcctggctattttttgtatttttagtagagacggggtttcaccatgttggccaggttggtctcaaacccatgacctcagatgatctgcccacctcggccttccaaagagctgggattataggtgtaaaccactgcacccagctgcagtcaactaatttttgacaagggcaccaagaggatacaatgggaaaaggatagcctaagtgtaggaccagaaaccacacaactcccagaagaaaacggaagggaaaggttcctcaacattagccttggcaataatgttttggatatcacaacaaaagatcaggctacaaaagcaaaaataaataaatgagactgtgtaaaatgaaaaagctcctgttatcaaaggaaacactcagcaaaataaaaaggccaggcacagtggctcacgcctgtaatcccagcactttgggacgctgaggtaggtggatcacttgaggtcagcagttcaagaccagcctggccaacatggtgaaactccgtctctactaaaaaatacaaaaaaatttagccgggcatggtggtgcatgcctgtaatcccagctactcaggaggctgaggcaggagaatcacttgaacctgggaggcagagtttgcagtgagccaagatcacactaccgcactccagcctgggcaacagagcaaggctccatctcaaagaaaaaaaaaaattaaaaaaaataaaaataaaaaggcatcctacaacccgggaaaaaatatttgcaaaccacataaccaataaggtttgcagactataaatccaaaattaatgaagaactcttacaactcaatagcaagaaagcaactaaccccaaaaaactcaatttaaaaatgggcaaaggtccgaccaggtgcggtggctcacgcctgtaatcccagcactttgggaggccaaggagggcggatcacgaggtcaggagatcgagaccatcctggctaacacggtgaaaccccgtctctactaaaaatacaaaaaattagccaggcgtggtggcgtgcgcccgtagtcccagctacactgggaggctgaggcaggagaatggtgtgaactcagaaggcggagcttgcagtgagctgagatagcgccactgcactccagcctgggcgacagagcaagactctgtctcaaaaaaaaaaaaaaggagggcaaaggtccttgacacagggtttgaacaagacaaaacaaaaacaaacaaacaaaaccagaagaaacaaaaatgggcaaaagatctgaacagacatttctctaaaggaaacataacaacaggccaggtgcatttgctcttctctgtaatcccagcatttttggaggccaaggcaggaagaatgtttgagcccaggtgttcaagaccagcccaggcaacatagtgagatcttgtatccacaaataagaatttttaaaaaattagttgggtctgatggcacacatctgtggtcccagctactcaggagactgaggtgggagaactgattgagcctgggcagttaagtctgcagtaagctatcatcacaccactgcactccagccttggtgacaaagtgagaccttgtttcaattaaaaaaaaaagaaagaaagaaattgtggtatatatataccacatatatatagtgaatattattcagccctaaaaaagaaggagctcctgccatttgccacaacatagatggactggaggaccttatgctaagtaaaattatcttgtattagggcgtcttgtggaataagtagactttagctgctctttcacaaaaaaagtaactatgtgagatgacagatatgttaatttgcttcataatagtcaccaacttactttctatctgtattcaatagcatataaacctcaaatatacacaaaatttatttcaaaaatatcgagtcaggtaggcacagtggctcttgcctataatcccagcactttgagtggctgaggcaggcagatcgcttgaacctaggagttcaagaccagactgggtaacattgtgagaccctgtctcaataaataaataaatgaaagtcatgtggatttgtcattctgagtctgtgtgatttcatggcattgggattatccatgtggagacattctcatttacgagtgtgtccttgcggcaaaaatttccccaacctactgcccagcagctgcttctcagacacacttgtgatccggagctgccatcaacaaaacgtctccatagaaaacgtggatctgtttcattcctgactggcagttgctgatctgcattgcacaacagtgctttttttgttttgttttgtttttagctgaaacttggtggctaatgaataaagaatggattctctagtagaagttttcccatagactaacaccagagtttccacagtgttctgggggaaaaaaaaaaaaatcaacaacattattttgtttttaaagagcaagtttttcaaaaactcagctaattttaatttttttttcccagttccaacccctccaggagccttactcgtagaagatggtcattctttggatcaatatcttgacttatatcagccacgaaatggtagcatcatatacatcatatagataaagacagttttgagcctttgaaagttggatgaaatgaaattagtttctatttccctaggtaatctaaatgaaaaaaactgtatattttatttgaagtccattgcatttattgcatttattttttaatttattttcgacatggagttttgctctgtcacccaggctggagtgcagtggcgtgatctcggctcactgcaacctccacctcctgggttcaagcagttctccttcctcagcctcccgagtagctgggattacatgcatgcaccaccaagcccagctaatttttgtatttttagtagagacggagtttcaaccatgttggccaggctggtctccaactcctgacctcgtgatctgcctgcctcggcctcccaaagtgctgggattataggcatgagccactgcgccccaccagtccattgcatttatatttcacagaaacagttattggagaaaatgataggaggtcttgctccgtgagccagtccctctctttgccatctctggaatgacagaaacaccactggcctaggaacagatctgtttccaggcccagttctgcccccaattaaccacatcacttcacctcttcatgctttcgtgccctcctgagctgggagacaccaccctcaagaagcacatccacaaaaggatggtgtctaatggccttctggcaccagcgctgtgcaaagcggcatgaatggagcattctcaaggttaaacatatggcacattacagccgatttccttttcattactgccacttcctctgcggtcactaatttcaggttgtctggagcttacaaaaagagacatgcaagtatgtgtgtctgtgtgtgtggtggagtgggagggaccttttgagggttcattgcaagagttagatgagaataaaacagaaaggagctaggctagaatgcagccattgctccccacttagaaacacacacgggctggaggcagatgaattgcagaactcacagatacagctttgtctgccacccactgtttcacaggccgcagagacacagcagaggcaatcccaggcggataaaccctgggtgatggcaccgatagaccatcacaatgactgtgcacagtttccgtaaccaaacctgaaaccaggcaaaccccatttcaggtgtcattaccagccccgcattcgctgccaagggtcccaagccttctaggggactgaaggccaagtttcactagcttggatgctattaccaggcaaaattaaagtggaagaattaatctgcctccggcacatgctctaggtttatcagtttgtttcagataaagcctgaaaattccacgtatttgttgtctacaattcagaaggcaaagacagatttagaagtacaatcaccggtatttcatcttagggccattgaaacctgagcctatgttctttccccacagtggtagactgcattcctagttggaggcattcagctccatctggtcgtttcatccccggttagataataccagacgtatctatgtaacatacaagccactgtcaaatagcactgagccatctccctgagacagctgtttcacacaagggcttcattgtctgagaagagctcgtatcattttacttcaagtgctgcgggaacaagcattctgtcagctgtcttggcttggaggaaacctcactcactgcagtttcattattttattatcaagccaaaaaaaaaaaggtactgtcgacggttggggttgaaggtttaaaacaagaactaaagtctttgctctgctttgcatttatcagggaaaacagtaactccaggcacccaaagaatgtatagttacactgttcaaaagatagcttgaggctcctggctactccaaatgcttgttttcggtctgccttttgttacccacatttagtcagtttcaggtgaactaggaaggtgttttccagccctgtgaggccaaaagcagctgtcacaattagcataatgacatcacaaaataattaataactaaataactatttaaaattagatagactctttcttcttcaactctctaatagagaaagatgattacaactaccccacatgcaatatctgaacctcaaatttccagtgagtaaacaggttattttccaaacttttttttttttttttttttttgccatggatgcactgtattttgaattcagggagtcaattaacaaaatacattcttacatgaatatgaacatgaacatggttgttctgcttatctttagctgctgctgcctatttctgagtttttgtttttttagttttttttgttttgttttgtgtttgttgttttttgtttgtttgagacagagtctccctctgtctcccaggctggagtgcagtggcacgatcacggctcactgtagcctcgacctcctgggctcaagcaatgctctcacctcagcctcatgagtagctgggaccacaggtgcatgccaccaagcctgcctaattaaaaaaatatatatttttgtagagatagggtctctgttgcccaggccaatcttggactcctgggctcaagcgatcctcatggcatggcctcccaaagttctgggattacaggcaggagccaccacgcccagtgggggtattttaaaattgtgataaaatagacataagatttgccattttaaccacagtgaagtgtaccattcggaggcattatgtacattcaccaaacattttaaaatatttaaaaattgggataattctggtaccccacaaaataaattgcgtgattagaatcttccgttttttccctctatcctatttatcttttcatgatgacttcaagaccagatctcctggggggattttgttatggcaccacgtttgtcaggcaccctgaagagaggccctccttctgcaggtctgaaacatcccttggcttggccaagggatagaggtatctgtacttgacccatttatcgaagctatttttctggtgtgcacagaattaaaacaaacaaaagctggttgcttagaatttggctatgcctgccaagtgggattggcctctcttccttaccgcccctcttacaaaaaaagaaaaggttaagtcagagaattggtgaaacaaaggccctctgcaactctaggcccagttatcagaacagagtggtgcttgccaaggagtcagggacagatctgcatggcgggctttaaggaggacagtgccaggcaacgcaaagtatcattatcttgtcaaatgttattcatgtgtatctgttctatcagacacttctgttttctgtgaccttggacaagatactgccagagaactgttgtgagggcaaataaaacagcacctgtcaaagtctctaggccatcgtcaggggtattgtgagggcaagatgaatattctttcatgcactgatattttcccttcttcctggagagggttgctactgctttatggtccaattctccctgatctggattggccgcatttgaaattggtgactctgtcctgggcgcagggtttgccacggcactgactagaattttggaatcccagtagtttgaagctcctatttcgtgtctctcaaagtatgaaaaaatagagaaagccttcaagtgtttgtggaatggaactgtgtcttaagaatgagacaggacacacaaggttcatctggactagccacctgtcccacacggaagtgctttccatcacttctgtggcaggtgcccatctctctcttccacatccttgtcctgatcagaagagctcatcatctgtcacgggaacacctttccagcttttggcaacaagaactgttagttacttgctatggtctgaatgtctgtgctcctctaaaactcatatgttgaaacctaattaccaatgtataaatagtaagacagggggcctataggaggtgagttggtcacaggggcagagtcctcatgaatagggttactacgcttatcaaggaggcccaggaagcttgtctgctgcctccatcgtgaggctgcagcaagaaggcgccatctttgaaacagagagcagcccttgccagacaccaaacctgccagtatcttaatcttgaacttcccagcctccagaactgtgagcaataaatttctattgtttataaattacccagtctagggtattttgttatagcagcctgaaaggactgaggtattacttattgaagtttttttttagctaattaggaagaaaggttttgctaagtaaaatacttttataaaacagaatttccagaatatttcaaggactcaaatacatatttactgatcccctgttatgcgtcagagggtctggtgatatgaagatgagtaagacaagaataatttctgttttcagaaagcttactttttagtggaagagaaagatacatcggttattataaaataatgtgggaagtacctgaaggacaaatacacagggcattacaggagcaccagggcgatacccagttcagcttgaacaacaaattaggcctggaacaacagatggttgggcagttccctcatgttcattatcttgggactttgccagcagtgtacatttcaaaatacaaatacgtttctctttcatcctgaacataggctgagaagctggttttctgacaagattttcaacctttcaaatatatgttattgtattacaatacaactgacttgttttcctagctcctttagtttttcctaaatctttatacaatgagtatcctcacacatcattatagagttgggttgagagaggtagatcaagtctcagactgaaaggcccattaaaagaaaacaacagataagtagtttccaagagtcctgttgaaagccagccaggagctgggtgggtggctcatgcctgtaattctggcattttgggaggcagaagtggggggattgcttgaggccaggagtttgagatcagcctgggcaacacagtgagaatctatctctataaaattttttaaaaattagccaggcatggtggtgcacacctgtagtgacagctcctcatgaggctgaggtgggaggatcacttgggcccaggacgtccaggctacagtgagctatgatcccatcactgcactccagcctgggtcacagggcaagactctgccaaaagaaagaaaagaaaaccaaagaaaggagggaagaaaaagaaagaaagagagagagagaacaccaatcaggaagctagaaggagaaccaaatttgagaattgaaatctgaaagtttgtgccattgagcagtggcacgggatgtcattgttccttagttgctggcatttttcctaggaaaatctgataaactgtgagtatgtccacaaggagaaaagtgaataagatgatccaactaagactttcttactgaaaactacccctgctcccactgctgctgagacataccttgtttacctgtcaccagggcaaagacctaattgtgcttgggggtcaacactcaggtgagtctgcagtggcactaacaggggcaaatgtcaaggagatttacttttccactgccaagttgtttgcactcataatatgaagaagcaaaggaaacccatttatgggttttacagaaacccgttaatgaatttcctaacttgcccataaaggcaagcgataagctagtcagtcatttgacaggggtcaggcaggaggagcagactggagctgtgagtgagagagtggacacagtgaagatatccccagtctgatgacaactgttattttccagactccatttcattaaaaaaatgattcccctagggaaaaactcactactctttgacaccactagtttggtgcatttagtaaatgcacttaacatgatttatagtagatgttaaatctaattaagaaattattggccgggcgctgtggctcacccctgtaatctcagcactttgggaggccgagacgggtggatcacctgaggtcaggagttcaagaccagactggccaacatggtgaaaccccgtctctactaaaaatacaaaaattagcttggcatggtggcaggtgcctgtaatcccagctactcaggaggctgaggcaggagaatcacttgaacccaggagacagaggttgcagtgagccaaaatcaggccattgcactccagcctgggtgacaagagcaagactctgtcttttaaaaaaaaaattattgtttttgttacgtacgataatgcatgataatattttacctttttttgagtcggagtctcactctgtcacccaggctggagtgcagtagctgcgatctctgttcaccgcaaactcaatctcacgggttcaagccattctctgcctcagcctcccgagtagctgggatcacaggggccaatctccacacccgactaatttttgtatttttacgagagatggggttttaccatgttggccaggctggtctagaactcctgacctcaagtgatctacccgcctcagcctcccaaagtgctaggattataggcatgagccaccgcacaaggcctatgattatacatataaaaaatgttttctataagtgtgagctacatagggaagtgacacgatgccttggattttctttttttctttttttggagacagagtttcactctgttgcctaggctagagtgcagtggcacagtctcagcttgccgcaacctctgcctctgggtttaagcaattctcctgcctcagcctcctaagtagctgggattacaggcgtgtgccattgcacctggctaatttttgtatttttaatagaaatggtgtttcaccatattggctatgctggtcttgaactcctgacctcaagcgatcctcctgccttggcctcccaaagtgctgggattacaggtatgagccaccacacctggtgctggattttcttaaaaatactctgacaacaataactacaaatggtggagacaagactggccagttgttgaagcaggtgacgagtacatggggactcatcatgttaaactctacttttgtgcatgtttaaaaatgttcataataggccgggcacagtggcttatgcctgtaatcccagcactttgggaggccgaggcgggtggatcacctgagctcaggagttcaagaccagcctgaccaacatggtgaaaccccgtctctactaaaaataccaaagtagctgggtgtggtggcacatgcctgtaatcccagctacctggaggctgaggcaggagaatcacttgaaccctggaggcagacgttgcggtgagccaagatggcaccattgcactccagcctgggcaacaagaccaaaactccatctcaaaaaaaaaaaagaaaaaaaaagaaaaagctcataataaaaattgaaaaagtaatttaaaaaacaagtctaaaaagttacttcatagcaatactcttttagatgctttgcacacagacatgaagcaggcattaatgcctaccaccaaatttccttgtttcaaaaatatcatcagttggaggatccaccattaatttaataataatgtttcagaggaaaataaacatacaacattaaaatacatactgattatatataagctacattctaatttcagaattgttgaaaacatgtaaaacatgcctcagaattgaggtaatttgattatttttctttttcaactgttaatataatttgacaatttttctttttcaattgttaatttttctttttcaaatgttaaaaggtcaagtttgaaaataatagtgtgcaggctaggcacggtggctcatgcctgtaatcccagcgctttgggaggccgaggtgggcggattgcctgagttcagtagtttgagaccagcctgggcaacatggcgaaaccccgtctctaccaaaaatacaaaaatcagctgcacatggggtgcatgcctgtagtcccaactacttgggaggtcaaggctggggtgagccatgattgcgccactccaacttgggtgaggagtgaggccctgtctgaaaaaagaaagaaaagaatagtgtgcgaaaaagagtgtccattatttattttatgtattcatcgtgtatttcactttagcccattcaactgtaataagattataaaatgtgtttctttggcagctaaagggtttgcccctgtaaatcctaagagaaagtgcctgtcaaacaggcttaagaatacaaataggtgggggtttctagcggcctatacgttataagccttgttttaatgctgtatgttaatgagaataacaaaatcataaagaatataaatccccaatgtacctgtatctatggaccttgaaaaaagttagtattatttatatatttatttttagagatgggttcttgctctgtcacccaggctggagtgcagtggtgtgatcatagctcactgcagcctctaacccctggactcaagtgatccttccacctcagtctctcgaagagctgggactacaggtgggcaccactgcactgggctagttagaattattttctttttttatttaaaaagaatttttgtgggtatatagtagatgtatatattcataggatacatgagatgttttgattagaattattttcaatcccctgaggatcagcaacattccaggatcatcttggagaagagggaccaagttagagacatgaaagcacctccacacagagcttggtattttcagaaagaaaaagaacgtcatgggcctagagctaaggacagtgttatatctacccaggagttttcttggttttgtgctgtgcagggacttctggactcagctggaatcacctagctctcctgcatgttctggtttggggtgtggaacgtcaaggttatacaagtgaagctggcagagaagaaaacaacaaggtctgcacacacaaagcaaccccagccccaggggacgggtgtggcacgtggtggcattacttactgtcttcgggcaggttgttttcccgttcttcccgctccatctgttgacaccacccctccatgcggtctcgctctgcctggagaagcttcaggaaccagtggccatcccggtggcacactgacctttgcacggcctccagagggtcttcagtgatagagtcaatccaggggtccggaggaggcagaatagaggggtcaaaatccgtgtcaaagtcatcatcggcggcacaggcatggtaatggtttcctgagccctgaatgctgactgtggaggtgctggcatcgcgggagaactgtctggccatggggccaggacacgaattgtcctctatagattccagagaattttccagattatcatggaagtccaggtcggcctgtactgctgtcgtcacactgttggatcgagtgaacctgcggaagcttgggagaatagaaaaaagaaatttagttagaggatatttctttctttccttccttccttccttccttcctttctttcttttttttttttttttgacagagtctcactctgtctcccaggctggagtgcaagtggcgtgatctcggctcacagcaacctccacctcccaggttcaagcgattctcccacctcagcctcccgagtagctgagattacaggtgtatgccaccacatctggttaatttttgtatttttagtagagaaggggtttcactgtgttgaacaggtgggtctcgaactactggcctcaagtgatctgcctgcctctgcctcccaaagtgctgggattacaggtgtgagccaccgtgcctggcaaggatatttcttgaagcaaaactactttctactttacttggcaggtgtgaccattagaagtctcatcttctcaatcttctctgtgtgtgtgtgtgtgtgtgtgtgtgtgtgtgtgtgtgtgttgggggtggtggtggcaggggtagacccttgaggcaagcatattgattgtcatagcttcaatgtgaagagcacgaatctcatttttgctcaatatggaatattaaagcatatcaagagaaattttataggtggaaaagtgctgaactattaaagccagtagaatgtgcagctctgtcatccattacctgaagtgtccaacttcctccccaaatctggggtgacttaagtcctgaaattcaggttggtgatgagtaaggaaactattcactactatcttagtcggggtaatttgcttagaaatagggaaaaagggccgggcgtggtggctcacgcccgtaatcccagcactttgggaggctgaggcgggcggatcacaaggtcaggggatcgagaccctcctggctaacacggtgaaaccccgtatctaccaaaaaatataaaacattagtcgggcgtggtggtgggcacctgtggtcccagctacttgggaggctgaggcaggagaatggcatgaacccgggaggcggagcttgcagtgagctgagatcgcaccactgcactctagcctgggtgacagagtgagattctgtctcaaaaaaaaaaaagaagaaaagaaaaaaagaaatgggaagaaaggccgtgcgcagtggctcacgcttgtaatcccagcactttgggaggccgaggcgggcagatcatctgaggtcgggagttcgagaccagcctgaccaacatggaataatcccgtctctactaaaaatacaaaaaaaattagctgggcgtggtggcacatgcctgtaatcccagctactcaggaggctgaggcaggagaatcgcttgaatccaggaaacggaggttgtggtgaactgagatcatgccattgcactccagcctgggcaactctgtctcaaaaaaagaaagaaaagaaaagaaatgggaaaaacataacctaacctggaccaaaactatcatgaatcctgcaaagccacatttttccaggggcaactcttaccaagttaagacttcctgaaagcaaactgaagtaagtttctttctttctttccttccttccttccttctttctttctttcctttcttactttctttcttttttttttttttttctgagacagagtcttgctctgttgcccaggctggagtgcagtggcacaacctcaactcactgcaacctgtgactccctggttcaagcaattctcctgcctcagcctcccgaatagctgggagtacaggcatgcaccaccatgcccatctaatttttgtatttttagtagagtcggggttttgccaagttggccaggctggtctcgaactcctgacctcaggtgatctgcctgcctctgcctcccaaagtgctgggattacaaggtgtgagccaacacacccagcccaaactgaggtttcaataattacctcttaaaattaaaactcatttgcctggtaaaggtttacctttctcttagtcatacaggtacaaagccttgggcgcaaacatcagcttatagttctctattagggttctgtatttctgccctctcctgtgcctttaattttcttttcacagttctagcgaggtgatgaaagacaccttgttcacagattaaggctgagcattttacatggatgtccatgagatcagtgtttctcaaccaaagcgccctatatatctctggctgaaccctgcgatgaaggggagaacatggggaaggtgggaggggagagacacgaggagagaagcaaggaactctttctcagatgaggggcaaggaaggcgtgggcctgatgtcatttaagacatacaaaaagagctttgctgcctctggagaagacaggaaacaatgacggaatataagtccactgaagatagcaccatgtgtctgttacgatgccctgtatgtcttttttttttaaagtcgcttcctggcctaatagtttacttattttttattatgataaaatatacataacatacaatttaccagctgaaccattattaaatgtacagttcaatggcattcaatacttaatatattcacattgcatgtgcaaccatcgccaccatccatgtcaactttctcatcttttccaactgaaactgtgcacccatgaaatgctaactctccatttcctcctccccctggccccaggcagccatcattccactttctgtgtctatgagtctgactactctaggtacctcttattggtggaatcatgtagtatttatttgtctttttgtgactggctttttaaattcaacagaacatcttcaaagtttcatccatgttgtaacatatgtcagaatttccttcctttttaaggctgaatagtattcccattgtatgtatttaccatattttgcttacccgttcttccactgatggccacttaagttgctttcaccttttggctattgtgaataatgctgctatgaacatgggtatacagataactctttgagtcactgatttcaattattttgaatatatatcccgaggtagaactactgagtcacatggtaattctgtttttaattttttgaggaacaaccctaatattttccatagtggctacaccattttgcattcccatcaacagtgcaccaggattcctatttctccacattctcatcaacatttgttattttctgttttttgacagaatgtgtgttctgtgatttctgtgtttttgaatgtgtgaggtggtacatttctttgagtagctcatgattgtgccattttaagatagtttgttggccagttgattttcaactgtttcatattcagtagtgccagccttaaacaatagtgcactaaacaatatttatacaacactaaatacaccagattatgtgggattttaaaaaactatcctggactatgctcttgaagccaataaaaactaatattctagtccatcaaaaataaagaatgaccagaacaatacagacaagtagttatttgcaagactgtagaaagactaagagtcacaaaaaggaagagtcatctcaataaatcaattttttctctagagaataaaagtcaagaaaaaaagtggctaaggtattgatctgtgtcagttattaagatggccaaaatgaccaaatacgttgtgattctggccatccattttacgaagataaactagccaaagttgacccatttgctgttttcaaaaaatcaattctgatgaagttatccaacccagtcacttttgtaagctcttaactctcaaatgagccaaaaaaaaaaaagaaagaaaaagaaaaaaaaaatcacatagtgtgaaaatctgaatgcaatgttacaagtctcttgtgctagcaatgaaagaaagaacaattttgcgaaagtggttcttccaacaaccactcatttcttggctgcagtaggctatttctgcattcttcccgttcatccccaaaatgttaactgtcatctgaagctaagctttctctccagctgcatatgtgtgaattggatgactctccttgcaaacagttgacattttggctgttctgctaacatgaaatcccaactatgaaaacattagcctccacgctccaagatcctgtattgccagaggcattacatttccaaacttaaagaagtactagtccctcattgttttcaatcagagcaaactgccacagccagaatctgttccacatataaaacagaatgacctactttcctgtgcctctgtttttatctacacagaactgtactacccgcattcctaacagccatctcctggctatggatcttgcaaaggatccaccttcttagaaaaattacttggcagtagattaatagaagtttgcagtttgcagtgtagtcactcagaaagaaaagttaagtaaaattaaaatggtttgggattaaaagcggcgcctttgaactcaggcagccctgtccaacctgctagtttctatcaattaagttccttaagcaagtgctttcttctactcagagctttcaaagaatgttctgctctacaaaatgatttatgtctttcataagcaaagttccttttgggtgaagagtgcagtcaagttgttattgtttttctgcaattttgataggaacacaaaatgaggtccctagattaatttctttattttttgaaagaattgatcagttcctcgttgatgatatcaacccaaaagctgaacccagtggcttgctgtttcccaacccacagttttcaatcttgaagcttccttggctcttcatgcccctgcaggcacagtgtgtaataattacaacttctgaaaaatgctggccaatattctggcccaagaagcagaaaaccatgaaagcaaagactggatcaaccagtatggaacacaatactctgtctgttctgaatagccagaagaaagtcacttgttagcattcacttctgctgttgctttatgttccttctatgaaacaagtttatatttctaactagaggagtttctaccctctcccacttcctacaacttttctgtacagcaagttacaaatcaaaacatatatgggtaaactgaagaggttccattcttgtccccctgtctgatagagttgcagttaaacaaaagaaattgtgcacaaaaactaagcacagtcattatctttatgacatccatgctttggaactacaagacactcaactgatgagactcaagtcatgaacttatttttaggagagtagcttagtctttccatcatagaatcccctggcctctgcttagcgtctttatccctctcattcacataatggctgcttttcaaggctaagtccagtttcaaagagagcaatgctagcactctgctattctttctttctttgtacatgcctttagacattttaaactaagccttctgtcaaggctgaatatatgtgggatctgaaatgctactcctagaaagtgcaaccatcttggtattttatgaaatggcaccctttcactgatgtaaaaaccaagatgtctcattacataaaataaaagacagatcaaaataaggcacgggcgtgaggagaccgagatcaagaattcaagcttggctgggtgcagtggctcacgtctgtagtcccagcacttcgggaagccaaggcgggcagatcacttgaggccaggagttcgagaccagcctgggcaacatggcaaaatcccgtctccactaaaaatacaaaaattagcctgacatggtggtacgtggctatagtcccagctactcgggaggctaaggcacgagaatggcttgaagaacccgggaggcagaggctgcagtaagccgagattgcaccactgcactccagtttgggcaacagagtgaggccctgtgtcaaaaaaaaaaaaaaaaaaaaaaaaaaaaattcaagctcccccaaaagaggtttacttaggtttactaatttggatcagcttccaaattagaatcatgcatgggagggcgcaggcataagcatcccttgtgcaaaaattcaggtgggaggaaccctcctaccctccatttatatacggttagcactgtcctatcaccagattttaaaactatctcaagacaaacatccatctgttatttcaaatcctctatgttcatcattcctttgcttaaatacatcatgcttgaagatgtctttaaagtaaaggaaaataggataggctttctataaaaaaattttctctaccccaaataattgtgatgtttttctcaaataaaataaagggaggaaatagaaaataatgagagtggacgtgttgtcatctggtaacttctgagagggcccagcatgctgccagcctctttttagcaccagctgggcaggtgctaatacctttgatgggctgtcactataggaaccctggttaggagtctcaacaaaacatccttgaactgaatgtgcccccagaaggaactgctttacctccgcaactggaaggttaggtcactccttggctactgacccgaggtaactaacaaagcatgagcagtctcactaacaattatgttttactgagtcttgtcaaatggaggctgtaggcttgtaagtccgatggttttctttctgcacactaagttattttgaaaaatacataaaaaggaagaaagagagagagaaagagaaggagggagggatggcagaaagaaagaagaagggaaagaaaaggaaaagaaaagaaaaaaggaagctgtgaggcttatcaggagttatgccaagtttcaggcttttgaaatttgaaacgcctgaatgccacgcctttaaaactcaggtgtacagtaaggaactatttggctaggtcatgatattgttaacttggcaaagaaaagagattacttttcaagtgcaatttcaagggtgggtactgggctgtgaggtactccaaggaaactttgaagagtggggactgatccaaagctcctgggttgacaaagaagcaatgttttttgattgccaaaggtctttccaagtctgtggtccctgaactggctgtcagatgttgcctcaattttggctttatgttttaatatcctgcttagttgaaaaggcacaaatcactacaagccctaaagtttacatatttaagtcccttgcgatcaaaagagatcttttatagtagctgacattgtgctataagagaaaacaatgctacctttccacttgcttgttccacccagttacgaaggctgtgagctttgatgtgtgaagcaaggaagattttaaaaactcagaattgggtcacttctggaaatgcaaatggaaacagaggcaatattggtggaaaaaaaaaaaggggtaacagtcctattcactgaggcatttgtttctagagacgaggagtggctctcataatatgtcaccggggctttccttcaacacctctgactcagtctgtgcattcacagatctactggaatggtaggtgccattcacaggcatatttaatgccagcattttttctctttcacattaagtatgtcctggaggtctaaatgttatgtgtaatgtataaaaggtatactaggagagaaggaggttgctccaccaacagaagatcagaaagagcagaaacttttatgcaaatcatcaaaatacgcatctgctcccatttccaccccactgatgtaaatgaaaagatcctggctttccctttaggtatacacacctctgaacacacaaagcttgctctagacattcactattagtcaatttcacctgtttattaaaaattgataaggctggagagttgatgaggcagaaaaagaggccacagagtagtttgccatccctttttctaggaaaagtgttctcttctgattttctggatgctgaaggaaaagagttctcgcagcaacactgaattccacttggatgatctctaaagatttcagacagtggataaatcatttgtaaaggcacagatgaaaatattaagtatacatacaccagaaaaataacatcctggaattcgctttccagaacattgttatgagaccagtagcttctttgcatacccccaagaatgacagttgtcacttgtcagtttgacactgtcagtaaggaactaaggagtatacaattgcaaagtttctgcctccccttaacactttcagttgtgaagatgggcgatgattgctttataaattattacaaattacatcagaaatatctcactttaggaaacgtagccgagttggaatggaggcaggaagccagaacctgtaccacacacttattcacacttatctcttgtttctgaagtggagattatgacagcaatatagctacctgggaactatagtaataagcagaaaggcaaaatccaggacataggtcctaaacttcaactaggagtctctatctatatgtaacacaaccctaaagttgaggaaacactgatggtgttgaatcagagaacttacaccaaaaaatgttattgttgttaatagtagtcaactcccaaattttagagacagagaggtaaagcgactttcaatctggatctctaaactagaatactcttttgttcccatgactccaattttttttttttttttttttttgagacggagtctcgctttgtcacccaggctggagtggagtggtgtgatctcggctcactgcaagctccgcctcccgcgttcacgccattctcctgcctcagcctcccccttagatgggactacaggcgcccaccaccacgcctggctatttttttgtatttttagacggggtttcaccctgttagccaggatggtctcgatctcctgacctcgtgatccacccacctcggcctcccaaagtgctgggattacaggtgtgagccacctcatccggccccatgactccaatatttttccaatacattccaagaccttcaaagccagagagtagtgctaaataacagggcttgccttacttacatataggccagataaaacctatatggacgacttctgtgcatggcaatgatggagtaagaatgactgaacttactatattatctgaaacaactaaaaacctggcaaaatatatgaaacaactgtttccaagacatttgatatcagacaatgaagaacagtgatcactgagatatgggaaacaaatggggcctttgactgactggagcgagtttccagggagtggtccccatggggagtcggcagtctccctgactaatgagacattgctaggggtacgaggaggacaaggcagctggaatttgcatggcagtgtatggaagaggagagaactgcacagagtgaaggtctgagatctgcacgggtcccaatagcatattcacctaagtactgttcaatgcatgactatccaagactgggatatctttattcctctttagaaaacaaacaaacaaacaaacaaaaacatagccattaatctagagtgctgtatgtggcaaaaatatcttttttaaatgaagacaaaataaggacttttttatatacacagaagctgaaagtaggccgggcacggtggctcacgcctgtaatcccaacacccggggaggctgaggtgggtggatcacctgaggtcaggaattcaagaccagcctggccaacatggcgaaacctgtctctactaaaaacacaaatcttagccaggtgtggtggcatgtgcttgcagtcccaggtacttgggaggctgaggcgcgagattgcttgaatccgggaggtggaggttgtggtgagctgagattgtgccactgcactccagcatgggcgaaaaagcgagactccatctcagaaaaataaataaataaataaaaagaagctgaaagtattcatcgccagcagtcatgccctataagaaaggtttaaaatactttctattttcccttttgatttttttctttaacccatgggctacttagaagtgtgttacctagtctccaaaaatttggggattttccaaatatattttagctattgatttctatttaattccattgtggtcagacaacgtactttttcctgaacccttgaaaatttattgaaacttgttttttgggccaaaatattgtctatcttgttaaatgctctgtgtgtacttggaaaaaaaaatgtgtactttgcttttatttatttatttatttatttatttatttatttttgagacaaggtctggcactgtcgcttaggctggaatgcagtggctccatctcagctcactgcaacctctgcctccctggtctcaagggatcctcctacctcaacctcctgtgtagctgagactacaggtgcagtgtatacagttcaataaattttgccctctattaaattctattttgtatatatacaacaataaagtcattttaatttctccattaaaaaaataaatggaggccaggcacagtggctcatgcctgtaatcccagcattttgggaggccgaggtgggcagatcacttgaagtcaggagttcgagaccaatctggcctggccaacacggtgaaactctgtctctactaataatataaaaattagccaggagtggtggcagatgcctataatcccagctactctggaggccaaggcaggagaatcagtcaaacccaggaggtggaggctgcagtgagccgagatcacgccactgcactgcagcctgggtgacagagcaaaaccccgtctccaaaacaaaaagaaaaaaaaaagaaatggaatcatagaaagataattagccccaaagaagtatttttcaaatacttcatacttttccaagtatttcatcaaaagatgaaaaataggaagagatatgaataataaatacaatacggcatacttaaacccaaacatatcaacagtcagtcacattaaatgtaaatggtctaatcactccaatttaaaggaagaggttgtaagattgaaataaaaagcgaaaccaactatatattgcctatgaaaaacctactttaaaaatagagaaataaataggccgggagccgtggcttatacctataatctcagcactttgggaagctgaggtgggcagatcacttgaggccaggagttcgagaccagcctggccaacatggtgaaactctgtctctactaaaattacaaaaactaaactaaactaaaataaataaaaatagagacgtaaatagtttaaagtaaaaggatgaaaaaagatacatggtaatactaatgaaaagaaagctggattggttgtcttaatatcagactaggtaggtttgagatccaaaaatattaccaggtaggaaacaggatgttttctaatgataaagagatcaattcatcaaaagaccataatattcctaaacatttatgagtttaataaagaatttcttaatacataaagcaagcactgatagaactactagaagaaatagacaaattcacaattagagtcagatatttcaacaatactttctcgataatagattaaaaaacatctagacagaaaattagagaatatagaagaattcagcagctatactgaccttattggcatttatagagcactccactgaaaaacaggccaggcttggtggctcacgcctgtaacctcagcagttgggaagctgaggcaagcaggttgtctgagcccaggagtttgagaccagtctgggcaacatggtgaaacgccttcgctacaaaaattagtcgagcatggtggcatgcacctgtagtcccagctacaccggagactgaggtgggaggatcccttgagaccagggaggaagaggttgcagtgagccaagatagagccactgcactccagccttggtgacagtgccaaaccttgtctcaaaaaaaaaaaaaaaaagcaaagtacacattttttttcctagtacacacagagcatttaacaagatagactatattttggcccaaaaaacaagtttcgataaattttcaagggttcaagaaaaagtatgttgtctgaccacaatggaattaaatagacaatagctaaaaaatatttggaaaatcctcaaatttttggagactaggtaacacacttctaagtagcccatgggttaaagaaaaaaaaaatcaaaaaggaaaatagaaagtatttcaaaccgaatgaaaaagaaaaaacaatgtatcaaaatttgtaggatatagttaaagcagtagacaccattagtcaaaaagaattaaggtttcaaatcaatgctcagcttccaccttaaactaaaaatagaagagcgaatgcagctcaaggtaaacagaataaaggaaattataagataaaagcagaaatcaatgaaggagtaaacagaaaaactatacagaagaataaagaaataaaaagctggttcttttcaaaagctaataaaattgataatcttttagcagacagataaaaaaaaaaaaaaggacacatattaccaatatcagaaatgagagccgggcgcggtggctcacgcctgtaatcccagcactttgagaggccgtggcaggtggatcacgaggtcaggagatcgagaccatcctggctaacagggtgaaaccccgtctctactaaaaatacaaaaaattagccaggcgtggtggcgggcgccggtagtcccagctactcgggaggctgaggcaggagaatggcttgaacccccgggggcggagcctgcagcaagccgagatcgcgccactgcactccagcctgggcaatagagcgagactccgtctcaaaaaaaaaaaaaaaaaaaaaagaatgggagaaaatgtttccaaatcatatattaataaggatctagtatccagaatgtataaagaactcttaaaacactcaacaacaaaaagacaaacaacccaattaaataacccaattaaaaaataggcatacgacatgacaagacatttctccaaagagataaaaatggccaatagagacatgaaaagacaatcaacatcattagtcattacagatatatagatccacaccacaatgacatgccacttcatacccaataggatagccataagggaaaaaatttaaagaggaaagtaagtgttggccagtttgtggagaaactggaaccctcatacattgttggtggggatggtaaaacggtgcagccactgtggaacgaattcctatattaactagtaattctattcttaggtatatatcaaaaagaatttaaaacagatgttcaaagacttgtacatgaatgttcatagcagctctattcatgatggataaatagatgaaagatttttaaaaacccaaatatccataaacagatgaatgaataaacaaaatgtggtatatctaggcaattggatattattcactcataaaaaggaattaagtactaacacatgctacaacatggatgaacctcaaaagcatcacactaaatgaaggaggctacacacaaaaggccacatattgtatgattcaatttataagaaatatctagaagaggcaagtccatagagacagcaaaccgattagcagttacagagactgggaggagaaaggaatgcagtgagtactaatgggtatgagatttctgttggtgatgatcaaaatattttggaactaagtcgtgatgatggttgtacaatgttgtaaatgtagttaatgccactgaattgtataccttaaaatggtttaaatggtaaattttgtgttatatgtatcttagtataatttttctaaaaaaaaatcagcaattcaattcatcatattaacagtctaaaaatgaaaaattttttaacatctcaatagatgtcaaagaagcatttgacaaaatccaacatctgttcctgatcataatcctcaacaaactaggaaaagaaaggaacttcctcaagtaaataaaaaggcatctataaaaagaaaaaaaaaaaaaacctaaagctagccgggcacagtggctcatgcccataatccagcactttgggagactgaggggggtgtggattgcttttagctgaggagttcaagctcagcctgtgcaacatggtgaaaccccgtttctacaaaaaatacaaaaattagctgggcgtggtggtacacctcggatcgcgccactgcacatcatacttaaaggtgaaaaactacatattttcatctaagatcagtaacaaggcaaggatgtccatattcatgacttctactcaacattgcactaggccaggtgcagtggttcaggcctgtaattccagcacttttggaggtggagacaggtggattgcttgagcccagaggtttgagactagcctggcaaacatggcgaaaccccctctctactaaaaatacaaaaattagctgggtgtgctggcacatgcctgtaatcccagctacttgggaggctgaggcaggggaattgcttgaacctgggagtgggaggtggcagtaagccaagattgcgccactgcacactccagcccgggcgacagggcgagactccatctcgaagaaaaaagaatattttttaaatgtctggattatttcatttcaggaaattttatcacagttatatatgcacagttttaaaatatcaaatggttctaaaaggctggttatgaaaaatagaaatgcctggcccaattatagagcaattttctacttcagaggcagccacttttaaacactatttctaaataacaaaaataaatctttacacattttttagtgtctgtccttaggaatgctgaagatttagatttctctcacctttccaacactcctattcctcactttctctctctctctttttttttttttgaaaaggagtctcactctgttgcccaggctggagtgcagtggcgcaatctcggctcactgcaacctccgcctcccaggttcaagggattctcctgcctcagcctcctgagtagctgggattacaggcacgtgtcaccacacccagctaatttttgtatttttagtagagacagggtttcagcgtgttggtcaggctgatctcgaaatcctgacctcgtgatccacccgcctcggcctcccaaagttttgggatcacaggcgtgagccaccacccctggcctctttttcttacacacacacatacatgcacttccggtctgtccctgtatttttccattcccctgatatagctgtattattaatttggataactatattcagaacttgttttttatgactatattgttatgaccaggaaatatcattcacaactgaatatgtgttacaggccaaattgtgggccccttccctaaattcatatgttgaagtcctaacacctagtatcttagtatgtgactgtatttggagataggacctttatttaattaattaatttatttattatttatttacttatttttaagatggagtctcgctctgttgcccaggctggagtgcagtggcacaatcttggctcaccacaacctccacctttcgggttcaagcgattttcctgcctcatcctcccaagtagctgagactacaggtgcatgccaccatgcccggctaatttttgtatttttagtagagacggggtttcaccatgttggccaggctggtctcgaactcctgacctcgtgatccacctgcctcggcctcccaaagtgctggagttacaggcgtgagccaccacgcccggccagagcctttatttttaatttgtatttttatttgagacagggtatcactgtgtcacctaggctgcagtgcagtggcacaatcacggctcactgcagcctcaacttcctgagctcaagccatcctcctacctcagcctcccgagtagctgggactacaggcacatgccaccacgcccagctaattttttttattttttaagagagagggtctggctattttgcttaggctggtctggaactcctagactcaagcaatcatcctgcctcagcctccctaagagttgggattacaggtgtgaaccactgcacctggccttagggcctttaaacaggtgattgaggccccaagggtgggctctaatccagtatgactggtgtccttataaaaacaggagattaggacacagacacacacagaggagagacgacatgaagacacagggagaagatggccatttgcaagccagggagagagaccacatgagaaatcaacactgctgacatcttgatccagaaccagaccctttttttttttttttttttttttgtaagacagagtctcactctgtcgcccaggctggagtgcagtggctcaatctcagctcactacaacttctgcctcctgggctcaagtgattctactgcctcagtcttccgagtagctaggattacaggggcccaccaccacgcctggctaatttttgtatttttagtagagacagggtttcaccatgttggccaggctggtctcaaactcctgacctcaggtgatccaccacctaggcctcccaaagtgctgggattacaggcgtgagccaccacgtccagcccaccagaaccagacttatgcctctagcctccaaactgggagaaaataaatttctgttgtttaggacatcagtttgttgtattttgttatggcagcccaaactgactaatattatatacatatatatatatatatatacacatacatataaatgctttttttctgaaatttatcttccaagtccttttgaatttttcagttctgctactatttctttttttctttttttgtaaacgaagtcttgctctgacacccaggctggaatgtagtggtggtcttgcctcactgcaacctccacctcccaggttccacgattcccctgcctcaggctcctgagtagctgggattacaggtgcccaccatcatgaccagctaatttttgtatttttagtagagacaaggtttcaccatgttggccagactggtcttgaacttctgacctcaggtgatctgccctcctggcttcccaaagtgctgggattacaggtgtgtaccactatgcccagccacagttccactattatttctatgaacacttttcttttctttctttctttttctttttctttctttctttctttttctttctttctttccttcctttctctctctctttgtctctttccttctttcttttccctcccctccctccctccctccctccctccctccctccctccctcccttccttccttccttccttccttccttccttccttccttccttccttctttccttcctttttttctttcttttgagacagggtctcactctgatacccaggctggagtgcagtggcacaatctcagctcactgcaccctctgcctcctaggctcaagggatcctcccacctcagcctcccaagtagctgggactacaggcagccgccatcacacttggctaatttatttttaaattgtttttttttttctttctttttattttttgtagatagagggtctcactatgttgcctagactggtcttgaactcctgggcccaagcagtcctcctgccttggcctcctaaagacctgggattaggcatgagctaccactcctagcaagagcacttttcacttctgccccttccctcatctcttccaggtggataagaagattctttgaggaagaccttgacaacttccacatccctcatggatgcttctttactcacctttcctctcttttctctcaaaaataactttttaattttctgaatgttcctgaacaatttttgtttctagttttctggctcttgtcttatctccctgagtttgctgatccttgtcttctcattcttgagaagcacactaaacccagcttagaagtctatgcttttgggaagagcttatcctctctaatcctcactgtagggtgatctggctgggctttcatcttgcaaaatcccggatgtcagcatcttctggtctttgggctcagaagggtcagccctccacaatggactctgccacactgccatgtagagggttctgtgccttgctgtcgggaccctgggggctgagcgagcctaagaaggctcagggcagtgtgcctcaacactgtttgtatatcttcacttaatcctcctattttcagtatagtcaccctgctctcaactatgctggtctcctccaggccagagacccttagttttagcctctgaagaagagacaccctcagtctctgtcagggtaaggaaggactgtcacttggctccgcagattcaaggactttttagctccatcttcatccccgctttcagagcgcccaatgccacccatccacatgcattttgtgggttcttaaatttaaatgggattacatcttggattcctgcactactggctttcgattcagctttctctggtctgccaaatcggttgtcacttccatatctgctttctagcttgctaaattttgctgtttttttttttctctcttgttctcttcctccttgggagttaatgccaaaacaaacaaaaattccttttattgtcatttagtttcagaaggcctccaagatacatgtgtatccttttttttcaccatctttaaacagaaatcatctaaaagtaatgttgataatccggcagaaggagaaaggggcagaaattatggtcctcctatgaatttgagtattgtgcattcattaaaagaggtgtttgctatgaattttcaatagtaaaaagaaaactttttaaataatgtttgttgattttaaagatgttgtaagactatacataggattattccaccaactctttaaatgttcgtggaaaaagtgtgggtaaaaatatacttatttatttgttcatggttaatggataggattatgggcgactttattttatttctgtaatttatacatttttacaatgtaaatactactttgtttttcttatcattaattgcattgttcaataatatgtaattactgtggaaaaggtagataatacgtaaaaagaagatacatacacacatagtttttttgttttttgtttgtttgtttgagacagagtctcactctgtcgcccaggatggagtgcaattgcgtgatctcagttcactgcaacctccgtcttccgggttcaagcagttctcctgcctcagcctcccgagtagctgggattacagatgtgcgccatcatgcctggctaatttttgtatttttagtagagacagggtttcaccatgttggccaggtggtctcaaattcttgacctcaggtgatccacccacctcggtcccccaatgtgctgggattacaagcgtgagccaccacgcccggcccacacatagttttttaaaaaattactccaaagcctatcaaaattaaaaactgttaatatgttaagatatgttttcttccaagtaaatttgcatactacttttgtaatgaaaacagtaatattcttcctctttgtgtccactgctggagtcttagagtcactaatgggctaatgtaagaaagtctagtttgaagccactgttaaaatagaattgttatttggaaggaaatgggagattcctgggaacctcttagctttctcacctaagtcaacagaaaggattggcttactagatttgctaattatcagcctgaaagacaaaaggacctcatacaaattcctggggaccatcaaaaggatgagagacaattgggacatgatgctggagacttctgcatggggccactggcggaggtgagtgccccttggggagatgttgccaagatttgcctgctttacttaggatcagtcctgcatatcagcaaacacatgctatgtgtgtcctatagagcggtaccactagctgacctgtgaaacaggaattgggggaaaacagctaatgtttgatgaagatgatgggtttctgcactggcttgagaggagcagtctcctttcaaaacgacatacgcattcattatccctggcttcctgctgccacggcatttaaactagtgatcttcagacagcattcctctgtccacggtcctcaccgcgaggcagccccagagaatggacaatgtgcatttgcgatccatggcattttgagaatgtcatggtggcctgcaaatgtaacagggatatttgtgatgctccatttcaactcctgttattgaagcagatagggctacctggtgcattttagtttttactaatgagtttttaacttctttttgttttgatttggaacactgaaaaccacactaaatttagaagtctactccttaatagatcaatcagttaggtgggccttgctgggttagtttttgttcctaaattataattgattcaaaaggaaatgagtcccttggcctcttacaaggtcttttaatcatttctttgcactatctctttctcagctcaattttctttctttttctcactttttgttaggttgctgtcttttatcagtctgtttatttgaaaaaggaagagataagttgttaactggccattcagtgtgaaaacaacagcctcacctttatcaccagataattaaaaaaaaaatacccctcagctgtcattaagtaatcccatctgcccgatattgctttttaagatcctatctaaatgaattacaaccagcaaaatcataaaagaattaagttagagacagaaggtattggtaatcccttcttcctgtttgacaatggatttcttttggagaggttgaaaacaatcattaacatcaatttcaatgcttatttactttacagtggttaactataaagtgacctttgaagaagggtatgttttggaaagctaagtactaaaattggcctgccaaccgttttggggatgagttttaaatattttactcagtttactgaggaactgaccattctacaaacttcaataattcaaataaagttcaactttaaaaaataatgataaaaatggctcgtataaagttttttaggttgctactaggtatgaccaaacaatgcaatatttagcattattgtggaaatgaaatttgaggccgggggcagtggctcacgtctgtaatcccagcactttgggaggccgaggcgggcggatcatctgaagtcaggagttcgagaccagcctgaccaacatggtgaaaccccgtctctactaaaaatacaaaattagccgggtgtagtggcgtgtgcctataatcctagctacttaggaggctgaggcaggagaatcgcttgaacccaggaggcggaggttgcagtgagccaagatcacaccattggactctagcctgggcaacaggagcgaaactccgtctcaaaaaaaataaataaataaacaaataaatttaaaaacctggaaagatagactggctgattgcaggagaaatgtttgaagtaaagtaaaggagacgactttctcctccttttttttgaagaaaaggcagcataattattatcttgaaacttctttctttagagagattctatttgagtgcttaatagactaggaaacacgcagagcattgtatatatcaggtattgctctaaaagttttacatgtattaaacaaaacaccccaggacaacacactgaggttaatgctatagtccgctttcctccaacccctttttaaaattaataaactttgtttttttagaacagttttaggctcacagcaaaattgagcacaaagtagggaactcccatacaccccttcccccgacacacacacagcctcaactgatatccacatttcacactagagtggcacttttggtgcagttcaggaacctacactggctgtcattatcacccaaagtccatggtttacagtagggttactcttggtgttgtacattctcgtatccaccgttgcattatacattcagaatcgtttcactgccccagacatcctcagcctattcatacctccttcctcctaacccctggcaactagtcatctttttactgtctcgttgcctttccagggtgtcacatagttggaatcatacagtatatagatttttcagattggcttgtttcacttagtaataatacgttgacgtttttcccatgtctttttgtggctcaatagcttattacttttagtgctgaataatattctattatctgtatgcaccacagtttatttatccattgacctactaaaggacaacttggttggttccaagtttgggtgattagaaatacaggtgttataaataaccacgtgcaggattttgagtgaacataagttttcaattcatgtggataaattccaagaaacaaaattgctgacttgtatggtaaagaatatatttagttttgtaagaaactgttgattaggcaaggtagttcatgcctctaatctcaacacgttgggaggccaaggcatatggattgctcatgtctgatattataagagtaatttgtgtcttctctcttagttagcctagttaaaggcttatcattttattaattttttcagagtcaggttttggttttgttgatttttctctactgattactattttcaatttcatgatttctgttataattttatttatttcttttattgtgtttattttggatttaatttgctcttctttttctagtgtcctatggtggaagcttaaataattgatgtgaaattgttcttcttttctaatacatgcaatcaatgctataactgtccctctaaccactgcttttgcctcattccataaattttaataagttgtatttctgccgggtgcggtggctcacgcctgtaatcccagcactttgggaggctgaggttggtggatcacaaggtcaggagtttgacaccagcctggccaatatggtgaaactccgtctctactaaaaaaatataaaaattagctgggtgtggtggcgtgcccttgtagtcccatctactcgggagactgaggcaggagaatcgcttgaacttgggaggcggaggttgcagtgggctgagatcacaccactgcactccagcctgggtgacagagtgagatttcgtctcaaaagaaaaaaaagttgtatttccatttatttcaaaatatttagtttcttgagatttatttgactcatttgtaatttaaagtgtgctgttaaatctcagtattttgggaatttccagctatccttctgttgttgatttctagtttaattctactgtggcctgagagcagatatgatatgatttataattttaaaaatttgttcatgaccagcctggccaacgtggtgaaaccctgtctctactaaaaatacaaaaatcagcctggcgtggtggcgggtgcctataatcacagctactcggaaggctgaggcaaaagagctgcttgaacccaggaggcagaggttgcagtgagccaagatcacaccattgcactccagcctgggggacaagagtgagacttcgtctcacaaaaaaaaaaaaatggttaagatctgttttatgacccagaatatgttctgccctatctaggtgaatgttccatatgagcttgagaagaatgtgtaatctgttgttgttggatgaagtagtttatagaagttaactatatttagctgttcagtagtgttgttgcattcaactgtgtgcttactgatgttctgccttcttgacctgtccatttctgatagagaattgttgaagtctccaattataatagtagatacatctttttctccttgcagttctatcagttcaagaactcatgtattttgtagtttttgtttgtttgtttgtttgttttgagactgagtctcactctgtcacccaggctgaagcgctcttggctcactgtaacatccacctcctggattcaagtgactctcctgcctcagcctcccgagtagctggaaccacaggcacgtgctataacacccggctattttttgtatttttagtagagatggggtttcaccatgttggccaggctggtcttgaactcctgacctcaagtgatccgcccaccttggcctcccaaagtgctaggattacaggtattagccaccgggcccagctagaattcatgtattttgaaactctgttggtaggtgcatacatgttaaagatttttatgtcttctttgagaattgacccctttatcatcatctttatccctgataattttctttgctctgaagtctgctctgtctgagattaatatttctactcccactttctttttattagtgctagacattttctctttttccattcctttacttttcaatctatatctgtctttatatttaaagtgggtttcttgtagacaacatatagttaagtcttgttttcttatccactctgacaatctctgtcttttaatgatatatgtaaaatactaatgtttaaccctgttcctatttgccctgagaatacttgctggtggcacctgcagctacagcctttaacccaagataactttgccacaaaatattttgttttattattattttcacattgctctagtatattgactttggaaacaaagacatcatcctatttatagcattctggtcttagcagtggtatttccatttagaaaatatagtaattctccattgctgaaaatggcaaatcctagaaaacgtagcattcctacacgtgatgttaacattgtcctcaaagagttgtggccgagattcatttgatgaatccaatttttctgaaatagatgattctgatgattcagatgattctgatgttagttctgtttagaaataactcgaagaacagtttttacattttattttcacattgaaaatcagtcatatttgcttcggcctcaaggagtgtgtttatgtaaaattaaatgagcgctgacagccagctgcacattttttctaaatgggaaaagggttaaactgattatctagttggattaacatctaccatatttgttattattttctattttttcacctttgttctttcttcttatttttgtctttcacattttttctgcttttaatagttttctattgagcatttatatgattgaattttctctcctttcttagcatactaattttatttttcttttacctctttttagtggttaccctagagccctagagtttgcattatgcatttaccacgaatccaatccactttttttttttttttttttgcggagtctcgttctgtcgcccaggctggggtgcagtggcacgatctcagctcactgcaacctctgcctcctgggttcaagtgattcttctccctcagcctcccgagtagctgggactataggcaagtgccaccgtgcccagctaatttttgtatttttaatagatacggggtttcaccatattgtctaggctggtcttgaactcctgacctcgtgatccacctgcctcggcctcccaaagtgctgggattacaggcatgagccactgctccaggccccaatccactttcatataacactatgacacttcacaggttttgcgagtactttgtaataattaataatttccaattcctaccacttgttccttgtatcattgctgccattcatttcatttatacatgagtaagtaaatgtacatatatttaaatacatttttgctattagtattttgaacaaacttatctgttagatcagttaagaatgagaaaaatgggccaggcgcagtggctcacgcctgtaatcccagcactttgggagggtgagatgaccggatcacgaggtcaggagatcaagaccatcctggccagcacagtgaaaccccgtctctactaaaattacaaaaattagctgggtgtggtggtgtgtgcctgtaatcccagctactcggtaggctgaggcaggagaatcacttgaacctgggaggcggaggttgcagtgagctgagatcgcgccactgcactccagcctgggtgacagagcgagactccgtctcaaaaaaaaaaaaaaaaaaaaaattagccaggtgtggtggcgtgggcctgtaatcccagccactcgggaggctgatgcaggagaatttcttgaacccgggaggcagaggttgtggtgagccaatattgtgccactgcactccagcctgggtgacagagcaagactcagtctcaaaaaaaaaaaaaaaaaaagcatgtttatgtaaaattaaatgagcactggcagcaagctgcacatttttttctaaatgggaaaagggttaagctgattatttatctagtcggattaacatctaccatatttgttactactttctatttttttgcctttgctctttcttcttatttttgtatttcacattttttctgctgttaataattttccattgagcatttatgtgattgaattttcttttctttcttagcatactaattttacttctcttttacctctttgtagtggttaccctagagtttgcattatgtatttaccacgaatccaatccactttcatataacactgtgacacttcacaggttttgcaagtactttgtaataattaaatatttccaattcctaccacttattccttgtatcattgctgccattcatttcacttatacataaataaataaatgtacatgtatttaaatacatttttgcaattgctattttgaacaaacttatctgttagatcaattacgaatgagaaaaatgagctgggcacactgtcccacgcctataatttcagcactttgggaggctgaggtgggcggatcaccagagattaggagtttgagaccagcctgttcaacatggtgaaacaccgtctctactaaaaaaaaaaaacaaaaaaaaaaaaacaaacaaaaaatagccagatgtggcaggtgcctgtaatcctaactactcaggaggctgaggcaggagtatcgcttgaacctgggaggtggaggttgcagtgagccaagatcctgccactatactccttcctgggcgacagagcaagactccatctccaaaaaaaaaaaaaaaaaaaaaaacagaaaaatgaaagtttttattttagtttctgacctatgtcattttccttctctcagaagaacttcttaacatttcttgaaggtctgctggcaacaaattccctcaatttttgtttatctgaaatagtctttatttttctttcacttttacggataatttcacagggtacaaaattctagatgggtgtttttggttttttattctcctaatactttaaatatttcactctgttcttgcatggtttccgagaagttggatatacttctttcaatttttttcgtttttgagtgtttttatagtgactaagcctcgctatgttgctattagtccgttttaacgctgctgataaagacatacctgatactgcgcaatttacaaaagaaagaggtttatgggacttacagttccatgtggctggggaggccccacaatcatggcataaggtgaaaagcacatgtcacatggtggcagacaggagaagagggtaaccgggcactgtggctcacgtctgtaatcccagcactttgggaggccgaggcgggaagatcataaggtcaggagtttgagaccagcctggccaacatggtgaaaccctgtctctactaaaaatataaaaattagcaaggcgtggtggcgggcacctgtaatcccagctactcaggagactgaggcaggagaattgcttgaacccaggaggcagaggttgtagtgagccgaaatcatgccattgcactccagcctgggcaacaagagcaaaaactccgtctcaaaaaataataataataataattatatctgtgtggccacagttacccaagtggctgtggtggaaggattgcttagggccaggagttcaagtccatcctgggcaactgatatggttttgtgtgtccccactcaaatctcatcttgaattgtaactcccacaattcccacccgttgtgggaggaacctggcaggaggtgattgaatcatgggggtgggtctttcccatgctgttctcatgataacgagtgggtctcatgagatctgatggctttaaaaatgggaatttccctgcagaagccctcttctctcccttttttttttttttttttttttttagatggagtctcactctgtcacccaggctggagtgcagtggcgtgatctcggctcactgcagcttccacctcctgggttcaagtgattttcctgcctcagcctcccaagtagctgggattacagacacgcgccaccacgcctggttaattttttttttttttgagactaagtctcgctgtgtctccgaaagtgttgggattacaggaatgagccactgtgcctggccagatataactcttatcttttatcttttttgtttgtttgttctgtttgtttatttttgagacacggtctctctctgtcgctgaggctggaatgcagtggtgtgatctcagctcgctataacctccacttcccaagctcaagcaatctttccacctcagcctactgagtaactgggaccacaggcatgcaccacagccagataactttttgtattttttgtagagatgggattttgccatattgcccaggttggtcttgaactcctgggctgaagtgatccacccacctcagcctcccaaaattcagggattacagatgtgagccactgaacccggcctagttcttatctttgctcctctataggtaagatgttctttccctctcacttttttcaagatttttaaagtcttatttttctgaagtttgaatatgatatgcttaggtgtagttttttggtttgtgtttgtttgttttggcatttatcttgtttggtattctctgagcttcctgaatctgaggtgtctgacattaatttgggggaattctgttattattgcttctaatattgcttctgttcctttctccatcctctccttcttgtattcctctctcatgtaaagttacacctgttgtagctgtctcactgttctcagataatctgttatggcttttttttgtttttttggtttttttttttgagacggaatttcgctcttgttgcccaggctggagtgcagtggcacgatctcggctcaccacaacctccgcctcccaagttcaagcaattctcctacctcatcctcccaagtagctgggattacaggcatgcaccaccatacccggctaattttttatttttagtagagatggggtttctccatgttggccaggctggtcttgaactcctgagctctggtgatccgcccaccttggcctcccaaagtgctgggattacaggcatgagccaccgtgcccagctgatctggctttttatcagtcttctttctctttgcttttcagttttggaagtttctattgttatatcctcaagtttagacattagtgtccagtttactagtgagcccatcaaagatattctttgtttctattagagtgttttttatctccagcatttctttttaaatctctcttagaactctttttcattctccatctctctacatgttctgcttctttcattagagcccttagcatattaatcataattagaaaaaaatcttggcccggtaattccaacattcctgccatatttgactctggttctgatgcttgttccatctcttcaaactgtgttttttaccttttagtatgcctcgtaattttttgaaaagtgggcatgatgtactgggtgaaaggaactgtggtaaattggcatttagtaatgtactggtaaggtgtgtgtgagggaaaagtgctctacagttctatgattagtctcagccttttggtgagcctgtgctcctggtctgtgaacttcatcagtgtttctcagttgtttttatttttttctcttacgtgggataaggtgcctgaagggggctgaggttgggtatgtcccttcccccatgtggaaggctagaggaaactagagctgagtgttttccttcccccaggtaggttctaggctctgataaaaccccagccagcaaaaggttctggtaaaatagtttctgctgcgtgcaggccctgtgaataagaagagaaagtgctggcatatttcaaagtagttattttttccttcccctttctggaagcacaaggagattttttttctctgatattcactttgaggacctggtagagttcctggaggtaaaactcacaaaagtgtgagctctccctatgactgggtttccttggagcttttaactctcagagttgtcaatattgagcctccaacaattcttcagttactgcttacgttttcttaccctgtgctggttcctgcagagatttctacttgtgtttctactccagtaagttgtaagtctctgtatctgtctgtttttccaattttgggagaagcagtgtgccctgtgacctcccttctctaagagatatacaaagagatgttgattttttagtttgttgagatttttacttgctaagatggagtggtgacttccgagttccttttagcttatagtggaaactgcttgtaaccccctttttacatataaggaaactaaggcacaaagatgggtagtaatttgcttatggcccctcagttagtaaggggcacagccaggatttggtgttctggctcaagagtctgtgctgtcaaccactacatcgttgagaaaaggcaccaagctgggctggtgggagatggaggaatatattttctttttctttttaagacagagtctgctctgccacccaggctggagcgcaatggcgtcatcttggctcactgcaatctctgcctcctgggttaaagggattgtcctgcctcagcctcccgagttcctgggattacaggaacccaccaccacgcacagctaatttttgtaattttttagtagagacgggtttcaccatgttggtcaggctggtcttgaactccttacctcaggtgatccacctgcctcggcctcccagactgctgggattacaggcgtgagccattgcccatgtccaggaatatattttctttaatgtctactaaatgtatactttcaaaaatttttctaaaacacttaataaagaaacatatgcctaggacattaaagcaatgattaccggcccagcgcggtggctcacgcctgtaatcccagcactttgggaagccaaggcgggtggatcacaaggtcaagatgatcgaaaccatcctggccaacatggtgaaaccccgtctctcttaaaaatacaaaaattagctgggcgtgatggtccgtgcctgtagtcccagccactcgggaggctgagtcaggagaaccgcttgaacccaggaggcggaggttgcagtgagccgaaattgcaccactgcaccccagcctgggcgacagagtgagactctgtctcaaaaaaaccacacacaaaaaacaaacaaacaaaaaaaaatgattactaaaacttttcagagtaaaagaaaaaagtcactcctaaacctaccatttgtacgtattacatttcagtccttgtccatctgcatgaacactatgcgtggatattatatattaaagtttttcacctaacattgtatcatgggaatttccccatgtttctccacctttttaaataaatgatatttaatagctgtataatagtttaccttggtgaggtgctataaattacaaaagcatgctattattggttatttgataattagtgtttttcttttacaatgataaataatgtttcacaattgtttacctttcattgagtaatttaactcaagccccaagagtgtgatttttgggtcaattggtacggatagatgtgtaactattgctaacttttgtcatatttgtttccagaatgatcgtaccagttttctgggcttccagcattgcataattatatcaggttggtgcaaaagtaattgaggtttttgccatattatacacacacacacactatatatatatattacatatacacacatagaatttattaataaatatattaactatatgtatatgatatatatacacacctcttaaaagtatagtgtcaatcaatagtgagaggttctaaaacaggaccatttccataaactgataaattcctccttttcagattttcagtttacgttacatgtagccttgattataggaggcattccatagattttattgaatggatggataatggaaggatggataggtgacattcaaatgattcttcctaattaacacactgaaagttagtagcaaagttgagatgatacactgatttataatttagagtagtttctctcaccgtaactccagttttactttattcagccaacatttgctgtatatttagtatgtgcaaatcacaatgctggaagctgggggtactactagcaataaaacatggttctacccaccaagaaactcccagtttgagaaattcacatgcctctctccatcagattctcatttacaacatgaaattattgaccccaaattctgtaattttatgaaatcctacatttcccatttatagatactaaggctctaaagtaggtaaagagtaatctgaaggactggtgattcaggataatgacagggaatatcttctttttcattcattcattcattcattcattcatcattcattcattcatcattcattgagcacacactaaacaccagacactattaagtgttgggaatagaaatagaaataaggtaagttctcttctcataaaaagtgcactgtctcatatgggaaggtctcttattttttttgttttcagaggtatagtttggcaacccaagagtactgcacacagtatttatatgtatgtaatatgcttacagtactattcaaacaaaactcaaatggagtggtgtctagtattaaagtacaggagagaatcaactaatattgattcaacttcaccctttaaatactcccaaaacttagaggaaaatatcattgaattttgtagacttatcacggggaaaaatgcttttaccttacttcaaaacatcaagacaaaagaggatgcgtgcatgtggacttaccacttctcttcttctacttgcactcccacggactggaacttactgggtgctttattctcccctgttttgtcaggttcttcagcatcatccacctggagaaatcatcaaataaatagagttgttccatttcagtcatcttgcttgaaaaacaaacatcacattttatgagaaaaatctctaatatgactggaatgttttgtaatttataacctccttgttcaatatttgtgtacactaccttcactgcacgctctttgactctgttgctgttagtaaaatgcaattttatccactctcaaggtagctgataaatgtttatgattcctccacagatttgcaagtctgtacttagacttaagtatcttactgtaaatactatattagaagggaatctacatggaaatgtgttcttggaagttttttttttctaatagagtttccctctgtcgcccgggctggagtgctgtggtgtgatctcagctcactacaacctccgcctcccgggttcaagggattctcctgcctcagcctcccgaatagctgagattacaggtgtgtgccaccatgtccggctaatttttgtatttttagtggagacaggtttttgccaagttggccagtctggtctcaaactcctgatctcaagtgttctgcccgcctgggcctcccaaagtgttgagattacaggcgtgagccaccacgcccggcctggaagttttgaatttgaagataacaacatacaaaataaagaggaaaatttatatattgtaattataattgttgacattgggagatttagatattaaccttattaagataaactatagagtgtcttcatttttctccccttaaataaagaattgactttgaatatcactccatagtttctaaatagctatgtgtatattacagctatatagaaaatataccatatagaactaataacctatgcaacagattagctccaacccaaatttgaagaaaattttagaattattaggtttattccgttttcctactatgtgtttaagaaatgttgtctctaaatataaagacaattcaatgtaagttatataaaattaaaatacagaaatatataatgtagaaagagaaagtctcccaagaattattgtcaattatttgatgtatatttgtctatctttatatatatgtctaaatatatatatttaaatttttgtttgtttgtttgtttttgagatggagtctcactttgttacccaggctggagtgcagtggcacgatctcggctcaccgcaagctccgcctcccaggttcacaccattctcctgcctcagcttcccaagtgtctgggactacaggtgcccgccaccacgcctggctaattttttatatttttagtagagacggggtttcactgtgttagccaggatggtctcgatctcctgacctcgtgatccgcccgcctcggcctcccaaagtgctgggattacagccatgagccaccacgcctggcctaaatgattattttattttattttattttatttttgagacagagtctcactctgtcccccaggctagagtgcagtggcgcaatctcagctcctgcaacctccgcttcccgggttcaagcaattctcctgcctcagcctcccgagtagctgaaattacagacgcgtgccaccatgcccagctaatttttgtatttttagtagagatgggatttcaccatgttggtcaggctggtctcgaactcctgacctcgtgatttgagtgcctcggcctcccaaattgctgagattacaggcgtgagccaccgcacctggacaaaaatatttattgacttcttatgtttctatctgtaagttgtctgttcatatcctttactagtctcctccctaattaggctgttttttattttcttaatcataggatctctttatattttatgaacctaaactctttctctgttacatatactgcaaaagttttctctcagtttatcatgtgtcttttaaactttgcccttcattggagagagtcttaggtagtcacatccagcttttatggtttggaaaggctttttctctgagcatatttttaaaagtcttcttgtattttcttttatgctttcatgttatctttttttcgtatttaattcttaaatccaccatcctgaaatgtttctgtcaaagacacatacctagagatctactattaccctcctgtactacctcccttgggttatgaatggatctggctccgtttattaactaattcgccttttttatttgagatgccagctttatctgataccaaactttactcacatatatttccccatacattctcatataggcattctcatatacagtcatgacacacatagtgacatttctgttaacgatagagcacatatacaatagtgatcataagattataatggaactgtcctgtgcagaagtaccattctgtatcttttgtactgtatttttactgtaccttttctatggttagatacacaaatacttaacattatgttataatggcctacagtgttctgcatagtcatatgctgtacaggtttatagcctaggagcaatgggccatactatatagcccaagtgggtagtatgctctacctcccaggtttgtgtaagtaccttctatgatgttcacacaatgacgaaatcacctaataacacattttcccaggtgtatccctgtcattaagtgacatacatataaagacctgtttctggcctattgatctgctgggcttattgaccttccctctcctttttcctaaatttttttttttttttgagatggagtttcactctgttgcccaggttagagtgcagtggtatgatctcggctcagtgcaacctccacctcccgggttcaagtgattctcctgcctcagcctcccaagtagctggcattataggtgtgtgccaccatgcctggctaatttttgtatttttcgtagagacgggatttcactacattggccaggctggtctcgacctcccaacctcagctgatctgcccgcctcagcctctcaaagtgctggttgcatgtctggcctttcctaatataattttgtaatcagtcttgatattttctatggcaagtctcctcctgtagttcctttttcaaaaagtataattaggctaggtgaggtggctcatgcctgtagtcctagcactttgggaggccgaggtgagaggatcgcttgagcccaagagttaaagaccagcctgggcaacatagcaagaccctgtctctacaaaaaataagaaaaaaaatagctgggcatagtggcatgcgcctgtactcccagctactcaggaggctgaaggaggattgcttgagcctgagaggtggaggctgcagtgagccatgatcatgccactgcactccagcctgagtgacagagcaagacagtgtctcaaaaaaaaaaaaaaaggtaatttaaaaacagaacaaaccaaaacaaaaatctctaggttattttggagtattaacttctaagtaaactttaacatcaaattgtcaagctcgtcctgttagcctccaccaagtgataaaaatcatattggaatttttattggaatttctttaaatatttgtattaattttcaggaaattgttgtctttttactatgtagtattcctgtgtaggaatagtaaataattttccatttattacagtattatattttatttatttatttgctggatgagatcttgctatgttgcccaggctacagtacagtggctattcacaaagtcgatcccattagtgatcagcagggcaattttgacctgctccttttctgacctgagccagttcacccctccttaggcaaactgatggtcccctgcccctggcaggtcaccatactgatgctgaacttactgtggacaccccatcactatagtgcactacagcccaagactcctgggctcatgtgatcctcctgcctaagccccctgagtagttgagacacaggtgtgcatgaccatgcatggaggttatttacttatttatttattttcagatggagtcttgggactctcactctgtcgcccaggctggagtgcagtggcgcagtctcggctcactgcaacctccgcctcgggggttcaagccattctcctgcctcagcctcctgaatagctgtgactgcaggcgcgtccaccatgcccggctaatttttgtattttttagtagagactgggtttcatcatgttggccaggatggtctggatctcttgacctcgtgatccgcccgcctcggcctcccaaagtgctgggattacaggcgtgagccaatgttcccggccgcctggaggtcttatattttatgtaaggtaagtttttatattgttttcaaataggagttacatattatttctgaagctcaattgtgttgttttatagtttttgttactactgtgaatgggttatttttgtacctttatattttgtttattgataatatatagataagttattgattcctctgtatttatattatattctttcacgttgctgaattctaatggattttcagtggtttcttctaggtttttttttttttttttttttcttttgagacggagtttggctcttattgcccaggctggagtgcaatggcgcgatctcggctcaccgcaacctacccctccgggattcaagcggttctcccgcctcagcctcccggtttccgctagaattttaaaggtggacatgtatattatctacgaataaaagcaattttgctttgttttgaaatatttacagttcatttcttgctttgtgtcttggccagtaaaggcaaacaacactgaataagcctaagaaaatattcatccttacttgacttctgactctggaatatctctagcatttcgtctttaagcagaagtttagattggtttcttttatttatttatttgtttgtttgtttgtttgtttgtttctgagacagagtctcactctgttgcccaggctggagtgcagtggcgcaatctaagctcactaagcaacctccaccccccaggttcaagtgattctcctgcctcagcctcccgagtagctgggactacaggcatgtgccatcatgcctggctaatttttgtatttttagtagagacgggattttgccatgctggccaggctggtctcaaactcctgatctcaagtgatccacccacttcagcctcccaaaatactgggattacaggtgtgagccactacacccggcctttagtttggtttcttataaatgctttttatcatgttgatacttggaatggcttctgatttttaccaaatgcaatagtttttactatctatctgataccaaacttttccccctaaaggctaaaataactttggatttctgtgacatacactacttggtaatagtatattatttttatttcatttttcttacttcagacaggaaatatgctgacacgataataagatgtgagggaggcacatcttaaacttttgtgtgaagacccaatcatcatgctgatgaatcacaaaaagatcagtaaaggtatattatttttaaaaatatatatacactttgattaattctcaaatttggtaagaatttttacatgtatttttgtaagcatgttattccataattattttttcttgtgttctttcaaatttaggtattagagttatgcttatttgattaaaatatattaagaatcttgtctgggcgcagtggttcacacctgtaatcccagcactttgggaagccgagacgggcagatcacctgaggtcaggagtttgagaccagcctggccaacatggtgaaaccccgtctctactaaaaatacaaaaattagccgggcgtggtagcgcgtggatgtagtcccagctactcgggagactgaggcaggataattgcttgaacccaggagatggaagttacagtgagcctagatcataccaccgcactccagcctgggtgacaagagcaaaactccatctcaaaagaaaaaagagtcttgatcttttttgtaatattacatgctttaaataacataggaattatttgcttcatgaatgttgagaaaacctttcctgttaaaatgatccaagtccgtaacatttgtgaaaggttttttttttcttcactttttttgcactttattctatggttataagatttcttcctccaggtttttattttatttatttatttattttttagacagagggtttctgtcatccaagctggagtgctgtggcaaaatcatggcttactgccactgtgacctcctggtctcaagtgatcctcccacctcagcctcccaagtagctggcactcaggtatgtgccagcacgcacgactaattttttctactttttgtagagacaaggtctcgttatgttgcttaagctggtcttgaattccctggctcaagccatctacccaccttagcttcccaaagtgctgggattacaagtgtgagccactgagcctgacctctttccccagatttaatactccctcttgcatcggtattagtaatatacatgagtgtacgtattattttgactttaaaatttgccaacattaagctgtcacaagaatcttttatagtttttcgaaaggtcatatactattctcattcctaatattgttgatttctattttccctctctcaatcagacttgtctatttatttagtattttcaaataaccaattttggtttatcaattccactttacttgtaattccttcttttgaatctgttgttctttttctagctttgtaaattgagtgtttactttatattgtaatatttcttccttaattatgaaagaacatagggctagaaatttttgttaggtcataactatggccacagcccatagtggtgatttataggattcctgctgtcatttatttcaaaataatcttgaattccttccgtaatccaaatgttatttagatgttttaatattttcaaatggttagattttgttatctgtttagcgttaatttctaattttaatgcatcatggttggcaaacatgactgattatttcttctttttggaattcattaaaatgatctccgtaaggttcattagttttgactggagagaggtccctccaaaaatctctttccaaataaacactgatgctgacttcgaggacatcaaaataaagtcttcaaggcttaaatgttttgaaactatctccttagtgttcctttactattttaagtcaataaattatgaatccaagataatgtgcctttttattttattttattttattttattttattttattttattttatttattttgagacagagtctggctctgtcgcccaggctggagtgcagtggcacaatcttggctcactgcaagctccacctcccgggttcacgccattctcctgcctcagcctcccgagtagctgggactacaggcgcccgccaccacgcccagctaattttttgtatctttagtagagacggggtttcaccatgttagccaggatggtttcaatctcctgacctcgtgatctgcccacctaggcctcccaaagtgctgggattacaggcgtgagccaccatgcatgggcctttttatttttcaaagctttctttcaaatagtaaccattcctttggtttgtactttacttggcagagacaagtttcattatctgcagttggacttatttcttcacataagcataaaatattaatatatatctgtacacttggacaggtattaaaggaaataaataagtcttaagagtatgatctaaaataactaaattttcttttatttttaattcaaagaatagagaaagccattgcatttcatataatgtgaagattaagctgttcttttcatctgttttgcaaattgagttaaatgataatatatggaaatcataatgtaccatcaggaagtagaggggtcagggcctaaaggtagtacatgaaactcatctgtagtcagaattactcttgagagactaaaagacaatgtaaccaactgttgccaggggtcacctttggggagtacagtaggaatacgaggtgggagtgggaaagaaggggaaatctcatattttgctctatacactcctgtactgtacgaactctttataataatcctgtatacatgaattactcactttgtaattataagaaaacaaaaaaaatttatcctaaaggtgcctatgacttttagtttagacatacaactttgctctaaatccagagcagccagtccccacaatgcccccatcacccccagcactagggtatcaagaaaaacaccagataaagtacttgacttgttttggtgccatattatacagaaatttatatctttaaatattctagaagcagagtgccacaaggtgctcccataagaacataggaatcaagactgcacacggatcatgtccattttaggtcttttaacacacatgctgattgaaggaaacagcacatttatttattatatcagacaaagagctttgttttggtgatttgcttactgtctagcagcctcgagcccatcttctacatttagctgctcttcgacactgcggccaggactcccaaactacatttcctaggcctccttgtcagctggtttccagctgtgttctaacaaaggaaggtggaagaagagaagaaacttccttcctgtttccaccttcttctggcatcactcttgcatgtgaaggtagctatggctccaccctccaactcctttttttttttttttgagacggagtcttgctctgtcgcccaggctggagtgcagtggcgcgatctcggctcactgcaacctccgcctgcagggttcaatcaattctctgtctcagcctcccgagtacttgatattacaggtgcccaccaccatgcccaactaatttttttgtatttttagtagagactgggtttcaccatcttggccaggctggtattgaactcctgaccttgtgatccgcctgccttgacctcccaaagtgctgggattataggcatgagccagcgcagccagctccagctcctttttttttttttttgagatggagcttcgctcttgttgcccaggctggagtgcaatggcgcgatcttggctcactgcaaccttcgcctcccaggttcaaacgattctcctgcctcagcctcccgagtagctggaattacaggcatgcaccaccatgcccggctaattttttgtatttttagtagagatggcgtttctccatgttggtcaggctgatctcgaactcccaacctcaggtgatccgcccaccttggcctcccaaagtgctgggattacaggcgtgagccactacgcccggcctttttttttttcttgagacggcgtttcactcttgttgcccaggctggagtgcaatggcacaatctcggctcactgcaacctccgtctcccaggttcaagtgattcttctgcctcagcctcctaagtaggtgagattacaggcatgcaccaccacacccagctaatttttttatttagtagagatggggtttcaccatgttggtcaggttggtctcaaactcctcacctcaggtgatccacccacctcggcctcccaaagtgcagggattacaggggtgcgccaccgtgcctggcccttcagctcctttcaacagcccatgcaccagctgctctgcaccactctgaagtcccagcaccacgtgaccctgccacctcacagtctgagcacgggctaccccaggcctttcttctgagctcctaaacttctggtaaccccaccttttccttcttgttccttttattgctctctcagtcttcccatacctgtgtaaccaattttgtgtattaaactgtctctgtttaagaagtgagcctggtctgtgatttcctggatgagattttaaccaattccatatgactacacttttgtaaattaaaaacgcttaggatgtcagccaaagtaggatgttgtgtcttctactatgcggtggtataaaactatccaatgaaatttgttcagaagacgcatggtagttatttccctgaagaagcacgatcctcaatgcatgaaaaagaggagacagaaaagaaggagggttcatcagaacaagaatggaggatattgttctctgcctggtccaagcctcatccccactggtcctagaactgccagctcatttgcatcaagtattagcatcttctaagctttagtcattgtatataaatttatctgtgattttttactcttagctccaaatattggcaaatggcatcttttatgtattgtatctagggtaatctacttaaatttataaagtggctttcaaaattgtaaaagaagttgcaggatatgagatctctgtccaaaaaaataataattgagaaagtccatggcatatttagttcagcatatttagctaattataattttaaaggacaatattaatcataacaactaaatctaataattgttgaacacttatgcctggcactgtgcttacggccttacatatattttatcaattaatttttaccatacccaaaatgtaccatatgaaataaggactattattattctcattttccagatgaagaatctgagatacagaaatattaagtaattgatctaagttcacagaggttataaagtaagtagttgtagtattagctattgggtatgaattaaatgtaaagttttggtaaaggattggaaactctggccctaagagagaaagcatggaaggaagtctaagattctagtgtgacatattttgggaacttgcatttaaatttgatttctgtataacgaaattcaatgaatagtttgcgtctttaatttttttttttttttgagatggagtcttactctgtcgccaggctggagtgcagtggtacaaccttggctcactgcaacctctgcctcctgggttcaagtgattctcctgcctcagcctcccaagcagctgggactacaggcgtgtgccaccacacccagctaatttttgtatttttagtagagatggggtttcaccatgttggccaggatggtgtcgatctcttgacctcgtgatctgcccacctcagcctcccaaagtgctgagattacaggcctgagccaccgcacccggccattttttttttttcttattattctccatcaaagaagtagtataatgtgatcatgttagacactaggtacaatcttggctctgtcaacaaaaagcaggtgaccttgggcaagttttccaacctctctgtgctctcatctgtagggcagagatgatcctaacacctacgccataaggtggttggatgagtcaaatgagagtcacataaagtactcagtactttgctataatttacatagcagtgtacaatgattagaggaagaataagaacaatttttttattcactaaaatatccaactatttaagacatgagataatgtctcaagtaaaaacttttctccccaatggtatacgtggatttaagtctagttccatcctactgggtgaaaataataattattattattattctgaaactgttttaaaaaatctagcttcctgtggaggttatagtttggtgggtgcatcatcaccactaaacacacacagtatagtgatggtcacacaacaatgtgaatgtccttagtgccactgaactgtaggtgtaaaaatagttaaaacggtctttctttttgagatggaattttgctcttgttgccccgacttgtgtgcaatggcatgatctcggctcaccgcaacctccgtctatcgggttcaagggattctcctgcctcagtctcccaagtagctgggatcacaggcatgcgccaccacccccagctaattttgtatttttagtaaagatggagtttctccatgttggtcaggctagtctcgaactcccgacctcaggtgacccacccgccttggcctcccaaagtgctgggattacaggcatgagctactgtgcctggccacgcctggcttttaaattagccttagagtgggttcaatgtggatggatttattcaacagcaaattgagaagttattattcaaagggtacccgcagactgatatagcacaacaaaaatggagagagaggatgatttttcttctttgatagaagaacacttttagcagggtaacccaagctaaacagatgtaaaagaaacaaggtggaatcagtttgatcttatctttgaaaagcagaaaaacagtgaactgaactgagaagcctactgagttttctaccattttcatgaaatgcttgattaggctgaaactagtgcacattctttcctcatgatgctgtgatgtgtgttattgctttccacactgtcagtcactttggtcttgctcgccttcactcccacatctatgggaagtgattcacatttttgttctcatatggtcattcaatagtgttgaacatactgttatgtggctcgatgaccccggctattcctgcaagtccactctcttttctaaaaatagaaatgtgcgttaggaattaaaagcacctcatgtttgattgtgttcatgttctttgaattatcctgcagcttgagtcacacattcaatttagagaacaaaaataatagctgctaataatgtctacaaagaaaatactttcagaaaccctgatttgagccagacgtccaaagtcaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgaatttcagagccacatacctaagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcggctgacccagaggcgaggagattgctgggcccggcccctgaggacgacggtggccacaatgatcacagtcaaccacaggcctctcaggaccaggacagccacgcaccatcccctcaggtgtgaccggagactttgcagtgtgcatggtcaggggtggtgccgaagcgtcttccacctgccgtgcggaccgtggaaaataaaaggctctgcccccggggtgagtgtggccggttgtaccctgcagtagcgtctgccctgagctgccagtgctgggtatcccccagccccaggaaatgtggggtcggccgggaccctcacagctctgaatttgcttctgttatttacggctttttgctgcttcttggtaccccatctcctgtctgtgtccttccaaccccaggctgcttatgtggcccaaccccaatgctgtcaactaggcttgaaccccacagcggctgtgctcttctgggaggttcccgcttgctgccttcagccagggcgctcctcagagccctgttttcctgcagacaccagctctccttcctgcctttagatcctgagaaggagggaaatgaggggtgctgacacagtccctctgggagagctctgcctagtctggtttggtgaggcccttgatcaccttggccctcctccctgtcttctctgattcttttccctcaaaatagtcctgagaactaattgtcacactggcttatcatgtctctgtgggtgaggtgggagaagcctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaaatcttctcaccatgaaaaaaaaaaaaaaagaaaagaaaatactttcataatcttggtcacatttaacagtatacggagtccacagccaatcacttgaaaatctggtcctatgcatagatctatgattccaagcggcaagaaagcaaatcttccggggaaacaaaaagtgttacattccttagttttaagttcctatttcaaaggatagaaagggaggctgttacctgtatcccgatagacaggcatcgatttttcttaaagtggtccttcttcctgtcctccgtggtgacggtggctatggtagtcgtggtggtgacggtggcagtgttattgcccatgtgttgactggcagggccatggatctgggcgtttgcagcttcgatggcggctgtcagagccttcatactgtccaggctctcggtggagttgctgagtccagactggctgataatatctcctcgctggccctgtccgtccatgtaggcatcctgggctgactctgtgctactctgggctgtgatagaaatgaaaggtttcgtggtagttctgggtgggactggaggtggtgtcttcttatatgttgtaatgcaagatgacactggaagacagtgaaaacaaagacaatgtgatttctgcgtgggttttaatttctgatattgtaactgacagccattgggaattagggcacatgaaacacactgagacatttaacaggaaaacaagttccattgacaggctgagacccctgctctccggaggtggtttgggtctcctctgaggtgacacctccacaaaactgagggagaaaaacaccgggaaatatcaatctctgaaatggaagtttctaaaatggaaattaatatgaatcaacataaactagatacgattagccctctgtcgaaaccttcccagccaacaaattgtataggcacatagaaaaggtgaggggagtttctgtcttcagggaaaaaactaaatatagctaatattaaacagagtaactcattagaagagattttagtggttgataataaatatggaaaaagaaaaaaggaaggcaaagaggttgtgaggatgcgtgttctgatcctaataacaaggacgaggtgtctgggggagaagggtacacacgccatggtagctgctgcaacttgtttatcgaagccagttccttccttccttctttcctccctcccccctccctccctccctccttccttccttctttcctttcttcctccctgcttttcctttttccctccttcctgtaaaaatatttttaaaaaatagagaggaggtctctctgtgttgcccaggctggtcttgaactctgggctcaagagatcctctcccttaggcctcctttcaaaggacagaagaggaagctgttgcctatatcctgacagacagacacatagaagtgctgggattacaagcgtgagccaccgggcccggccacttcccacctttctgtctttctgcctgactgaccgacctacctacctacctacctacctacctacctacctacctaccttccttccttccttccttccttccttccctcctccctccctccctttctctctctgtccctctgtgtttccccacctccttcccttctttccttccttccctccttcagtctttttcttttctctgtctacctgtcttgtcatccttccttttccttctctctctctctccgtctccctctttcttgtctttccccttcctcctcctctctgtcttccttcttcacttccaccttgcctatctctctctctgtctttttctggataaactctcactatataaacttcttttgtttaatttttgcttgtttctgagcagaactactcactgagagtatttacactgtacaaaagtctcctattgtagaaattaatccacatgctagcttataaatcagtcttcgtgggtttggtctgtatgagtcactccctaaagtgtctttctttagggcaacttggtcaagtcaagggcctgaatctgactgggtgtggtggctctcgcctgtaatcccagcactttgggaggcccaggcgggtggatcacctgaggtcaggagtttgagacgagcctggtcaacatggtgaaacctcatctgtactaaaaatacaaaaattagccgggtgtggtggtgcatgcctgtaatcccagccacttgggagactgaggtagcagaattgcttgaacctggggggaggaggttgcagtgagctgagatcgtgccactgcactccagcctaggccacagagcaagattcggtctaaaaaaaatggtgggggcctgaatctaggctgctgagtacaattttggacccgtacaagggggtcaaggtctatttggaggctcccgacagcagcctcagcccctccctctagccatttgattacaacgctgagggttttgaagaagctttacacgttggctttcagtttctcatttgtaaagcatgatttaagaaaataaggatcaaaaatgaattaagtttccaagtgggactccggtcagtgaagcacaattccttaagcagctattataaattcattcaaataattatgcttccatcatttcctccccaccccaccccagcccacccactctcacaggtggtgtcactgtggctccatcacatcagctagacctggccatgcagtcccaacttgttacctacagttccagctgccaactcaggccatctcactgaatgaaatacttgcttcaacattgaagatgtttcctctggccactcagaggaaacaccctataatgaacaataaacaaaaggactctattatgctgtcctgctgtttcagtggcctatgatttggagtaatttccttaaccataaaatagatggagacaataatgtttggctatttcccagggattgcctgagtattggaggaataaatcaagcaaatgtctcattacaatatcatatggactctgggatggggaaagacaaggtgcatgacatagaggcagtcacccctcattccctgggtggatgactggcagaggcccagcccaggagaacttcccatctatgttgactcatgaaacacacaacttcatctctcttttttttagagatagggtctcactctgtcatcaggttggaaggcagtggcacgatcatggctcactgcagcctcgatctcctaggctcaagcaatcctcccacttcaatctcttgagcagctgggactaacaggtgtgcaccaccacatccagctaattttttattttttgtagagatgggggtcttgttgtgttgcccaggctggtcttgaacccctggcttcaagcgatcctcccatcttggcctctcaaagtgctgggattagaggcattagccactatgccatgcccggcccatctttatcatttgaatgcagctcaacaataagtgtcgacttcctcattttttagctaatgcacctgacaggaaatacgactcagggaaaatacagtgcttgcaaggtgcagagtcaggagcgagccagccagcctcaggttcttcccactagcccacagctaagcctctggctaaacaatgccagtgcatatacattgtaaatatcttgcctcactcaatttagtttcttgcatccaaaccatggtggagctctggttcccagagaggcatgagtgatggtagtcctgctgggagtaacgctcatctcagtgattcagctgaagacccagagtgggtgggagccataattaggatagaacctctccctgctaaaattgaatgaaactacagcattgtaccacttctcctaagacatgtctttacaacgtgaactcactattttgttcaaaatggattctcaggacattccgcccactgatatttcaagaagctaaataacatattccaacatcaaatgtctgatcttttggattatgtattgcttcttgttagctctccttggtttcttcttttagtgtggataatccaaactggacagtgaggccaggcacagtggttcacacctgtcatcccagcgttttgggagactatggtgggaggactgcttgagtccaggagttgcagaccagcctgggcaagataacgagatcccatctctacacaattagaaaacaaaaccaaacagtccccctccaaaaaaaagctagataattcagccaaatatggaatcatttgatttgctgtgacatacagtaaaaatcctgccatgatgtgataagtgggggtgggaggggctagttcacattgtttccaacgcatgactgaccttggggactgagcctccagtgcggctcctacactccccaggccaactgcaattggacgccacctggtggctgttgtcagctcatcttcgctatcgatagggataactctggataccttgctcaacagggacattggcagagttccagtaatgcttgacatctaccatggttagactggacagggagaatactggagacatggcttctccaacagggtggtccagcccccaacacccaaagaagataagattttgagatcccccccaacttcgaataagggagctgaatggagggcaggaaccatctcccatgttgttatacggagggacattactcattattatgaggcttaaggaaaggaaccatctcccatgttgttatacggaggggcattactcattattatgagacttaaggacaggaaccatctcccatgctgttatgctgagggactttactcgttattatgaggcttcactgcagtgagcggcactgtccagtcatgggctaggaaggtaaaaggaattcaaatcttcatgactgctttttttttttcaactacagacgggatctcactgtgctgtgtacgctggccttgaactcccagatttaagagatcctccccctctgcctgctgaataggtggcacaacgggcgcatgccaccatgcccggcttaagattgccatttgaaggagaggaaagggattcaaatcacaactcacacttccccatagttccccttcttcattttccaattcttctgcactccaaaactcatacaacgaaatccttccattttccccaacatccccctttcctagatttgctaagccctaaacccacacttctctcctaagggtattttgtttgttggttggttggtttcagttctactctcagaattcagtgccaggaaagatttagaacccactgagaaggtctgagcaccagcaggtgtgtgacacataagagtgagactgaaggagggtgaaacaccagccaatatgtttgtcttgcctggtcaaaacagaaagagaaaatgagaaagagaaaaagagaaaacgagcagtttctatacagtaagtgaaacatctgatttgtttaagagtgacgttctctttttattttgagacggagtttcgctcttgtcgcccaggtgcaatggtgcaatctcggctcactgcaacctctgcctcccgggttcaagcaattctcctgcctcagcctctggagtaggtgggattacaggcctgcgccaccatgcctggctaatttttgtgggtttagtagagacagagtttcaccatgttggccaggctagtctcaaacccctgacctcaggtgattcacctgcctcggcctcccaaagtgctgggattacaggcatgagccaccgctccctgcaagaattgagaggtgaagccagctggacttcctgggtcgagtggggacttggagaacttttctagctaaaggattgtaaacgcaccaatcagcacctgtgtctagctaaaggattgtaaacgcaccaatcggcactctgtaaaaacggaccaatcaacactctgtaaaacggatcaatcagcaggacgtgggcggggacaaataagggaataaaagttggccaccccagccagcagcagcaatcccgcttgggtccccttccatgctgtggaagctttgttctttcgctcttcacaataaatcttgctgctgctcactctttgggtccacactacctttatgagctgtaacactcattgtgagggtctgtggcttcattcctgaagtcagcgagaccactaacccaccgggaggaacaaacaactccgcacacaccagctttaagagctgtaacactcaccatgagggtccgcggcttcattcttgaagtcagcaagaccaggaacccacaagaaggaataaattccagacacagaatgacgttctcaaaaacaatgatttttaaaatgtaagtggaacttgaaaaaagaaatgatgctgtattttttatcaccattactgctttcctttgccctgataagttttttgttcatttcaaatgaaattatttttttcctcatctggctgaaaggactcttatccatttatgagagagttgcagaactagagctgcagatttcagtgacattttcattcagtggatactgtagtgcacagagagaccagaggttggtatttacatttaagaagttatatatttttggggccgggcgctgtggctcacgcctgtaatcccagaactttgggaggctgaggcggccagatcacctgaggttgggagttcgagaccagcctgaacaacatggaggaaccccatctctactaaaaatacaaaattagtcaggcgtggcagcacatgcatctaaccccagctactcgggaggctgaggcaggagaatcacttgaacctgggaggcggaggttgcggtgagccgagattgcgccattgcactccagcctgggcaataagaatgaaactccgtctcaaaaaaaaaaaaagttatatttttaagaaagacattatacggcagagtgcggtggctcgctcctgtaatcccagcactttgggatgctgaggcaggtggatcacaaggtcaggagatcaagaccatcctggccaacatgttgaaaccccatctctactaaaaatacaaaaattagccaggcgtggtggtgtgtgcctgtattcccagctactcaggaggctgaggcaggagaattgcttgagcccgggaggcggaggttgcagtgagccaagatcgcgccactgcactccagcctgagcgacagagcgagactccatctcaaaaaaaaaaaaaagaaaaaagaaagaaagacattatagagaaaacaacacattcctatcatttcagcttcgagctagctcatgattgaatattgcctacatttgtatggaaagataatgcggccaggcgcggtggcttatgcctgtaatcctggcactttaggaggccaaggcaggggataatttgaggtcgcgagttcgaaaccagcctggtcaacatggtgaaaccccgtctctactaaaaatatataaaaaaaaattaacccagcgtggtggcaggcgcctgtaatcccagctatttgggaggctgaggcgggagaactgcttgaacccaagaggcagaggttgcagtgagccaagatcgtacctctgcactccagcctgggcgacagaatgaaactccgtctgaaaaaaagaaaaaaaagaaaaaaagaaagtgttgcaagcttcaggaaggcctgggccagagattattttattctgtagtggtgaagatgttctggcaaattatccagactctctttccactctggttatccttcaagtttaacagcacacaagtgtcaggcggccacaaaacagatgtgagatcaaactccctttttgtgcctttttattcataaacccttaccagctaagcgaatggatcatacaccataagctatgtagagcaactatttagcagttcctgattactgcattttagaaattctttaaaacatgagagagcaagtccataaggaaccacaaataaaaacacaataagacaaagtaattaaacttatatataaattaaattatatatagatatatatgcagatgtcccagagtcaagtaacatctttttgatgtaaacatgttgttaccccaaggcgttgttattaagtgcagctattatcaagcaagctgtgatttgatcatccttgagaagtggcagcgcctacacagagctcatggggaaagcaaccttggatttgctgtgagttctatcagatggtgtcatcttactgagatgaagactaccagagagaagggctgccttggtccactgtctaaaatctgctgagggcaaagttctcccgatttggtccaggtgatcagcagttgttcaacaagccctcaaaaagaaggcctttatttctttatttgagacagagtttcgctcttgttgcccaggctggagcgcaatggcaccgtctcggctcactgcaacatccacctcccaggttcaagcaattctcctgcttcagcctcctgagtagctgggattacaggcatgtgccaccacaccaggctaattttttttatttaatagagatggggtttcaccatgttggtcaggctggtctcgaactcctgacctcaggtgatccagctcccttagcctcccaaagtgttgggattacacgtgtgagtcactgtgcctggccaaaagggctttattaaaaagatttttaaaatctaatggggttgacagaagcgtgctggaactggcccttctcagcttgctaagctcgattgtgcacatttctttctacctctgtattcagtcacttttcactgttagcttgaaattgttgaccttggtgtatttacaccatggaaatcagcaaatgcctgaaatccaggttcccccctgtggattttcttcaatcagagagccggttgttaagcatttccaacacccctgtgtgtacagagcagggttattcaaagcctggtctgcagagtggtgcccgtttgcaaactgtgtcacagtgcagggtgacacatgctatgaaaattgagtgtagggtcaggtacggtggcccacacctgtaatcccagcactctgggaggtcgaggccagtggatcacctggggtcaggagtttgagaccatcctggcgaacatggtgaaaccctgtctctactaaaaatacaaaaattagccgggggtggtggcacatgcctgtaatcccagctactcaggaggctgaagcaggagaattgcttgaacccgggaggtagaggttgcagtgagccgcagaggttgtagtgagccgagacggtgccattgcactccagcctgggcaacaagaatgaaaccccgtctaaaaaaaaaaacaaagaaaattgaatgtaagtgtttagaaacttttatagcaattttatagagtgttttacctgttgaatctaaaaacaaaacaaaacaaaacaaaaattatgggtttgttttttgtatgtcttaaaaaaaaagtcctctttctagtaattcttttttgttgcattttaccaaagcactaatctgcagcagattgagggcaaacaaacaaactggtcccttaccagagataggctgagaagcactgaaaagaacatttgcaaatccagggaacagggcagaggtagtacaagtgagattaagaatatattcaagaggtaacttgaagccacaggctattttagaaaacaaaatgatgtgaagaggccaaaagaaaaaaaagaaacttggaaggacctaaactggggacataaatgtatttctattgtagaaatacagaatgggaacgattggacttatggttgtaatgtcaggtaaggtgtctatttcaggaaaggcatgtaggattagaagtatggacctaggcctgttgcggtggctcattcctgtaatcccagcactttgagaggtccaggtgggaggatctctttgagctcaggagtctgagaccagctagagcaacatggtgaaacccatctccacaaaattatccaggagtggtagaatcctgccccagccttccaagtaggtggcacctgtagtcccagctacttggaaggctggggcgggaggattgctgaagcccaaaagattgaggttgcagtgagccaagatcacaccactccagcctggcgacagagcaagactacgtcaaaaataaaaaacaaaaaataaaaataaaaagacggggtgtttcatttggaaaagaagaaaggggggttttcaattatttggagggctcttgcttagaggatagcatgggcctgttttgtataagtccccaaaggaacaacaaaggcaagggctcagagaggcataaagaataattctccaggcattgattgtccgtccatagaaggaatatgaggacctcataacagagggagttctcagcccctggacctgttcaagcacagaccagcacatcttttggctgggaggctatagcaattgtaccaacatctgatagggggctcaactagatgacaaggtttctttcaaattggatggttatgataatgagtgaaatttagacaagaatttgcaaactagggagggtcccacagagaatgatgctgaagagctgaagaaagaagccaaaaaaggaggccagagaaagagctccaacgaggctgtctggtagcaatgatgaatgttctgccatcttgggaaagcagctggcactgatgaggacaaaataactaatagacaagtttgctgctgctgcttccagccaagcagaccccatagttgtgcacttaacagtgcatcatagggctcctgctccttgcggtgatgtgttatgctggccggactttccaacaaatgccagacaaatcagcggtctggctggagtcctccaccggcaaaaatgcgcaaaccctggcaacaacaaagatgatgagatgagattcagtccagacccgtgacatgccattagatcttcctaatcaccagagagcaaatccttactctgtgtactggacactgtgctaagaacttaatagacatgggggctgggtgtggtggctcacacctgtaatcccagcactttgggaggctgaagcataaggatcgctttagcccaggtgttggagaccagcctgggcaacagagtgagacctcgtctcaaaaaaacccaaacaacaacaactagctggtcatggtggtgcacgcctgaagtctcagctactcggtaggctgaggtgggaggatcacttgagcttgggaggtggaggccgcaatgagccatgactgtgccactgcactccagcctaggtgacagagcaagaccctgcctcaaaaaaaaaaaaaaaaaaaaaaaagaaaaagaaagaaagaaaaagaaaaagaaaaagaaaaagaaaaaaaagaaagaaaagaaaagaaaaagaagaaaatagacatgatctcacatatgtgaaagatcccactatccccatttaactgatgaaaatattaaggctcagagcaggcaacggacatccctaactcatctagagattcagtgacagagttagagtactcagggctccaactcccatctgaccattaactcaaaccacctttgtttatctcccccgccccccgccagtaaacactctctagtaaacaccttgtccactaaagcaccgtggtttccacgagggactccttcgtgcacagccatcctcactctgcaggaactcttaagtttcagtgaatgaatgaatttggagtggtcaacaaggggtgcacagttgcaacttttaaaatattgcagaaggagagaaatgccacaaaacaaaatgcacatggaaaaatcactaccttatttcaaaatatttacagcttcacatttaaggccacccaaagcgtggcggtcagtggtgagaaggcagagatcagaggctgttggggtgggtcatacaccatgattcccggcccccctctgggagatacaaggtatcccacagtcttctctcccagttacatcctccacggaaaccacaagatgactcgctcaactttttctaaagtagaaaaaaatatgcttgtgtgtgtgtgtaaggggaggagaggggatgtgaatgaaatggagggtagtgtaataattcctgtagtcataagacacgccagttggtagttgctagtattccagacacttcctaacgccagacaaatgccccaagcctcggcatgtctggcctagagatctattcaactgatagcagccgcctcttctggggagagcagatctttcagaaagcactggctgcgctgctaatcaaacgcaacattgttctcagcaaggaggaagaatggaaaggtttgtttcagagtcacaactttattttttttaaaaggcacccaagttgtttcaacaagctgctacaaaacttgggcttcctgagtggaggctgttttgcacagtgcatgtactgtacaaaaatccaggcagggaggggtcagagagttcgtcattaaagaaaaaaaaaaaaaaaagccccaggcacttgatgcctggaaatgatgtcagacgcagccactcctctgttagaactacagccaaacaatgcgcaggcaatccacagcagctgcccctgcaaatgtcagcgccagcccagtcaaaagagcttgaaacctaccaagccggaggactgtgctgtgcctctctcgcccacattttccccaagcactctcaggaacctggcaacaggtaacgtggcaacctttgacttataaaagggcaagtggcacaatctcagggaacaaatggacttttttttaaagccagcatctcccccaccactcccacacccccctccctccctccctccctcccaaccaaaagtctgtaaaaaacaaaacattgacgcgggcagtcctactctctagtgtccccttgtggccaagcctggaacatcacatctgtacgttgcaatctgtggatcagctacgaggtaagtcgctctttggaaggggtggaggtctttgctggacttgtcttccgaaaagtatgaagagtggaagtcaaggctcagaatggcgtccttttttaccttatcaccttaacaaaaacttcaccttagctgcagggttaaacctctgggttggggctggggattttcgttgttgttgttttaaagcagcagccaaggccatgttttttaaggtggtgagttaaacggagcaagagctgcggtagccttttccacccaatctctttcttcacatcctagtcacagccaagggtagggtggatggcagtgaggataaacagcccagaaacaggattcctgcagggtgggactggcattttccatttttatctgaagttgtactttgaatgcagacacctttctctcaggccagaagcactgctcatttgtattgctggcttccagttagcctatttgcaaggattacttaggatttccagactgcaggcccagctacccagagagtgtgcctcaaagccccacctcaaagcttttatctctatgtggcgggaaacacccacgaaaatgccaacggcggtatttgtaacttgccttcttccttttgggaactgctttctgcagctctctctgcgttagaggaatagctacagctgggagctgctccagccacgcaggaggagagggcacccattgagaggcgggcaccccttctgtctccctctggctatgttaactggaaactaggaaaggggttcagatcaaagtaactgctgtcttcagaaagttccattcattaactaagttagcggaaattaaatggtgtttggaggaaggtcatttcagaaggcccagggccagaggctgaggtctaaaacttctaatctggacttctattgaagtttggcagtaagttaaacaggaagttgaaggctaccatatgtaaatccagttgttgcctgaaatcagtcatttcaagggagtatcttgaaaggacacagactgggaaacaggcatgagaaaaaaaaaaggaagtagacagacatttggctagtatgtgcctggaccacttaacactaaagattagaaacctagggctctgagtaagaatcatttgaccagtagctaaagtgagtcatggcctgcacagaactagggcacacatgttgaagtcaggatgttgagaacatcaggcttactaatttgcaaggcaggagtgctgcttccagtagggaatgtgatcaggatttcacggctcattttcccagcctttccaacaggtgcaatcaagtcatccgtgtacacaagtgactgccctgttacatctgttaggattaaatttccatttgttccattactttatatgaagtgatttctactgctgagtcagacagaacacttcctcttagacctagggacttttttcaacatttttaacaatgtgtgtgtttttcaaaatgtgtcccaaccaggtctgcaggtcttcctgggttgaatggactgtttacagaaggggaagattcaggcccaaggtcagggttacagaattatataaggtttcctgtttgggcagctggtctagcaacacctctggttggggcagactgggtcttgttgagagatagcatgcccaggaggctagggcagggagagtgccaggagcaggaaagaacatttttcttttctttttttttttaagaccgtgtcttactctgtcacccaggctggggtgcagtggtgcgatctcggctcactgcaacctccgcctcccaggttcaaacgattctcctgcctcagcctctcgtgtagctggaattacagccgcccgccaccatgcttagcttatttttatatttttaatagagacggggtttcaccatgtgggccaggctgatcttgaactcctgaccttagatgatctgtctgcctcggcctcccaaagtgctgggattacaggcttgaaccaccaagcccggcctgacatttttcttttaaatcttttatcaaccagctttcatttcttgtcagatgtcacttttcagcaacctgttgctatattctctgttaggagaactttttttttttttttctggccagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagcatccctgactctgagactgtggggtagctggttgttttaagatgggaccagggtattgtgcacttattgccaattcttgcttcagtaagtggggtggctgtgcagagtgagtggcctgtgtatgaaccagggtccgtcccatctaatgagagtccggtcaggctgagtcctcaccaagacttcagcgtggattcatcagtaaccttggttcactggcaggcttgctggactttggagaaaaggctgaccctcccccaaagcagcccattgctgccactgccctaggaacagagggcctggagccagggcttgacctggtacaggagcttttgcacaaggccggctcaaacctccaaacctggggaaacaggatgcatggtgaagtgaagaagaaagaaaatgcatccaccgttccttcctgttggtgtcagcacgatgaggaataattacctggatctggaaagcaggcgtgtgggaggctgcaggcccccctgatctgtgtagttaggcacttaatttttcatcctcctccttctctctgccctcccgaaaccgccgttttcaaaggaaaaacagaaaaacgtatctgggtaacccgtgtaatactgtttacatcagcccacttggcccagaaaggataccagctccttactgatgctcagataacagggttagtgcttaaaaaaattatgccttgggccgggtgcggtggctcacgcctataatcccagcactttgggaggctgaggtgggtggatcacaaggtcaagagatcaagaccatcctggccaaccaacatagtgaacctgtctctactaaaaatacaaaaagtagctgggcgtagtggcgcatgcctgtagtcccagctgctcgggaggctgaggcaggagagtcgtttaggcctggcaggcggaggttgcagtgagctgagattgcgccacactgcactccagcccaggcggtggagtgagtctccatctcaaaaaaaaaaattctgtctcattcattatccaactttgtcactgatagagaaggacatagatccagagaagaacttgtccaggtgaccccagggctctttccccctccattacttttttttttttttttttttgagccagagtctggctctgtcacccaggctggagtgcagtgtcacaatcttggctcactgcatcctctgcctcctgggttcaagctattctcctgactcagcctccctagtagctgggattacaggtgcatgccaccccgcccagctaatttttgtatttttagtagagatgaggttttaacttgttagccaggctggtcttgaactcctgacgtcaagcgatctgcctgccttggcctcccaaagtgctgggattaagggcgtgagccaccgcgcccggtcccctccattactccttaagtgtcccttaaagactgtatttatttatttgaaacagagtcttgctctgtcacccaggctgttgtgcagtggcatgatcttggctcactgcaaccttctgcctcagcctcctgagtacctgagactacaggcgggcgccaccacacccggctaatgtttgtctttttggtagagatgggggtttcaccatgttggccaggctggtctcgaactcctgatctcaagtgatctgcccccttcagcctcccaaagtgctgggattacaggcgtgagccactgcgcccagcaaagactgtgtttaaaatactacctttctgttaggtacttgtcatttgccaaaattaaataaaaacagtctaggaacctaggaacctgtgaagtcagtactaaaatctataccaatttactccacaaacccccatcctcctcctcgttggttgagtgtttaataaagccaggcgctttacctatagtctcattaaattaaaaacaatcctgcataggaagtcaggatctcaattttgcagatgaaaaggaggcttatctgggcatgcccagcaaggtctggggaacgccccttaatggagtacttgaatttgtctgcagggagaggtggcatcaccgcactgtaaatagtttccgaggtcaagtttggctagtggcttttagaattggggcagaaggatgccatcctactcccaccttcagaggcatctcaggttctggagctctgtgctaactaagcccacctgtggagggtggcaatggagtggtgacaggcgtgcaaggtttcacgtctttaaagaaaagacagctccaaggacagagagttttttgttgtttgttttgttttttgagacagtctcactctgttgtcaggctagagtgtagtggcgcgatctcggctcactgcaacctccacctcccgggttcaagcgattcccctgcctcagcctcccgagtagctgggactacaggaggcgccaccacgcccggctaattttggtatttttagtagagatgtagtttcaccatgtgggccaggatggtctcgatctcttgaccttgtgatccgcccacctcggcctcccaaaatgttgggattacaggcgtgagccaccattcccagccaattttttttttttttttaaagagacagggtctcgctctgttgccagggctggagtgcagtggtgtgatcatggctcactacatcctctaactcctgggctcaagcgaacctcccactttagcctccggaacagctggaaccacaagcgcacaccaccacatccagctaagttttaaaaaactgtttgtaaagacagggtctcactatgttgcccagggtcaaggtcagatttgttaatccttctgacattgtctcctgttggagttctggatgttcattagttcatcaccatgcatgtgattcacacactgtactcagaaacattcttttttcttgtttttgtttttttatgagacggagtttctctcttgtcacccaggctggagtgcaatggcacgcacgatctcggctcactgcaacctccacctccccggttcaagcaattctcctgcctcagcctcccgagtagtgccaccactcccagcttatttttgtattagtagagacggggtttcaccatgttggccaggctggtctcgaaccccggacctcaggtgatccacctgcctcggcctcccaaagtgctgggattacaggcatgagccaccgtgcctggccagaaacattctttttattcgtttttattataattgtagtaagggccctggtaggggatttgaactgtttctttccacagtgtggaatgatgtctatatacattacagaatggagatatagatatctatagagatctatagatatctatagagatctatatagatatctatagctatatagatatagagatatagatatatatagatatatagatatatatagatatatagatatatatagatatatagatatatatagatatatagatatatagatatatatagatatatagatatatatagatatatatagatatatagatatatatagatatatagatatatagatagatatatagatatatatagatatatagatagatatagatatatatagatatatagatagatatatagatatatatagatatatagatagatatatagatatagatatatagatatatagatatagatagatatatagatatatagatatagagataaagatatagatagatatatagatatatagatatatagatagatatatagatatatatattttttgagacagagtctcaccctgtggctcaggctagagtgcagtgatgtgatctcagctcactgcaacctccacttcccgggctaaagcaattctcccacctcagccacccaagtagctgggattacaggcacctgccaccatgccagctatcttttgtatttttagtagagatggggtttcaccatgttgatcaggctggtctcgaactcctgacctcaagcaatccacccgcctcggcctcccaaaatgctgggtttacaggtgtgagccactgcgcctggcccagaatggagtaatctgatgtggtcttacagataaacacttcacatatgcaagggtgtgtgtgtgtgtgtgtgtgtgttttaactcatcttttccattctcttcccaacccctcctttcccatctgctaccctcaggctacagttcgacttcacagatagaaaaataaaacctacggctgggcatggtggttcacgcctataatcccagcactttgggaggccgaggtgggccaatcgtttgaggtcgggaatttgagaccagcctgaccaacatggtgaaaccctgtctctaccaaaaatacaaataaattagccggtcatggtggcctgccccagtaatcccagctacttgggaggctgaggcaggagaatcgcttgaaccaaggaagcggaggttgcagcaagcccagatcacgccactgcactccagcctgggtgacagagcgagactccatctcggaaaaaaaaaaaaattagctgggcgtggtggcgagtacctgtaatcccagctactcaggaggctgaggcaggcgaatcgcttgaacccgggaagcggagattgcagtgagtggagatcgggccactgcactccagcctgggctacagtgcgagactccttctcaaatgaatgaataaataaataaataaaacatatgatttaccttggcccactataattttgcactacagggtggcagctccgtgctatgtacaagccgggtgccgcgcagctttgatgctgcccaggacactgacctaaaagtgtgtctgcaagtactctcacccttcattcattcaagctttgcctagtacacactttttggaaaccatttcccaaaatgcatgcttttataccacatttcccacccaccagataaccgagacagtgcacgtaacacagtttgaattaaagaataatcttgttttggccgggcgcggtggctcacgcctgtcatcccagcaatttgggaggccgaggcgggcggatcacgaggtcaggagatcgagaccatcctggctaagacagtgaaaccccgtctctgctaaaaatacaaaaaattagccgggcgtggtggcgggcgcctgtagtcccagctactcgggaggctgaggcaggagaatggcgtgaacccgggaggcggagcttgcagggagccgagatcgcgccaccgcactccagcctgggcgacagagcgagactccgtccaaaaaaaaaaaaaaaaaaaaaaacaaagaaacttgtgttggtagacaaataaattcatgaactgcagatataaatagatcgagcactagatatgtttattatctccagcacagcactgcctcctggtgcggattatattccagttttcaaaaggaaccatagaagatacaagcaatacgattttattttggagggatttctagcatcataggtcaaagacgttattaagtatcgactctgaaaaagcaactataaatactgcaaatcgactaagccagaggacgcaaatatatcctgcgtgttgtgtgctggactgtggttgagacttcatggtcgtgctctgggctcatgggggcagctgactgctcataattaagattgctgttgccgctgcctgtgttccaaagagaacacaagaggacagagctaaggtgtaggaatgcggaagaacttgcagaaactagagctagtcttcggattgaaatgaattaccaataaagggttgggaaatggatcaaggagagggaagcgttttgatggtccctgctccgaggttcagcccatttgcagttgctgataaccttgtcaggtcaccagataaaggcaagtcttgtcaccctcaggcacctggctgcgaagtaataaaacggttgccttatcatctaaaggtggagtgagtcaaacctcagcccagggtaattatagtaaactgaaattgcctgtcctttacaaaaaaaaaggcggagggagagagaaaggaaaagggcttaaggcaggaaattgtgtttgtctttctccttggatttaaaaaagaaacgagcaaaacagcaaaaagttttccagggagtgagaaaagcagcccggctagactcccctcaccctgggttaacaggattgccgacagatcaggcccacgtgatggtcaagaaaagaggctcaagctgatgaaaatccaagaaatcttcttaggagccttcctttctaaatgtaaatgactgagtcattgctttgctaaggagggaaggaagttacaatcacaccaagtgactcattcattgctgttagctccggcagttggatgaaaagttttagcaaaagcagcaacaaatgtactttaaatactagcacagtaagggaattcctgtctttcaggatgaatgccatccacacaaaagagctcctgttgacatctcatttacaatctcccccaggacacagacaagaccctttcaataaatccagctcagaaacacctattgttcaaaatcttcaactcgccacaggctaccaccactccctatggctttgcaaaattaaagatttagaagaaggatggggcggtggaagctatgaaaagaggcaggaaaaaagttcctttgacccgatgctgtcagagagcgtgcatgaagaagaaagttaatggtatttccatttatataagaagcgcctaagaaatgcctgtgacgttcgtgaactagtgattgtgaattccaaatttgatgccaactttatgtgtaaagaagctaactcctgccaacatcgtggctgaatgaacagctgggactatgcttaacccattcccagcttataaaagccccatggcagctgcagtgaagcatcaggtgagtctgatatgggctgtctgttccctcggggatttgaatcttgcctgtcctttccaagtggagtcttgtgcctaagtgctagagcccactccttcctccccactgattcccttctttccatttctgccatttcccttcttcttttaataaaacttggacattttctggagttacatgtttttcttgggatgtacttcaaattaaggagcatatttatgtttacaaacacacgcacacgcacacacacacacacatacacacaaaagaatcgggcatttctcaagtggtgatacctttaccctccttatttttcacttaaggttccccatctcagtacacgatccctttatctgccccgagttcaagccaaaactcagcattatctgtaagcactcctttgggtccttctctccagtctcttaaatccctgtggagtcattccacatccttctgtgcatctttctgcttccctagatcctacagttttaatgttatcttctggagtatcacagcaacttccttaactcaaggtttctccaactctgagttgtcacttagtgggtagtgaaataagatgagtcatgcagtttcaccatttagaaaatgcaaaatgttaggtagaaaatgtcagcgtacatcctgtgtagaaaaagtaagtcttgttgtgaaacctctttcagtttgtgtgtgcgtgtccccggatctgtgtacatactgggcaacagggaaaatgcattttgtaggtcaaaatatttggagaaatacgtttctacttagtctcactgggtctgtcttttctgtttccaaactattgtgtacacttagaggaagagtggaaaccctccagcaggtcctgtcagtctgcagtttacaaatctcccctcaggataagagttcctattcacccttttcaggtctcagaattctgcctcctcctgaccacttttcctttagttattcaacccatcaagttccctgggtttgcatgtgcaatcgattcctcgttagggatattctttcctctggtttttccttcagatacgagcttacgttcgacctcttccaagaagacgtcaggaatgtccttctgaatgcctttcctagttctcatgagaacacagcagtttttaatcaggcagagcacttattacattataattatcttcttggttcccaactgaacttttaagttccaagtgggcagtcagtaaatatttcttggtgcatcaaatgctccacattttacacagttaacgtttgctgcctacaaaccaatttggatagttactttaaagtatcttatctctagttctcaaagctttagtttcctttaacacttaagtatctcttgcatattttcttttcaaacactgcttcgttaatttgcaaattcattggactcctttccttaaaaatcaaaataataaaacttcaagaaagctgttgtgacttctggcctctctgaatgtcagatctgtaaacaggaagggcagaactctgatctctaaaatcctctccagtccactactctgaccctctaacttgagctttctccagagaggttaagtgacttttccaaggtcacggagctttttagcggcaggagattttttttgcctgtctatagatttttaaaagctagccgtaaacaaaaaccaaaaagtttaccgaggacactgagtgccactaacaagtttgtgtgaaagagaattcatgaagaaataggagacttcaaacaaaacactaaaatcaacaacaaccataatggattcctgcctaggcaggtcgggacattaagaaaaaaaaaggtctcgctgtggtttgctattagatggagagatattcagatttcatttttaaaatgaaagtgaaagattaaagaattttggcatcctgaccctttgtagaggccattcctcagaggcacagtgtgcagacaaaactatcctagaggtgccaaccagaacaagctctaatgtctgtctcattcctgagccttggtgccttgacgagtcaccacgctcaggaagaaagctgcaactcgccaggatgaaactgggccccgcttcttagaacccttccccgcttccttcccctgccagaaccacactaaagaattcgctgctctcaaagacagacgttttcattacttccttacattatagagtttgggcttagataaccagttgtatgagtagtaagtcaaacagaaatacaacagcaataatacttatttctttccctaattgtaatatgttgtacttcataagccatcatatgcatttgttgcttttcccccttctacactgaccagtagttttgctttgtttgacagaaaagtatagtaagaagaaactgaatttgaagtggattcttacaaaggaaaaagaaaatcactattgtaactataccaaattactatgtatgtgagctcccagctttgacatcaagtcgttacagccacgtaatgggattacgggtgatttttactttattctttgggcttctctgaattttcctatattttgaaaaagcacctgcattattttgtaattataaaaaagtataaataagaattatacacactattatttcttcactgctatgacatgactagattacaatttttttctttttgagatgactttcggtcttgtttcccaggctggagtgcagtggcacgacctcggctcattgcaacctccacctcccgggttcaagcaattctcctgcctcagcctccccagtagctgggattacaggcacctgccaccacacctggctaattttagtagagaaggggtttcgccaagctggccaggctggtctcgaactcctgacttcaggtgattgatccacctgcctcggcctcccagagtgctgggattagaggcatgagccatcgcgcctggcctagattatggaatttttgtattaccatgtatgttgccgtgtaatttttgttttgaaccttttttatttttcttttaattcctttgagacaggatcttgttctgttacccaggctcactgcaacaaggtgattttcccgcctcagcctccagagtagctggactacaggccggtgccaccacacccagataatattttatattttttgtagaaatggggttttgttttgttgcccaggctggtcttgagctcctgggctcaagcgatccaccctcctcagcctcccaaaatactgggattacaggcataagccactgcacccggccttgagcatttgttttttgaaggaaattttatatgattaccacataaaaaaggaatactaaaaatctaacattatttgatatctcactgtctttgaaaacttaaggaacatggacccatacaaggcagccaaatattggccggtaactcctttacaactgggctgcagcatattttattaccttctcctgacaatttcttatctggctgcttatcatttccagaacataccatccttttgcatgcctttacgccagtggcaaacatggttgtttgcctcctcataaccattctctctatcctgcttgctaatgagaccccagtactgttgatcttttccacacagctgtgagttttaggggtggctaagcccctccctacacgtggaggctgaatcttcaccagactaccagacaaagagatgagaagggaggttggatgggaatgttctgggaaagtttacctcactatttaaagccacccaagtcagggacatcctttttcttcctctggactttgtcatctgcaagggatgctggaactgtggctgccatcgggggaccacagaaagtactggcctaagaagaccagctcagctgggcgtggtggcctgtaatcccagcattttgggaggatgcgggcagatcatgtgaagtcgggagttcaagaccagcctgaccaacatggagaagccctgtctctactaaaaatacaaaattagccgggtgtggtggcgcatgcctgtaattctagctactggggaggctgaggcaggagaattgcctgaatccgagaggtggaggttacagtgagcggagagggcgccactgcactcccgtctgggccaatgagagtgaaactccatctcaaaaaaaaaaaaagatgagctcacactggggatgacgggtggaagaaaggccagctgtaatgaacttgctggttttggtaaattcattgccttacccttggacctggtattgtttgagaaaataaattattttgccatcttagtcactttgattttattttttaagttgtatttgtttgcttattgatttgattggcttggcacttatgcagtgactttgtagatgctgtctatgtgttggggctcagaacataatgccctaaaatatggtgacttggcaattgagaaaactgaaggagcaagaaggtcactcactgtgagagctggccacgagggaatgctctgacctatctttgtctgaaagtaggtcataagatgctcattccagagaggtctcgctctatacccagaggcgaagaaggaacagacagctcttgccctactgtcccccagttgtttgttaccgttagataataaatttattctagttgaaatctgaaatactccaaagtctgaaacttttcatttttttgagacagagtcttgctctgtcacccaggctggagtgtagtgcacgatctcagctcactgcaacctccacctcccaggttcaatgatcctcctgcctcagcctcccaagtagctgggattacaggcatgtgccaccacgcctggctaatttttatacttttagtagagacagggtttcaccatgttggccatgttggtctcaaactcctgaactcaagtgagcctcggcctcccaaagtgctgggattacaggcgtgagctgctgcacccagcctgatctgtaatactctcccttgcagtgtcctcagcctcccaagtagctgggactgcaggtgtgcaccaccacaaccagccaatttttaaacatttttttgtagagatatggtctcactatgttgcccaggctagtctcaaattcctgggctcaagtgatcctcccaccttggcctcccaaagtactgggatttgaggtgtgatccacctcacccgggcctgagtcttcctttggaaggctgctgtatcatgtgaaacttatgttaaataaatttgcttatttttctgttactaatctgtcttctgtgataggagtcttagccatgaacctagcgatgggtgtggaatagatatttcttccacacgctagaaaaggctgtgtctgcctggtgcaaatcctgacctgccagttacaagctacttaactttacactattaaatcatcttttcctgagtttcctcatctgttgagttaggataacagcacctatctcatagtgtgatgcggtgagcgaagaggtgaatgtagggaaaggggatagagtgttccacttaccctgtgacatataggaattaggtgctcttcttttttctttccttcctagattatgtgatgcaacaaaattcaaatatgaaaaccatctcggaggccgggcgcggtggctcacgcctttaatcccagcactttgggaggccgaggtgggtggatcatttgaggtcagaagttcaagaccagcctggccaacacggtgaaaccctgtctctactaaaaatacaaaaattaactgggcgtggtggcacatgcctgtaatcccagctactcgggaggctgaggcaggagaattgcttgaacctgggaggcggaggttgcagtgagccgagatcacgccattgttctccagcctgggcaacaagagcaaaactctgtctcaaaaataaaataaaaaattgctttaaaaaataaaaattcatctcatcgctgttctcaattcatatgtcctctccttcgagagggctttaaaaaaactaaaactattttacctcaaaatatacttctttggcatatttttgagatggctgttcagagggcccacaggcaggaatagccctgccaagttgccatttgtggaggagacgtacatctgcagagaaaatctgcagcaatgaaataaacagctaggctttttctgaggccctccgcctatccagacctaggagagattaactgagtctgacacctttgaaaatgtgacagagaaacacttaaccacagactaccttctgttctctctgaggactgctacctgtgagatttaacccacctgtgccctcaccttccctctcccctccctgccataacctattttgccatgctctgagtccctactcctcagtaacatcaagatggtataaaagcatcaactcagccaggggcagtagctcacacctgtaatcctagcactttgggaggacaaggtgggcagatcccttgagcccagaagttaaagaccagcctggcaagcatggcaaaatgctgtctactaaaaatacaaaaaaaaaaaatagccagatgttgtggcacatgcctgtaatcccagctacttgggaggctgaggcaggagaatcacttgaaccccggagatggaggctgcagtgagctgagatcacgccactgcactccagcctgggtgacagtgagactctgtccctcaaaaaaataaaaaaagatggtataaaagtattaactgtatggtcttttttttttttgagttttcatatgtatttttttcctatggcagaagagttttcataatttgtatgactcatgcacatgtgtgcacgttagcgaaatttgtatgccagccatgtgtggcataagcctgtagtctcagttactcagaggctgaggcgggaggattgcttgagcccaggaggtcgaggctgctgtgagctatgatcgcaccactgcactctaccctgggcgatagagcaagaccctgtctttaaaaaaaaaaagtgtatacttttttttcctgttaatttactatatgtttgttttatagactcaaattatcaaggcttcagggggaaaatgtaaacttccctacagctcccctgatcacccagcttacagcagcctcacaccctcccatcccaggcccgcatccccctaactgatttgagatgcctggagaaaataagattgctgctccatcttttataaactacaagttttggggtcggggcagtgcaaagttgcaagcttgctcattcaacccagtcctgaccggctctaccactgcactcgccccagccctccacagccttccaacggcagctgtctccagattccctacgttctagttagcagccttcaccctccccatgaccaaggccccacgaagtctttccaaagcccctgcttgtcatttctgttaacgcgtccccgcctcccacctcgaaattacatagcaggacccgctgcagcccctgcttccttgcaccttggaacatggcagaacttaccacgcgtttctcagggcttgtatggtggacccctgccagtggtttcaaaccttttccgcaccttctctatcaccctccagttcagaaaagacaaaaaggaaaccccaaagaaaatccaaacaaaaaagcttacaagtatgtttctctttgcctccatagtcagcactaattatttccagctggggtagagagcagggtgtggatgggaccaagtcctgttgctaagttcaagtacttgagaatttaacatcccagatcctctccaagctctgctgcagacccctcaactatattcccctagcttaccatggtaacaagccagagggctagccctaagtgtatccacttacattactaaagcgctatcaaatgaacaaataattccctttgcttttcatgcctgaaaggcaatattgtatgatgtttaagaatatggcacagttctgtcgtcccagctgcttggaaggctgaggtgggatgattgattgagcccaggagtttgagtccagcctgggcaacatagcaagatccgatctcaaaatattaaaaataatgtaagttcaggaggccgaccttgatttaaaagtgtgttacctagggaaggttgctgaatctctataaacatctggtttttattgtctaaaatgaggataagaatgaaaaacttccttatagggttgtagagaggctgaaaggaagcaatatatgggaaatgctcagtgtattaactcagtaaatggcatacagtaacaacagccatcaacagttccataaggggaatcccttcattttaaccaggggacccgtggcccttgtgaaaggtctgagaacatctgaagctaacttctacaccaacgtggtcagatgatgccatcccgtatccatggcaaccagatgtctccagtatctagtttagtgccaggcgggtggtgtacaatgaaacaacagaatcacaggctgcaactctgctgttcagttcattcgttagtggaatccctgtaacacactcaaaattctgacttcataggacctttgaattacagtttcataaaagaagttctgaaacattgaccaatcatttcatacacattttttagttattctcagatgatggttgctgatgtaaaaataaaacaaccaaaacctttgtgttagctatatcttcaagtctatcacaatattttagtccatttccttttttttttgagacggagtttttgctcttgtcacccaggctggagtacaatggtgcaatcttggctcactgcaacctctgcctcctgcgttcaagcgattctcctgcctcaggtcctgagtagctgggattacaggcgcccgccaccatgcccggctaatttttttgtatttttagtagagatggggtttcaccatgttggttagtcttgaactcctgacttcaggtggtccacctgcctcggcttcccaaagtgctgggattacaggcatgagccaccacgcctggccttttagtccattttctattgctaatgtaagaggaattagattaggaagtaggtttttgaagacaaattttcaggttacatgaattgttggtagcacctcacttcataagtaatattagatataaaacccttctcaggaaaaaaaaagttagcattctggagaaaggagtaaaggaaacaatggtttattgtcttccgttttgttttgtttgtttttcagagggactcactgttgcccaggctggagtgcagtggcacaatcatggctcacggcagcttcaacctcctgggctcaagtgatcctccttgcctcagcctcctgagtatctgggaccatgggtgcatgctaccattcctggttaattttttaattttgaattttgcagagatgggggtctccctgtgttgcccaggctggtctcgaactcctgggctcaagccatcctcccacttcctctctaagtgttgggattacaggcatgagcctggctaggaagcaatgttggcccacagtgtccagtgcccagtactcttaggaagtatgaatttatgaacaattaacgcccagatgagttaacagaccttgggtataaattggttggtctgtgtccaaaggcaatacagttttatgcttcattttattaccatctgtggaatgggacaataactacaggatggctgttacagtgaatattaaagacttaaaatatgtaaaagccctttgtaagttgcaaagtgctatgcagatgctaggcaaagaagccacagcagctacccagtaacagttgttacttttttttttttgagatggagtttccctcttttgcccaggctggagtgaagtggcgcgatctcagctcactgcaagctccgcccccaggttcaagcgattcccctgcctcggcctcccaggtagctgggattataggtgcccacaaccacacccggctaaagtttgtatttttagtagagacagtttcaccacattgaccagactggtctcgaactcctgagctcaggcaatccgcccgcctcggcctcccaaagtgctaggattacaggcgagccaccgtgcctggccagttgtcacttttttctggctccagctgagtaacatttccaaaccacaattcttcctggaacagcataagttgtgttggccttggccaatattgaactggggttctgggataccgcaaagtattatatacaatttgcataaatgtacatttaggctgagtagaaagggagaaaatgctgtaaaaattaatatgggtcaaaagaaatgatctctaatcataaattgcacacttcccctctcaaccatccccaaaacactcataatatttgatatgaaaataccatggtggcaaatagctgtatcaaaaagaaactattctttcattatagcgtagggtgaagctaagtagattttaagaattactggagtctcccgcactttgggaggccgaggtgggcggatcacctgaggtcaggagtttgagaccagcctgaccaacatggagaaaccccgcctctactaaaaatacaaaaaaaaaaaaaaaagagccaggcgtggtggtgcaggcctgtaatcccagtttcgggagcctgaggcgggagaattgcttgatcccgggaggcagatgttgccgtaagtcgagatagtgccactgcactccagcctgggcaacaagagtgaaactctgtctcaagaaaaaaaaaaaaaagttattggagtcaaacataacttggagaggagacaaaataatttatttttattttatttatttatttatttttgagatggagtctcactctgttgcccaggttggagtgcaatggcacgatctcggctcaccgcaacctccgcctccaggttcaagtgattctcctgcctcagcctcccgagtgactgagattacaggcgcccgccaccatgcctggctaatttttgtattttttagtagagatgggttttcaccattttggtcaggctggtctcaaactcctgacctcatgtgatccgccagcctcggcctctcaaagtgctaggattacaggcatgagccactgtgcccagcagacaaaataatttttaaaaagatgcataaatagagttgataattttggtggtatttgagtaaatgagtagaaaagctgggactggaaggtgtattgttaccacatagttggtgctgattggggagcctctattttcttgactagaaactcacttctaaagagaaagagcacagatgcctgttaacaaataggcttcaggacgaccttttttgaatttccagcagggaggaaaactgggtcacaagaagataatctcaggggttgctggaggattggccttggacacgcccaggtgaggagagaaaacacccaagggagatgttgacagcagagagggcattgaagcaagtctggccagtaggaaaatggagccgatggagatgggggaggccaagaaagctgcatttttcattgctttgtctgaagcagtgagccctgggcacacttgtgcagtagctaaaatttctcaagtctgtctctgtaggcaactggagacaccctgacagcctgtttcccccaactggctccagcccaaattaactcactctctcattccctgagacacttgcctttgagaggtaaaaatttagctagtttgataagagaatgcattttaggtggggagggggcattttagcaggaatttttgcaaacatttcttccctcaagggtaagaaatgtgtattttaaaagggaggtttctataaagttggccttaactccgagggatatttaaagtggggaatttctggcactgctaacagacccatagtgcagctaagacctttctgtggctctcaaatcataatgaagcccaggaaggagaaatgaaattgtatactttgcctgtcacaggcatagagttctgctgagtaatttgtacgtgggattattattccatttcacagatttagaggtgcagctaaagttgacaggctggtaaccagccctcgggagactgcattttccaaaagtggctgcaacaatatcttccatctgacatgtccttctagaacaggtgttcacaaactttttctgttaaaagccatccagcacgtattttaggatgtgtggatcattcgctgtctgacctgactactctatcactgtggcacagccctgggcgatgtgtacatgtacagccttgtttgtgtttgagaggtgagcccattcggtggtctgagggcgatagtttgccaatctgtgctctagaactttgctgcttcccttcaagaggtagagtctaggccaggtgcagtggctcacacctataatcccagcactttgggaggctgaggtgggaggatcccttgagcccaggagtttgagaccagcctgggaaacatggtgaaaccccatctccacaaaacaaaaaaaaaaaaaattagcctgctgtggtggcgtgcacctgtagtcccagctactccagaggctgaggttggaggatcacttgagcccagaaggtcgaggctgcagtgagccgtgattgtgccacttaaaccaccctaggcggcagagggagaccctgtctcaaaaaaacaaaaagaaacaaacaaactggaaaaaaaaaagaggtggacgaattcccttttccttgaatccgagaggtttgtgatttgcctataattaagacaattggaaggaagtgacactgcatgacctctgaggctagatcagaacaggtgatgtaacttttaccagtcagcacataagtagcccagctgtcctgaggctgccatgctgtaaggaagcccaagtgagtccatgtgaaagaccacctgaaaagccttgaaactgtaggagatgctcagccagccccacttgctccagccctcacctggagagactgcaagctcaggagagatgctgagccagaactaccccgccaaagctctccccaaattcctgacccccagagactgagaagtgatgagatgattgctttaagacattaagttttgggggtgatccgttgcatagaaagaaacagaacattttccccaaactagtgagtggcagagatgggattcaaactgaggctggcctgagcccaatcacctgatctttctattaaaaataaacaaaaaatactgctggctgggggcagtggcttacacctgtaatcccggcactctgggaggccaaggcaggtggatcacctgaggtcagaagttcaagactagcttgaccaacatggtgaaaccccatctctagtaaaaatataaaaaattagctgggcgtggtggtgggcgcctgtaatcccagctacttgggaggctgaggcagaagaatccgggaggtggaggttgcagtgagctgagatcccaccattgcacttcagcctgggcaacacgagtgaaactccatctcaaaaaaaaaaaaaaaattgttgaaaactgctgacacagagacatgaagtgagcacatgctgttggaaaaatggtgttgatagacttgctccatgcatggttgccacaaacccttgatttgtgaaaaacacatctgcaaggcctgataaagaaaagtgtaattgccgggcatggtggctcactcctgtaatcccagcactttgggaggccaaggcgggtggatcacctgagctcaggagatcgagaccagcctgggcaacatggtgaaaccccatcactactaaaaatacaaaaaaattagctgggcgtggtggcaggcgcctgtaatcccagctactcaggagattgaggtaggagaattgtttgaacccgggaggcggaggttgctgtgagccaagatcgtgccattgccctccagcctgggtgacaaaagtgaaactccatctcaaaagaaagaaagaaagaaagaaaagcacaattaaacaatgtgtgcctgtatttaaacctatattggctagtgagtttgaccagagtctaacaaaggtttatcaaggaaaaatgtcagagaattcagatcctgtaagtcaaagacacaacctgttccaggaaggactttgcaacagcaattactctaacaagttacaattcgcagagtccggcctttaaggggctttgaagagagagaaacccatgaatcaataataagataaggctatttggtttgtttcaacttgcgggctgtttgacttccgtatcaaagccatgccttgagaatgaaatcatttctgtcaaacagccctttcaaagaacatccgacacaaacactcactggctgctcctttatttccactgtgtccagggtgtgtatggacttggtggaatttaggggaatagctgtgaattgtgcatcaaataaataacctgcagggagttggcactggtgactgctagccataaatgttgctatttgcttacacaggttaagcctgggcttttggaggcttctttgaccttttctgcctttttcccaaccctaacccaacatagctatgacaaggcagttctgggccgggcagggtggctcacgcctgtaatcccagcactttgggaggccgagacgagcggatcaggaggtcaggagaccgagaccatcctggctaacacggtgaaaccccgtctctactaaaaatacaaaaaaattagccgggtgaagtggcgggtgcctgtagtcccagctactcgggatgctgaggcaggagaatggtgtgaacctgggaagcggagctggcagtgagccgagatcgtgtcactgcactccagcctgggtgactgagcgagactccgtctcaaaaaaaaaaaaaagagatgattaagttaattgggtcattagggtcataatccaatatgactggcgtccttctaagaagagagacagcaggacctacgtgcatagaccaagtgaggacagagagaggccagccacccgcaagccacagagagaggcctcagaagaaaccaccttgctgataccttgatcttggtctcccagcttccagaactgtgaggaaataagcttctgttgtttaaggcaccccatctatggtacttagttatggcagccctagcaaactaacatacccacaaacagagaattcacagccttaaggctgggacttcagaaaaattccaaaggtaataagcagaaatttcaacatgcaagagtctagccttttagcgcagtttctctttctgcatctttcccaggtggcctgcaggcaggatggtaaagcagtgctgggggctgggcaggggcgctgctgacctgcaagtctagtggggtcactaaggtctcttgactcaaaagggaagggaccagggttccagtcctagaaagtccagaaagtagcagggagactgagtaggtgtttggtgcatggtcaagaggcccatattgatgcaagtcactaaccccttccctcttctagccgccctagtccttccttctctcctcttcttccagtctctttgacttttcccaccaccccgtcctgcgacactgctttattatcaggtaagtcagaagaaggggaaaatttggctttaccttctgacttagcgtcatgcaaatcctgatgctcttttagttttttccttttttttttttttttttggtgggagatatgggatggaaggatatttgccggagttggtttttttttgttttttgttttttgagatgaggtcttgctatgctgccgaggcttaagtgcagtggctactcatagaccccatcattgcgcactacagccttgacctcctaggctcaagggatcctcccacctcagcctcctaagtagccggaactataggtgcatgccaccatgcctggccacctgctggagtttaagcaggtggtaggatgggtggatggtccctaaagacacccatcttttaatctttgaaatctgtggatatgctaccttctagggaaaaaaaggacttggcagatgttagtaagcatcttaaaatggaaaagttgtcctagactacctgaatgggcccaaagtcatcgtgaggtccttataagagggaggcaggagggtcagagacaaagacgatgatgtgatgatgggggcagaagtgtgtgtgtgcgagagaggagcagaggggttgaagatgcacctctgctgctggctttgcagatggaggaaggggctttaagccaaggaacacaggcagcctctagaagcccgaaaaggacacagattctcccctatgccctccacaaggaaaagcagccctgccgacccatttctgacttctgacctccagaacagtgagatgatctgtgttgtgtaaagccactccgcttgtgggtgtaactggtgacagcagcaataggaaagcatacaggctgcaaggatgaaaatcctcgagaacaactgctatcacattttattattattattattattattatttttgagatggagtttcactcttgtcgctcaggctggagtgcaatggcaagatctcaactcactgcaacctctgcctcctgggttcaagtgattcttctgcctcagcctcccgaggagctgggattacaggtgcccactaccacgcccggctgatttttgtatttttagtacagacggggtttcaccacgttggccaggctggtcttggactcctgacctcaggtgatccgcccacctcggcctcccaaagtgttgggattacaggccagagccaccacgtccggcctggtatcacatttaaacaggcagtgatgtgtgaccagaaattatacatatttctagagctttcacccttcaaacagtggttcccagaggttggtctcccaccagtagtgtcagcacctgggaacacgtgggtcaaatcctcaggctccacccaggactactgggtcagaaactctggaggtggggccagcaccctgtgtttgaacaggtccttctggtaattctgaggcatgctaaggttcaccttaaagataagtgacctggggctgagttcagtggctcacacctgtagtcccagcactttgggaggctgctaataatagctatgattattatacctgccctgacattatcttctgtttccaggcttgacatataaggatcctatacaagatttcacctacacaagagattcaatccatcttaggttctgctaatgacctcccctcctaaggttcatcaaagctgaagcgggaagaaggcttgaggataggagtttgagaccagcctgggcaacatagtgagaccttgtctgttaaatcaagtttagcctaaagtggcctccttacatattttaagttcagcctaaaggtttctctgtacatagtgaactatatacaacctaaatggaggtataaacccactgtaacctactcttgtgccaatcagagagttttggccaaagggggccaactgttcaaaccgtgttcaaataaggcaaacgccaagctgtagccaatccaactgtttctgtacctcacttctgttttctatatgttactttcctttttctgtctataaatcttccactgcgtggctgcactggagtctctctgagctaccctggcttgggaggctgcctgattcgcaaagcattctttgcttaactaaactttgttaagcttaatttggctaaggtttttctttcaacacgtccctgcaaaaacttaaaataaaagaaattagctgggcatggtggcatgcctgtaatcccagctagtagggaggctgaggtgtaaggattgcttgagctcaggaggttgaggctgcagtgagccgtgattacaccactgcactccagtctgggtgacagagtgagaccctatctctacaaaataaatacataagttaaaagtgacctgggctgctgctttgccaacagagggtacctgtggagcctctgatgtgcgtatgggtagtgtatgtgtatgttggctgtgtgtgtacccactgactctacaattaagctgattcttttttttttttgatatggagtctcgctctgtcgcccaggctagagtgcagtgacgtgatcttggctcactgccagctccgcctcccaggttcatgccattctcctgcctcagcctcccaagtagctgggactacaggcgcccaccaacacgcccggctaattttttgtattttttagtagagacggggtttcactgtgttagccaggatggtctcgatctcctgacctcgtgatctgcctgcttcattctcccaaagtgctgggattacaggcatgagccactgcactcgtcctaagctgattatttcatgattcatgcttggcttgggatctgggaatgatggggaaagttactctctcaaagattggctctgtcccctggggaatgtgggaggagggagagtccagaattcggcttccaagtggccacaagtctggcctccttcacccagcctgtgcctgtgtccacaggacaagatccaggctgacagccatgcactgccacaccactgtcccagactggggcaagcagaagggggctgtttcctctcatctttccccaatttcttgcttgccagaggcaatcctaacttggctagcggaaagataatcacttttgaaaacatgagtgaggtcagcccttccagccacagcctggagtttgaaattacacattcattgatttctttttttttctttttctttttttttgagatagagtctctctctgtcgcccaggctggagtgcagtggcacaatcttggctcattgcaacctccgcctcccaggttcaagtgattcttgtgcctcagcctccccagtagatgggactacaggcatgtgccaccatgccctgttaatttttgtatttttagtagagaaggggtttcaccatgttggccaggctggtcttgaactcctgacctcaaatgatccgcctgcctctgcctcccaaagtgctgggattacacgcgtgagccaccagcctggcctgatttcagtactggaatggcctcatgtcagctgggtgatcttgtgtgctgcctctctgtgtccccatgtcctcactggtgaaacaggcatgctaaaagcattgatttaagagagttgttgagaggatcacatgagataatcaaggaaaaagtcttagatcagggcctggaacaaagtaaatgtttaatcctattaatgcaattaattgtggttaatgacatgtcataattaatagctatgattattttcacgagccctgacattatcttccatttccaggcttcgcatgtataagaggtcctagacacaaattcacctacacaagggattcagtccgtcttaggttctgctaatgacaactcttcttgaagttcttcaaggccgtgtgaaaaggaaaagccagccgggcacagtggctcacgcctgtaatcccagcactttgggaggctgaggcgggcggatcacctgaggtcaggagtgcgagaccagcctggccaatgtgtctctactaaaaatacaaaaatcagccgggcgtggtggcgcatgcctgtaatcccagctactcaggagcctgaggcaggagaatcgcttgaacctgggaggcggagcttgcagtgagccgaggtcacactactgcaccccagcctgagagacagagcaagactccgtctcaaaaaaaaaaaaaaaaaaaaaggaaaacccccctagaaaatgcttttcccgttgcttccctgctaatgggcctttttcatcagggcagcctccagccttaggatgtggccggtccccgtgcggatgcccgtttcccctcctgcctgcattcatctgaccggttcagtgggatctggtacttttcctccctcctcctcgtgctgggcttccacatcatccagacagctgctgccacattccaccgctccagcagcggaagtaaggcacatttaggccctttctgggtgagtgacagcatttgagatgagattaatcaaatgccagtgttaggggaaagcagcctttccctgagtcacctctgctccacctttctcatgacacagagcatgagcctgtccaacggttggcctgtgcgtcaacctctggccaggagacaacgggcgcctgtgacctgggcgtgaaccgtctgtttgtgcgcataggtctgacactgctgctgggcgagcctgcgtgcccctgccccgcggtccattgactgtgccgctgagcacaggcagggatgtgtgcctgtcgccctgggccgctgtcccctgacggcagatgagatattcttccagctcaacactgatgttgcagggtttttcctcacctaccgcatgacgactgaatgaaagcattccaggaaaccaaaagggctgggcaggcctctggaatttcaaagccgacagcctggccctgctggcagctcatttctgccgcgtcattttctctgaactgtaggagtagttttgtagcaaacttatcaccaaaatcccacaaatgttaagcattacccttcttagaaaggaaaagcctacttacttttccccattggaagacttcaattttttaagattcaagaaatccccaaaagtcatgataaagaagagggaaaacagactgagcatacccatccccttttaaattcaaatttattttgtttttttctgcttagctacagggaaggtttgatcatatcacatctgagttaggccatatgcacccagggggaatctcaagagcaaactaatctaaactccaagaaatagaccactaagacccacccaggtagtactcactgaacgctcttcctgcctctcataagaaccaaaaatagcggtttcccgcagatgctcccagaagcaaagtctacctaccacacacacaatatgcagaagggaaaaacccaagccacaagtccctaaacgcctgagtcgtgactcatggaggctgtcctccacccctgccaagtataagaaatgatttctacccacccacttctctaaggagatggtccctcattcctctctcccgagcaggcttcacagcccccttcatagagatgaagccctagtcattaaatgcccagtgatgttacgactgccaaattctatgactatttggaaagttttatcaggtatggatacactccacctatttgcttaggtggccaagatctctgtgcagttgcacagacagtttctgtcctcccaccccgtgagaggttgtgtgtgtgtttgcgggggctgggaagctaatggagggaaggagagacctcctcaggtgagtcaccttgcagtggaactgcttcctgtgtgtgtgaagttcttcaaggaggcaccacttcacgcaatgccccaaacagaaaaatcgaagcaaattagcaaattattttctaggagattagatgttggacaacttcaagctttcacaatagaaaatggcttgttttaaggcagttaaacccaaagcatgccttttttggggttttgtttatgaatatgttgtaatctaagaagagtaatgttcttacagaaaaattagaccttcatgattgcaatctaagtgagaggcaattaggcttatttttcttagagattagtacatcatgttagttcagaaagcatttgtaaaacagaaaaaaaaaggaaatcataaatatcaatttcatcttaacacaatgcaactatcactgttctcaacctgagttcttaatttctggcatgtcacaaattccttgaactaccaatgttgaactaacctcccctgacccagggagttgaatagttttttcaaaggatatgatcaaatctctgttcatgcatgcctacatttattcattttccaaaagcataaattaattctgagggacagaaagtagacttgtgcttgcctaggtttgtgggagatgaaaatgtggctgggagccatggctcacacctgtaatcccagcattttaggaggctgaggcaggaggatcatttcagcccaggaattcaagaccagcctggacaacatagggagacccatctctacaaaataaaaaaattagcccagcgtggtggcacatccctgtagtgccagctacttggggggctgaggtgggaggatcactttagcccgaggttgaggctacaatgagtagtgatcgcgccagtgcactccagcctgggctacagagtgagacccagtctcaaaaaagaaaaaaaaaaaaaagatcaggaatggcggctcacatctgtaatcttagcattttgggaggctgaggtgggaggattgcgtaagcccaggaatttaagacaagcctgggcaacatggcaaaactcagtctctacaaaaaatacaaaaattagctgggcatggtggtgggcgtctgtagtcccagctactcaggaggctgaggtgggaggatcacttgaatgtggggggtcaaggcttcagtgagccgagatcacaccactgcactccaccctgctgggtgacagagcaagaacctgttaaaaaaaaaaaaaaaagcaaagaaaagaaagctggatgtggtagctcatgcctatcatcccactactttgggaggtggaggtgggcggatcacttgaggtcaggagttcaagaccagcctgcccaacatggaaaaattttgtctctactaaaaatataaaaattgtggtggcgtgcacctgtaatcccagctactcgggaggctgaggcaggagaatcatttgaacccgggagggcggaggctgcagtgagctgagatcacgccactgcactccagcctgggcaacagagtgagactctgtctcacaaaaaaaagaaaagaaaatatttgaagctaagactgtggtgatggttgtacaactctgtgagcacacacacaaaaaacgctgaattgtgcactttaaacgagtggattttatgacatatgagtcatatttcaataaggtcattaacaatgtacctgaaagaattacatggtctcatgaaagtactgctaacattttattagtgctagtaatttttttttaatagagatgagggctcactatgttgcccaggctggtcttgaactcctgagcttaagtgatcttcccgccttggcctcccaaagtgctaagattacaggagtgagccaccacacctggcctagtgctagtaattttttgtcagttgtttctggtgtgtgattactaatacaatgctcttgagaagaacagattgcagaagtttataggcttctgagctcagggaaggcactgaccgagtcccaggcaggcaaatgcagtgagtgaatttgttcagtccaatgtgttgtcagtttccttcgtacagttccatgagatagaggaatgttaggcatatatgtttgctttcttatcccccatctttcctgtccttctcccacacgctacagtcctacacgctatccggatgcttctctaatgggtgggcgtatcagaattttgaggaggaagacagtgaagagcaggtagtttttgtaatttgaaaaaacatacagtagtttgtcttgtaatataatatttagttgtggggcattccttctttctctgctatatatatttttagagatggggtcttcctctgttgcccaggctgcagtgcagtgatgtaatcacatctcactgcaacttcaaattcctaagctcaagtgatcctcctgccttaacctcccaagtagctgggactgcccatctaattaatccctccgctattttttctttctttcttccttccttccctcccttcctccctccttccttccttttttttttttttttttttgagatggagtctcgctctgttgtccaggccggagtgcaatggggcgatctcggctcactgcaacctcccacctccccggttccagtgattctcctgccacagcctcccgagtagctgggattacaggcgcgcaccacacctggctaatttttgtatttttagtagagatgggctttcactatgttggccaggctggtctcgatctcctgacctcaagtggtccacccgccttggcctcccaaagtggtgggattacaggcgtgagccactgcgcctggccttgtgctatattctttttttttttttttttttgagacggagtctcgctctgtcacctaggctggagtgcagtggtgtgatcttggctcgctgtaacctctgcctcccgggttcgagcgattctcctatttcagcctcccaagtaggtgggattatagccatgtgccatcacactcagacgatttttgtattttcagtagagacgaggtttgaccatgtccgccaggggtcttgtactcctgacctcaagtgatccacccacctcagcctcccagagtgctgggattacaggcatgagccagtgtgcccagcctattcttaaagaataattacaaaatgaagattccgaaaccaccacgtaggccaagctatagaatgcctccgagcctgcagttcacattccccgtgcatcttttccctgttacaaacccctcctatcccagaagtaactagtctgctgatatttgtcattattttcttgcctttagtatttctgcatgcattcctaaacaatatagcttgattatgcctggttttgaactttaaattaaaagaagcttactacatatatgtattcttttgtattttgcttcttttacttaatgttgtgggttgattcacctatattgtaattacatacaacttgtcaatttccattgctatatgaaaataccatttcattgcatggaaataaacaataaaaatacattttactatagatggatatttagggtttttttggtatttgaacaatgccaccatgaatattcctgtcctgtatttggcacacaagtaaaagacttttctagaaaatgttcgggttgtttgctatgagtttcttcataatgtcaaataatatttttaaaaatgtggatattgtcccaacatacactcccataacagtgcatgagaattcctattgctgctgcatatctttgccaacatttgatattgttacactttataattttttgtggccaggcacagtggctcacacctacaatcccagcactttgggaggccaagacaggagtttgagactagcctgggtaacacagcaagacgccatctctaaaaaaataaatagctgaggtgggaggatcacttgaacctgggaggttgaggctgcaatgagccatgattgtggcactgcactccagcttgagtgacaaagtgaggctctgtctacaaacaaataaataaaaataaaaaataggctgggcgcggtggctcaaccctgtaatcccagcactttgggaggctgaggcgggcggatcacgaggtcaggagatcgagaccatcctggctaacacgctgaaaccctgtctctactaaaaatacaaaaaaattagccgggcgtgttggtgggcgcctgtagtcccagctactcgggaggctgaggcaggagaatggcgtgaacccgggaggcggagcttgcagtgagccgagatcgcgccaccgcactccagcctgggcaacagagtgagactctgtctcaaaaaataaataaataaataaataaaaataaataaaaaataatgaaataattttttgctaacctggtaggtgtgtattggtatctcactgtggatttaatttacttattttggattcctaatgagatgagcactttttgcaggttttgatatttcgatgtccctttcttgtgaagggcaaagtttgaacacaataggcaaatgtagcaatctttttaaaaattttcatgctcttcatattttatttcagaaacttcccctacccccatatcattttgggaagctttattgtttggcctttcacatttaggtcttaaattcaactagaattgcttaggagggctggagtataaagttgtaatggttaattttatgtgtcaacttgactgggccatgtggtacccagacatttggccaaatattattctgtgtgtgtctgtgatggtgcttccaagtgagagtattacattggaatcagtagactgagtacagcagattgctctccccagtgtggttgggcctcattcaatcaattgaagaccggaatagaataaaaagactgaatatgagagaatttctcctgtccgactggttaagttggggcatcggttttttccagccttcagacttggcctgaaacattggtcctccttgggttgtgagcctgcaggtcctcagactgaaactatccatcagctctcctggttctcaggctcctggattcaagctggaagtacacatcaggtctcctgggtcctcagcttgatgactcgagatcttgggaattctcggcctctataactgtgtgccccaattccctataataaatctttgtctttctctctctcctgttgtctctgtgtctctgaagaaccctggctaatacaaaggtatagtccaattttattttattttttttccaaataaatactcctcagtgacagcaccatctactgaatattgtcccttccccactgaattgcaaagatgcctctcaagcttccatatgagcacgggactatttctgtaatctgtagtctgttctgttgggctactgccctgtccttgtgctaacaccatgtcttattactataggctaattatgaatcttgatgctcaatagggcaaatcctctaattttgctgcttttcaagagtatcttggctgtatgtggcactttgcaaaaactaaaacacaacaacaacaacaaaattcaggtttttggttgatattgcattaaatttatagatcagttttaagtgaattgacacctttctaatttgcagttttgaatctttttatttattttttatttttattttttttatgagactgagtctccttctgtcgcccaggctggggtgcagtggtgcaatttcggctcattgcatcctctgcctgctgggttcaagcaattctcctgtctcagcctcccaagtagctgggactacaggcatgtgccagcacgcccagttaatttttttttttttttaagtagagatggggtttcaccatgttggtcaggctagccttgaactcctgacctcaggtgatctgcccaccttggccttccaaagtgctggcattacaggtgtgagccaccgtgcctggctgactctttttatatgactttaggagttagtctagaaattctaatccacatatttaacttactaatatctagacttaatacccttaaccttttcttagaaaatacaaggtacttaaaacactttaactcctgacttctactgggttatatgtatttttaattctgtcttttaaaaaatattctggacagttgtggtggctcatgtctgtaatctttgcactttgggaagctgaggcaggaggatcacttgagctccgagttcaagaccagcctgggcaacatagtgagaccttgactctacaaatagtaaaaatattagctaggcatggtggcgtgtgcctatagtcccagctactcgagaggctgaggcaggagaattgcttgagcctgagaggtagaaactgcagtaagccgtgattgcaccactgtactccagcctgggcaacaaagcaagatcctgtctcaaataagtaaataaattaaataaaattcacaagatgtaatttgttatttttattttattttttcaagacgaggtctcgctctgtggagtgcaaatggcgagatcatagttcattgcaacctcgacctcccaggctcaagcgatcatcttatctcagccttctgagtagctgagaccacaggtgtgtgccaccacaccgaattttcttattttttgtagaggcaagttctccgttgcccaagctggcctccaactcctggctcaagtgatcctcccacctcggcttccccaagagatggggttacaggcatgagccactgtgcctggcctcacaagatgttgttatctttgttttacactatcaatgcccatgcgtccttacttaattattaaccactgtattgctgttcattcttcctgcatctcatatcttccatcagggatcatttttcttctacataaaataaatcatttgtaatttcctttagcggtggtctgcagtcttcatttgagggtgtctttattttgtcttcattctggaaaaatattttttcttttctttttttttttttgagatggaattttgctctttgttgcccaggctggagtgcagtggaccgatctctgctcactgcaacctccgcctcccaggttcaagcgattctcctgcctcaacctccgaagtagctgggattacagactcacgccaccaggcccagctaattttgtgtatttttcgcagagacggggtttcaccatgttggccaggctggtcttgaactcctgacctcaggtgatctgcctgcctcggcctcccaaagtgctacgattacaggtgtgagccatcatgcccatcctaattcttataatccaacgtcttaatccttggtgggttgtttctctcatttatgatgccttgtttccttgtatgcttggttatttttgacagtgagaagattactttccttgggagcttattttggaaggttatatgtggcctagaaaaagtctttttttttctgtagaggattatcatttgaaatatatcattcatggcttgaagttttttggaccgttcaggtgatgtaaatttgggctgaggtttgaatgagagctcatggttacaacttctcatgaatggataacccccaattttagtaccaagacaagtgtttgtttttgtgttttgagttgagatggggagtggatcatatggcaatgactacttgctcatctttacctttagggtataatctttttggggtgccaggtttatgggatagaattttcctattaggctacgccttgggcaagttttgggctttaaagtctgcttctacctactctaggtaccatcaaagcctaaattgggctgggcacggtggctcatgcctgtaatcccagcactctgggaggccaaggcgagcaaatcattcggtcaagacattgagaccatcctggccaacatggtgaaaccccctctctactaaaaatacaaaagaaaaaaatcagctgggcatggtggcgggctcctgtagtcccagctactctggaggctgaggcaggagaatcgcttgaacccagaaagcagaggttgcagtgagctgagatcatgccactgcactccagcctggtgacagagctagacttcatctcaaaaaaaaaaaaaaaaaagcctaaactgaagatcaagctgaatagatagggagggggagtgctttgcatgcttccctcaggggaatttatcagaattaagagtggaaggtggggatttctgccagggatgattatgtatatgtatgtacagtatataaaaacttagcttggattttttaaaagtttagaaacactattctgtaactgtattcagtcctgttttctaaaatttcactgaaattgcaattctacaaattctgtaatgaagttcctttatattttgtgattccttagataatgtgctaaaagctatagatacttttctccagaggtaattcacatatgcacacatgtatacacttttattataatttcaaatggtttaagagaccctctaaagtccattcatggagtcagtgtaagaacgtaagctctaaaaatactgaatactacttgaatttccataagtaaaggaatagttaaataactacggccatgcatgaaaacagaattttatgaagacattaaaaagaaggtaactttatatttaccaatatagatagatgctaaagatacaatgtcaagtaaaaagagcaatttgcccagcatattagaataattttggttgtgtatatatattatgtatgttatgattccatttgtgtatgtgtatagaaaatatctgaatacacaagaattttggacaatgtggctggatgagtattatacacaagaatacacaagaaatttggacaatgcggctggatgagtattatagagacttttttctttaaaataagttatctttgaacatccccccccactataaatttgtatactttttttgcatatattaaagaaaaaaatcaaattaattaaaaggtgaatcttttttataatacataatgttttatttataatctactccaaagaaaaaagtgactttgtatttattgctattcaagtgagatccttttctgtagctgaaaactttgatctccctttccttctttgtttacctaaaggttaagagacatttttggactttccatcctggcttgactcatcactggttgatcatcttgcttttgattctcttcttcaagttttcaatttcttatttatgtgtaatgccctgacattataataataaaatccagatagatgtaaattatattgagaatattgccttcatttctatatgaattcacttaatttatgtccttttaagacacactttgtgattttaatacaaactggttcatggattattaattcaaattatgctgttatagtcaaccacatgagatgaggtaattggaaagataccatgttcttacataacgatttggtctctgaatgactgaaggactctccctgtcatttatttgtacagatgaatttattcgaaggtgaacaaagtaattctaatctttaccaaacattaaatttcctacttgatatttcaactcaatgacatccaatttttttaagcagagtaaattttctaactttattatctgacatacatgaggcgtgttgaataacattagaaaagagacattttccctggctcctgttagagcagggtttggaatgaagcagggaagtgtgtataataaacatagaaatcactacaatagaagatacatgaaatgtccagatgttctctcttactgaccacagaaagtttcatatacaaactagtcaagagtctggttgtctgtcccattttttttttttttttgagagggagtctcgctctttcacccaggctggagtgcagtggcgggatctcggctcactgcaagctccgcctcccgggttcacgccattctcctgcctcagcctcccgagtagctgggactacaggcgcccgccaccacgcccggctgatttttttgtattgtatttttagtagagacggggtttcaccttgttagccaggatggtctcgatctcctgaccttgtgatcctcccacctcctcggcctcccaaagtgctgggattacaggcgtgagccaccgcgcccggcctgtctgtcccatttttttgtcagcaaataggagctccaccttcttggccaactcattcattcattcttgcagcagtgggtgtggtgacctctactgtgactagctgaggacaacctcctggggaccagggaagctgctggggatgtactttaatgagaatactcaccagcagatggccaccatctctgtcttgcagtcagttacttgctaacaacttccttatgtttaacccaattctctcttggaatgtaaccccctaactttgaattctaatcttcaaaaagaaagaaactggcaatatccaatttgtaagccctcattcttcccctcataactatgtttaaatagtcagcaattccatgaattcaatctcctcatcccatggatgacttggtcttgacaggccttcctcaataatcactggattttctgcctctaatccagacccttcctaattcactcttcgaaatgccttctgagttgtattttgaagaaagcaactcaatacttcattcactggcttaaagatcttcaatatctcctcatttcctaaagaatgaaattcaaattccttgaggggattttgacagttgggccctttatcttctgcctcttcctattctctccccacatacctttcgctcttttctcagatatgtgtatggtcctgtttccctgacttgacacatgcaacccttctgcttggagtttccactctccctttctttacctggccaactcctatcatccttcaggtgtgctgtcacctctcctgtgaagccttcctaggttatctgctttgtcctcatgctctcttagcctttaaaggctgtcttttacacctttcattaactaattatagatttctgtctccccaagagataagaacccatgtcctcactatttctgagtccagaccctatagagtgcccagttcaatagaatttgttttcaattatacttttgtatataatttttgttggtttgttttttgagacggagtctcgctatcttctaggctggagtgcagtggcactatctcgactcactgtaacctccacctcccgggttcaagtgattctcctgcttcagcctcccgaggagctgggactacagacgcacgccacaatgcatggctaaattttgtatttttttttagtagagatgggattactctatgttggccaggctggtctcaaactcctgatctcaagtgattcacccgcctcggcctcccaaagtgttgggattacaggcataagccaccatgctcggccacttttacatctttttttttttttttttgagatgggatcttgctctcttgacaggctggagtgcagaggagtgatctccgctcactgcaacatccgcctcccaggttcaagtgattcccctgcctcagcctctcaagcagctgggactacaggtgcacaccaccacacctggctaatttttgtattttcaatagagacggagtttcaccatgttggccaggatggtctcgatctcctgacctcatgatccacccgcctcggcatcccaaaatgctgggattacaggcgttagccactgcgcccggccacttttacatgtcttaaatgagttcatatgtctttctaaggaaactcaatcttttcctaagaacaaaactgaactatcacaaaatgaacccctggatgtccctgattatccaataggcaacagtgataccccatccttttgattgttgtaaaattttgcagtgtatgtttatggatatttgcagggatagtgagtgagcaagaaaggggcaaaggctgatcaaggaatttcatttcttcctaattttaagacccacaatctggtaatataaaatgatacgtgcaaatccctagaaaagtctccatctgaggctctcctcttgtttgccttctagaaacacgtttagtttatttggtaaaggagacacacttcgctcctggtagcactttcctatatctacgattttgctcttttaaaaatgtttttctaggccaggcgcagtgcctcacaactgtaatcccaggactttgggaggctgaggtgggaggattgcctgagcccaggagttcaagaccagcctgggcaacatggcaaaaccctgtctcccccaccaaaaaaaaaaaaaaaaaaaaaaattagccgggcatggtggcatgcacctatagtcccagctactcaagacaccaaggtgagaagattgattgagcctgggaggtcgaggcttcaatgagccatgattgtgccactgcaatccagcttaggcaacaaagtgagatactgtctcaaaaattaaaaaaaaaattctagttatttaaatattatatcaatataatacacagagttttgttaaaacttatccaattccaaatatattagaaagactaatgcctgacttacgtttctttggcacctaatgtattttcaattcataactctatggtttgttgcattatcactattgtaggtttttgtgctaggtagcttttttttttttttttttttgagacggagtctggctctgttgcccaggctggaatgcagtggcatgatcttggctcactgcaagctccgcctcccgggttcccgccattctcctgcctcagcctcccgggtagctgggagtacaggcgcccgccaccccgccaggctaattttttgtattttttagtagagacagggtttcaccgtgttagccaggatggtcttgatctcctgacctcatgatccgcccacctaggcctcccaaagtgctgggattacaggcgtgagccaccgtgcccggcccttttttttttttttttttgaggcagtgtttcactctgttgcctaggctggagtgcagtggtgcaatcatagctcactgtagccttgacctcctgagctcaagtgatcctcctgcctcagcctcctgagtgtctaggactatggacttgtaccgccatgcctggctagtttttaaaagttgttttgtaaagatagggtcttatgatattgcccagtctgttcttgaactcctggcctcaagtgatcctcccacctcagcctcccaaactgttgggattacaggtgtgagccaacatggctgtcttttctccccccatcttgtgattttatattttgtttttcttccctcagtcacattaatgtatatcttactgccttggatgacatcttaatgagatatttatactttataaagatcacagtgactattctgttaatcttacatttttaaaagtgtgaaaattttaagaataatatcaaattcttgaggcattatgtgctttctgtttttaacatcaggcaaacattcaatatcatcagtacttgataccattagtatttgattcctacattatcaagagaacaaccctaaatgagtctgattataacaaagtccaataagatcctaaaatggtcacattggcttatggcatcaaagtggatattagataaggttgcaatcgttgtataaatctcatttcctttcatctactttatctaaccacacttagtgataaatccacaagaactccaaaactaatgctacactgtgccttcagtttcctaagatagctttttaccctcgtcggttttgaaaggaaaaatctggccaggcacagtggctcacgcctgtaatcccagcactttgggaggccaaggcaggtggatcatttgaggtcaggagtttgagaccagcctggccaacatggtgaaaccccgtctgtactaaaaatacaaaagttagccaggcgtggtggtgggtgcctgtagtcccagctactcgggaggctgaggctggagaatggcttgaaccctggagatggaggtttcagtgagtcaaaatcatgccactgcactccagcctgggcaacagcgagactccatctcaaaaagagaaaagaaaagaaaagaaaagaaaagaaaagaaaagaaaagaaaaatccccaaagctgtgaaccatgacctgggtgctattagcagcgtccagaggagcctgcacagaagcacaggaagagcacgaactgatgctttgtggagatagcacagggcattggcggtcacggggctagaattttgtatgggaatcacagcccattggcttaaaaggaatcacagcccattggcttaaaatctgattacagatgaggtttctgaagggccagcttggcatatcagtgactcaggcaaaaagcctctgaaatctctgatgcagatgatgatgaagtaacagtctggtgaacataatacaccattggacataattgttctcctgctacctgcagagttgcctttttttttttttttttgagacagagtcttgctctgtcgcccaggctggagtgcagtggcgcgatctcggctcactgcaagctccgcctcctgggttcacgccattctcctgcctcagccttcggagcagctgggactacaggcgcccgccaccacacccggctaattttttgtatttttagtagagacagggtttcaccgtgttagccaggatggtctcgatctcctgacctcgtaatccgcctgcctcggcctcccaaagtgctgggattacaggcgtgagccacggcacccggccccagagttgccttttaaattaattagcctagtgagatagggtacattattttttttccgtatccctcacagctcgtaggatagtagtgtcttccctgtgatagatgcttaataaatatttatttaaaaaatagatataaataaatacaggggtaacttgacataaaagtcctacttaaggactgctgtgggctaagtactatgttgtcctgttctcttctcactccagactacgtgctgaagtccttgatctatagcccaagcaacagagaatggcacactcttaggagcaaagccagaattgtttccaacatgcaataatagtataccatcttcgaaagcacttcaaagcaaccaggaaagtcaggacctgctacacagcgagacagacagcgggcgctctcagctcaggtcggaaatgaattcttggttgaacaagtgatggaaaccaacaaagctcccaaactgaggagaaaccaagcacgtggagacaccggcaggtcaggccccaggggtggttccccagtgtcccactgctgcactcaggaccctggggtcatctaatctgatcctgtgctcttcctataccatgcttgcaaatgaaagatgtttcctagctgagggccaaagacgtgatgaccaatgccaaaagcggagcaacccggcagtttcctgtgctttacagcaaaccttatgtctgcttatgtccagaatcattctcaatctcctttctccgccaatatgactactgttactattacaagtactatcaccatttattgagtgcacacaatgtgccatacattgtcctaagaccttattatgtattatacaatttaatccttactattattgtcattcaaatttttaatgaggaaagagaggcacagagaagtcagtttatttgcccacagtcatatggctactaagcaggaaggccaggattcaaaccaagcagtcagaatctagaactaaattcttaacaactacactgtacaaaacattttcttcatgaggcacagcaaacaagagtacactagtattccatacaagtaagacaatgtattatatgtaatactatatgtgtgtatgaacatttattacttaattacatataactagtattatatatcatatattaatacataattattaattaatgtatattatgaaggattctcagggcagtcattccattgaaaataagacaagaggccgggcgcactggctcatgcctgtaatcccagaaatttgggaggccaaggcaggcggatcacctgaggctgggagcctgaccaacatgaggaaatcccgtctctactaaaaatacaaaaattagctgggtgtggtggcgggcacctgtaatcccagctactcgggaggctgaggcaggagaatcgcttgaacccgggaggaggaggttgcggtgagctgagatggcaccattgcactccagcctgggcagcaggagcaaaactccgtctcaaaaaaaaaaaaaaaaaaagaacataagacaatgtacacatatatatatacacacacacacacacacacacacacagacacacacagtatataatactgtcctctatggcaacaatagtagattggtttttctgtaataaattcataacaaatacttatatttcactctacagtttgaaagtcctttcacctcatcatctcacttagccacatagcagtcctgtaagggcatagaacaggtggttgtctcatatgtactatagatgctgggcctaggcttatgagcctttcaagaggatacaaatgtttgagtcttgaaaaaagagtcactggctctaaaccatgaacagaaaactgcaacatgaaaactaataaaaatttagttaaatgcctttggacgctaaatctctaaccggtctctgtgggacagtgctgcttctgttctgtcttcagggatctgtctccactaacacctgggtccccttcttaaacagtgtttcatagaccagtgcctgtcactgtggacacacgtgctaaattatgttcatttacctgaagtccattgtcattatccacaaacactcctccgctactccctcaccccatctcattagattgtgcctggaagcattggtactgcaggttgactatcccttatccaaaatgcttgagaccagactgttttggatttcagatctttttgaattggattggaatctttgcattattcttactcgttgagcatcccaaatctgaaaatccaaaatccaaaatgatccagtgaatacttcctttgggcatcatttcagtgctcaaaaagtttcagattttggagcattttcgatttcagatgtttgaatttgggatgcttacctggcatatgtaaatgtgagatttcactatgcaccatctccctcagatagtttaaactgcttttagccctatctggagataggtatactgaaaaggagggtattactgtggatgacttcaaggattcaattattactcactcagtcctgcatttgaaactttatgaccttaagctagtaccttttccatgccttttttggttttctcctctacaaatcaagggataataagagtggctactgagttactgtgaagtattaatgagataacatacgccttgcctttgcttactataattatgaacgtattataaagtgctcaacaaatgttagctctttgtatcataagccttcatatcttcttgataagatacattctttgtccagaacttaaaaagcacaccccagagctaagcattttaatatactgctggtgggagtacaaaaggtacagccccttgggagggggatatggcaatgtctagtcaaaccagctactcttcgacactttcacccaacaattcaacctctaggagtttatctgaagatatgcctccccacatatgaaacaactagactcaagttattcattgtggcattatttgctatagcaaaatattggaaataaactgcacatccatagaagattgtgtgagtgaattatggtacaatcacccaatagactaccatgcaaccctagcaaagaaggaagaagattttaataaaatgaatgatttccagaatatactacagaattttgaaaagcaaagagagtgtataatatgccaccttttgtatacgtagaaacgggaggacagatgaaagaaaaagaaagaaagaagaaagaagaaaggaaagaaagaaagagagaaagaaaaagtaaatcaaaaccaaaggggtattctctctaatatataactccaacaactcagtaagaaaaagactaacagtcatctaaaaaatgctgaaggaggccaggtgcagtggctcacgcctataatcctagcactttgggaggcagagacgggcggatcacgaggtcaggagatcgagaccatcctggctaacacggtgaaacctcgtctctactaaaaatacaaaaaattagccgggcgtggtggcaggcgcctgtagttccagctacttgggaggctgaggcaggagaatggcgtgaacccgggaggcagaggttgcagtgagctgagatcgcgccactgcactccagcctgggtgacagagcgagactccatctcaaaaaaaaaaaaaaaaaaaaaaatgctgaaggatatgacatgacagttcattgaaaaggaaatacaaatgactcaaatataggttcaacattgctcataataagagtattacaaatggaaaacccaaaagtttgatgaaagagtacgttgatgaaactgtggagaaacaggcgctttcaacagtgctggtggcactcctagtggtgtccactgggaaagcctacggagggtaatttggcagacttttgccaatgaaaaaagcatgcatgctttctgatagatataattagtgctcacccatattgtactctcttctcctaccagaaacacacacaaaaactgtacttcttggccttcctgaagtttggcagggccatgtgactagttctagccaataaaatataagtggaaataatgtttgtcacttttggttcaaggttgtctctcccctgcggcaatgactgtgaaggctgtgggttccagatggtgcaggcacaagacccaagcctgggtctctgagagactgtgtggagcaggaatctcctgcaaaacgaacatcacaggacatgtactaggggttggaatatttttggtatgtttattgacagatttgagagttgtttgttattgtatgcaaaacgtaacctcattaatacaatctttgacctcgtaactccacttcagggatttatcctgaagacatattaggacaaaattatatgtttacaatactattttattttatttatttatttatttatttattgagatggagttttgctcttgttgcccaggctggagtgtaatggcgcgatcttggctcactgcaacctccgcctcccgggttcaagtgattctcctgcctcagcctcctgaatagctgggattacaggcgctcaccaccattcccggctaatttttttatatatttagtagagatgaggttgcaccatgtcggccaggctggtctcgaactcctgacctcagatgatccacccgcctcggcctcccaaagtgctgggattacaggcgtgagccactgcggccagcctattatttatttattaaagcactgtatgagaaagctaaatattgggactaattaaatgtgtggcaaagaagaaactggttatgtaaattgtaatatatccatatagtagaatactatgtagctgcaaaacataactagaaagttctctatggaaatatggaaatattactaagacatattgttaagtgaaaaaagcaagctgtacaatagtgtacatagtgtactatcctttgggtaaaaaaggggaaaacacatactcataatgtttaaatatgcaaaaagcatacatctatgtagaaaaaagaaaattggtcatggtaggttacctgttaaggggaatgggaactgtgtattgagtcaatgcatttttccctcgtattttaatttttttgtttttcttttttgagacagggtctcactctatagcccaggctggagtgcagtggaggaatcacagctcactgcagcctcgacttcccaggtgagaggatcacctgagcctcccgagtagctgggactacaggtgcataccaccacacctggctaatttttgtatttcttgtagagacagggtttcacatgtggtccaggctgccatatttcaattgttgagctatgtgaatatatatatatttttttaatacagaaaatgaaaataaataaataaataacatccttttctggctatgtattgcctgtaggaactttgaaaatgtatttccaaccagcattcccaacttcatgcctggatgttttcccttgtgggcatggagctgcagtcacatctgactcctggagggctaggcgtttttcatccttctgtctgtgtgcaggcttaggtctccctcaatgagccctccccttcctgtttgcctctgcatagcttgcaaaacctagacatgtgcactggggcatccttctgatctacccaggcagagttcctaggctgacttctatgttcacataattccttttatatattcctgccattgcattcattatattaagtcataatggcctgttcacacgtatgctgccttctctagatagaagaaccatgtctggctcatctttccatctttctgtccccatggcctgggatagggcatgaaatagtagtaagggcatttattaactttattcatgagttttgtcataaacagattaataagcatgaagcaatagagtataatatgtcatgtttggaaacagtctttctgtgcttcctgccacagacctcagcagcctgaatcctttacatcatcgtgccttacaaatactctatatgagactggtatgccctaaatcatttgacggtggtagttttcaaacgtcttatttttaatgtgatgagtattcactcaactaatgctactccaaaacaatatttttaaaaaaggaggccaggtgtggtggctcatgcctgtaatcccagcagtttaggaggctaaggctggaagatagcttgaacccaggagtttgagaccagcctgggcaatataatgagacctcatctctacaaaaataaaaagttagccgagcgtgatggcacacacctgtgatcccagctactcgggaggctgagatggaggatcacttaagcccaggaggtcaaggctacagtgagctgagattgtatcactgcgctctagcctgggcaagatcctgtttccaaaaaaagaaaaagaaaaagataggaaaagaaaacaaataaaaccctccatacttaaaccaaaaccataatcagataaagaaaaggaaacagttgtgtagagaattctaatcatttttcttgagtggttttgattgcatcaagctcattagttagattgccattagattacatgtaataaaataatatttaatttagtaaaaaacaaattcatgttatttagacacatgatcattgctctttaaaaaatattgtaacagccgggcacggtggctcatgcctgtaatcccagcactgtgggaggccgaggcgggcagatcacgaggtcaggagattgagaccatcctggctaacacggtgaaacctcgtctctactaaaaaatacaaaaaattagccgggcgtggtggtgggcgcctgtagtcccagctactcgggaggctgaagcaggagaatggcttgaacccgggaggcggagcttgcagtgagccaagatcgaactactgcacttcagcctgggcaacagggcgagactccatctcaaaataaataaataaataaataaaatatatctattgtaacatcaccgggtgcggtggctcacgcctgtaatctcagcactttgagaggctgaggtgggtggatcatctgaggtcaggagttccagaccagcctgaccaacacggtgaaaccctgtttctactaaatacaaaaaattagccaggcataggtatggtggcttatggcggtaatcccagctactagggaggctgagtcaggagaatcgcttgaacctgggaggcgcaggttggagtgagctgagattgtgccattgcactccagcctgggcaacaagagtgaaaatccatctcaaaataaataaataaataaataaaaatatacatgtctatatatataataacatcaagcaaaagtagcagcatatgaattttttataatttaatttttgagcccataaaaacaaaaacgataacaaaactataaataaatatctaaaatatattgaatgcctacatgctaaacagtttactaggtacttcaacattatctgattttatttaagctccttttttttttttttaaaccgagacttgctctgtcacccaggctgaagtgtaatggcacgatcttggctcactgcaacctccgcttctggggttcaagcgattctcctgccttagcctcccgagtacctgggactacaggtgtgtgccaccacgcctggctaatttttgtatttttagtagagatggggtttcaccatgttgaccaggctggtctcaaactcctgacctcaggtgatggccctccttggcctctcaaagtgctgggattacaggtgtgagccaccacgcccggtctatttaagcttcttaatcaactggagtgctaagtagcattaccccattttacagatgaggaaagtgtggtacagacggagtaacttgctccagattacaacacagccaggaagttatggctacgaagtttgaacctaggactgtcctatatactgttctatactttcttccaatatgtgttccaaacacaattttaggagttcatatttaaggagggcatgtataaaatcaacaatgggatatagaaggctaaaaaggaaattaaatttgcttctctatctcttaacaggtgcatgtttaagaaacactgtactcagcagaagtgtaccaggtttccttctgccttcacttaagcacacatgtcggttaaagctaggaaatagctgaaaatctgtattttcaaaacatttcacatccttaaggcttctggactggcatctaattttgcattttgttgaaacattgctagaaaaatcctttggccttcttctcagtgaaaccaaacaaaacccataacgtatgctctttcaacttaaagcatcaatggattcaacaaaaccgttgtatatacagctgtggcaatatttacgcatgtaaagcatcttagttgaataccaaattcaaacaaaatcaatacaaaatggattttacagttaattttaatgggtgtgatgtatcgtttaagagggtgtgatttccgggttcataacatcaagtgatttcagcagttgtctacattatggtgtgttccaaaattaatagtaaggtcagactatagttttagactgaaaatatcaaggccattttctaaattcgggcttgaaatactagaagtggctttgatattactattgaattggcttcaaagactgctaattagaccattgtctttaagaactgccttcttatgcaatgtaatagagttgcttgttctttaagagtaagagttttgtttacattgaaaactttcactagactgccaaaataacaaaaacaaatacacagacattgaaacttatactcttgaaaaacaaaaagaaaagagggaaaataaatcagtgacaagtggcagattatcgtttgcagcttgcctttgatttgtaaatgcctacttcctgccccagggaggagggtgaagggtaggttatggtgcttgggatgcacactgtcttctgggttatgctaatttgttgttaagtgctcaaggccgcttattcagcacagatttgattagtttttggctatacagttcaaagatttatgaaaagttcctctctggatagctgtggttgtatttactttggttctccttattcaaaaactttcatatcgttgatgagtggtgacaaatggcttgctcaggaacactgtgccagtataaactcttttgtaataaaacacaattaatattgatgaaatcagtcttcagtcagcacttgtttgttgcctgaaaacctttcctctcctccccaccttccaggactcaaaaaacagactgggggacaatctcatctgaatcgaacactccaaactggggctgtgacttgcccctggcagatgccacaggtcccagaaaggtgatcagagagctctatccaacacgaggagtcgcttccctctaaggactctcaaaggggagaagcaaggatttataaactggctctgtttgtggctttgccgaaaatgaaactctcagcagtgtgctacaccatgattctagtagaaatgatcattagacactggaaagaggaaagcgggaaggagagcacctactgccttccgtacactgtgttaaggctttctctctagcatctagtttagtctctgcaactgccccaagagaagtctttattttattggctaggacactgaggcaaatagcggctccttgccagacccttccagccactggttggctttctgttgcctagggtcccccttaaactttcttctacactgtgcagaaatagaaaagggcagttggaaaagaggaggagggagagggaaacaaagaggggaaaagataaacttaaaaaaaaaagtaaaaagataaatgtgagagagctctgagatgaggtcaatggttggtcatttgaggtcaactttatctgaggtgagggtaatcacaagatgacaaatggctaacccttggaaatttctttccacacatcttccagtttctgggtcacgtggctccacctctgccatttcaggagggtcctcgtcttaggaagctatttgggaaactctcaatgctcccagagacattactgttttttgtttttttattttttttggaaacaggatcttgctctgtcacccaggctggaatgcagttgcacaatctcggctcaccgcaacctccacctcctggattcaagcgattctcccgctcatcctcctgagtagctgggactacaggcacctgccatcatgcctggctaattttttgtatttttagtagagacagagtttcaccatgttggccatgctgatcttgaactcctgacctcaagtgatgctcctgcttcagcctcccaaagtgctgggattacagttgtgagtcaccgtgcctggttgaaacatttatatttcataggaatattttggctggatgcagaggctaaggcaggaggacagcttgaggccagcagttcaacactaccctgggcaacatagagagaccctgtctctacaaaagaaagaaagaaaaaagaaacgtttagccaaaagtataatgacaagtaaagatacatctgagaagagaacattcgtttgtttagtgtggtgctccagcctccacgtcatttttataaacaggatgtctgggtttctttgcagaaacaagtttcttgagttttgttctcagtttctataatattccatttagtattcctgacacactgccacctaccacgctggtggaaggaaggaaggaactccttctgggagatagctctatcctatctctgtcagttatctgactaacattttgatttccggtagtaaaaatgttgaaactggccaggcatggctgctcacgcctgtaatcccagcactttgggaggccaaggtgggcggatcatgaggtcaggagttggagaccatcctggccaacatggtgaaaccctgtctctattaaaatacaaaaattagctgggtgtggtcatgcgtgcctggaatcccagctattcgggaggctgaggcaggacaattgcttgaaccagggagttggatgttgcagtgagccgagatcacaccactgcactccagcctggcgacagagccagactctgtctcaaaaaaacaaagttggctgggcacggtggctcacgcctggaatcccagcactttgggaggctgaggtgggcggatcatgaggtcaggagatcgagaccatcctggccaacatggtgaaaccccctctctactaaaaatacaaaaattagctgggcatggtggcaggcgcctgtaatcccggctacttgggaggctgaggcaggagaatcgcttgaacccaggaggtggaggttgcagggagccgacaatgtgccgctgcactctagcctggcgatagagcaagactctgcctaaaaaacaaaaacaaacaaacaaacaaaaagttgaaacttcattctcagtttactactggtggtaaatccatcagcatctgtttattaaaggatttaccacagtctaccttgacacgctgagcacatggctttgctctaaaaatagaaagattcagctgggcaaggtggctcatgcctgtaattccagcactttgggaggccaaggcggtcagatcacttgaggccaggagtttgagaccagcctggccaacaaggcgaacccccgtctccactaaaaatacaaaaattaagccgggtgcagtggttcacgcctgtaatcccagcactttgggaggccgagtgcagtggctcacgcctgtaatcccagcactttgggaggccgaggtgggtggatctcttgaggtcaggagttcgagaccagcctggctaacatggtgaaaccctgtctctactataaatacaaaatagccgggcgtggtggcgggcacctgtaatcccagctactcgggaggctgaggcaggagaatcacttgagcccaggaggcggaggttgcagcgagccgagatcacgccactgcgctccagcctgggagacagagcaagactgtctcaaacacaacaacaacaacaacaacaacaaaaaacaaaaagcaaaagttagccgggcgtggtggcgcgcgcctgtagttccagctactcagggggctgaggcacgagaattgcttgaacctgggaggtggaggttgctgtgagccgagatcacaacactgcactccagcctgggcgacagagcgagactctgtatcaaaaaaaaaaaaaaaaagaaaagaaagaaagacacaatgacaaaggcagagttcacctacagagggaatgacatcaatacattaggaatatttttaatacattaaatccctttggggtgtttttggacacctggcttgtcatactatgaacaacagaatttccttaaaaagtttttattttagagacagggtctcgctctgttgaccaggctggagtgcagtggcgcagtcatagctcactgtagcctcaaactcttgagctcaactggtcctgccacttcagactcccaagtagctaggactacaggtgtatgccaccacaaccagctaacttttacaaaatattttttgtagagatgagggggactcgctctgtggctcacggccgtcttgaactttgaatacctggcctcaagctattttcctgcctcgccctcccagagtgctgggattacaggtgtgaaccaccgcacccagccctcatttatttgatttcttcagagaggctcatctgttcctatatttagaaatgtggaacttttccaaagaagacaaccttcatttttttcatacgggctttcaaaagaatgtgatgtccttttggtgttttagattctcacctatgaggtataaacaaatcgccttgcagacaagtctcaacacagaacacatgctgcttatcactggcaaagacttgcatcagcctgccaccacggctggctcatcttgtccctccaggcctgtgcctgctggaacactcccactccccatgtctgaatacaccacttcggttggaccaagagtttccagctcgggtggcccctccttccctggaaataaatagctgcctatagaatatcagagtcattctgactcaggggtgactcagctcttccatgacctgtgttcccacttctccttgataaggccaatgttttggccctactggtgaaaatatgtagacctaacatctatctccctgctccagtttcaagagaaaagaccttattcagagaaatatttagaagactcttgtggaattcttgctgtgagtggtttttccttccctgccattggtgcgactgtttcccccttccgtcaaattgctgtctagatgtttctctctgaccccaattttctcggagtttgggattatcaatctaaaatcagaggtgagaattcatcagtgttatcgataagactttgcaattatttctttcaaactgaactttttccctattcacttatttttcctcattgcaaaataatcaaagcattgatgagtgtttctgtttaaattcaaaggacattccacctttaaccttagcattcatgagacacaaaatgggtttttctttttgctgatttaaaaagctgctatgaagctgcacagtgcggaagagggcacccctgctccagaaaagaagaaacaaaactgcctgccatagacacttggtagggagtggcaaatggaatcttggtttgtttttctcttaggactttgacaattatttttccttgaaaagaataagagaatctacctaaaatattaatactagtttcagagctctaggataatatagagcagagtctcttttttttaaaaaaggaaagcggtttcatttctgacagtggatttcttccactgatgtgcacactctttgacatgaaaagctgcacgaagctgccttgaattcattctgcagatggaaagttgcaagtacggtaattagctaagcagtggcaaggccgaccatctgaggtttgatttctcatcaagagatagtgtccgacacacgtgccactgagcatgcttgtaagagttccacgtttcagatgcactgagaatgcatgcatggaacacacgtccccccagcccaacaaccgcactcccaaattgcccctgcacacatatattctaacacggttacaacacagcatgctcccgagcctcagacaataagctgcccaaaaagatgctcaagcaacagtcgcagtgggcctgacttctggtatccgcagccactccagagaacttcctgtgagccccagggactcagaggaggctgagtgatgaggaaggtggccagaggctgccggactagccccaagcagtcactctgcttcctgcctttgttttccctcaaactctcatctttctggagaaaacaaaaccctgtcctgggggtgtagaccagccatgacacccactaataacctctagcaaaacaatagttttaaaattacttaatgctctcttgactttctgacttttaaaatgaaaattgtattttgtcactgtatccttttgttggcaagtggaatactgcactcaaaccaagcaggcaatgtaaaactatgacttcaaagccattccttgataaaacatcaaaacggcccagagtgaaccaactgttatctgtaattcaacagataattaactgaaactcagtgctcaaattgctactgggagtttctgcagccaaggtcattctcatggtgctgcttgattttgtttctgtgtctcttatatcgttttaggcagggaggaacttggattgtccttcagtaaaattccactttgatgcgcaaagcgaacttgaatttctgcttggcctaccacaggcctgcaacatgcactttctcctcgaggtgagaaggtctttttctctccactctgaaacaccgctgcctgcaccttttgctgagtttagagtagcatcatactttctgccacgaatgccacaaatactgccttttcaacttggttttgtaaaatgtaatggtactaaatccgccaaagggataaagcacccttactttggatttgccagtcccatgggtacataactgacctactactctcccacctcccaaccttgaaactccagccccctgaacggcctcaccactccaacccccactgcaatttcccactccccacctccatgcattgcccattcaccaagccagccacatctccctttaagttgaaaactcacccgaaagcccactacctcttccatgcagcctcccctgattaagtgaggatgaagaaacctccaaagcatggccgacaaactcccaataaacgagaacacacacccccccaaaacaaacacagaaactcacaaaagaagaaaatgacacattctctacttttgatttgtgaaactcctatggggctaaggagatcaattttataccaataaatcatttcagaaaatgaagtcattttaatattcttggggttactcagcaaaacactttgcttggacgtctcttttgtactttccttaaattcttcttccttttcttctcggctttttgaacgtatgactgaagggaactgccactcactgacacggacaacagtaaaggaacttggtcttcactatgcctcatagtggtgggtcacactgcccaggaggaacccgcaatgagaccggcaaatgccttaaccatctcattgtctcatcaggaagaagcttaaatgactcttcttgctcacatacttcctgggcaaacatgtctgctctgttgggataaaggacgctctagaccaggctctgctgaaagatccagggcaaaggttcctgacaagactatgtccagcctcaaataaggccacagaagagcccaggctcgctgacgagcaccggctccgaggcagtcacatcaggagacagaaacagacatgttggtgctgccctctcaggtcagtgcaaatgccacttgaggagggctgagagctttgcagcataaaatgaccagaacaaggagaaacacagatgcaatggcaatagctggcaattcgcacatggcgtcaaacaccactgccacagaagctttttagctacaagccacgctatgcaacctttaagcaaaacattattgattttgtggttgtaaaaacataccttcaactgcagaactcagttttatgacaccttgaataaaaacaaaaagtggcagttatataatggacccaaatcgccttttccaggcttctcataacacacgcatgcttcagatttggatttttctttttctgctggcattgcaagaacgtaactaaacaaatatcaacttcaaaaataaaataatttttagtcttaactaggtctcatggatgtcttcttttcccccactaaaaccatttggggaaatttttcactaaaaatgggatcaaacatgtttttggatgggacaaaggccaagtctgcctgagtgactatttctgtgtataaattataccagattatggatcaataaaagttcacacaataggatgctagggaccagcacttcctctttgatactgtatctagagatcatctgatgcatgttaggacagagtttctgttgaaacatgtaacaggtggttaaaaaccatggtgtgatctggtaactttcttctctggggtggttgggccagagcccttttcttggtctgatgggtttagatttcagctccctcaagtcagagagtgaacgggttatctgagcaagtcaagttgttcatgaagcaagtcagtacccttgactgatatttatgcacctttgcagtgaattttttttttttttgagacagagtctcgctctgtcacccaggctggagtgcagtggcgcaatctcggatcttggatctcggctcactgcaacctctgcctcctgggtggacgccattctcctgcctcagcctcccgagtggctgggactacaggcgcccgccagcacgcccggctaattttttgtatttttagtagaaacatggtttcactgtattagtcaggatggtctcgatctcctgaccttgtgatccgcccgcctcagcctcccaaagtgctgggattacaggcgtgagccaccacatttggcttttcggtgaatttaaaggtgaaaataccaaactaagataaattagacctgataacaatcatttgatttaaagagcactttttataagtcatagttaaaaataaataatattatctaatcttacgcaatagtcatgatcatttaggctgaacaaaaatgtctgcagtttcattcggttgaagtcctggttctctttcaaactggaggagtttgcaaacaaaattcttttcaatactggtaaatcaaattggtatctgtatgaacatacactgatttttaacagattatgttcacattgctcttccttatgactttctggaaaagctgcttttaagtttgtttcctattgaatttcatctttcctgcataaccaatggtgtctggtccaacgttgagtaagaaacactataggggaggaagtatgcatatacatgtccatatgtttattataaattttgctgatacgaaagatatgtggcacacagtctataagtaacaatgaaatatacagtattctttatggcaaattccatatagtgaattggttcccatggaattctttttttttttttttttgagacggagtcttgctctgttgcccaggctggagtgcagtggcgcgatctcggctcactgcaagctccgcctcccgggttcacgccattctcctgcctcagcctcccgaatagctggtactacaggcgcccgccaccgcacccggctaattttttttgtatttttagtagagacggggtttcaccgtgttagccaggatggtctcgatctcctgacctcgtgatccgcccgcctcggcctcccaaagtgctgggattacaggcttgagccaccgcgcccggctcccatggaattcttttgttcatcttggccaaactcttgtatctgtagccagcagttcaaccatgatcagacaatcattcattcagttgcatctcagtttgcccttttcccaacaaacttactattattatatcttttatgtgatataagttatttttattaaataagcctctttcagcttcaatactatgtcagtacccataccatggcatatttgtcactgtacataaagttgggcagagatgtgcagtgatcacaccagcatgtagtatttccaccatacgggtatggtagaatgtaacctcaagagcatggatagaaacatgactaggaaatgatgagttttaaatgtttataacttttgtttttgatataatttatctaattgtaagttacacaatttaatttgtaataatgggcttccaaaatgtctgaaactgtaacgtctggctcttgcaagctggtatgaacccgctttagggcaccactgccataactgatgcttccttgtgtcaggcccagggaagaccttgaacttcagaatacttcctgagatcttcataaagggggtaatcatttaattgaacaagacaaatggaagtaaacttaggatttgctattattttttgccagttatttcaaaacctgtgaagcctttcattgcaaaaataaactatacatacatcaccttagagataacagtcattgacaatcaactagtataatcacaatataaatggatttgacattcttttggtcaggcaactaaaccaaaacgcaaggtcaggtacaagtaattgacttattaagcaatgacctcatcttttcagagtagaattcttatatacatcagaatatcaagtttttcagccatattcatttttgagtataatcatggtgtcagcaaatgtcattcaactgaaaagacaacaatgtgctctgatcagtatgtagaaacagagttcatgcaagaaaacaagaaaatttaaacaaatcatcagggaagacaggggtggcagtgaaggagagcccaatcatcatttactgagttggggaaacaaggtaagctcaaatacaaacaaaaattagatctgtaattatcaacattgttttaagaaaaacgtgtgattcactagctccaaatagacttctcttatatttttaaaccccaagtcaaattattctgtatagtaaggtaggcctttatattgggaagtaactatgttacagtgaaaatttagaattagctatatctagttagataccttatattaacatgatacacaaaattgtacaacgagtgggaaagatcatttatcttaaaatgtaaatgtttttaaaaattttgaatatttaagaagggattgatgttgatattaaaaagctacacatagcactgctgacttccaggacacacaatagacattatctggtgtgtggctgacattgacattgcctggaattcagggtaagccgtaacacatacatttatacacacacacacacacacacacacacacacacacacacacggatgctaccaccccccgccgcccccacccccggtttctttttcatagtctgcagaagtgtttgaaaatacaattgaaaacaacaacaaaaaacaaactcaactgtttttctctcagctcaatatctttttttttttttcttattttttgagacagaatctccctctgtcgcccaggctggagtgcagtggtgcaatctcggctcactgcaacctccgcctcccagcttcaagcgattctcctacctcagcgtcccgagtagctgggactacaggcacgcctgaccacacccagctaagtttcgtatttttagtagagacagggtttcaccatgttggccaggatggtcttgatctcttgacctcatgatccgcctgcctcggcctcccaaagtgctgggattacacgcatgagccaccgcgcccggcctatttccctatttcttctacttcatctcacatgacttttccccttattccggacccattagccacatggtttctttctgtgctttgcaatgctatttcctttctgcccttggctggtgtacttgcggctcgctccctcttgcctgctgccctaaactgcccaatcttcctataaccagctcttttcttttgttcacatttgacttcaaatataacttcctcagagagtcttccttgattactatatttagagcaggccagaaataactctatcccattgctcttatttatttatttgtttacttaatttttattttttaaaaggattgggggtgggggtctcactttgttggccagcctggccttgaacttctgatttcaagcaatcctccagcctcagactcccaagtagcagggactacaggtacctgtcaccacaactggctttcttttattttttaaaaatagcacttttcactgtttgcagttatctcattgatttcacatctgcgtccttgtttacctctgtcctcctcattagaatataatcagaaggagagcaggaacctggtctgttttgtttgctgctgtaactcctctgcccagaaatttgtagcatagagcaaacacacaaaaaatatttactgaatgaaaaggtgatcattcccgagtatcctcaaggaggatcttatcaatcccagcaaatgtacttcaaatacgttatttcaattatggatgttattgagctgagtactgagatttcattatattgaccactgtctatttctactcagaggctgttctttatagggagttagtcaaaatctatgtgcagagtgaatacatataacttgcagtaaatatttaggtgttttagggttccaatattggcaaggtatctgacaagtaagtttattggctacttggagacaaaattacgccctaaatggacttcaagaaatattagttaactaactttatattcaaatacctcaataatctgcagttctcttgtctcaactgtcatcaccctgggccaaattatgacagcaatgttcacaggaaactgtatgataaggcacaatagagaaagaggaactaaaaaagaacttcagcctttaatatcctttttctaagttattcccatgctgcaggtggagagactttttcaaaagatcatgtgacagccttccaactcttattttattcatttattttttagatgaagtttcactatgtttcttaggctggtctcaaactgctgtgctcaagtgatcctcctgcctcagacttccaagtagctgagattatcggcatgtaccagagtgcccagtgaaattcttaagacaaaaagccttaacatgactgcaaaaccctctatgatgtcacttataggtgaataaaaatggccacaaattcttccacactcctcccacagacaggtggaggctatgtctcctctccttgaatctgggtaagctctgtggctgctttgaccattagaatacagaggaaatgatgctgtctgcccagatctcatgaaacaggcagcttcccctctggtgtcatggaccactccctccgggaagcctgagacagcaggttacaagtcctgagacggtcctgatggaaaggccacatgcagacactcataaacatcagctgagcctaagtgtcaagtttaggcagagggaagaagctgtaaggtctttttttttttttttttttttttgagacagagtttcactttgttgcccaggctggagtgcagtggcacggccttggctcactgcaacctccgcctcctgggttcaagcaattctcatgcctcagcctcccacgtagctgggattacaggcgcctgccaccatgcctggatgatttttttttttgtattttagcagagatggggtttcaccatgttgctcaggctggtctcgaactcctgagctcaggcaatccgctcatcttggcctcccaaagtgctaggattacaggagttagccactgctcccggccagctgtaaggtcttgagaagactgctggtgaaggctgggaggactgaaaattgtcactggagcctggagaaaaggtaactctattaatgtagtggcagagaatttgctaacattatcacttgtagtaatgtggaaaatagaaaatatacccaaggaacccacggattttagtaagaaaacttctaggcagaatgcttaaagtgccatttaaaaatttaaaaaaaaaattttttttaaagctacacacagtaaaaggtgcaggtagagaaagatgagtcaaaaaagaactgttcagttttcaaacaaaatttggagacaataaagagctagaatgtgttgagtaaaaacaaaacaaaacaaaacaaaaattgttttaacactcctagggggtggctgtaaaataccttttaatgactgtagaaatatttaaggatgtacctcatagagtttccaaaatagacaaaaaggcttttaagaatcctaagggtattgtcccacagcacccaactctgagcccagaccaaaaaagggactatcttgaagagaattgtaggtatgtgtttcatttaacagaaagaaacccagtaagattcaaaggatgcccacaaagattatgagagaagtgtattagtggacacataatcagcttggacaaagcaggcagaggtaaagtgcaaagagtccttagagcccccagacttttatgggtgagacataagctgagaagattattcagctgaaagtgctatttcttatggaaaggggacaactcagaaggtgcaacaagagtctggagggtggatccaagagccgcagagaatcattccagagagcaggactcggccctccagccaaggaactggcagcatgtggatttcagacttgctatggtaatgcctggcgtatagctgtttatccactctttgagtgggaatatcccaagcacttatcccatccctgtattatcagtatacgttggacatatatgaggcaaatacctttttcatattgagaggtcttcatattgagagaaattgtataagacaacagcatcaaatgggccccatcagcaactgaaccttatttagatggtaagaacctgaatctcggctgggtgccgtggctcacgcctgtaatcccagcactttgggaggccaagatgggtggatattctgaggtcaggagttcgagatcagcctgaccaacatggtgaaaccccgtctctactaaaaatacaaaattagccgggtgtggtggtgcatgcctgtaatcccagctacttgggaggctgaggaaggagaaatgcttgaatctgggaggtggaggttgtagtgagccgagatcatgccattgtacttcagcctgggcaaggagagcaagactccccctaaaaaaaaaaagaacctgaatctcaaacttgagcttgagataaggtttttgaagtctttagaaggggtgagtatattttgccttacagaagatgtgaataatttgtgtccagaggctgaagcatggatgactaacgatgaccacagattatttgaaactcttcctattgagaagtggcatcttcgttattccctttggtctgagtgggcttgtggactgctttggccgtcaccaagaatatgaaggaaaagatgctctgccagtatctgggctcagaccttaagaccttaagatttcctatctcttgtataggaactgtctctggaagccctgaactgacatgtaaggagtcttgaagccgcaaggctggaggtgccaattacaggtgctctagtcaacagttaccatattgctactgatcaggagcccacactcccagccattgaaatgaaggtgccaggcatgtgaataatgctgtcttggactctcaagaccagcccaactgtgatggttagtttgtgtgtcaacttgactgggccatgaggtgcccagagatttgaacaaacattatttcgagtgtgtgtgaaggtgtttctggatgagattaacatttggatcagttcattgagtacagcagacttcccttcctaaggtgggtgggtcttgtccaatgagttgaagtcctgaatagaacaaaaagacaaagtaagagagaattctctgtctctgctgggacatcagtcttctcttccctttggacttcgacttgaactggaacttacacaattgttctccatgttctcaggtctttggacccagattggaactataccattggctctcctgggtttcaagcttgcttgctgactgcagatcttgggacttctcagcctccataattatgggtcagtatacacacacacacacacacacacacacacacacacccacacacacacacacacacggatatactacttctctggagaactctgactaatacaccaacttctagctgaatgtggaacagaagaattgcccagctgaaccctgcctaaattcctgattcaaaatcataaggtataatataatgattgtttttcagctgctccacattggggtaataaggtatgtagcaacagatgacagacatagtcagctgtgcatacattttctgactacacatgtgccctgtcccttagctcttggtactccagccacatcaccctttcagttctactaatattgaatgcagaattagcacgtgccatccctcacccttcttgatcctttgactcttagctaatgaggattttctcagggaagttctccctgagcctctagattagtccctttgttacaatagatcctcccacaagaactgtctctttctttcagcgcagttatctctgtgattatttgattgacgctagtctctacccctagatggtaaactccatgagaacaaagggtaagactgcttttgatcaccagtgaattccccgagttcagcaccatgtctggacatagtaagtgcagaataaatatttgttaagaaggtgaatgaaatatttgaagcagctgataaagactcccttctcaccatagcttttaataaccatgtcaatattcttttctttgcaccttgtgaaaatctgggttctcagccattgtaactgggaaagactgtgacttaatatgaggccactggtcctactatgctattgtctgtgacggcagctaagcacaactgaagttgctggagttcctttttgtaaccgctggggaagaggaagcacaagagagcctctgggtgtgtgggcgcaggaatgcatagagaaaaaagtaattagtgcctgttcacatttatgtctttagttggaaattagggagctctcctaaaagtctaaagaaaatcgtggatgctcaaactgtttaaaatgtttctaaatttaagtttagaaacaatttgttactagatcaggagctcttccccctccccccaaccccttcctctaaaaatggaagaaataattgctgcttccttagtgctgttaggaaaattctgtaccttccataaccattgctctcagtattattttcttaatacctaatctgaattcctactgttttaaaatgcattcccctacttagctctacggatatggaaaatacatgctccgctgggaatagtctttcttaaaatatatctgctctgcttaaagattagtttatcatttttgccacatataaaataagctcaggtctctacaagtgcccttgtaatttccatttcataaatttaaaaaatattttgttttacctcgttatatttctaatagtgacctccaaatgggtctgtgtacgatatttcattaaatgggtttagtaggcttccaaagggagaaaagaggatttccatttctgcataatattcttgctcttttaagaagaaaacacctctacagtggcagggctaatatgtcgacaggcatattccgtatcatttatgtaagttaacacattctgaggctctgcccatttccacttctctgatttgtcctccctccctgagtgcacaatactgcatttgtcccttttgaacatgtaacagattaaagagctgggcaggaggcagatgtaggggcacctttgatctctcatccttggaggttaagggagggcagacacctggcggctgccgagctggaaacaaaacacaggcccagactggaattaccttaaagggagcccggctccaaccgcagaggcagctggaagcgctgaatgggcaccgggggaagagagccccgcggtcaggcagaggacgcaacagagtcctaacaatgtgatccaggctacccgagagctggttagaataatccttcctacgcagaaagacccaggaaaccttccaggaaagactaggcagccgcattgagaaaaaacgaaaagtaaatcttttgcaaataatatcacaaaacttccagctgtgcacaaatactgaagggcaattttgatgacaatgcaggaagctttcaaagaaaggatttttaaacatattttttccttggcggaactctttttagtaaggatttccacctttgccccaggatcctgccaatgttcttagtcaaagccagacccgagtttcctaggattcttcggtgaaactgcattgccccctggcgtttgtgtgctgtcattacgccgcacagataaagcccatggaacacctaccaatccgaggaaggatgcagctcctggtttcatctacatggagaaacctctcttaaaacacaggatcagagaatgcagttctaaatggcaaatctagacttggtttgacaagacatggaatgaaactttgaaattaaaactccttccttttccatccttagcagaatctcctgagatgttcaagtagctctggaaagaaactgatcagattctaatctgtcaatttaaaaagtttttttttaaacaatttttaaatttgttttagagatagggtcttgctgtgtcattcaagctgcagtgcagtggtgcaatcatagctcactgcaatcttgaactcctaggctcaagggagcctcctgcctcagcctccgtagtagctgcaactacaggcgcccaccactacaccctgctaattttcttatttttaaatttttttgttttgttttagagatgaggtctcactgtgttgtccaggctggtactcctgacctcaagtgatcctcctgctttggcttcccaaagctctgggattacaggcctgagccactgtgcccggttgctaatttgtcaatttttttttttttgggagtcagggtctcactctgttgcccaggctggagtgcagtggtgcatctcagctcactgcaacctccacctcccagactcaagcgattctcttgcctcagccttctgagtagctgagattacagacatgcgccaccaccacccagcttatttttgtacttttagtagaggcggggttttaccatgttggccaggctggtctcaaactcctgacctcgaacgatccacctgcctcggcctcacagtcaacaaatattgactgtgctgcttaccatccatgtgaacttggaaaaccctcttaacctttctttgtctcctccacttacaaaatgaggctgataatagtagcatataccatctagtacctagtaaacaccctttaagtgtttgtgaatgatgagaactatgtgagttttccactccggtggactagggaagattaaaaaacattctgtgatgttgaaagggcttggacttggttcctggccaagtctattaaaaccccaaaacacaaagaaatgctccaggtactgcggtttctacctggcctcagtgcaaacctagaattaagtacatctctgacacttccaggtcggtgtgactggacctctgagaatatgctggggcctgagagggtccattcttgtccacaccagggcagagttccacccccaaggctaggccagagccggaatgactccaggagtaaggccaagggtggtcttccttggcccaggttcctctagaatatgccactgtggcataaaaatgattttgagctgaaggcatttgataagaggcttatttctaaactccttatctgccccaaagcagaacctcctcccaaaactcaattgtcataaatcccttcccacagatttttctgcaaccagagaaagttgactctaataccaaagagaagcccacagcacacctaaacaggcattgtcacaaaactatcatctcccatctattctcctaaaggcccatgatctttcttaaaagtaatttatttttccttaagtgcccttctcctcctccccttctcttgttcagatggcacataagccccaaattgtaagtgcccccttgaggcatattttcctgagaactcccatacataatgaacagaagcctgtcttttcttttgcagcccccaaaacactgaacttaagagggtaaaggaacagtttttccttccttcgtttcttctttccttccttccatgttttctagagacagggtctcacactgtcatccaggctggagtgcagtggtgtgatcatagctcactgcagcctcaaagtcctgagctcaagtgatcctcccccctcagcctccaagtagctaggactacaggcacatgccaccacacccagctaatttttttaatttgcaaatttttgtagagatgggggtctcactgtgttgcccaggctggggaaaagtttttcatcttccgtaccttcttctgtgcctttggcaaaatactggactccactgtgcaaaaaaaaatctctgctcaggccttcaaaacaagcttcacatcttgtgccaagctatcctcagtcgaagcagtggtggcaaatagacgcaccataaatgagaaatagaatgcttggcccagtgcactggctcacgcatggaatcccagcactttgggaggccgaggcaggcagatcacctaaggccaggagttcgaggccatcctgggcaacatggtgaaaccccgtctctactaaaaatacaaaaattagctgggtgaggtggcaggtgctacttgggaggttgaggtaggagatcgtttgaacctgggaggcggagcttgcaatgagccgagatcgcgccactgcactccggcctgggcgaccgagtaagactctgtctcaaaataaataaataaataaattaaaaagcaatagaatgatctacataatatttgacatgttaatattcgtacagcatctttgaacaaaggctgacaaatacaagtgataagtgtttgttaaatgaaaataaatgttgtacaatttcagtctttaagaaagacaacgcagactggtattagggttccagaccttccagatgtttttcttattttgcactgcatctttaaaatcttgcgtattattgataaggagtgctgggaagggaagagcgtgatgcctttaaatgatacggaagaggggaagggaagtgctgggtagaggagggcgtggtccctggctagggctctacccccacggacctaggcgaggacaggcactcctgccttcctgcccaaatgttgcattttccaagaccaccttggcccaccacacccccaacctgggcctataaaaattcgagaccctagtaaggaaagagacacaagcggctggacgtgttgggaaacacatcggcagaagaagacacgagtggttatgtgtctggtcattagagagcatgtctgcggaagagcacatcgatagactcccgcacatggatcgatgccatcgacccgcgacctgcggaatgagggagagttggtccggggcagtcagaggagagccgggcagcgggtggcccaactctaggggaaggccatcttccttctggcttcctcaatggctgagaactacttctactcagtaaaactttccactcattatccaagcccccatgtgatccagttcttccggtgcaccaaggcaagaacccggatacagaaagtcctctgtccttgtgatgaggaagcggatctaagtgaactaacacaagctgcctatagggctaaactaaaagaacaccctgcgacacacgaccactggggcttcagctgtaaacattcacccctagacactgccgtggggtgggagccctacagcctgcctgtttgtatgctcccctagaggtatgcgtagtgaggcactgaagaagtgagccacatagggtgtgcgatgggaacaagggaacctttcccatttcattataacgataggaaaagagtatattgttttacaacaaaacaaaacaaaacaaacccctaaaaattgtattgctggagtaagacgatcgaagtgagatcgttttaactaccgtcttttgaagtgtaagtgtgtgcaaagcatattcagacttaatacaaaatggaacagtggatgactagagagataaatggtgccaatagctactaacaatcatgcaaaattatacatcctgtgggagactggaaacatatattcattttcaagagaagaggttagaaaatggagacctctgatgcgatttcaaaagacgtgcaatcaccaatgaacactttttgacttcctgggaatttctctgcattacaagcaaatctggcaactgataacttcctggacagctgtctctcccatttattcccccaattcttttttggtaattgtcagctaaatctttacatgagtgtaatctctaccctgcagaaagaaattcatcttagaagttttcattttcatttggcaaaggatttggaagaatggtgattattctctaagcctaaagtgaaaattcaagggtttgttttctacagatgcaatcaagcataatattgtggtatctttatgagaaatttctaattaatgtctagttcagtgtgcttaaatgtaagtcacaattctgattatacctgcttgtattaaccatatcctgaaattaatgtttgctgtcatttaagcaaaacctgctttctttggttggcaaatcatctaacattaactgtcccataactaagcacactgagatcaaggtcaatctgttagttttattttagtttaccttattaagaatatcagaaaagtttagcttgcttggcccttgattgaaactgcttaataatctcccactgctcttcgcaaaactgtcaaaatccttaatgtggcttacaacgttctgggctacctgagccagtattacttctagttttgtcttggatcactcccatcccttctttctttttcccaccttccctcccctcccctccatctctgtgttccagtcactctagccttcttttaattactcaaaattttatattcattcctgcttctggcctttgctctttgctgctttttttttttttttccacctggaattcaagtcagacttccttgaggaagaagcagtttattttctttgatcacacagctcatggttgcctaggatcataacacccctatctctctctctctttacagtacttgtagcaactgtaaacattttatgtataaacactacaagaaaaaaagctctcagattatttgcttttgaagtcagagcagaggctgggtcagtgttattgctgtatcctcaggagcagcctggtgcctggcacacgttaggtgctccataaatgcttgttaaataagggaagggattcgtagttccacctgactcttaaattggcaatgcatgttttcctgcttcatggctgcacttgagcagaaatgtcaaccatgccacaagaggttgattatttaagactaagatggagccagttgttttcataaaggttgaaaacagattttgcatttgtattccttaagtacttttgaaacagatatattctcccacacatactcattcacaaataatgggagtatgatctttaagagaacctaagcaaatatagtcttgatgaagtaattccattttaaataatctattttaaggaaatagtcatagattattttacccctgccctcatgtagtttattctcagcagagcaggaataataatttcttaaaagccaggatcatgcacccccttgggcaaaacctggaaatgatcatatttcactcagagtagaagccaaatccttccaattgccaacagagtcctgcataattcatgttatttgtatatttcgtgtttttttctttacaattttctgcaatgagatatttgttcaggaaaaacaaaagcattattaaaaaggaaagagggacattcagaaagcagatttgaaaagttaatattctgtttttttaatcattgaaaataagttatgaagatgggatttcttttagaagtttttttcaatgggagaaaatgtgattattactaatcattcaactgctgattagacacacacacacacacacacacacacacacacacacacagaggcaagaatttgctctttggcttctacttatctatttcttgaaagttaacaagagcagggaacggtggttcacgcctgcaatcccagcactttgggaggctgaggagggcggatcacctgaggtcaggagttcgagaccagcctgggcaatatggagaaacgtcatctctactaaaaatacaaaatcagctgggtgtggtggcacatgcctgtaatcccaggtactctggaggctgaggctggagaatcgcttgaacctgggaggcagaggttgcggtgagccaagatctcgccattgcactccagcctgggcaacaagagcaaaactctatctcaaaaaaaaaaaaaaaaaaaaaaaaaaaaaaaagttaatgagaaacaggtagataaacccaggagtgtttaagacttttagagactactcacaactaagttctagttcttactttgtattcctcttaaagttatcgtgttctccctaatcttgttgtatcagtttcaaccattcatcaatagtggtggcgagcacatgtccggcatcaaggcagactagctggcaagaaccaagctagtctgcctcctcctttcactgtagttctactttctccctggccacctcccctggtggattcctacacctgttctttcctctccatccccagtgccatgcctggggcaagtccttatctcctcttgcctgttgtattccaactggtttttgtgtcttcagtcttttgcctctttaatttattctacattaaagtgaatgatactctaagacaccgattacttcctactggcaaaaggataaagttcaaggtctatcttagtctagattcaactctgtcttccgtggttccccaggccctattctttggcttcgctcttttacttcacatgccttgtacttacttgcctccacacctctgtgcgtgcctggggagcccctccccagtttcttttcacattcagggctcaattcactgtctttgatagtgatgcctccctggtcctcctgcggcacaaacctatccctctactgcattcttttaacactttgcatatctctattatggcccttactggatggcattgtaattgttcatattcctgttgccctcagcgacctgtctggtttactaaagcattgctcccattggttatcgtgtactgtcactctttagaagcactaattgatagaaagccatggttgataggatactcatagcagagagctattctagtaaacagctattttaataactattgttagcacacaattgctgctgtgaatgagaggaggatgattgcaactcttttttttggatggagtctcactcttcgcccaggctggagtgcagtggcatgaactcggctcactgcaaccttcgactcctgggttcaagctattctcctgcctcagcttcccgagcagctgggactacaggcatgcgccaccatgcccagctaattttttatttttagtagagacggggtttcaccatgttggccacgctggtctcaaactcctgacctcaggtgatcagcctgcctcggcctcccaaagtgctgggattacaggagtgagccactgtacccagccttttttttttcttttgagagggagtctcactctgttgcccaggctggagtgcagtggtgcgatctcagctcactgcgacctccgcctcctgggttcaagcgattctcctgcctcagcttcccgagtagctgggattacaggcacccaccaccacacccagctaatttttatactttagcagagacagggtttcaccatgttggccaggctggtcttgaacttctgaccctaagttatccacctgccttggcctcccaaagtgctgggaggacaagagtgagccaccatgcctggccgattgctactcttaaaactgctgccattgccaggcatggtggcgcatgcctgtaatcccagcactttgggaagcagaggtgggaggatctcttgaggccaggagtttgagaacagcctgggcaacagagtgagatcttgtctctataatattaaaatatatatatatatatgtatattttaaaaaatgctgccatggccaagtgtggtggctcatgcctataattccagcactttgggaggctgcggtgagacaatcatttgaggccaggagtttgagactagcctgcacaacaaaatgagctcctatctctacaaaaaaataaaaaaatcagctgggcgcactggtgcatacttgtgatcccagctactcatgaggctgaggtgggaggatcacttgagcccaggagttcaaggctgcagctagccatgattgtgccatggcacttcagcctgggtgacagagcaagaccctatctgtaataaataataataataaaaacctgccaccaccactaccacctttaccaccccactacctctactataatcacttccacccctactatcaccaccccactgtcatcacctataccacgtccaactctactcttctcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcacctccactatcagtaccgagtccaccacaatcatcacccccattcattagcataggcagagcactgccaagtaccacgcagtgggttagctggtttttttttgagatggagtctcactttgtcacccagggtggagtgcagtggtgcgatctcggctcgctgcaatctttgcctcctggttcaagcgattatcctgcctcagcctcccaagtagctgggattacagacatgctccaccacgcctggctaagttttgtgtttttagtagagacgggatttcactatgttggttgtccagagtggtcttgaacccctgacctcaggtaatccgccggcctcagcctcccaaagtgctaggattacaggtgtgctccaccgtacccagccagggttagctgttctatatgcattgtctcattccatctctacaacacgattaaatatgagaaaactgacactcagatccagcaacatctgtttgatggcacagctttgggtggaagtgtttggattctaacttggggccctctggcctcagagtctgaattttcgtctccaaagatctgttgctaataagctactgcagtggtaccctacagttttgtttcccgcattcctatcacctttgctcacttcatccactccagcggcctcatcctccagctgactcatccatgccacccatccccacctccatctgacccactccataatgtgccctctaacagggctttccattaaggcctttgcagtggtgtgctggtaaatgtttaacaacaggctctctgaagaggggcagaggggatttctcctttgtagcatttgctgttttccatggtgtaaatactgccacatgacttttttttgtaccaaccaacttgatgtcaaccagctgaaaaaattattaaaactttcatagtcagctctcatgagccaatattgatacaggagttaagaagaaattacttaggcagatagtgagggtacggaagtccttggtaatgttttcctttgaatgaaaagcagccccagactatttgttttccttttaatgaaaagcagccccaaactattttcctttctaacaaacagcagcctgtaagatcaagctgcagacatagatgccggcagttgtgccaatcatgttcaaaatggcagtcccatctttcctctgccagccgcgtgtacagcaaggagcagacaagatggcgcagcccaaggagaaagtttatttgcgtaataagattagggtggggcaaccagccttccctgctcgctatgtaaatgtcacacttaattgaaccaatctgtgagcattatgtaaatcagacaccgcctcctcaaacctgactataaaatctggcacatccaccactggcaggtcctctcggaagacccttctctcactagagagagctgttttcctttctttttcttcctccttcttttgcctgttaaacttccgctcctaaactcctcatgagtgtccatgtcctaaattttcctgccgcgagatgacaaaccctgggtatttactccagacaatgtagcagcttcagtataagctggcttcaaggtcctacaaaaaccccttttacaatgagcaacttccttctttcacacctctgccttaagggaaccaaggatttttccttggtaataccattaccctcaagaccttgccaatttgaggctacttctcctgttttttttttttagaagaaattgtgaggtcagtatacacaaacaaacaaacattaaccaattaattagaaaaagtactcttctaattaatttaaagcattttcatggtttaaaatcccaaattcaacagggtagtcactgaaaactctctctcctatctgcgtttccaatcaccagatttctctccctgaatgcaatcaatgttctcagttttcatgtgtattgacatactttttctttccccttgccctttatggatgcattttctgttgccaccaccctttaaactcttattttgaggctaattccactcatacagttttctctattatctactaacttccaggatattcctggaatatcttctgtagcgacttcagcccgtttcattgggctttctatcccatcctctgagatttcaacattcatgtttatggtctcacaaatttccccagcttcaagactctttatctccagttcctcaaccaccagttgaggaattgaaccaccagttccatttctaaattatggaagagtcaagaactcctttgataactatccctttatcctacaccgtaatcactccttcacgtccactgaatctgccatagggccatttgtgaacactagcctggctccattttgccccagtgaatcagctctctactggtttcatttattgtcttaacctgacccacaccctcaaaactagccattccaacaagagaattctctgtcctcttccctaccagttatatccattctaaaattactcattacctgtactgtatattcctgcagcagttctgaagacatttttgtgcttaaaagccttcagcggctttctaggaatttaatccagaattctcagctaaatagacagagatccatgtttctagcgtgcctatgaccatccacttcagggatccagtgctcagccacatccagctacttgctctctttttcttttttcttttttttatttgaaacggagtctcactctgtcgcccaggctggagtgcaatagcacgatcttggctcactgcaacctctgtctcccgggttgaagcaattctcctgtctcagcctcccaagtagctggaactacaggtgcttgccaccatgcccggctaatttttgtatttttagtagagatgaggtttcaccatgttggccaggctggtctcgaactcctgacctcaagtgatctgcctgcctcagcctcccaaagtgctgggattacaggcgtgagccactgtgcccggtgggtttttttttttttttttttgagatggagtctagctctgtcgcccaggctggagtgcaatggtgcaatcttggctcactgcaacctccatttcccaggttcaagcgattctcctgcctcagcctcccgagtagctgggaagacaggtgtgtgctaccatacctggctaatttttgtatttttagtagagacagggtttcaccatgttggccaggctggtcttgaactcctgacctccagtgatctgcctgccttagcctcccaaagtgttgggattacaggcgtgtgccagtgtgcccagcctacttgctcttgttttaacataccttggcctttcccacctccaggtcatttgtttgatgattccttctgcttggaattatctctctatctctgcctattgaattcccatagattctttaagacccagctcaaatcacatctccttcacgttttctctcatttccccatctctcctttaccgttgtgtttgcttacttattttataaagcaaagcatgttctgcttaatatgatcgttgtttttgtgtcttatcttcctaataggctgaacttcttgaggatgcttgtatttgttcttagagtccccattacattaaataattgctttatggctttggataaaatacatttacaatttcttttccaagaacgaacaaggatcagaaagcaaaatagggcaaaataaacattacaatgttctgataggttattataccacacaacttaattctcaaattttatagaaatgcagaataggatttttccctcccctagttattacagaaattattcttttctacccaaatataaaacaaagctccagtaaaagaaggtgtgaacacttgtttctgctatgcatcgcaatacatgggatgtttatatggcaaatgcatgtgtgggatgtgtcctgcatttatatatgttggggggaaattcttagctcacagaggatagtgaatgaagaggaacagctataactatcactggttcttcttcttcttctttttaaaaaaccagttaattaattatttttagagactggatcttgttatgttgcccaggctgagctcacactcctgggctcaagcaatcttcctgccttagcctcccaagtagctgggattacaggcgcatgccactgtgcctggctgtgttcttgatcaacaaggcccccgtgtctttgcagcaaatattggtttctcattttccctccccaccccctactcccacccccatggattttttatcttttcagaaaagctcttgttgacctccattctcttataattattccttaattctgtactagttggttttccaacataaaaaacagtgaagtctctgtaattatgaaactacttgtgtgacatgacactacttgtcagcattctttctgttgcgagaatgaatagcaactttgacttcccaaaaaacacagctctagcttgaatacactgaacatgtgtagccgcgccaagaatgactaagtacagactaccagcaatgagcacttgatgatcacctgcagttttcatcatccccttctgttcagccaccccagtggcctacctcttatgggtcactgcaacacacaggcagcaggcaatagagagtatatgggctactagatagggccgatgagctccgtggtagtttggctctaagaaagacaacaggccaggcacaagtggctcacacctataatcccagcactttgggaggctgaggtgggaggattgttgagcccaggagtttgagaccagactgggcaatgtagtgagaccgtgttgctaaagaaaagaaagaaagacaacaaagggacatgaagtatcattatggttttctttttcttttctttctttctttctttcttttttttttttaaatagagatgggttcttgctatgttgttcaggctggtcttgaactcctggactcaaatggtcttcccacttcagcctcccaaagtgttgggattacagacgtgagccaccatgcccagccatgggtttcttactaggtggtggagctatttcccacgagaatagcatgaaatgtgaaccatttctcaagagaatagcatggccattcttcaccaggggtcttggtcgaggttgtagaatctgtgtggccctcctctctctaacggttggcaaaatggtgataggccagtaggtgacaggacagcctggctggacatctccatctgtcatctctgttatggttgggacctcagaagggagcgaaacaaaaccaaaagtcattccaaattgcttagggttaattgaaggaagccacaggaagagcagctatgaactctgtcctcagggcatccacagagtgtggggacctggagaaggagcagtggcagccacaggcctgagggcagaaggaaggggtacaggtgagtacagtgatcacagagtctcagctttctgagaaagtcatgattttacctaatctattctgttgtcagacatgttctgttctttaaccctcaatgcttagccattgaaaatttggaggccgggcgtgctggctcacgcctgtaatcccagcactttgggaggctgaggtgggcagatcatggagtcaggagatcaagaccatcctggctaacatggtgaaacccctgtctctactaaaaatacaaaaaaattagctgggcgtgatggcgggcacctgtagtcccagctacttgggaggctgaggcaggagaatggcgtgaacccgggaggcggagcttgcagtaagccgagatcgcgccactgcactccagcctggaagacagagcgagactccgtctcaaaaaaaaaaaaaaaaaaggaggaaaaatactgtttgactcatgactcatggtagtgtttttcacaaacaaatgctatcatttgcacacttgggcctaggaagaatgaagaagcctgaatctatgctgcaaactctggtttccacaagcctcgtgaaagatgaagaaagaaggctaagaaggcttcctcccaatgggatgatggtaagtctgaaatcccagttgatctggtgagatatgaaaaagggtgagataattgtgctgagaaatcatctcagtttacaggcacgcacatcttcaacacaaaatggaggctgatgagagttcagttcaatgactgtttccaacactagagtggggctatgaattggcatcatcctagagaaatttcaagtggcttaagtggacttgaaaacagtactgtcctctcactttttgtcatttagtttcttagagtcagagataatgtctaaaaaagggcatttctcataataatttgtgaccaggagaatcaataaaaaaggatttcccttgccaggattttcagagagaaaactatgcttacagtccacagaatgacaaatattcattgtgtgatgctaataaaagtgtaaggcattttaaaattcaagggtattttcttataaccatcttcttcaaagaactttgatctctagttaccttatatgattgaaaacaatgactaaatgaaatgcttgtctcctccaagaatggaatataaagtatttacataaatcgatattgctggaaaaaaatctgcagattccttatgcttgggttcacatgaaataagtaactttcttccccaaaaagccagctgtgtgattactaagagaccaagtcacatggtttggatctgtgtccccctccaaatctcatgcttagttgtaatccccaatgttgaaggtggggccttgtggggagtgatttggtcatggggatggtttctcgtgaatagcttagcactatcccttcttgatattgtcctcatgatagtgagtgaattcgtgtgagatctggtcatttaaaagtgtgtggtggctgggcgccgtggctcccagcactttgggaggctgaggtgggtggatcacttgaggtcagaaggttgagaccagcctggccaacatggtgaaaccctgtctctactaaaaatacaaaaattagctgggtatggtggcacatgcctgtaatcccagctacttgggaggctgaggcaggagaattgcttgaacctgggaagcagaagttgcagtgagctgatattgcaccactgcactccagcctgggtgacaggcgagaccctgtctcaaaaaaaaaaaaaataaaaaaaaataaaaataacgaacgaactaactaattaactaaataaaataaaagtgtgtggcacctccccctcacacctcacactcccttgctcctgctctggccatgtgatgcacctgccccctcttcaccttccatcatgattgtaagtttcctgaggcctccccagaagctaagcagatgccagcatcatgcttcctgttcagcctgcagaaccaagagtcaattaaacttctcttcttcataaattacccagtctcaagtattcctttataacaatgtgagaatggactaatacacatggcctttttggaaaagctctagatataaagtctgaggccagaggtttagatgtgtggtacagaaaatacacgagaaaagaagttgggcccgatcctctctctgtttctgatttttataaagatgctattcatttatgagtcagaaggcctagattcaagtcctgactctctctaagaaggtgtttggctatggttaagttattttggtcttagttgtgtaatctgtagtgaggcagctactctagatgaactcaaagttcctgtcggctgtagccctctgaggactggtgtggggtgtaggcactggcctctaactgggttctagggaaagcactgataacacaggactcctagagcatcctcattatttataagcattatttgattgattgaagactagtatccaaagcttgttttctttctttcttttttttttttttctgagatggagtcttgttctgttgctcaggctggagtacagtggcatgatctcagctcacggcaacctctgcctcccagttcaagcaattctcctgtctcagcctcttgagtaggtgggattacaggcgcgtgccctcacgcctggctaacttttgtatttttagtagagttgggggtttcaccatgttggccaggctggtctcgaactcctgacctcatgatccacccgcctcagcctcccaaaatgttgggattacaggtgtgagccaccgcacccggccatatccaaaactttgaggaagaaaatccattgagtggtatgtttcctactgagtgctcttactgatcagttacagagaaggagctgatggtagatgaaatcaggtgagaaaaggtcaaacatcaagagaacacatcaagagatgtagaacacatcaagagatcaatttagtatctctttataataaacaacccaaaccaaaaataccaacaatatataagcaagaactgttctgatacaatcctgtaaaaatagctttattaaaacctagcctgaagttttacagagaaaagattagacttagaaagcctccaaatctatcaagagagaaactttttttttaaaatctctatttgggatgatagacgatgcatttcagtttcagagaaccagctaaaaaccaaggatgaaataataagtgctcaagtgggctagaaataaatatagctgctgttttccctatatgagggatgtgcagcagtaatgaggctcagacaaaggattatcatcatagagaggaaatgaggcattaagcaaataattaaagagtattaaatcatctcagaacacttgtaagactgtaaaaggcaaacatcgttagcagtattgttgagaaatgatggtaagaaaaaggaaaggaaatacagttagtgtttgggagggagtgtggtattgcgatctcttactagaggtatgttttttgggaaatcacttactcttcaagattcttaattttttcatcttaatgaaaaaatttcatcttgctcttaagatggagcaagtaatatctccctcactggggggacacgaggattaaataagggcacagagaactggttctgagacattaagccgtcagtaagtggtgcctattgttattcaggaacagaaacaaggtgatgtttgatccagctagttaaatagctgtattctatcactgatacaaaaaatgcactctaggagagatgacagctcgttaaagtaccatatatttataatatgattgggtaaggttttttttttttaattaaaattttttttccttttctttttgagacaaggtctcactctgtcccccaggagggagtgcagtggtgcaatcacagctcactgcagcctcatcctctcgggctcaagcaattctcccacctcagactcctgagtagttgggactacaaggatgcaccaccatgcctggctaatttttttttttttttttttttttagcacagatggagtcctgctatattgcccaggctggtcttgaactcttgagctcgggtaatcctcctgcctcagcctcccaaagtgctgggatgaaagatgtgagccaccacacctggccaagatgtttttatttaagccatactgctttgaaaattagtgatcttccactttcattgcatgaatcattcacaacaggaaaagcaattcacccaagattctactattccaatgctataggaactaatcctctataagaagtgaaagaagaaaagacaacggggttggggcaccccttcagggcagttgcggtgttcactgacagagactaggcaaaacctgggagggagggtctttctctacaggagaaaaattgcagagattctgatgaaacaggaaaaaaaatgtcacttagaccacacctgtatgtaaaaggtcatcattagccatcaacattgcaaccaaaatcgtgtaaggagggaaggcagcatagtttagtaacttatttgataaagtcaaacaaggatttgcatacagtgaaaattttctaaggattgttcaaatgaaaagctgaaaacagtaatcctgtattgggtattccttttagtagccacaacttaatgtttggcattatttataaagcgctaattttcccctgtaaacatttggaataaaaatattgagtattgctgagaagcctgcattaccttgtaaaaaataagcatatcttccatgcttcttgattttagttattgccttaataaggttttttggtaaatgtatcacatggtaaaaagtggatttaagcatgatatatcagcaaccaagagaaaggagcacgacatggagcaaggtgtctttctctagtattaagtgtctcatggtaaaaatccaaagatggggcctggtgtggtggctcatgcctataatcccagcactttgggaggccaaggcgggtggaccacttgaggtcaggagatcgagaccatcctggctaacacagtgaaaccccgtctctactaaaaaatacaaaaaattagccgggtgtggtggcgggcacctatggtcccagctacttgggaggctgaggcaggagaatggcgtgaacccgggaggcagaacttgcagtgagccgagattgcgccactgcactccagcctgggcgacagagcgagattccgtctcaaaaaaaaaaaaaaaaaaaaaaaaaaaatccagagacggtaccctttaattatttatttattttgtagagatggggatctcactgtgttgaccaggctggtctcaaacttctggccttaagcaatcctcctgcattggctccccaaagtgctgggaatgccatgagccactgtgcccagcccaagatgctaccctttaaatcctcattataagacaagaataaaccaagaaacctaggagcacattgtataatcaaacacaattgctcttcaaggcccgtgccatcatataatgatacagtagcaaaatttagaaagggaatgctgtaggccggaggcagtggctcatgcctggaatcccagcactttgggaggccaaggcaggaggatcacctgatgtcaggagttcgagaccagcctggccaacatgatgagagcccgtctctactaaaaatacagaaaaatttaattgggcatggtggcacgtgcctgtaatcccagctacttgggaggctgaggcaggagaatcatgtgaacccaggaggcaatgttgctgtgagctgagattgtgccactacactccagcctgggtgacagaggagactccatttcaaaacaaacaaacaaacaaacaaacagaataaactaaaataaataaataaaatgaaaatagaaagagaatgctgtgtaagggtatttcttggaaacctgactgctttgatcaagtatgacaccctttcaaaaagcactaggaatccctaacagattccttcaattaaggaatcatgggggaaggttgtttagacagctcttgttttgagaactgtagcaaagcacactgttaacagaattaacagcattatttaaagactatgttggttatgataataataaatattgcatatttttattcagtttatatattgtagggcaaagacagtgttcccttatatcaatgctgtgcatagcaatgggggctctgtacaaagatgtttctttcctgagattttttcttttgtcttgtgcattttcactattgaacaagagactttagttgccccaggaagtgaagagatctagcctagatcaaagaaatcattggtcaggttctcagttgacttttaaaatctataaagtagggtgcataccacatgccctccaagagtgagtaggaaggtgggatcctgcacatagaacagatgttctagaacagatgtcagaggctctgtgggaggcagaataatgcccctcccccagagatacataagttctaatcctggaacctataaatattatcttatctggccaaagggtctttgcagaactgattaaggatcctgaggtggtgagattatcccggattattagggtgggcctaatgtcatcatggggtccttgtaagtggagggggagtcagagtgttgcaggctaagaaagactcagtgaaccattgctggctttgaagatggaaggggccaacagccaaggaatgtgggtggcctctagaaactggaaaagacaaggaaatggattcttcccaagagattccagaaggagcagagtcctgctgacatcttaattttagcctggtgagacctgtatcggacttctgacatttcagaattccaagatgataaatatgtgttcatctaagtcaccaagtttattacagcagccataagaagtgaatacaggcactctctcttacacttttgtattcagttcactttgaggtgcttcagcctgtgggtgcccaggtaggaggcttttctgattatatgatctagttttctctgaattagcttcatgaaatggacagatggtgtaaaagaattaacgataataccaataatgtaagcatacgccaacaacataataaaatgttgacttgctttgatatagctcttcattaattactttataaacatgatgatgatcttatcagatctgacaagaaattggcttacaaatttaaaatccttgagaattttgaagaacatttactctttaaaatgaagaactaagtcttaatatatgaagctttattaactaattatatatagtcatcacaatggaaaagtactttcagaaatacttgaagatatagctatgaacttaaaaacaataacttgcaaaagtgtatacaggactttcatagaaaaaactcagaactcaatgccaaaaaaataagcaaaacaaattttataccaggaagtgcagtatgtatatagaatgtaaaaagggccgaagtaaacaaatgaccaacctataacattgaaagagaaattctgaccaaacaatagctttataataatgagtataattatcccaatcctcagagactgtttttttttttttttttgagacagggtctcgctctgtcacccaggctggagtgcagtggtgcgatcacggctcactgcaacctctgccttccaggttcaactgattctcctgcctcagcctcccgagtagctggaattacaggcatgcaccaccacgcccagctaatttttgtattttgttttagtagagacgcggtttcaccatgttggccaggctggtcttgaatttctgacctcaggggatccaacggcctcggcctcccaaagtgctgggattacaggtgtgagccaccgcacccggcccagagactgttttaaaatttaatcacaagataattctttctcatctaaaatggatatagttaatggttatcaaatgtgaatttcttgattcatatgaaagaatctgtatgacttaaaaccagacaaagatgtgagatacaaagtagaaatccagccctctaaagggaagcagagggcagttaccttcaaagatggaagggatgcaacccttgaggcatcttggcaccctaagggaaagatcagtgaaatgctgaaaaattattaaaaaaaaacaaaagaaaaatgtgaaatgcctgttcatgtgtgactactacaatgtctcagaacaaacttcagaatgttactgttgataatatttgcttttttcccatcagtttaagatatattctaggtattaaaaaaagacacacacacacacacacacacacacacacacacacacacacacacacacacaccctaccaaaaataagaaacaaaacttgaaggtgggaagcaggtaaaggaatgggttaaagggttggcttggagacatctggcaatgcttgccctccccctccctcctcgtggattctttacacatttgcaggaatgtctgatgatgcatgagactggcctctttcatccggcctcctttctggtctccagaaccctccgaggccctttactgtcgactccactgcagggacatgttaataagaaacagatttgatactgggaatgctgtcatggagaaccctgggcttagctcattcacactcagtttacctttagcggatctggtttcatgcattcctgatctatttatgcatgtctgcctctctagaaagactataaggccctacccctgtgctctgtctcctccaggcacaatgtttttgcacactaaagcactgaatgaacgtttactaagttaaaaaataatatttgaagaagattctttgtattatttattgtattacttgcaatgcaggatctgtggtttctggaagaatttaaagtcacttatctctctgctcatgttaaaaccaaaggactcctaaacctcaaactgtaattgctgacctcaaacaacaaaccttttcatcagctagagcaacaaagttaaaaacctggctgccaaataaactctcctctctgtttgaccgttaatgggtttcaggaatgtaattttagataccccatcatccagggtcaggttgccctcattttggtgacactgggaatgtctgaaaaataatctctagccttgtatgtatcagacaaacggtatcattgtatccttttttttaagcagacctatcttttcccttctctaaatatcatcaagaagagaaggtaatcagccatttcagtgggaagctgatatgtgtggagaattgctacccacctcagcaaatcagaacatgaatgatggatttaaaggtatatttccatgtgtctaggtctaggacccacacaaatataactaggccaatgtgccataattgttgttcaagtatctcccaaattgtatgccttggaagaccagttctgagagatataaaagtatgtcttaagaaaaaaaaaatttgtggttaatttggaaaattctggatcaattagaattaaagaggtttcttgattgtagggtttcttagagtcctcgatatgttaataagcactgtgatttcttaagaggtttacaacctgtaactagggtaagatatacttttattgtttttaaatttatttctagaacacctcataaaatcctggcatatagtttggaaaggccagcaagcctcccccttgattcccattttttttttgtggaattcctaagcattgttgagaatttctgaacttcaggattattaacagtaccctgcgggctgggtgaggttttttttttttttttttttttttgacagtgtttcactctgttgccctctggtgcaatcacagctcactgcggactcgaactcctgggcttaagtgatcctcccacttcagtcttccaagtagttgggactgcaggcatgtgtcatgaagcccggctaatttttgtattttttgtagagttggggtcttgccatgttgctcaggctagtctcaaattcctgggctcaagcgatctgtcccctacggcctctcaaagtgttgaaattacaggtgtgagctaccaacccagggcaagggtatttttaaacaatatcaaggaaggagagattttccttgccttggtttagctcctgaaaaagcctttggggattccaatgacttggagtcatctttgggatatccaaagacgagctggggcccttgattgattctgaagccccaagacctcatactggcctggaatcacctgccagagcaataaagtgatgaaagtgcccagaggaagtacaggctgaaataacacatttagagaagagagtaatttttaaaaaggaataaggaaaggaagtgattagtcttttcgcttccctatttcttcctcgagtatttctttaaaggagaaattccttgtaatgtctattctttttttgttttcatatactgtagttttttcctccagcttcctaatttattagtctttttcaccaccaccaacagaattaggctctacatctcatgctgctaatcactgaggccaagacttatgattcagacatgctggcggtagcaggcttctaatcatgtgctgaagaaataaatataacttctaatcatgtgctgaagaaataaatacaagtttggaaaatggtacagtattggcctgccatgcaaaacagtatttggtataggtggaaggtgtatataagggtctggtttagtggagacactcacataaagaccattcctgacaaaggggtctgactccctttttttctcaggccaggtgatttccgtagttgatatgctaattcgaaaaatcataagtaggatgaacatcaattactcagaaaaagggcaggtgcagggggtcatgcctgtaatcccagcactttgggaggtggaggcgggtggatcacctgaggtcaggagtttaagaccagcctggccaacacagtgaaatcccatctccactgcgtgatggtgaacatctgtaatcctagctactggggaggctgaggcagaagaatcccttgaacctgggagatggaggttgcagtgagctacatcgcgccactgcattccagcctgggcgatagagcaagactctgtctcaaaaaaaaaaaaaaaattactcagaaaagttaaatgaacatgtgtatgacttccagcaagtaagcttttttattatatctttacatttatgggcctgtatttacatttgttattgtaacaatataaagataaatacaaacccaaaagaaaaacaaaagaagtcctttataattccaccaaacattttaaaaaagaattgaggaggccaggaacagtggcttacacctgtaatcacaacactttgggaggccaagacaggaggatcacttgagcccagaagctcaagaacagcctgggcaacatggtgaaaaaccatctctacagaaaaagaaaaaaagagttagctgagagtggtggcgggcatgcatctgtagtaccagctatttgggaggctgagatgggcagactgcttgagcctgggaggtggaggttacagtgagccgagatcatgccactgcattcctgtctgggtgacagagcaagaccctgtctcaaaaaataaaaataaaaaaaataaaaaaaggttgaggaattagttcatttaatacttcatataaggaaggaaaaatagaaaatcttgaatccacgtaatggtggtttgtatttttcactgtatttgcttaagtcaatgttttctttagttcatcttaatcaagaaagagctatccttaggaggactttgaaaaatttactaattattttaacatatcctcagaacaataccaagggaaacaaattcctggccgctggtgagctacctctggtaatgtaacttagcacaagatcaaaggttaagtgcctcttaccagaggagagaagtaatcatttccattatgtgtattttttggagtgttttttttgttaatacaaaatgaaatggactttcccctctacaaaccattaatagctgtgtatgtgcagccaaggcatattatgagtcaattataaagttctcatggtctccagagttcaaatgtaattttatcattttaattagtagtttatccttttaccaggcatcagagtgtcttgtgacaatgtacacaatggcctaccttcactcccaatttacagcaggatggggaggcataagctcttcaaggttgttcaatacctcttcccatttatttacactggcagtggttcaggtcttgggaagttaaccctgtttctgcaagcgagggccaaatggtcaggtctggttgagatctgcatatggcagctctttgctagctactcagtactttaaagattcaaagcactctcctgttactgagttcacatatactccttgggagagggatattatcttagaattatcctcctgaaacaacttctgttattaacttttctcattccacattaggaaatcaagaagctctgtccctggaaattcaaacaacttctctagtgttccagaactagcaaatgaggtgggcctgaagccaacacagagctgggacctaggttagtaattctggacttggagcttcaaggctctgctcatgccgatgaaagccacgcagcatgactatcatgaagcaggcaccctggatcactgaaagctctttaactcttggcttaaggtattctggctttttcagtataaaagccattacatttctttgcactgctaatgtcaaggaacaaatgtgaggcaaactatattttctttttcagagacagagtctatgtcgctcaggctggagtgcagtggtgccatcatagctactgcagcctcgaactcctgggctccagcgatcctcctgcctcagcgtcttgaatagctgggacttcaggtgtaccctaccatgtctcacttatttaaattttttttttttgtagagattggggtctccctatgttgctcaggctggtcttgaactcttgggctcaagtgattcttccatctcaacctgccagcctcccaaagtgctgggattacaggcatcagccatagtgtctggccacaaactacatcttctaacatttgattttctccttccatgtacactaatctgcatgttgaagaaatgcaaaatatttaattatactgcatgggcagaaacatgttagaaaacggatattaatgtgaaggcaatcactgcagagatgtgtgccagtcagattagtggtacagcttcctgctgaagatgattaaaaagaaaagagaaactcacacatccaggggtaattgactcagtgcaatttggcatataattatactgaggaccataaattctctatgatttcacagctgaagtaagacgaccccaatacacttaaaatggaagtattattctctgctgaaaatctgtttattgaaaaggacaaaagggaatccagattgggctaggaagctgctagaggagcatttagtctcagcatctcagtgtcatgatcagtgtctgatgttgcactgtttgtatcagtggctgatgtaagctgatgatggcatttttttttattatagttttaagttctgggatacatgtgcagaacgtgcaggtttgttacataggtatccatgtgccatggtggttagctgcacccatcaacccattgtctacattaggtatttctcctaatgctatccctcccctagccacccccccctcagcccccaacaggccccagagtgtgacgttcccctccctgtgtccatgtgttctcattgttcaactcccacttatgagtaagaacatgttgtgtttggttttctcttcctgtgttagtttgctgagaatgatggtgtccagcttcatctgtgtccctgcaaaggacacgaacgcatccatttttatggctgcatagtattccatggtaaatatgtgctacattttctttatccagtctatcattgatgggcatttgggttggttcccattctttgctattgtgaatagtgctgcaataaacatatgtgtgcatgtgtctttatagtagaatgatttataatcctttggtatatactcagtaatgggattgctgggtcaaatggtatttctggttctagatccttgaggatctacactgtcttccacaatggttgaactaatttacaatcccaccaacagggtaaaagcattcctatttctccacatcctctccagcatatgttgtttcctgactttttaatgatcgccattgtaactggcatgagatggtatctcattgtggttttggtttgcatttctctaatgacaagtgatgatgaacattttttcatacgtttgttggctgcataaatgtcttcttttgagaagtgtctgtgcacatcctttgcccactttttgatggagttgtttttttcttgtaaatttgcttaagttccttgtagattctggatattagccctttgtcagatggatagattgcaaaaattttctcccattctgtaggttgtctgctcactctgatgagtttcttttgctgtgcaggagctctttagtttaattagatcccatttgtcaattttggcttttgtccctattgcttttggtgttttttttgttttttttttttttttttgagacagagtcttgttctgtcgcccagactggagtgcggtggcgtgctcttggctcactgcaagctccgcctcctgggttcatgccattctcctgcctcagcctcccgagtagctgggactacaggcacccaccattatgcccggctaatttttttctgtatttttttagtagagacggggtttcaccgtgttagccaggatggtctctatcccctgacctcatggtccacccgtttcagcctcccaaaatgctgggattacaggcatgagccaccaagcctggcctgcttttggtgttttagtcatgaagtctttgcccatgcctatgtcctgaatggtattgactaggttttcttctagagtttttacggttttaggtcttatgtttaagtctttaatccatcttgagttaatttttgtataaggtgtaaggaaggggtccagtttcagttctctgcatatggctagccagttttcccagcaccatttattaaacagggaatcctttccccattgcttgtttttgtcaggtttgtcaaagatcagatggttatagatgtgtggcattatttctgaggcttctgttgtgttccattggtctatatatctgttttggtacccataccatgctgttttggttactgtagccttgcagtgtagtttgaagtcaggtagtgtgatgcctccagctttgttctttttgcttagaattgtcttggctatatgggctcttttttggttccatatgaaatttaaaatagttttttctaattctgtgaagaaagtcagtggtggcttgatggggatagcatttaatctataaattactttgggcaatatggccattttcatgatattgattcttcctatccataagcatggaatgtttttctatttgtttgtgtcctctcttacttccttgagcagtggtttgtagttcttgaagaggtccttcacatcccttgtaagttgtatttctagatattttattctctttgtagcaattgtgaatgagagttcactcatgatttggctctctgtctattactggtgtataagaatgcttgtgatttttgcatattgattttgtatcctgagtctttgctgaaattgcttatcagcttaaggagattttgggctgagacgatggggttttccaaatatacaatcatgtcatctgcaaacagagacaatttgacttcccctcttcctatttgaatacgctttatttctttctcttgcctgattgccctggccagaacttccaatactatgttgaataggagtggtgagagagggcatccttgtcttgtgccggttttcaaagggaatgcctccagcttgtgcccattcagtatgatattggctgtgggtttgtcataaatagctcttattattttgagatacatttcatcaatacatagtttattgagagtttttagtgtgaagtggtgttgaattttattgaaggccttttctgcatctattgaaataatcgtgtgttttttgtcattggttctgtttatgtgatgaattacgtttactgatttgcgtatgttgaaccagccttacatcccagggatgaagcctacttgatcgtggtggataagctttttgaagtgacacttggttcggtttgccagtattttattgaggatttctgtattgatgtttgtcagggatattggcctgaaattttctttttttgttgtgtctctgccaggttttggtatcaggatgatgctggcctcataaagtgagttagggaggagtccctctttttgtattgtttggaatagtttcagaagaaatggtaccagctcctctttgtacctctggtagaattcagctgtgaatctgtctggtcctggactgttttggttggtaggctattaattactgcctcaatttcagaacttgttattggtctattcagggattcgactttttcctggtttagtcttgggaggatgtatgtgtctaggaatttatcagtttcttctagattttctagtttatttgcgtagaggtgtttatagtattctctcatggtagtttgtatttctgtggaatcagtggtgagatcccctttatcattttttattgtgtctatttgattcttctgtctttcttctttattagtctggctagtggtctattttgttaatcttttcaaaaaaccagctcctggattcattgatttttttttgaagggttttttgtgtctctatctccttcagttctgctctgatctatttcttgtcttctgctagcttttgcatttgtttgctcttgcttctttagttcttttaattgtgatgttagggtgttgattttacgtctttcccgcattctcctctgggcatttagtgctataaatttccctctaaacacttctttagctgtgtcccagagattctggtacgttgtgtctttgttctcattggcttcaaataacttatttatttcttccttaatttcattatttacccagtagtcattcaggagcaggttgttcagtttccatgtagtcttgtggttttgagtgagtttcttaatcctgagttctaatttgattgcactgtgctctaagagactgttatgatttctgttattttgcatttgctgaggagtgttttactttcgattatgtggtcaattttagaataagtgtgatgtgttgctgagaagaatgtatattctgttgattcagagtgggagagttccgtagatgtctattaggtccacttggtcctaatagaccaagtcctgaatttccttgttaattttctgtctcattgatctgtctaatattgacagaggggtgtttaagtctcccactattattgtgtggaagcctaagtctctttgtaggtctctaagaacttgctttatgaatctgggtgctcctatattagatgcatatatatttaggatagttagctcttcttgttgcattgactccttaaccattatgtaatgcccttcttagtcttttttgatctttattggcttaaagtctgttttatcagagactaggattgcaactcctgcttttttcttgctttccatttgcttggtaaatattcctccatccctttattttgagcctatgtgtgtctttgcacatgagtttggtctcctgaatacagcacaccgctgggccttgactctttatccaatttgccactctgtgtcttttaattggggcatttagcctgttcaaatttaaggttaatactgtttgtgtgaatttgatcctgtcattatgatgtttcctggttattttgcccattagttgaagcagtttcttcatagtgtcaatggtctttacaatttgatatgtttctgcagtggctggtactggtttttcctttccatctttagtgcttcctccaggagctcttgtaaggcaggcctggtggtgacaaaaatctctcagcatttgcttgtctgtaaaggattttatttcttcttcacttaagaagcttagtttggctggatatgaaattctgggttgaaaattcctttctttaagaatgttgaatattagcctccactgtcttctggcttgtagggtttctgcagagagatctgctgttagtctgatgggcttccctttgtgggtaacccgacctttctctctgatgattatgtgtcttggggttgctcttcttgaggagtatctttgtagtgttctctgtatttcctgaatttgaatgttggcctgtcttgctaggttagggaagttctcctgggtaatatcctgaagaacgttttccaacttggttcctttctccccatcactttcaggtacaccaatcaaacataagtttggtcttttcacatagtcccatatttcttggaggctttgttcattccttttcattctttcttctctaatcttgtcttcatgctttatttcattaagttgatcttcaatctctgatatcctttcttccgcttgatcgatttggctattgatacttgtgtatgcttcacgaagtcctcgtgctgtgtttctcagctacatcaggtcatttatgttcttctctaatctggttattctagctatcaattcctctaaccttttttcaaggttcttagcttccttgcattgggttagaacacgctccttttgctcggaggagtttgttattacccaacttctgaagcctacttccatcaattcgtcaaactcattctccatccagttttgttcccttgctggcgaggagttgtgatcctttggaggagaagaggcattctggttttcggaattttcagcctttttgcactggtttttcctcatcttcgtggatttatctacctttggtctttgatgttggtgactttcagatggggtttttgtgtggatgtcctttttgttgatgttgatgctattcctttctgtttgttagttttccttctaacctgccctctgctgtaggtctgctggagttttctggaggtccgctccagatcctgttgcctgggtatcaccagcggaggctgcagaacagcaaagattgctgttctttcctctggaagcttcatcccagaggggcatctgccagatgacagccagagctctcctgtatgtggtgtctgttgactcctgctgggaggtatctcccagtcaggaggcatgggggtcagggacccacttgaggaagcagagtgtcccttagcagagcttgagcactgtgctgggagatccactgctctcttcagagctgtcagacagaaacgtttaagcctgctgaagctgtctccatagctgccccttcccccaggtgctctgtcccagggagatgggagttttacttataggcccctgactggggctgctgcgtttctttcagagatgccctgcccagagaggaggaagctagagaggcagtctggctacagtggctttgctgagctgcggttcaaacttccccatggctttgtttacactgtgaagggaaaactgcctactcaagcctcagcaatggtggacgccccgcccctgaccaagctcaagcgtcccaggtggacttcaggctgctgttctggcaatgagaatttcaagccagtggatcttagcttgctaggctctctgggggtgggatccgctgagctagaccacttggctccctggcttcagccccctttccagggtagtgaaagattctgtctcgctggtgttccaggcaccactggggtatgaaaaaactcccgcagctagctaggtgtctgtctaaatagccacccagtttttgtgcttgaaacccagggccctggtggtgtaggcacccaagggaatctcctggtttgcgggctgtgaagaccatgggaaaagcatagtatctgagccggaacgcactgttcctcacagcacagtccctcaaggcttccttcggctaggggaggaagttcctcaaccccttgtgcttcccgagtaaggcaaaaccccaccctgcttcagctcgccctctgtgggctatacccactatctaaccagtcccagtgagatgggccgtgtacctcagctggaaatgcagaaatcacctgccttctgtgttgatctcactgggagctgcagactggagctgttcctattcagccatcttgccagccacctagcattttattttatttttttaaaattttaattgttttttgagacagagtctctgtctgttgcccaggctggagtgcagtggtgtgatctcagctcactgcaagctctacctcccaggttcacgccattctcctgcctcagcctcccgagtagctgggactacaggcgcccaccaccacgcccggctaattttttgtacttttggtaaagacggggtttcaccgttttagccaggatggtctctgtctcttgacctcatgatccgcccacctcggcctcccaaaatggtggaattacaggggtgagccatcacgcccagccgactttgttgcccaggctggaatgcagtagtgggatcatagcttactgcagccttgacctcctgggcttacgtgatcctcctgcttcagcctccttagtagctaggactacaggagtgcactctgccataccaggctaagttttaaattttttgttgaggtggggttgtgctatgttacccaggctggtcttgaattcctggctcaaatgatcttccaggctcggcctcccaaagtgctgggactataggtgtgacccacagcacctggcctgatgatggctttttaagtgtactaatgatctcatcagaggagccaaatgccacatgactcaagaagaaagaaccaaacagtccggatccagggtgaaagccttcttcagctattcttcattctgtagtgtctatgtgtggtgttcccgttaagggtgagaagggaaagcaatgaccctgtgttggggcctccaaaagcaatcacgtccctccctacaaatcattgagaatcctggttgctgaagaatgttaaaataataatatgtgattaggagaatgacagtgctgcaacatcaaagaaaaaagccgggcaaagcagaaggattcgacccatgcttatgtgataaatttggtgccagctagttgagctgaggaatctgagagattagaagttgttggagaatctgtggtttcagctaaagcagcagagaatatggccaaggagtccatttgggtctaaagtagagaagaggttggtgcagagaagctctgtgggctgagtccaggagactgtttggactttgggtgataaagaagagagaagataccatctgaagctgggttggtatattttgggttcagagcaaagagggacctgtttctctaggatgaattgaggtaattctgctgcgatctggcagatggacatagagagagataagacaagatgacctcaagagtcaagagtgagaagagtcgtaggaggggctctgtgtgtgtgagagacggagagacatagggagttcttgaagtgactgtttaagatttcaaatgtgtgccaagatatcggggtaaggttgagatgtatacatttatgttattctctatgtatgagtaccctgacactacctttattttaattaattaaattaattatttatttacttttgagacagagtctcatacttgtcccccatgctggagggcaatggcacaatctcggctcaatgcaacctttgcctcccgggttcaagcgattctcctgcctcagcctcccaagtagctgggattacaggcgtctgccaccacgcccggcatgaagtttcaccatgttggctaggttggtctcgaactcctgacctcaggtgatccgcccacctcggcttcccaaagtgctgggattacaggcgtaagccgctcctgacgtctaccttgaattttaaaatagcaggtgtgcttcatggtgctcaattggatatgcttcacaggagtaaacatgtttgggaaatgttatcaaaaccaggaaggcataaattgctacctttctatgggatggcaatagacaagttcccaagagaggcagcaacagacccctaggggagagcctggcagggttgtggacttcctgcatgcaggcgccctaggatcctgggcttcttcctagacccttccctgggtttgagagacaggggagcgaggcaggctatgggatcctatatgtatcatcttagaagtaatcagatacaacaaggtagctggcatcttagcaaatcacacagctggaagactttaagtaaatctctgtggggagccagagggctcagatctggaaggagacagctgctggatgaggaataagtaacaactgaaaagtcagggcagcccagtggcaggccccttaccagtggggttgaggagaatgacaggctcgctcctgcagccactcaggtacaggcagttcatccaggaagcagtaagggacagagggagaagagagaggacagggatccaagtcccagaaaggagtataagatggagactttgtcttagaaattgacatgaaagcttacttgctaggacaaaggcaagcaagggtctctggagtgttctcaattctgtgaaggcaggatcagcccagagctggttaagatgtggagcctgatggtgccaacaggtcatgaggccattcagggaaaacaagggttaggaaggaggatggggacccaggcacatgatggcactagaggtcctgaattccaaattccagaatctttgaagtggtgtcaagattgtgtctcaggatcaccggatatagctggtccttgggatggaatgtggcgctgtcctgacaaaagacctgaacttgccaactgagagcctttgattcacgtgctctgaattttattgcatttactccaaatgccactgggcagttgtccatgcataggctggagaaattaataggaagggcaagaaaacatgagaagtatcataaagaaatactataaaggacaaataaatgagactggtagtgaactagacagacacagaaaatagaggacagaaattcccagaactgcttcaagcacgaaagtgcagtggccctgatctctgtagaaggaggagtgtgaggaggatgtgtgttcagaggagagcgagtggctgttgtccacttgtttctttttagaagacggagggatatttgaaagttcactagatatggacacattctctgcattcttcttctcttttcgttcttttttgttttttgtttttgttttttaattctagaaaagaattgtttcttattttcctcccgaagatgcaaccaaatgccctcttttctggaaacattttagttgcagcttcacagactccatttacggttgacatgcattctttcccctatgaacacacctcagcagccgccagagggagactttccacacacggtttttgcgaagagaatttccttggagattactgcaccctacatgatacaaattcctccccacgttccccttcacaggcagggcttctaatcttgacagttcccagagcagcagtcatggctatatcaggcaattataccattgggaacattagggctgctttgtaaaaccataagcacccaagaacagatactttaaaaaatgtaaaaacaagacagcagtgacagcagaaaggacacagcagctgagtcacctcactgcatttctccacatcctagcccctaggaggatgctctgcggggcccacgggaagggctgagtgccacatgccagggaccccagaggttggcaagaatggctttgcctagagaccatgcttcctttcaggtgttgcagggagaggtggcaattctgtttcccacattaaagaaaaaattgaccgggtgtggtggctcatgcctgtaatcccagcactttgggaggtcgaggcaggtggattacttgaggtcaggagttcgagaccagcctggacaacatggtgaaaccctgtctctactaaaaatacaaaaattagctggtgtggtggcaggcgccagtaatcccagctactcgggaggctgaggcaggagaatcgcttgaacccgggaggcagaggttgcagtgagccgagactgcaccactgcactccagactccagcctgggtgacacagcgagactccatctaaaaaaaaaagaaaaagaaaaaattaaatttcatgacttagtgagaaatggtcattttgggggtccattgcttgatttttttttttaaatcttcttaaacaactctgaattaaaatgtctgagagaacacagtgactcatgcctctccacttcccagctttccaactgagcagcccactgggttggaggtatcttgccaagagggaagtatttttaatttgggctttatctgtcactcagctgtggtcatagagactggcaggaatgcatgcaattagaagaagaaagaacacctttatgattccataatattagtatttaatgccttttggatgttttggatagcagtcttgtgtaaagagacaagacatgaatacatgcaaaagcaaatgagaaaagtcagcatttataacactatatttggggattccagaattgggtaatagaggacaaaagtgtgcatctctaaggagttatttctgtagttcagttcacaaactgcagagtggaataagcttagcagatagaaataagacattcagttttttattagaagagaaacacacataatttggtagggctatttaaatttttgagtcaaacgaattttgttggcatgatgacttcagcgaaccatctgcaaggctatctgaaaggactctaaaataaatgaagggattattccagtttattttgtggaaagaaacattttcaacttttcaggctactttttttttttttttccaggaaacttcagggggttagaatgcagttttgctttgctctgtatacctccttgtcaacagcattgtgcttgtatggtgcagtattatagttgcaatgagttatctgtatttatcccttaaaaatttgctggaaaatatggagctaaacatatcatactgatttagtcgcagtataattcttcataaaaggctactctgcccaaaccatcagaccccaaggagcattaaaatattgtttcaccaagggcccaggacttaaacacaattccagactcaaaatgtcattttaactaaggtgaccatatatcccagtataataataataatagtaattattattattattattatttttgagacagagtcttgctctgttgcccaggctggagtgcagtggctcgatctcggctcactacaacctctgcctcctgggttcaagtgattctcctgccttagcctccctagtagctgggatcacaggcctgtgctaccacgcgcagctaatttttgtatttttagtagagatgaggtttcaccatgttggccaggctggtctcgaactcctggcctcaggtgatcctccctgcttggcctcccaaagtgctgggattacaggcgtgagccaccgcgctcggcccccagtataattattaatggtgcatttttttttttttttgagatggaatctcactcactctgtcgcccaggctggatcgcccaggctggattgcccaggcgcaatctctgctcactgcaacctctgccttggggttcaagtgattctcctgcctcagcttcccaagtaactgggattacaggcactcaccaccatgcctggttaactttttgtatttttagtagagacaagttttcaccatattggccaggctggtcttaaactcctaacctcaagtgatccacccacctcggcctcccaaactgttgggattacaggcgtgagccaccacgcctggcaaatggtgcatttttcacactcagtttggaagatacaataaatggccagcatgcatttaataccagccctgaagcttgcagggtgatggacacataagggccattgtgtctccacactcaggaacagcattgatgtgcttaatgaggacaggctgactccttcccttcagccttcctgcaaagagcaagcatcaacagctcccgggcaaaaataaaaggccaaggagctggaaaataggatataaattttcttacccaaagctttctcaccaaagcttgtaggtatgaaaacgtaatgttagtctgcaagcataaatgttgatgttggagatggagcttatcgaaggcttgcacatgtgagactctgagtgacgtcagtgatgtgttgagcaacattgtgatctggatgcagagagaaactgaagagatgacagaatgatctgatacagaccacagagaggcgactccagccagaagggtatgttgacttactaggggcaagtaagcaagaaacttcaggaaagcacacagccctaaactaatacgtcctggtagaaaaaagtttccccaaatgagaacttgacaaagaggtattcaaaagaataccaacatctacaagatatcagtgccactgagtttgggaatgggcggaaaaggaattttaatatggaatttaagagaagaactgagttcagcaagggagaactgaatgacatcaaagtattacgcatgcaattgtgggttacatggagaatataatggagaaatgggttgttaagggactgattaattagtaagccaagatctagtatttgtttgcttatctcttatttacccacctgaacccacctatctgaatacagtttatatcttaatatttcatgactcttgcaagttctctcattgtacctctacgctctaagaaaagaaagggagaaagacggtggtgtgaagatctctatctttggaagagaactacttctcatgcttttgatggaagcagaagaaaatggaccctagacggggtgcagtggctcatgcctgtaatcccagcactttagaaggccgaggtgggtggatcactggaggtcagcagtttgagatcagcctggccaaaatggtgaaaacccatctctactaaaagtacaaaaatattagccagatgtggtggtgcgtgcctgtaatcccagctgctcaggaggctgagacaggagaattgcttgaatctgggaggcagaggttgcagtgagccgagatcacgccactgcactccagcctgggtgacagagtgagtgagactccatctcaaagaaaaaaaaaaaaaagaaaacagaccctagattatcttgtgcatgtcttttcattgcgcttagaatactacactgtaatcgtggatatatttgtctgttttcctgcattggtgctgcgttcctggaaggtagaaatcagtttctatgaaggcaaggattatgtctgcctgattgaaaggggcttcttggagctctttggtcacattaaacgggcacaggaataaagttcttctaaagaagggatgttggggccactgggtgacttggtgcttaggagcagaggactaccacagaaggaacctcttcttggccaggtctgcaatctcttttgaaattcagaatgacattgtttcatccatgagaaaatggcaaaaaactgcatacaactcatcctttgtaattcctttttttttttttgagacagggtctcactctgtcacccaggctggagtgcagtggcgtgaccccagctcactgcaacctccacctccggggctcaagcaatcctcccacctcaacctccagaatagctgggactacaggtgtgcaccaccacacccagctaatttttgtacttttcaggagagacgggatttcaccatgttggccaggctggtcttgaatgcttgacttcaagtgatccacctgcctcagcctcccaaagttttggaattacaggcatgagccactgtgcccagctgtaattcctatctgagcaagaacacacatctgaccgttgtaaaacaaaatgttttttattgtgagagctgtgaattcaccaagttgaagttcatatggggtgatctttacccattttgcctgagtggtatcaggggtggaggagtcatgtcttcctaccctagcgcccaggattccagcttcttgtcaaggctccctgcaaaggacaatacaagtgtctcatttctgctccgtttcctgcctcttcctctccaagagcaccttcaggaagggtggaggatgagggaatctgtttgcgatgggcatctggacttaagtggctttaaattttggggcacactctacaacaagaatttaaaagcttaagtaagcacaatcgtaagtaagctaaagcttggaaatggtaatgaaggaaaaggatacaaaaggacctgaattagctttttcttggagaaaataaattgtaagagcgtacttgacagtacgcgtaaagagactcctcattgtgactcagatatgactttctgaagcttctctcccaggtgcacattaggtggaaggaagaagggagagaggaccaggtttctttaaaaacagatttttcagggaaatctctgtctgcctttgagatgccttacacctcttcaaaagcctacagtttggttgaatccactctccaaaaagactgggacagaaaaaaatttacaaagtctatttgtttagttaatttattcaacaaatatttactgagtatttattatatgccagatactggttatacaaccgtggaaaaaacatagtccttccttcaaagtgctcctataaatatacacttgcaaatgatggcaagtgctatgaagaaaaactacatagaagaacccaagtcctgggcctaaataaaatgagaaagctgccgtgcaacctgacatgcactccaaccccctacacaccttccttcactctgtgctggcccaatctgcctccaaatatttaccgaagacacccctttaggagccttcctaagactgaagaatgtattttaagaatgcttcactatacaccagtaaaccacagagcagtattgtgccagctcctttgatctgataagctttgttcgaatgtgagctgaactgttagcatgtttgacctgaagttgagttctcaacaacgtaccagtagagttgaaagtaattgcacatgtccactgtatacaatcccttggtcatttagggagacagtacaccaggcttttcaacattttttcagtctgtgcagaacatgtacatttgcactgggtcctagagactcactgtaaagcagcagtgcagaaattgaagatttagcacatggtattgacatgaaaagtcaatggaaaaagtaggtttccatgcaagactgtgaacccctccagggcaggcacgatttcccccagccctgcacccggggtttggcacagagaagtgttcagtgtttgcgggactgaaggattcaataatacttgatattcctcttttctctgcattcctaccgttgccatgcccagttaatactggaattagaagtagacagcatgggcataagggtatgatctcctgcctctgagatctaaggagcccaggacaggcccaaacctggtttcctttatacatcagttcacaaaactaaaactcaggtctatagaagatgaattactgctactcctacagccaatgagaagcacatttaaaatagggagctgctattttctgtagtggaggaagtgattcttcctgtgtggctacgtttagcacatatagcttgggacatggatggatttatgcttctctgtgcagtgggctctctccataaatacccaatggtctttcattttacactaggaaagacaagctaccaaaacggaacacttctcacacactcttatcctactcctaccaaaaggaaggaatatttagggaaaatgatttgaggggctgggactcaagactccttgtgataaaaaattctcacctgcccctgcagatttttgataggggccctacgtcatcccccgccctttctcctccacacccagcttcaggctctgcagagggacatgaatttgaatttttgtttgtttgttagtttatcaagaagaggtataggtttagaaggttaaagactctggtctaatgttctccccactgttcccagaaaagctcccgtcaaggacggtgtcaatgactgtggagaggaaagcacagccctcttttacttatttattccatatatatttttaaagcattcactatagatgtcactgttctaagagctggaggcatagtagtgaacaagacagaaaaattttttggctggaattgagatgacaaatacacaagtgaatatttaatttcatgtggcagtaagtgtcatgaagaaaaagtaagcattgcaaaggacaagagattgacttggggcagagccaagtggccatgagacagagatgtgaacatggagttgggaggtggaggaaggactccaggcacgggtgtagggggtgggtggaagcagcgccagagccctaaggcaggaacaagctcgctgggttccagaaggtcagagctctccatgtgtgggtcatggttccctggtgagtgtctaataagtaacaggtgttcctgagaaggtggcacacagaggtcagagggcagggctagggaaacacgggagtgagggcaagaagaaggccagtgcgtctgcaacagaagagtccagaaacacgacagaggaagtcagagagccaggaggggccgccctgggcaaggtctggcagagacttggctataaacacgatgatctcagccacagagtgtaagagggcagcacaaagggaagtaaaaacaaagccaagggcatatccttgttgtttcaggcatttaaatctgataagaacttgataactggagagaataaaagctacagcttgatgccccttctgtaatgactccagtgatcaatgctttcatcatgcaagtgaatcagatcatatcactatgaatgataaaaattgtgttaaagaatagccaggtaaatcgacctgtttataaaatgtatatgcccaattagtctattggaacaaaaatagaatgtaaaacaaaaaataaaaatacccacctaggtgagacaacttcaacttcaatcacctaaaagtggctcacgtatcccacccagatcatcagctgtgttgactgtggtgaggaataagacagaaatccagccgggtgtggtggctcatgcttctaatgccggcactttgggaggctgaggcaggaggatcacttgagcccaggagtctgagaccagcctgggcaacacagcaaagctccatctctacaaagaaaattaaaatattagctggctcagtggcaccacctgtggtcccagctacttgggaggctcaggtgggaggcttgcttgagcccgggagatcaaggctgttgtgagccatgatcatgccactgcactccagtctgggcaacagagtgagaccttgtctcaaaaagaaagaaaaagaaaaaaataaaaaaaggaagacagaaatgcatcggagtatgaggttgtggtttagggatggggagtgtggggatgggctgtgggaagggaggcatacagaaatgtataaggaggcatgagtcctaacaaactattcctgggttctggctagaggtatttttgtgacgatcacactgaccccggtggggtggcatggggggagcatggcctgttaatggctagaagtttgggttttctttctgctcctgaaggctgaggctgcaaacccagaacacacacttactgagtggggatctcactgcactttttgccttctcaattctccttgagaaatgcagccccacctttatttcttgagtgttctagaagaggtggaaaacagcctggactgtagtgggggtcagcccagcatcagtgtggtagtgagcaggggtggacttcgggagcaagagcagcgtttgccgcggggcttgcactcccagcagctcacccgtctctgtcctgaccctccctactgggcacgcagggtctctgtagcacttggccgaggcctagatacccagggtttcccactggaaagtctcacctggggctcatgcttctcacctgtacctgttaactcccacaaggcactccttacagaacacctcatggaattatttaacctcagttattaagagctaatagggacccatagtgttattttctccaagtagcgaataagctctgattttaagcaggcccattacagggagacaatatggtgcgtgaaatggcagtggtgtcagggggctaattactggggagcttgtcaagccacagaactggcctgctaatcattccttggcttattgcagctgacgtcatggggctttcccacagtgcatatgggaaaatgaaggaggcaatcacaagttttagttaaagtgcttaagttactactttctgtagctagcaggactataagtttaagcaagtgcaccgaaaagatagaagcggaatcaattcactcctaactgacttacccagttggaaaggcaaattcgtgggagtgaagttgttctactggtactgtttcctttacagagttatccttcagatgtgttcagaaggatggggcaggacacagtgaatatttgcaaaagctctagtactggcctttaaagctgttattcttttcaatcaatcctcatcaaaccctgccttggtgcaaaaaccagatgcagactattgggagatctatatacacaggatagaccctgaaccaccaacaagtacagcctgggttcgtgtggactcaggaccattctaccgtttctctgtttccctgcttctttgctgctgttcacagccggatcagctgagctacagtttgcacagctgcaactgattggactcccagttgccttttccagaacatgcaattggtgccataatctacaaaagagatattaaccccacaactgaggagattaggagcaaagaatgataagaatgaggacaaggtcaatccaagatggatggcgttgaaggcctgtggacacatcgctcagataactgaagtttttacagtaattggaaagatttgtgcatgtgggggaggcttcagtctaaaaggggaaatgagtaaatgttacagtggcttgttagtagttagaagaatgagcatgtgcaaattgctgtttgggatcaaattaaggcatatggtataagatagaagtatgctcagtggaggcagaagcaataagcggcacattgatgaattatgcctttgcttatacttctattttcagaatttgctttaggtcttccacttgattgtatcttcagtaatcataagtatttggtggtccttcctctgatatgaagcgtgacacttgtgtgatagaaagaaacatgtttatgacacagagcactcaggagagcctggcgcactgcagatgttcagtgggtgtccacggtgggactgctgtgcagagtactcacatttgaacatatgggaaatccaaaaataaaaggttttgaggatgatttaccatgttggattacataggaaaacaggcagccaagtggggacactgtcaggattccgccctattctgaaacacccacatatcctcacagcatcgtccgaggatgtgccctgggaagccgacttgatcaaccaattctgttccaatgcttctggaggtacggtgttaacatcagaaacaatttcttaggaaagaattttatctaagcaccacaagtttcttaatccccttttttaaaaaaacaattttgattcgaaattaattccaggggagacagatatgggtgtcctgttcagtcatataatcctatgaagactttccatggaagcaaagcaaaacaacgtatgattttctaagacagtttagggttttctgctatgcagctgaaatctagaagagtcgtttttggaaagaatcactacaaactacatgctgttttgaatagtccattgtttctcaaacacagccataggttgtgcatgagtagatggatgtatagccccagaagggatggaaatacaatcccagaagggatgacggtacaaccccacaaggatggagatgcacccccaaatgggaggctctggataacacgtacagttcctattaatgttcatgacaaaacctaagcactaggctgaaaatcagctttggtttgctcatcatcttgggttgaaagcctcctgttgcacacattcagcttgactgccacagcatactaataggtttaaaagaattagctgattacgtggtttttttttttttttttttttttttagagggagtctcgctctgtcatgcaatggtgtgatcttggctcactgagacctccacctcccaggttcaagagattctcctgcctcagcctccccgagtagctgggattataggcacgtgccaccacgcctggctaatttttgtattttttagtagagacggggtttcgccatgttggccaggctggtctcgaactcctgacctcaaggtgatttgcctgcctctgcttcccaaagtgctgggattacaggtgtgagccaccacgcccagtaaggttttaaaattccgcagacaacactgcagatgtagtttctctttcttttagatgaaggcttcacaatgctttgaagtaacttgtcctacaaaatatgggttgggaattaccagcctttggtactcttgtccaaggcagtgtaaccatatgaatggaagaagctcaactgcttatttctaggttctcattcctgccacattccctcaaacagagagttccagaagaacatgggtcagaaaagagagaactggtgagcatggctgtttttacttttcctaaagtttcccctagagctgttggaatgggtgagaaatggacaaatgcctttgagctctctctggaaaagagcaagaaaaagggaaggcaaaggaaaagtcaaggaagaggttggagaagggaaaggcacaggctgcaatgaatgtcaccagctaactcagtagcactattcctactagagcttgcacagtgctgcactgaggtgtacaggtgtacgagaaagcattatcctttgtttcattgctttgacacagctcacaatgcaaggtttcttaatcctcttttagcgtaggtttgtcaatatcactttctctctgaatggataacgatgatgatgatttgccatgactcttcacaattccacccagcacttcacttttcctattttcgagagcactttccctttctgaaaacacagatggtttacactattatattaggtcgtggctgtgacagaaacctttttttcttaccataattgcttggggagtttttctggctggaacacaggtacaactgaaagcatgcccttgagagctgagcttttgttagagtaaggactacaaaggcatggatttatatttttaaagacaccatgaactggttttatgtagctttattcctttgtcctaaactccctccacttcaaaaaccacctgcaactgtggtttgcaaattaactgcctctgacatctgaagagggggaaaaaagccctacaaaaatctacaaaacctcacttgctaccagtatgagggtaaaggaaagcaagggaaagaatattttttaaaaatttagtattgatttttaaaaagaattctttactagaagatgttatatacttagataaataacaatagcatagcagcacctttctggagatcatctccaatgatcctgcccaatcactgaatccaaaagatttcatttagtcaagaaaactaatataaaaaaggtgaaacctgaaggatatgctgacatgagatgtactattgcttccagtaggaccaaaccaatgaaacactagctatttctttattaaaaatagtttcttggctggatatggtggctcattcctgtaatcccagcattttgggaggctaaggtgggaggactgcttgagaccagcctgggcaatatagtgagaccttgtctctagaaaaaatttttaaaattatctgggcatggtggcttgtgcctgtggtcctagctactcagggggctgaagtgggaggattgcctgagcccaggaggctgatgctgcagtgagctgtgattgcatcactgcactccagcctgggtgacacagtgagaccctgtctcaaatttttttttcttttattataaaagcgaaacatgcacacctcagaacatttgaaaactaaagtataaggagaaaaacaaaaccattttggttccaatatcaaagataatcactttaacattctagtgcatttccttctagtattttttttttcctgagcaaaaattcttgacacattctgagttatgtgtgtatgtacaaaaacacactattttggatactgttcccatgtcctgtggatttctagtttaatataataccaaagtcctctcctttcccatattattataaacttttttaaaacatttgtggctgggtgcagtagctcgtgcctttaatcccagcactttgggaggcggaggtgggcggattgcttgaggccaggagttcaagaccagcctgggcaacatagagaggtgccgtctctataaaaatttaaaaatttttttagagagtgggttgtttcttatggcttggagcggtgcaaagagggtgagtttgcctttttttttttttttttttttttagtggaaattcaaaacaaggaagagacctccatcccagcagctttatactatcttgtaagccttttggaatatgctgcatttcaaaagaaaactagaaaaaaatagaaagaatatatgttgatgcaaatcctctatagattttctcatagttttatattcactctagaaatgtgatcagcagtccatgaaatctctttagttagatgtttatagacagagatttgagaccaggttagtaccaaggttgtattagccccacttagttatcacaggtaagagagggaacaggaaagaagggtgggtaggaatttcacctccacggggctttggacaagaaagtgcagagaaagaacacgaagtggatgaacagcctgagaaagaaaaggaaggctttctctgcagaagttagcacttaccagtctcttggattcttgctatcacccatttctagaggttcttttttttccaagtaagaagttattgaaactttgttcctcaaagtggtttggggtgacatgtgaccaccccactgtctctgaaatgaagtggtttattttcaggtgactgaaaaaacagtaaagaattttatgcttctgtggagacatcagagtcatcccagaaagctacagcgttcactggagcagcaaatttccagaggaaatcttatgttctcacctctcaattaacagatattcatggggcaaattctatgtacaagaactatagattttgtgtttagatggctaattgctgaaccactgcaaagctacaaagtgactggtatttaaagtctttaactccttgtagggtcacaaggtagtagctgagatcttatattagagtggtaggaagtaggaacttcaagactgctacgtgccaaagtcaagtgcttgcatcctatttatttaactaatttagaaagtgttatgggcttttggattgtgagtttctcgttctctttttctgagaacgagaacagctcttcatgtttcaggttaccaatttttaaataaaaagaaagttgctttaatttgtgtcagtttaacctggatttatgtcaacattctttttatttaaagggatatagcaaatgcaccattaataaaaccagaaaaggcccggtgcagcggctcatgcctataatcccagcactttgggaggctgaggtgggcggatcacgaggtcaggagctcgagaccagcctggccaagatggtgaaaccccgtctctattaaaaatacaaaaattagccaggagtggtcttatatcaataagaggcactgtgtgctgggtacagtggctcagtgtaactttgactggcctcccctttgtgactgtccatgtgaaagttgggtcatgtttgatgggggcatttctaggatgcgtggaagaaatattttttgtattcaacaagcagatgatgttatatgatggagatgaaacagtgcctgcccaactatccacctctaaggaaaccgccttgcccaaaacccccactgacagaattgtggccatttgtgtcactggaatctcagaaggaggaggatgaaaaagtagccacagaaataatgactgaaaatggccaggcacggtggctcacgcctgtaatcccagcactttggggggtcgaggcgggtggatcgcctgaggtcaggagttcgagaccagcctggccaacatggtgaaaccctgtctctagtaaaaatacaaaaattagctgggtgtggtggcaggtgcctgtaatcccagctactcaggaggctgaggcaggagaatctcttgaacccgggaggtggaggttgcagtgagccgagattgcgccactgcactccagcctgggggacgagagtgagactttgtctgaaaaaaaaaaaaaaaaaaagaaataatggctgaaaatttctcaaatttggcaatttgggaaaaaaatacaagcaaatccaatagactttccttctctaaaagtttctaaattatatttgacatttgaagcagaaagtataacattgtgtgatgtaactcttcatgtatgtgtaggaaatatttaagataattttaagttggagagggcaaagagacttgaagggaggtaaggtttctatacttcatccaactggcaaaatgtggatactaggagatctttgtggtgatggaatggttctacatcttgattatagtggtggatacagaaatctacacgtgataaaattatggactatttggccaggtgcggtggctcgcacctgtaatcccagcactttgggaggccggggtgggcggatcacgaggtcaggagatcaagacctgatacagcaaaaccctgtctctactaaaaatacaaaaaattagccgggtgtggtggcgggcacctgtaatcccagctactaggaggctgaggcaggagaatggcatgaacctgggaggcagagcttgcagtgagctgagagcgcgccactgcactccagcctgggcgacagagcaagactctgtctcaaaaaaaaaaaaaaaaaaaaaagaaagaaagaactattcatgcacattgtaacaatgtcaatgtcttggttttgatattgttgagatgtaactgttggggaaactgtgtgaggggtacagggacctctatgtactatctttgtaatttcctataaatctataattgtttctaattaacaagataaaaataaaagacaattgaaagaagtttcttgaaaatgataaaagcaaacatcaaagtatcattgtgattctctggccataatcaacattttagaaaagagaaaggttttcaaaagcaacatagtggatgagatggactcaccaattttcataaattttaaaatttcattatgggacaaatatgtaatggaataagaaagttaggtgaaaaagacatttaaggttggatttgaagagagacaggatggcagtcttatccagaaattcaggatgaacttccgtcttgattagatctgatacttcttgtcagacatacatctctacagcatgaaactggttaaccaatgtcaagtgtaataatattatgtacccttttgaaaccacagaatattctagggataaaagctaattaaactttgacagtttgtcatatattagagataacttagactagttatcttcttccataagtttaattagaagttatagaattagaattagtattctcagtaatattgataattggaagaaaaaggtaaaacaaaataaaaattctcttgtatgttggtggaaattgcatgtcagtaggacaccagcagatggcaaagaaagctttcaaaatgttgatagttacatgatcattgatttgtcattaaaataaatgtgagactgtttcaaatgccgttatagtaaaatcatggtactattcattttggtcttctctatttttaatcaaggacacttggcagcaggaaagttttgccctgaaaacttgacagaaagtcagtggcagtaggtgtagacagaaatgcaaaacttcaggtcttggatttaccacctggagctgaataatgttgctcttaaagtggctttgcagcattgtccaactgccagtgttaattacatggacaatttccaaccgctattagtttgctatatttgttaacatttaatatgaactggatcagacaactctggattatgaaggcttttttaaatggcagtttcttccatcataaaagtgcttatgggccaggcacagtggcttatacctataatcctagcactttgggaggctgaggcaggaggactggtttagcccaggagtttgagatcagcctgggcaacatactaagaccttgtctctacaaaaaaaaaaaaaaaaaaaaattagctgggcctggtataatctcagctatactgggggctgagttgagaggattactggattgctcgagcacaggatgttgaggctgcagtgagctgggattgcaccactgtactctagcctgagtggcagagtgagactctgcctccagaaaaaaaaaggtgtctgtggaggtatcataaagacaaaagtgaatgataaagattcacattgagagagcctgtttttctagtttgtgttttctgattgacctttgtaactgagttgctattgttcacatctttgctctacagttcaagcaagagaccagtcagatcagaattacattagtttagtatttttttacttaacccaagggcacagacatctgaccacttcatcagcctcaaaacagaatttgccacctgcttaatttacgcatgagttggcaaaaattattttctccatttagtgctgtctgacaacaccatgactagatcaggggattggatatttgatcttccaaatccgcataatgtgaaaacgactaagtgtaacaggaaattttaaacccagagagtattttcttttcataggcttttaaaaaaatttaatttcagtctagtttttttcatctttttctttaaacagatatttcacagacaaaccaacatgagaggccatgtcaataatatgtgaacaaatgtttctttaaaaaagagaattttttagaaactgatatagaaaatacagatttcaaatatggcaggaagctaaatgcatatttgcgagaggaaagaatgaaagaaaaaagctcctaggccttttattctataaatggatttgtattaaattatttcagattataccatagtttccaaggcatttattggtgattacagagagaatttcacttactagctgtgtggcctggtcaagttgtgtaacctctctaagtcttacatttttttttctctgtttgatttaaatgataatatcatgtgcaagtcatagagtattcattacggttacattagacaatgtatgcagctgtttgtatgcttgtcaaataataagtgcttaaaggttagctattatcattattattaaactaagccacattgagagatttaaaatcaaagccaaagtagggcattctaatttgtaatttgcataatgcttccttgtgaatgatctcatgtgaaccttacaacagcctttaaggccagtgtgccagaaaaccctggaagccccttcactgtttgccatgcaataaccccgaatgtgggcaaaggtggacttgcttgttggctgtctgtgaggcatagcccctcaaggttggcactccgttcccaagaggtgatttatgtacttcaaaacaactgcaggagatggaagcacatggtattcttcagattttaaatcttgctctgtgcctgataggacttttgcatttttatgacttcctaatattatagaggaatcctacctcgagtgccccacagaagaaaggagaagttataaccaaaagtctcctgcaaatcatcactgtcagtttccttcaatgtaacagcagacaaggataagttgcctcacaaaaggagtaggttgtgtcataaatcttgctcttttttctttcgtctgagcctgcaagggtggaagtacgcgatgtctccagttccacttggagagattcaaagaaggaaaactcattagcagagggacaaggaaccagtccaggcaatatctgaatatttattatttgattttatcttgaatagaaaagaaaggtgctttgttcagaaagcttctgattgatatctgtccctttgacttctgaacctttgcctccctgctttataacaaggatctattaattaacttggtgcttggcagaaagaactgagctttccccgaactctaagaattctccaaaaatggtcattaatgctgggaagaggatcagcattgtaatctcattttatacatgaagaaactgaagttcagattaacttcatactcaagcaataaataatttgtagagccgggcaccgaaggaacaaagggctgtttactgagagacctgagcttcttattctgactttgcctcctgttggaggttcaccactttgggccttagtttccttacctttgaatgggtttgatgaattagataggtgcagcagactttctctgtaaagggccacatcataaatgtatttggctttgtgggccaaaacattcctgcagagactactctgcaggaactattcaactctgcttttaaaagagggaactattcgctgaaacttctgtttacagatagcaggtaaacaaatgggtgtgagttatgcctgatgacagttaatttacaaaaacaggcagcaggttggacttggtccatagggtatgtttgcagaccactagactggatgatgtagaagtttgtttataactgctaatatttgatgactcagcttgttttaatagcaatgctattttccctaggaaagtcagcttgattattcaatcgtctgtggcttgtgcagtttgtggagtacttaaagatttttctgcagcttttcctttcttcttccatttttgaatgcctgctgtgtgtattgcaattacaaattattatcttaatgtcattctgcttagggtttagggtttgtgtggggggggagtggggagcaaggtgtgtgggattggagtgtggagtgcatgaaggtgggtgaggtgtggtctcctgggtaggatgactgacttggaatgaagacccaaacccttaggagaactttctgaatgttagttctgacctcagatgatcaacagattagctgcttttgctatattaagcaaggcttgagcaagtgtttcagagctgccaggaatgggggagggtgtaaggtaggaagatggaagaatgtgtctcaacttagaggaaaatatgatttctcctgttacaaaaatcaaactgtaaatacttctgttactgtggtcccaagctacatccaagagggtaagcactgctttcccatgggggacactgtaccctaggttcttactccccttcctgaactatgtgaaggagaggagaacagttcaactccatcattgtttaataaattcctctaataagagaattagagtattggtggggcatagtggctcacacctgtaatcctagcactttgggatgttgaggtgggaggatcacttgaactctggagtttgagaccagcctgagcaacatagcaagtcttcgtctctacctctacaaattgttttttaaaaattagccgggcacagtggcatgtgcctgtggtcccagctactctagaggttgaggtgagaggatcacttgggtctgggaggttaaggctgcagtgagccataatcacaccactgcactgcagcctgggcaacagagcaaaatatagcacacaggccaaactttaagagtaacagtgtggcaaatgaacctatttactctttataaaacttgtattattgctacacaaagcttctttggaatttcaaagtgaagaattttcttaaaagaccagagaatctgttgggtgtggtggctcatgcctgtaatctcagaactttgggaggccaaggcgggtggatcactggagcccaggagtttgagaccagcctggccaacatggtgaaaccccatctctaccaaaaatacaaaaaattatccgggtgtggtggcatgtgcctgtaatcccagctactcaggaggctgaggtgggaggatcacttgaggcggaggttgcagtgagccatgattgcaccattgcactccagcctgggtgacagagcaagatcccatctcaaaaaatgaaaaaaaaattagccaggcgtggtgatgtgcacctgtattcccagctacctgagttcaggaggctgaggtggaggatcgcagtccaggagctggaggctgcagtaagttataatcataccactgcactccagcctaggtgacacagggaaactctgtctcaaaaaaaaaaaaaacccaaccaaacagaaaaacccaccagagaatatatatcatgatagcttgcctacttctgtcaaggagcattatttctattcaaatgttatatttggcattaaaatcacaaaaagtcttaaatacttatttttaatacctccctatctctttaccatctgcctctccccacctactactttctgggaaaccactgcaaatgatttactttgtgtcctttttgaagttttttctgtacatttacgagtgtgtgcctgtatttggccggatgtgtgattattagacaataattagatcaccacatatgattattagacaatgtttctgcctatttagactattggtatcaccagatacaagtctgcctagctacaatgtgataatgccttttgataggtcctaggaaatattcagcacaggaagtaaaacaaaaacttccccttaaacacatagaattgcattggtatattccttcagaggcaggtttaatccaatcctctgaagtggaggtctgggtgtatttccagcatcaagttctactgttacctgaaatattttagatgattgaggcaagggttcttgttttttcagtcatgatattaactgaatcatgtttgcattctactttcctaccctgatattcctactgtaatattaactgctctaatatttcctcctctaatattaatctaatagtcccaggcactgtggtttatatgaaaacttgttgagtctattggatggagagaaatctgggtgcttgaagtagattacaggctgaaagaacctaagattctaccatagttagacaagccaagaagtcaataagcccaaggaagcataactttaagttccgtaacttcatccttaatttttcctgatttgctgaggtatctccattcatccttgctcacctactaatacctagaggatccctgcagccacctagagctgagcccatcttcataattctctcttgtggcatcagactcttgtctgtgatttcattttatgaatacgaataaagaacaaggctggaagagaaagatttaatagcatattttgctgaaaatgtgagcaattaaaatgggctgacccgaatgtcaaagatttagaatgtggattgctgtggagagaagttctacctaataagtgcagttgacaaaatgaggaatttttttaggacaaagggtaagtttaggaaaaacaacatctgttgtgagtatctgaaaataatgagcaaaggaagagagaaaaggacaaatctacatcaagtcctactaaaccgagatgtgcatctgacccgtgcatgtggggaaatcaataaaattagagcaaagtcatttctcaattttcatagatgagtgtattctttcaaaaattattaggtcctgtaagaaaatcaattttctgcatttttctacaggaaattatacttgattcaatgtaaaaaggaaactacaggaagaaaatgaatatgacagtattgagatcatgtgagaaaaagagaaggaaatgcgtgtgtggggtgtgtgtgtgagagagagagagagagagataaatagcacacaggagtagtaggaggggcagaatgaagggcatagacccttatcatatcataaaataaagaatttttaaagaacaaatccatgtcacagagaaactgtgaaaggtaatattggaaaaatatcctatgtgcttacttagttagaatctactataatggtttagtacttaaactgtttatttttccacacctgtaaagatgatacattatgtttggtttaatgattctgggtgaagtacagctgccctgtgcaaacacttggcattttatgcatcaccaaccccaggggcaagtcacacctttctgcccttaaatccttgcaggggcagccaagcctggagccttccccaagagagttgaaggtggaggtggctcgtacttaggataagattcatagagtccaagaaggagcaaatgcgatcccctctgtgcaggttgattcccttctccccgttttgggtgttttcccacatagcatttctggttaaagccctttagattcaacttagattaaaaatggaacaacatgagacaccctcccagggctcattcatctcctgccctgataggcttgttggattttagaaaaatactacaaacatgacaaatagttctgtagtataagtgtttctcatgcaatatttgggatatacctatccagcagaattattcactctttacctgaaattgaaatttaactggacgacctggattttatttggcaactctattgcttgagctctgggagcctccagagtatctgagaagtgtcttaggagggcagaccccatgtgtgtttggagtgaagagcatgggacaggcgctgatgcaggaagtgtaagtaaaatgacaaaaacacgcaaatctgacaggtgagaagagaaaaaccattccaagtctcttgctactttatctgcaacaccgtttcctgaggcggaaggagtgagccaccagccctttccttcccgactgttctcctgagagcaccccttgtgacttctgggccaggatctgcattttacatatttaaggagcgatttcagctggcaggcaatgagttcatcatacagaagaatggaccagacactgggaacgggttgtgtgttgggtgggggtggtgaaaatgggacacaccaaaagacatagtgataagctacagggacagggcagaccttccaaatcacacttactgcatgaatgcaaacacatacaaacatgctcatggttgatttttcaaaaatatatatatttttctcttcataaataactctcatttaatttattaacctgtggttgttcttggagaatttcctagtgagcaagaatatacggacatctaccatctctggtctggaggtagccagccagggtctgagctgctgggctccctgctgagctgcttggccaacgcaaggtctggaagcatctcttctcctaacactgagatttcagtctgcggtggtcaagaatgaactcctcttgtttaacccatatatttattttaaataaaattatcacctcaattccatatatctagttagaaggattttaacttggatttgaggacctttaaactcttaagcctgcggaagttctagactgaatgataattactgacatttgatgcacctagcactaaaatggagtgatacaatattctgacacaggcttttctttccaatttattcatcattatttatcttgactctaagtttgatgatcttcttgtagaatactctatattgaagttatgctgagttcaatcataaagttaagcctagttagacagtgggattttctttttggaacgcaaatgttatatatatatatatatatatatatatacatgtttcatatgcacgcattgtcatatatagcccacggtatatatatgtttcatatgcacacattgtcatatatagcccacggctatattattatgcaggttccagtgtcacagaaactcgttaagcttttctgtgtctccgtgcctaaaatctactgacaaaaatacagtttaaccacacacacacttaaatacagtttagtgggaaaaggaggtgctatttatacaggatagatcgaagttttaaaatagtgaaataaatctgctttctgttaaaataaaactcataaaatgtgcgaccaatattactgggtcatccgtttcttcttattttctcacagtgatatttcaggtcttttgggatagtcactttgtggctatcttggaataaaacagtcatttcaattctgtgatgggtcataagcagggtgtctggtcatttagggtcacagccctaaaaggccgagcctaattattgggagtaggagctggcggggatcggctcctaggacctgtgtggggatcttggaagtccctcccctctgggctgtgctgtccctccctcatggtgccgttgttgcagtttcccctgtggatgccagagatagagatgggaaagaggtgtgggagagtggccagaggcggggatagaggcagatagggaaggaaaacctttggtttgtaggacatgggtggtatcttgttcctggcaactatgtgtgttgacagcaagggcacagtctttggggacagtcgtgccatagccagcacaggggccaggctggctgagggcccgcgcactcacccgtgctgctctggatggtcctaacggtggtggtggtgcgcggcggcgaggacgacctcagggacacgcactcgtcgtcctgggagcagcctttctcaatggcccgcacatagctgtggctccgcatgcggaagcagccgggcatgggcaggtccagcgcttccacggcctgcgactccagctcgctgaacacggactcgcacacggactcgaactgcccgttcacttccatctcgctcacctgcgggcagacacaggcgttgtgacactcgcctccacctggtggaggatcaacctctccaagcatctgcgaacttcaatccccagaagaaaaagcagcgtctggttagattaagctcaaatgcattttatttcctttctgttacaggctataattgaatggcatccgcttataattccaaacaatagattactttttttttcttgtatttttagtagagacagggtttcaccgtgttggccaggctggtctcgaactcctgacctcaagtgatccacccgcctgggcctcccaaagtgctgggattacaggcatgagctaccaccaccagccgtgattacattttaaagaaaaaagggcaccgtttgtagaacgcaaggaaatgtggggcttattccaacgcatgacattcttatttataaaggcaaacttggagaagaattttaccagtccattgtcagagttcatgtattttggtatcactttttagcacaaacattttagaaacgagtatttttacagtgccttttgaagtgactagtttgtcaaataatttcagtgttaagcttaatttagtgcaaggtatggaaacatgccctatattttctggcaagatactcacgttttgcacaaaaatagactaaactcagatatgtcaaaatcttgaaaagcaccatcaagattttcaaactatttacaagtttcagtcttctttataaaaagcccatatgggctgactgttgtggctcgcacctattacccagcactttgggaggctgtggcaggaggatcacttcagcccaggaggtcgaggctgcagtaaggcctgattgcaccactgcattccagcctgggcaacagagagagatcttgtctcaacaaacaaacaacaacaacaaaaaacctgataagattcataaattattaatgtattttaaaaaaatttgctacagaaatatttggcgtaattggaaaaaaatctttgaaatgggggccctctttttttgacgaataagtttttattgatttatattcctcctgtatataacttacattaggtttgagccccacttaagaaaaaatattcctgactagatgttccagtcaacttctcactttttagttgacttgctagagatttgggagcatttctcaattttctgttaccttccaggacatcttatctctattttcctaatatcaaattcatgaggcaccgagaatttaacaaattaaactacaattacgttttgaatacttactgaaaactattacaatttttggctgtctcctcattttgtattatctgaagttgtgctccagtaatgactaatttctttaaacttcagataaaagtgaccaattaccttaaggcatatcaatagaaagagacatacactttttaataagaattctttacagtttaaaaatgctattttcacagtctttatctaatttgttatgtgaaatccctgcatattttccaggctaataactatatgtgtccatattagaaagttatatctctatatatccttgtttttaaagaaatacatggacacacatttagaggtaaaggaatgtatctgcaactatcaaatggagcaagagagacaaagagtgagcaagtgagccaaaatctcaacaatccatacatttcaatctgggtcaaggatatacaggagtctttgtattacatgtgtgactcttttttaaggttgcaattatttcaaagccaaaaataaagcaaatatatatgtgtgtatgtctatatacatctgcaaatgtatgggtgtatatatagacatatatataatatatgtatatgtatataatttattcatttttccccttttaatcaacatgccaaactttacaaagagatagcaaaatatttctgtcaaggtaacaaccattaaactcggatgattatctttccagataagtatatatgtcccctcttctactttgtataaaacttgaatcatatagtaaatataattctgcaacttgttggttttttacttaaccctctaggttaaacttatattcttttctttttttgagataggttcttgctctgtcacccagggtggagtgcagtggcacgaacaaggcttactgtagcctcaagcaatcctcccgactcattttcctggatagctgggaccacaggtacgcaccaccacgcctggcttttttttttttttttggagagacagggtttccccatgtttcccaggctggtctctcaaactcccggtctcaaaccatcctcccacctccacctcccaaaatgctgggattacaggtgtgaactacggctcctggctaaacttatattcttaacagaattcttcttcattcccttttatccttttattttcattatacacagatacagaaaaccatacaaaataaatatagaacttaatgaattataataaggcaaacatcctggaaccactacccagatcaagaagcaaaacttttctggacaccctagaagccctccacatgcccccatattcacaatctccactctccctctaatagtgcttaactagtaccctgagttttattgcgttcacttttgtgcatttctttatgttttatttcacccaagcgtgcatccctgggctctagttagtcttacccattttaaaaatctgatacactttaaaattcacctttaacatacacttattttgacttatctattgagcatctagattgtttgccccatagaggttcccatagtctgggttttgctgatttcatactcatggtggagttcatcatgttcctctgcattttgtattgcctgaaaattggaatccagattcagagatttgatcagcttcaggttcaatctttttggcaaggctagaggccatgtgtttatttcatcaggaggcacattatgtctagtttgtctctcttctatgttgttaggagttatctatgctcaatgtctagatttgttaatccttgggagctgcaaaatgcaatattctataattacttttataactactagttggaatattctctttcacattacttgtttacttaatgatttagttcatatagaatggtaggataaatgcttgatttgtcttctttatttactaattttcaagataaatttgttctctcttatattccatatgtaatcgatttttaaaaaatatcacattaactcatagatttaaaaatatttgatggttttaagtcaattgaaataattatccttaatgaacttaaatttgtcccatctttggtcagtgggagccttttaggttggtttgggggtctttttgacatgaaagtagtaatctttgagaacttctttgatatctggtatgacaaggtattctaaactcaacttaaacctttcctgcccagtcctggaatcagtatgtttccaaaaagccctttctttttttagtgggaaatggtattacaagaacacaatctgggtactagggagatatattgtcattgctactgggttaatcattgttcttaggccttttcagtgagaagaactaggatataaatactatagggttcttatgtaacctcttctatatatgtttattcttagatctttattccatactaagaatcttggttctcaaggacatgggagatgatggaattggaatattctataactatccatttgctttaacccatagtatatgcacagaaaacattatcagtactacccctgcccacatatgattaaagagcaaacaattttattttacatgtggtccctctattcttttctcatttttacatagttgtgctatatttacattgtcagagcaaataaacgtattatgctccccaaccagtgaacgctcatttagtcttagttctacaaataattgtgtttaatgtttgccgctacaggtggtccatgacttatgatttttctgctttatgatgatacaagattgatatgcattcagtagaaactgtactttgaattttgagtttagatctttttctgggctattgatatgtggtatagtattctctcgagattctgggtaggtgctcagccatgcaattacaagggtaaacaactgatactccaaagtgtactgtgttgccagtgttttttggatattgtggggtttttttgttttgttttcacatcccaccatgtttacaaaatgcccatttttgacttaaggtattttcaactcacaatgggtctatcagggatgtaatcccgttgtaagtagaggagcatctgtagttcttatgtctggtcattttggttgtttagagctcattgtctagtacatttctcagaatgtgttcatggaatcaatatttcctgcgttcatccatgcttataacagtttgtatgttttatacttgaaagtcagtttttctggatataaaaatctgactcacatgtttttccttgagtgtattaaaatgctacacacatcattttcttccagcataaaccattcctgttaaagggtccaatgataactcagttttcattttgttaagtaagttgttctttctgtccagaaatccaaagtgtttttaaagaaattctttaaagtcttgtaattttacaagaatatgtcctgatgttgattgttcagggtcaatttctcaggtacatggtgtgtttacatggtgtgttcttccaatatgtagcttcaaatcaactttttatttcaggagagtttaaaaaaatcattgtttttcttacttgttctgttcctttgattttcttctgaagggacttctattatctgtatgtctaatcttttttgtctgtttttgatatttgtcaatttctctttttaactcttcatttgtgttctctctctctctttctctctctctctctctaagagatagggtctagctctgttgcccaggctggagtgcagtggtgtcatcatagctcactgcagcctcaacctcctgggctcaagctatcctctggcctcagcctcctgagtagctggaacaacaggcacgagctactgcactcagccccatttctttttgattttaaaattttccttcctttctagttcctttttttttagtgtatttttacctttttgtagattttactaacctactttctaaaacatagcagtttacagtccaaacagcaagtaatacagagttcatttctcaacatggtcaccagaatagaatgttagctcagtttttgctgctctatgtcaagaatgatactgtgctgttttgatttacatcctacaaatgtgaataggcacctgtcactttatttactggcttttgacttatttactggcttttgtatttttttctctgattatttttatttataagctttgaccaagattcttttgggttatcttttcttactaatttgtagaaatactttaagcaactataacatttaccctttttgttaatgtgtgtcaatattcctcccaccaattgtattttaactttatcatatattttgccacacagaaatatttaattttatttagaatagatcttttactttatattttctagaatttgtattttattacaagtaataattctgaccacaatactatctatatattctcctaacatttattttaatgcattttgttactttgtgttattgcttagattttaaatttacttagatgtagtttttacatgggatgaagaagaattttagtgttccttcaattatatagtggacaatttgcttgaattctctgagcttcactttcctcatctgtaaaataagtataataatacttatctcataggagtactttaaggataaaaataaaataatgtcaaaatgcgtattttttttggagacggagtctcactcttgtcacccaggctggagtgcagtggcacgatcttggctcactgcaacctctgcctcccagattcaagcgattcttctgcctcagcctcctgagtagctggaactagaggcgtgtgacaccacgcctggctaactttttttttgtatttttagtagagaaggggtttcaccatattggccaggctgatctggaactcctgacctcatgatccatccaactgaggctcccaaaatactaagattacaggcgtgagccaccgtgcttggcccaaaattcatattatatgtctaggtatatggtacacactccataaaaggtggatattattttttgtgatagtgtagtgggaaaatagtagtaggaaacaaatatgttagtccaactctctgagactgagattcataaattaaaaaatgatctttcttacaggacagatgtgaaattaattagataataagcaaggctactagcatgtatcaggtaatcataaaacggtaactaattattccattgttattctttctactgttaatactactattactagcaatattattgccaccaataccagcaggtattgaagtcatttaccagttaagagtcaggacacttgggtttcctagcctctgtcactgactggctgggtacccacagacaattaatttatctaggtttccatttcattctctttctctctacacacacacacacacgcaagcacacaccatgccacatgcacacacacacacataatgaggggatggcctaagtcaaagtcacggctgagctgctggtattaaaacagctgcctagttacattaattttagaaaaggatgtagaaacccaacatgttgccagagaaaatatgtctgcgggcttctagtttgccattccagatgaaaatacctaggatttggacttgaaataaataaagacataaattaacttggaaatgacagtgactacatgacatatttttaaaatattggactttctataaatacaattctttcttctcaagccctactttaaaagccctcattttaaattagatgtacctatggtaaaaatataaaataataaacataaaaacatacttaatttttttccttatcatccaagcacaatctgtttttagggctcttttactgctgtgagtaataaatgacagaagcaatttagtttttctagaccaactccttggtgtactcaactttctaggagcctttgatgaataatgtgtcaggttttaaagggaaataagatataatgcacttaaattctatagtattatagcttctactaatgatctatttgagaaaatagctctaacatcttaaaagccaacctctttttgaaaagtctagggtatatacagtagcattgctttgaagaggaaactattctcctttgaataatgacaatgttgcaactacaacaggacgtttgaaattatccttaaagatactgtgttaccattcaaaagctagcagaaggcaagaaataactaaaatcagagcagaactgaaggaaatagagacacaaaaaacccttcaaaaaattaatgaatccaggagctggttttttgaaaggatcaacaaaatagatagaccgctagcaagactaataaagaaaaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcactagaaaaagagggaatcctccctaactcatttgatgaggccagcatcattctgataccaaagcctggcagagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaagccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagacgacatgattgtatatctagaaaaccccattgtctcagcccaaaatctccttaagctgataagcaacttcagcaaagtctcaggatacaaaatcaatgtacaaaaatcacaagcattgttatacaccaacaacagacaaacagagagccaaatcatgagtgaactcccattcacaattgcttcaaagagaataaaatacctacgaatccaacttacaagggatgtgaaggacctcttcaagaagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaacaaaaaaagagcccgcatcgccaagtcaatcctaagccaaaagaacaaagctggaggcatcacactatctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgcttggaaaactggctagccatatgtagaaagctgaaactggatcccttccttacaccttatacaaaaattaattcaagatgaattaaagacttaaacgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagtcaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaaccagaaataccatttgacccagccatccaattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattgaaaatcatcattctcagtaaactatcgcaagaacaaaaaaccaaacaccgcatattctcactcataggtgggaattgaacaatgagatcacatggacacaggaaggggaacatcacactctggggactgttgtggggtcgggggaggggggagggataccattgggagatatacctaatgcaagatgacaagttagtgggtgcagcgcaccagtgcggcacatgtatacatatgtaactaacctgcacaatgtgcacatgtaccctaaaacttaaagtataaaaataaaagaaaaaaaaagatactgtgttacttgaaaattgaatatggaactagaaaaatgatgtcattaggaatccatttcagctggccattctttctgtattttacctaaggccgaatggctacgtcatggaattgcagtgcttgacctgacagcattacttctcccatgtgtctgtgcaatgatttgttggtatcttactaagctatcattagaaagtgatgttgccctaaagaaggtcaaatgtgcagccagggactaaaaacagtgagctgcaagggtagtgtgctgctgggggaaattaaaagttctccataaagttatgaaaaccatgaatgtatataaatatttttccaacagaatattttaaatccactgatgtattctgcatgtatgacccctaggtttgtagaccattttataattctcaatgactgtgtgacctttaggccatgcagaataaatatgtgctccaaaaagttttaaatgttatattacctattgtgaaaaagataaaaacaaaacaagtccaaaatgcaccaaaatgaggctccagctatttccctgagaattgggataatgtatatcattggacaagcagtaaccagcacgaataggtttgcatgttcttggagatttctgtaaagcaaggaaacacacgatgggtcagcactgaaatcccacatgacagctttccctggctccctccctactctgcccttggagcctgccctgcagttcctgatttttttcttcaggactccatttagagcagggagcttaattttgttgatagggacagaatgagagcagtgtccctatttcagggtcttattttgacagatgtttcagtgatcagcctaccatttcataattttttctgaataccttgttttcatctataccagcaccacaccatagcatcactatcaccactgtcactgctaccaccatcacaatcacgaccaccaccaccaccactgtcaccatcactatcaccacaatcacaaccaccatcataaccaccaccgccaccactgtcaccattgctattaccataatcatcaccaccaccatcacgaccaccaccgccaccaccgtcaccatcacaaccaccactgccacccattaccaacaccaccaccaccatggtcatcaccaccactgccaccactgtcaccaccaccaccaccatcacatcaccaccaccaccaccatcacctcaccaccaccaccaccatcaccaccaccaccaccaccatcacctcaccaccaccaccatcaccaccaccaccaccaccaccatcaccatcaccaccaccaccatcaccatcaccaccaccatcaccaccaccaccacatcaccatcaccatcaccaccaccatcaccaccacatcaccaccaccaccaccaccaccaccaaatcaccaccaccaccaccacatcaccatcaccaccaccaccatcaccatcaccaccacaatcaccaccaccacatcaccatcaccaccaccaccaccaccacatcacatcaccaccaccaccaccaccatcaccaccaccaccaccaccaccaccacatcaccatcaccaccaccatcaccatcatcacaatcaccactgccattactattaccatcactgtcaccaccatcaccatcatcactgccactaccatcaccattaccatcaccattactatcactaccactaccactgccatcaccataattaccaccaccatcactaccaacaccatcaccaacatcaccaccatcaccatcactatcatcactgctaccaccatcaccatcaccaccatcgccatcatcaccatcactgccatcattatcaccaacacaccaacatcaccactatggtcaccatcaccatcagtaacattaattctcaccttgatgatcacagtgtcttccaaactagcctctctgcttctagcttctcattctctccaatctttcctatgtttttttgccagattagttatcctatgtcaaagttagattcatatcccttgcttgtttaaaagccgaagttttctttttctttttctttttttttaacagagaaagagtcttgctatgtcgcccaggctggagtgcagtgacgtgatctcggttcactgcaacctctgcctcccagtttcaagtgattctcttgcctcagcctccagagtagctgggatcacagatgggtgccaccatgccaggcttacatttgtatttttgatagatacagggtttcaccatgttggccaggctgatcttgaactcctgatctctagtgaatttccaaggaccctcttcattgtgctttatccacttacagagggccccacctcctggcagaccattgataccgggggcttactgcggctgaacccatggcatgctctttgcagcacttgactggacctcctgtctgatccatcaatggtctactggatgaatgactgcctccccacctcatgccctctcaattctcactaaccttcctgccactaatggctcctgaccaccgctgccctgacggccctcacctggctgatggtgctcatggctcgcatgtagctctcattcctggagcggaactttggtgatgtgagcaagcctgcagggtccaggctgtccaggctccggttgatggagacttcactcactgccctcaggtaactatgactccggatctggagtttgggtgagtgttcattggagattctggaagggaacaatggaagaggtgcattagtcacattccaaaatgcaggaagcaataacatgtggcactattgtcatttatgtagcaccctaaatactgggacaaatgacatagatgcccttctgtgattactaaactcccccacagtgtctcagaaggaagagcttttgacaggaaatcatcaagatctgatgacattcgagagcaattaacattctcttcaaccatgaactaattgcctcattcacatttttctagccatcctaggaagcagataataagcagcaattgtcctgcccaggaattctgacttgtgtaatttgtaaagcttttctttgtatctatttctttcctgtggccatctttttgtttttggactgtttggtaacagtaagtgggtatatatctatatctatatttttatctatcaatttatcttccttccttccttccttccttccttccttccttccttccttccatctttaactctctaatatagttgaaattgaacttcgtgaacagaacttacaccttagccattaaaaaggcacaactctcaatctttatatgtaaagacaagtcactacacactttgtattctttggatttattctaggatgcattgtaaaattataaaagtagaaaatgctaattgcaaatagccaagctatacagatgtgcacaaagtagaaggtgggtccctctgtctccccttgttcctgtctgtagaattccatacccttaaaagaactactcatagcagtttggggtatattcttcctcagtccttctattcatatataatcaatttaatgttagttattttatttaattttaattttttttttatttttttgagacggagtcttgctgtgtcacccaggctggagtgcagtggcgcaactttggctcactgcaaactccacctcccgggttcatgccattctcctgcctcagcctcccgagtagctgggactacaggcacctgccaccacgcctggctatttttttgtatttttagtagagacggggtttcacagtgttatccaggatggtctcgatctcctgacctcgtgatccgcccacctcggcctcccaaagtgctgtgattacaggcgtgagccaccgcgcccggcctttattttaatttttgagacagagtcttgctctgtcgtccaggctggagtgcagtggcatgatcttggctcactgcagcctccgcctcctaggttcaagcaattctcatgcctcagcccctgaatagctgagacaacaggtacacaccaccatgcctggctaatttttgtactttttgtagagatggggttttgctatgttggccaggctggtcttgaactcctggcctcaagtgacctgcctgcctcggcctcccaaagtgttgggattaaaggcatgagccactgtgcccggccaatgttagttatttttaaagtttcttttcacatggtattagtgcgatttttctttctttattagatttctttcattttggctgtaacattgttcctaattaaataaattaaagttgatagggaaaaagatgtatgcccccatagccgctattatttatcatcctagccagtgaaatcagaaaattttgaaaaataagtaatataaacattgtaaagagataagatttgagtatttatagattatgtaatcaattatctgtaaagtaagagaaaatcatctgaaaaaccatgagaacttttaagggaaatcctcaaggtagctagatacaaggtaacaatacataaattaacagcttttccacgtaacatcaaataaaattttaatgaaaaaaattccctttaaaattgcaaaacataaaatacacagaaattacaaaaaagaaacgcatcaaattttatgaagaaaatgataaaatttatggaaggcactaagtaagtgctaaattaatgcaaaaaacccccacaacaattttcctgtaaaaaaacttaaattttccctaaatttatctataaatttaacgtaattgcgacaaaaatctccatgtcaattttaccttttttctctttttgagatggagtctcactctgtcgcccaggtggagtgtagctcactgcaaccttcacctcctgggttcaagtgattctcctgccttagcctcccgagtagccggaatgacacacgcacgccaccgcggccggctaatttttgtatttttagtagagatggggtttcaccatgttggcccggctggtctcagactcctgacctcaagtgatctgcccaccttggcctcccaaagtgttgggattacaggcataagccactgccccataaatctccatagaaattttattcaaatgtaacaaactcattttaaagtttatataagattcagagcagcattattcataacagacaaaaggtggaagcaacccaaatgtctaactctgagtagatgaaatgtggtaaatgaactatttgactaaaaaaaggaatgaagtattgatacatgctataatatagatgaactttgagaacatcatgctaactgaaagaagcctcatattacaaaagaccacatattacatgattctacttacatgaaatgtccagaataggcaaatcgctaaagatagaaagtaggtgagtggttgactagagctgggcggggaaagcataggaagatggtggcattaggaagtgatatctgaagggtatggagtttctctttgcagtgataaaacagttctaaaattagttatagtgttggttgcacaactctgaatatatgaaaatcattaaattgtacacttgaaaatggtgaattatatgttatgtgtattatatttccacaaaaccgttgtaaaaaattacgtgagtcctcaaaataatcagatttccttacggagtttagagggtagactaaactgggcaatactagagaaagaaggccagttaaggtggttgcaatgttgctataatctaaacaagggaaaagggctcagttaagtattagtggtagtagagaggaagagatagatttgagaatccacacgaaaattaaatgtggttgatgagtaaggaggtctaaaggttctaagaacagccagaaaataaaaataaataaaaaacaaggggaggaatgccctttatctgatctcagctatattttattttttatttttatttatttttttgagatggagtcttgctttattgcccaggctggagtgcagtagtgcgatctcagctcactgcaatctctgcctcctgggttcaagcgattctcctgcttcagcctccagagcagctgggattacaggaacatgccatcaagcccagctaatttttgtatttttgtagagaaggggttacaccatgttggccaggctggtcttgaactcctgacctcaagggatctgcccaccttggcctccccaagtgctgggattacaggagtgtgccaccatgcccggcctcagctatactttatagctgcaatgatgaaaatgggtcatgttagtaaaggaactgacaaagcagtagaatgaaataaggactccagaaacagaactaagtatgtgtttgaatataatatattgcaaacgtggcagttggaataggcaaggaaaagatcaagtatttaataatggagttagaccttttttgcctccacttggggaaaaatgaattcctactaagcatatagatgaaaaataatattttaaaaacttaaagttctccaatacaatatagattatattttataatctcaatttctatacttaaacaatttaaagagaaatttatcaatgttttatgaataaaaaaacctataaagccttatggaaggcaataaagaaggcctaaagaaatgcaaaggaatatggtagagaaagactttagaagcatcgtggtaaacttagatgccataaagagaaaggttaatgaatggaagtacatgaaaatttaaaacttttgttcagccaaagatcctgtcaacaatgttaagaaaaatagtcattgtgtataagaacatatttgcaacactaagcagcaaaaagggttcacatgcataatatttaaattatgaataaaaataatgaaaccaacacaataaaaaatggtcaaagcctataaagagggaatcataagaaaataaatatataaattcacaggaaagtaactttatatatcaccaagcatatgacaaaatgctcgatctcactagtaattagagaaatgtggattttaaaaaacatacatttacacattacattcatgtacatccatcttgatgtcctcaaattgtaaagatattccctatattctaagtgtcctcttagtagcattgtgtacgattgcatctattcttaaagcttgtatggaattacttaatatataacagccaaaaactattcttaataatactaaaccctgagaatgtgataagcaaccactttttgcagctgcactgagggagaaaccaaattaagacagatctagaatataacatcgaaagtaaatctcttattgcattttactgttacaaaagataaactaggctgggtgcagtgtggctcacacctgtaatcctagcactttgggaggtctacgtggaaggaactcttgagcccagaccagcctgggctacatagtgaggccctgtctgtattttttaatataaaaaagtaaaagaaaaaaattgttctagaaatgtgccctatggatccttcaagtagtggtcaaacatgaaaatagtttgccaggtcaaggtaatattttccatgtgttacgtgctattatggtgattccagctgcatcgctttataataccaatgccaaaaatttcaaccaacaaacaaactgaaaaattcgttttccttttaagatcttttttagaaaaagagaatcgtagctggaagcatttataacctaaagttcacttctctttagaacttgcgcattagatgacaaatgtgtttctttgactattttgcaacctgacccagagcaatgatattgccaacataaatgatgatgccattccaaatgttatcagggcagtgacgggagtggctgtttcataaatggtgtatattcaaagaagaagtgaaagtccggcgttttgaaaaatgagcgtctgctggctgaatggggaaatgaggcatcattgcaacaatcattcactctggccactcgttatgaaataaggcacaattcccaaatttcaaagtgaaacatcattcagaaggaattgaatagttcttctctggtgagtcattcctgataaaacaatgcatacattaataacacacaaaatataaggaaatgaactgttttatcttgcccacttatagaacagagccctccgctatcaatataaaggttactatatgcccatgtgctccggatgcagaaacgctcattaaataaacaccaaaatagtgcatcgatgactttgtctttacctcaaaagaaagttgatctgctcagaagaaagacagtgtgcatattcagaaacattaactctctcatgttacgttaattatttccaatgttggtctaacgaaatggcactcttctttttccatccttctccctaaattacttatgctaagttaacttttcctagcttatcagaactaaagggagattttgattttttgggctgggaggtcccattcattatcatgactttaaagtacaaccaataatgggaagttcttaggtgacagtgagccaaccacacaaacaagcttgaccctttgtatccggaaggctgccattgcgaagaagagcgtgtacagtaatcatcagaccacaaagttttaaaccagtgtctcaaaagacaaaatgactaactttgcaacatattactggaaataacttcagatggctgggatgctttttcccccaaagaaggaaatgcttccaggttatggagtctaatgggagaatctttggaggtgatggaccatcttatggagccatctgcaccctaagttttgttcattttcacgttgtcttctctctgacttacaaaagtattggaatgtaaggctcttccatgggacccagaggaaacattttatggcctcaggaggttaatctaacttcattgtatttcaaaaatgaacgtatttggccttggtcatgacacttttatcaaatcatactcataaacattaatggcttaaactgagaggctttgatcccttgggctttggtgtggacaatggtacttagtaggtgacagttctctgttgaactagtttcagggaatcaaacacagggcattttagtagtcaatctgctttggtaaaacgaagcctttcttttcagtaaccttacctataatggctttataatccgtatagaaatgtaactttcattaaagttgtttacttttgtagttgcctcttgagttatttctactttataataatacctgacatttgttaccatttatccaatgcctggctactgttagataaagaaatcatgactttgagagatcacatagtgttgaaggtaattccaatggaaacttggccttttaacttccacattcctattctgtcttctccttctccttctcctcctcctcctcttcctcctcctccttcttcttcttctttttttttttttttttttttgacagagtctcactctgttgcccaggctggagtgcagtggtgcaatctcagctcactgcaacctctgcttcctgggttaaagtgattctccgcctcagcctcccaagtagctgggattacaggcggatgccaccacacccagctaattttttttgtatttctagtagagaggggggtttcaccattttggtcaggctgatcttgaactcatgacctcaagtgatctgcctgccttggcctcccaaagtgctgggattacaggggtgagccactgcgcccggccaacatctccttctatttcttggggaatccagcctggattctcatttgggttcctcttcctctaacttgcccttacatgcttttattccctaatactttataattgtttatattctgtttttattgtacattctgtttatggacaatctcatctcctcaatggcttctactaccaaccttatgctaatcactcccaaatctatttgtagtctagagatctcttgaacttcaaaactgaagttttaagtaactactgtacatttctatccagatgttccacaagtaccaaaaaattgtcatgaaccccaaatgaacacatacctttctcctcaaattttcttatttttttaatccacattgagatgaatggcactgaaatctacccagtcaaccaaactagaaatccagaaatttatcctgtctctttttcttaactgtccaaatccagctgataatcatattttcttgtttctacttcctatatacatttaaatatggtttcttctctctctttccttgtttccaactttttggatttggggttacatgtgcaggtttgctacatgaatatattgtgtgtgatactgaggttttggggtatgagtgatctcatcacccaggtagtgagcaccacagtacccaacagttagtctttcgacccttgtcccctccctccatcccctctctagtagtccccagagtctgttgttgccatcttcatgtctgcgtgtacccactgtttagctcccatttataagtgacaacatgtggcatttggtttttgtttcctgcgttaatttgcttcagatgatggcttccagctgcatccatgttgctgtgaaggacatgatttcattgttatggctgtgtagtattccatggtgtgtatgcaccatatttctttatccagcccactgctgataggcacctagattgattccatgtctttgctattgtgaacagtgctgcaataaacatacacgtgcatgtgtccttttggtagaaggatttattttcctttggatatctacctggtagtgggattgctgggtcgaatggtagttccatattcagttcttgcctctctctccttcagcacttcttggtctactgcttcctcagtccaggcttcaccttggttctcctaaccatgctcctatcatgagtcctgtatccttgaatgtatctctcttgtcctgctagttacttcgacactctcttacggaggctccttgggtgaatcctcttaaccacaggagaaactctaaactctttacctgattttccagtctcctcgtttgctgtttccccacgtgatcacgcatgccctcgcaagtttcatctttgcacacactgtttctatggcctggaatgctctccttcctctgctttccacccaccaaactcttcaactcattttagcaggtcactgggtgttagaacctctatttaggtcatttcccttcagaaggcctcctttgttcttcccagactaaagtcctccatctgtacccctatagtggcttttatacttctctgttacacacttttcccattgttgtaattattaatatttggttatacgtttgtgtactcttcagatttctgagctcttagaagcagaatcaatatttcattcattttgttacacagtggtacactggcacttaaatgtcttactttaattaccactaataacccctaacacttgagtgcttcctttatgccgggcactgtctttaaatcatctcatgaaatggatgagtaaataaataaatgaagagggtaactcagttgatcattattctagacctaaaatactttgctgtaaaacatttttcattttctttcttttttctttttgagtcagggtctcactctgttgcccaggctggagtgcaatggtgctatcacagctcactgaggcctcgaactcctgggctcaagcaatcctctcatttcagtctcctgagtagctgggaccacaggtgtgtgtcactacacctggctaattaaaatttttttttgtagagatggggtattgttatgttgccctggctggtcttgaactcctggtcccaagtgatcctcctgtgacccgacaaaattttttttttttttttttgagacggagtctcactctgtcacccaggctggagtgcagtggcacgatcttgtgtcactgcaacctctgcctcccgggttcgagtgattcttctgcctcagcctcccgagtagctgggactagaggtgtgcgcgtgtgccaccacacctggataatttttgtatttttagtagagacagggtttcaccatattggccaggctggtctcaaactcctgacctcgtgatctgcctgccttggcctcccaaagtgctgggattacaggtgtgagccactgtgcccggacttcttcttcttcttcttcttctttttttttttttttaatgagatgcagtcttactctgtcacccaggctggaatgcagtggcgcgatcttggctcactgcaacctctgctgcccaggttcaagtgattctcctacctcagcctcccaggtagctgggattacaagtatgtgccaccacacccagctaatttttgtatttttagtggagacagggtttcatcatgttggccaggctggtctcgaactcctgacttcaagtaatctgcctgccttggcctcccaaagggttgaggttacaggtgtgagccaccacggccggctcataaagttttattgtgatataatttatacacagtaccataaaagtcacccttttaaagtgtgtacttcagtgatttttagtatattcatagaattatgtaatcataattactactgaattttagaacattttcatcatcccctgatccaatcttatgcccattatagtcactctccattcttccctagcccaaatcccacatctaccccttgtctctatgcctttgcctgttctggacacttcatgtacatggaatcatacaatccgtggcctttggtatctgtcttctttaacttagcatgatattttctttcctccctccctctctccctccctccctccctccgttcctccctccctccctcccttccttccttctctttctctttctttcttctctctctttctctctctccactctctctctttctccctctccccctccccacccccctctctctctctccttcctttttacgatgggttctcactctgctgcccaggctggagtgcagtggcatgatcacagctcactgcagcttccaactcctgggcctaaacaatcctcctgcctcagctcccatgtagttgggactacatgtaggtgcaagccactgcatccagccctagcatgatgttttcaaggttcatccgtgttgtagcatgtatcagtacttcattcctttgtatagctgaataatattgcaccgtatgaatatacaccaaaatctgtccattcatcagttgatggacagttggcttgtttttatttttttggctattatgaataatgctgtaataaacaatcatgtaaaagtttttgtgtcagcgcataaaaattttataggaaaacatttgagataaatgagcaagaaactttacataagggggtgggacttctggaatgacagagaggaattaggttaacatattggcaaaacgattaaaatcaaccattcctgaactaagtaaccaaaggcagggaacgaacaaactcatttatccaagaaaaactgctgattttagataaaaacaatggggtctttggagatttaacttggggatatgcccattgccctgctccccggtgctggcatgctagctgtgaacagatggcagccttgcagccaacagagtggatgcacccttttggagctctgttgaaaccaccatctccagtgaacagttaatatttttactggtctcacatctcccctcgaaagcctggatcccagggcatcagaactatttgatctgattggaagctctgctctgtggaaaagccctatccccaggctgttattgaaaacaacaaagaacttggcccaaaatttcaaagaaagacctagggaacttgaaaagttctgatatattgctgagaatctagaagactttatgcatgttacagggatgtgtgcatgctgaggaaagacctgggaaaggaaaggagctccatcgctcacctgtggctgaccttgagatcctgcacaagcaggaagtaaatactaaggctgatttgtaagctgcctgaaatttggaagtatgccttcacatacagtttcccttagcaaaggtggaagacttgttggcttaaggtatttaaagacatattctgaccaatcattggctgatcactaaactatgctaatttcacagtgaacccaaggaagccaggcttaaaaatactgttgtccttgggaatctgtgggggattggttccaggactccctgcaaataccaaaacctggagacgctcaagtcccttatgtaaatggcatagtatttgcaaataacctatgcacatcctcccatctattttatttatttatttttgagacagggtctcactcccatcatctaggctagagtgcagtggcatgatcatggctcactgcagccttaacttctcaggctcaggagattctctcatctcagcctcctgagtagttggaactacaggcacatgccaccataccctgctaatttttttgtatttttagtagagatgaggtttcaccatgttgtccaggctggtcttgaactcttgggtccaagcaatctgcctgcctctgctcccaaagtgctgaaattacacgcatgagccaccgtactcagcctcctacttcaaataatctctagattacttataatactgaatacagttgacccttgaacaacacaggtttgaattgtatgggtccacttgagcactggttttcttcaataaatgtattgaaattttttttttggaagatttgcaacaatttgaaaaaagctgcagacaaactgtggcctagaaatattttaaaaattaaaaaagaattaggtatatcacgaatgcataaaatatatgtagacagtagtttattttataacttactaccataaaatatgtacaactatattataaaagaggggtggggggtggctcacacctgtaatcctaccactctgggaggccgaggcaggtggattgcatgagctcaggagtttgagaccagcctgggcaacatggtgaaacccgtctctactaaaatacaaaaaaaaaaaaaaaaaaaaaaattagctgggcgtggcagtgtgtgcctgtagtcccagctacttgggaggctgaggcaggagaattgcttgaacccgggggttggaggttgcagtgagcagagatcgtgccactacattccagcgtggcgacagagcaagactccatctaaaaaaaaatatgtattataaaaaattaaagtttattaaaacatatgcacatgaaaatttatagaccatgcatggcaccatttgcagtggagagaaatgtaggcaaatgtaaagacgcagtattaaattataactgctataattaattgtagttcatatcatactactataataatattgatttgaactagattaagataagatacatattgtaatctctggagtaaccattatgaaaataatttaaaaatatttagtaaagaaaaccaaaggattttttcactagaaaaaatatatataacacaaaagaaagcaataatggaggaacagaggcaacaaagagacacagacatatagaaaacaaatagcaaaatggcaaatctaaatcctaccatagaaataattatattacatgcaaatggattaaacttccctatcaaaaggctgagattgtcagactggataaaaaacagaatccaattctatgcagcctgtcagagactttcaattcaaagacacaaataggttgaaagcaaaaggcttgcaaaaatatagcatgcaaaaaacaaaaaacaacaaaaaaacaaaaaacaaaaacaaaacccaaaaaagaactggagaggctatactaatttcagaccaaatatactttaggacaaaaaacaaagttaataaagacacaaggggcgtcttataacaacaaaagtcttagtacatcaggaaaaatcttacaattataaacatatgcacctaacaatagagtcccaaaatacatgaagcacaaactgacagaattgaaggtataaatgaataattcaacaatagtagttagacacttcaatacttgactctcagcaatggataacacaattagaaatcaacaaggaaaccgaagacctcgaagacactatcaaccaaacagaactaacggatacctatagaacactccactaaacaaaaccagaatacatactattttcaagtgcactgaactatctctagggtagaccacataataggtcataaaacaagcctgaataaattttagaagattgaaagtagacaaagtatgttcagtaattataatagaagtaaactggaaattagtaacaaaaggaaattttggaaccgcacaataatttagaaattacactaaacattattttttttttttgaggtggagtctcactctgtcacccagactggagtgcaatggcacgatcttggctcactgcaagctccgcctcccgggttcacgccattctcctgcctcagcctcccgagtagctgggactacaggtgcccaccacgatgcccggctaatcttttgtatttttagtagagacggggtttcgccatgttagccaggatggtctcgatctcctgaccttgtgatctgctcgcctcggccttccaaagtgctgggattacaggtgtgagccaccacgcctggcctacaccacacatttttaaaaactgtaggtcaaagagaaagttgcaagggaaattacaaagtattttgaactaaataacaatagaaacccaacatatgaaaacttataggatgcagttaaaacagtagttacaggaaaattaataactttaaatatctatgttagaaaaaagaaattatctcaaattaataatctaaactttcaccttaatagtcttgaaaaagagcaatttaaatccagtgcaagcagaatgaagcatataatagctattatagtggaaataaatgaaatggaaagcaaaagaaaaacgaattagttgtttttgaacaaaagtaggctctttaaaaaaatcaatactttagcaagattaaacaagaaaaaagagaagaaacaaatgatcagaattagaaaaaagagaggaaacattatgactgacatcagaaagtaaaaagattgtaagagaatactgaagtcagcaactgagacaaaatagaaaaaaattctaaaaaaacccccaaattaccaaaactgcctcaagaagaaataaaaaatctgaatagatctccaacagctaaataaatttaatttttaaataaaaatctttccataaataatagttcaggctcagatcgtttcactggtggattatgtcaaacatttaaagaggtaatatcaatagtctatcaacccttccagaaaatagaggaagaataaatatttccaaactcaatccatgagagtagtatcaccctgagatcaaagccaaagatactgcaaggaggccagatgtagtggctcatgcccgtaaccccagcactttgggaggccaaggcaggcagatcacgaggtcaggagttcaagaccagcctggccaaaatggcgaaaccccatctctactaaaaatacaaaaattagcctggtgtggtggcatgcgcctgtagtcccagctacttaggaggcttgagtcaggagaatcgcttgaaaccgggaggcagaggttgcagtgagccaagactgtgccattgcactccagcctgggtgacagagcgagactccacctcaaattaaataaataaataaataaatggtgcaaggaaaggaaactacctactaatagccctcattaatatacacccaaaaattcccaacaaaacaatagtaaacggaatcccacaaaatacaaaaaggattacacatgatgaccaagtcagacatacttcaggaatgcaaggttggtttagtatctgaaaatcaattaatataatacaccatattaaggaaacaaaggactaaacccacaagatcgtctcacatagaagtagataatgcatttgattaaacccaacagctattaatgataaagactgaataaacttgaaatagcagaaaacttttttaatctcacaaagggcatttactaaagaccagcagggaatatcacacttaatggtggaagactgaaggctttttctataagactgagagagggtggacgcggtggctgttgcctgtaatcccagcactttgggaggccaaggcgggtggatcatgaggtcagaaattcaagaccagcctggccaagatggtgaaacctcgtctctactaaaaatacaaaaaaattagccaggtttggtggtgggtgcctgtaatcctagctactcgggaggctgaggcagagaattgcttgaactggggaggcggaggttgcagtgagccaagattgcactccagcctgggtgacagagcgagactctatcttgagaaaaaaaaaaaaaaaaagactgagagcaaggcgaggataactgttcttgtcacttcatttcagcatcattattggagtttctagccagtgcaaacaattaagaaacaggaacaaaaattttacataatacccaacgtattcaaacctgaccaatgaaatctggacactgcacaataagtcttggctttgtcattaactatttgaaagactgaaaaaagtgactttaaactcttgggattcagttttctaatctgtaaaatgagagagctcaaaatttctatgaagctataataacgggagcttcagtttacagtgaatctcttgatgatattgatcattattggccaaaattattcacagactatttttatttatagactcagggtctaactcaaagccactttctgtctgaagctctccctaatgcctgcgctccaaatgagtctcttctttttctgccctcttatggttgcttgcttgcacatctatttataagcttaacatggattatattgaagtcagttctgcatgtccttcttaacctggagatgtgaaattctcaagggcaggaatcacatgtcctccataacatccagcataagcgtcatgcatagttggattagtcatgcatatgactcatgcatatgactcctccagcataagcgtcacgcatagtaggattgcagatgcccgactttcttcctttgttccagatatttgcattgccggccagagtccctttacaaattttacgttttttgcaacaacacagttttccttaaacattaattttccttctgtttcttaggagtgtgacttcataaagggatctatttcaccaaccaatgtgccccatccgaagatctcagtttatacacagggacaacttctaaagtttaagatacaaattagaggaacaaactcctatagaccccttctatattcttgttcttcctccgtaaaggtttgacacggggcataaatgtcatcattatttctgggagacattgctattgtgaagagctgtagactttggtatctcctagaagctcagggttcagggtagggtgaaagggagttgagagaataatcttggggattcagttgatgctgcaacttattatttgctccatctatattgctctgccaaaaaaaaaaaaaaacaaaacccaacctgatttggttggggatttctgaatgctcaactggagaaactgttcaaaaaccacaggctcactatgtgcaaagccacatgctagaagctggaataacccattttagttatcaagttggctttatccaaaatgaaggtgttgtccttttcataataattcatcagacgtagaaattatcaacataaaatgcaattctttcagcgtgccaaatatgtttatccatcatatttagactcttgtggcacttggaacttaaatgttctttcctcagttatcaaggctatgcaacattagatttaaagcaatacaaaatgaatgccgactatgcatgacgcttatgctggatgtcatggaggacatgtgattcctgcccctgggaatttcacatctccaggttaagatgaacatgcagaactgacttcagtgtaattcatgttaagcttataacagatgtgcaagcaagcaaccataagagggcagaaaaagaagagactcatttggagtgcagccattaggaaaagcttcagacagaaagtggctttaagttacaccttgagtggtaagactgtcaccaggtaaaagtgagccagacatagtcattccagatccagggagctgcaagggcaaaaacctggaggcagaggtacaggcagcggccggggtgccagacactcaggatgccggtgtatccaaagctgagcctgttctggtcagaggcctattgaagtgaggtgtaatgctctgctggtcagtttcttcatcaaaacgtgggcttcccgagggcagtgaccacagctggcatcatgggaatacatcattgtaatccccaatgtcagcacagggtccgacatgtattaggcctccttatatgtttgttatgtaagtgtgtggggggcaggggtggtagggtgtgaagcctggccaagacattgtgacaagaggcccagtgggactgtgatgagggcctggagaaaatcagggaactgcggaaggaagacaggaggggcgacacagggccaatccaagaggaagcagttgagaggtcagacctgccgagttctgctcctgggtgacaggaggcaagtggcgacaccttttacctgatatctagagtacagtcaggcccaggggaattagtttctttttttgggagcagtaaggaaataatctatcttaatacttcaatgtgcctagcagagttttattgccagctggctggggatacagcaggcagtacagaaagaattgtttccaaagtatgccaggcaggagttttgggctacaggctgctttcatgatcgcaggaggtctgtgtgagaacgcggtcatacacatgtgggcaaatcactgtccagaactgaacagcaactaaagctaagtggggcacctcttccttctggtccagggctgccagttttataaaaacaatcctttgcattgcctcaaaataactcctgcaattaccttcacttaatttccatttgcgtaggaccaaattgatcaccaaatcaattacaacaatccagataaaaatgtgattttctgtggggggtggttccctgtagcataaatagttttacagcgggaagtttgttctggtggatttggctcttcaattcgttgaacactggttcatcagtctgagttttggttgggtccgtgacactgtgcaagccacagcttcctctttaaaacagagctaacaatatccaccttatggaattgtgtgaatttactgcgtaataaacatctgtctgtctctctgtctttctcgtgctcccccttcattgtggcaaaatacacataatataaaatccactgaattcaccattttaagggtacagttcggtggcattaaggatagtcacatttttgtgcaatcactgccactgtgcatctccaaaagttttttcttatcccaaactgaaaccctgtacccattagacacgaactccccgtttccctccctcccccagcctctggcaaccaacattctactttctgtatctatgaatttggtcactctaggcacctcatataagtggaatcatacaaaatttgtccttttgtgactgtcttatatttctcctggcataatgtcttcaaggtccatccacaatgtcgagtgtgacaggatttccttccttcaaggctgaatcatactctgttgaatgtgatttggtttatccattagccatagatgaacacttgggttgcttccaccttttggttattgtgaataatgctgtgatgagtacgagtgtatctgtttcagtcccttctttctttctttctttttttttttttttaagacggagtctcactctgttgcccaggctggagtgcagtggcgtgatctaggctcactgcaacctctgcctcccaggttcaagctattctcctgcttcagcctcctgagtagctgggaatataggcatgtgccaccacgtcgggctaatttttgtatttttagtagagacggggtttcaccatgttggctaggctggtcccaaactcctgaccctgtgatctgccagcctcagcctcccaaagtgctaggattacaggcgtgagccacagtgcctggtctcagtccctgctttcaattctttcaggtatatacccagaagtaggaatctctctttaacagaagaacttcgtcttttctatttcatttctcagtaattttgctactaacatttggggaccaacacaataaaaacaaaccatcatttcccccaccctgaggaggcactttgttgctaattcagtgccagttttaaggatgctaaataatatagtagtacttcagggactattatggccatggctgaaaatagaaaaatgatacttctattagttggtgaaaaacagtaatagaattaaaactcaatataatattgttgagaattcattgtattgccaagattaagacatccagaaaaacaatttcataagcagttagagattgctgaaagactgttgacaacagtatcagtttatgaaccagtaagaaaagaaataactttattgctaagaaagatgtagtgacagtttaaattgtaccaggcagcccacaatagtaattcttaggaagggatgtaagtagtgacctacatgctgctttgagctgaatacaatgtgtttctttcaattttgagagcagatgtacttacacagatgtaagctgacactgacaaattggagcagttaaagctagtgtaaaagtattttgatagatttttttttcacaaattgcttcatattctgacttcactttaggaattctaagagcaactaaagagagacccttaaataattcttttgatgttggttttcttctaatccctattgtcaaatgctctatgtctatctgaactcactatcagcatgctgaaaggtcacaaaaaaggtatctcttctatgtaatcgccttcaatggttctgaacacagcaatcatgtatcttccaagccttcctttctttaggtgacatgaccctccactcctcttatgtcaacatttccaggctctccataatcttgatgactcttttctaaagtcagacaaattgttaatttctctttgacaagaaggcaccccgaatgatacttcacctttcaaatgtggctgacaagtgaggaatacagaatggccattatcatccacattctgtaggaaatcctgctaggatgcagcctgggaaagctttggattgcatggtgtgatggttaatattgagtgtcaacttgattggattgaaggatgcaaagtactgttcctgggtgtgtctgtgagggtgttgccaaaggagattaacattggagtcagtgaactgggaaaggcagacccacccttaatttgggtggacaccatctaatcagctgccagcccagccagaataaaagcaggcagaagaacgtggaaagactagactggctaagtcttccagactatatctttctcctgtgctggatgcttcctacccttgaacatcggcctccagattcttcatcctaggactcttggaccttcaactacagactgaaggctgcactgtcggcttccctacttttaagattttggggcttggattatcttccttgctcctcagcttgcagatagtttattgtgggactctaccttgtgatcacatgagtcaatactctttaataaactcccctgtatatatacatctatcctattagttctgtctctctagagaaccctgactaacacacatggcctataatctcattttttacttctggtaagctctttttgggtgacttttagatcttctttatatcaaatgatgttaaatcatcccaaattttgatcctttgcttcagttaacgggaaatgaaaggcctatcttttttttttcttttttttttgagacggagtttcactcttgttgcccaggctggagtgcaatggcgtgatctcgtctcactgcaacctccatctcccaggtacaagcgattatcctgtcagtctcccaagtagctcggattacaggcatgcaccaccatgcctggctaatttttttatatttagtacagatggggtttcaccacgttagtcaggctggtcgcgaactactgacctcaggtgatccacccatctcggcctcccaaagtgctgggattacaggcgtgcagcactgcgcctggcctattctgtcattcttatgcaatacatgcatatatcacctattcttgccagttatgtgtagcagctaatgtgatgagaaaagcaaaaataacaaaaccacaatttactgagtgcgttacatggccctatgcatttaagtgctttacctacagtatcttatttatcacaccagtattaaggattattataacaattacgaagtattattatacctattttcaatgaggaagctgaagccgacaagtttgtaaactcaaaattgaaagctggttctaatttctgtagtcttaaccatcctgtaccctcccataagcatgtcatctatatccttactcaaacgctagcaaattattcactaagattgggcaaatcagtaatctcctttggtaacaccagtgatcagtgatcagtgagttggctcagtccgttaaccaaaaagctgtttaaccaactacatatgttcctattgcccaggcctcgtttgtttgtttttcctgcaaggtaattgtgatctactgtttccaatgctatcctaagtacagtcacattcctgtgatgtacctctctcaactaagacaaagagggaaatacgggtagttccatataccccttgttaatacatctatgctgttttcccattttcgaaatcatcccaaaccatcaattttaaagtttattttagaattttgcaagactcatatgaaggtaaatatttgcagtctaaaaaaatcttctcttcgggaaagtgagatgacatttactcttttcctggtacattcctcatggttcctaaaatatcaccaatagtaattgtgcaatcatatctgggttccttcagatggaaacaaaattttcatggctttatatgacttcttatttgtggtagttatctggtttttgttctaggttgagcttaggtgagtggcgtcaactttgtcagcttggaattgggcaggaaatgagaatcaggggccacagggaagaacaggggtgagaaaagcaacctcagtgggtgccagaggtgtagctgagtctgggcacagcctcaagtttgtttgtgtgcatggctgtgtttgttgtatctgtttatgtaggtggtggatgggcattccctggctgctttggaaggctcagaatctccatgcacacttgcaaacttttttttttttctttttttttttttttgagacagagtctcgctctgttgcccaggctggagtgcagtggcgcagtctcggctcattgcagcaagctttgcctcccgggttcacaccattcttctgcttcagcctcccgagtagctggaactacaggcgcccgccaccacgcctggctagttttttgtatttttagtagagatggggtttcaccatgttagccaggatggtctcgatctcctgacctcatgatctgcccaccttggcctcccaaagtgctgggattacaggcgtgagccactgcacctggctccacacttgcacacttttaagatttttacacttcatttaaactggtaaaaatgatgatgtcattagattctgataaattataatacctaaagctacccttaaaaatttgtacaaagagatatactcgggcacggtggctcacgcctgtaatcccagcactttggaaagccaaggcaggtggatcacctgaggtcaggagttcgaaaccagcctggccaacatggtgaaccccgtctctattaaaaatacaaaaaattagccaggcgtggtggcaggcacctgtgattccagctactcaggaggctgagacaggagaactgcttgaacctgggaggcagaggttacagtgagctgagatcacacctttgcactccagcctgggcaacaagagcaaaactctgtctcaaaaggaaaaaaaacaaagagatacactcaaaaacactataaataaaaatagaatcctgaaaaaattaagtatcacattggaaggtgggaaaaataaaatagggaaacaacagacaaaataaacagaaaacaaaataaaaaatggcagacttaagccctaacatgtcaataattgcattaaatgtaaatagcctacatacgtcaactaaaaggcagagattttcagagtgattaaaaaacacatctataagaacctcactgcaaatataacaatgtaggcaagttgaaagcaaaaggatggaaaatttatatcatgcaaacattaattaaaggaaaataggagttgctctactagtatcagataaagtacactacaaagtaaaaaaagtcagagatagggaagtacattatataatgatatatcatgggttaattcatcaggaagacatagcaatcttagatgtttatgcagcaaacaacagcatatattgaatgaaaaagctgatagaactgaaaggagaaatagaaaaattcacgattgtagttggagacctcagttactacctcccaacaattgacagaactagacagaaaatcagcaaggatagacaagaactcaacaactccataaaccaatagactcaaacagacattagagaacactctacccaagaacagcggaatactcattgtttccaagtgcccatggaacatataccaaaatagtccatatttggggccataaaaaaaaactcaacaaacttgaaagaactgaaatatacatagtgtattctacaaccacaatgacatcaaatgaaaaatcagtaacagaaagataacaagatcacctttaaacgcggaaattaaacaatgcaaagcttaataagccatagataaaagaggaaatcttaaggaaaataaacaaatacactgaactggaggaaaattaaaacaagcatattagaagttttgagacacagctaaatcagtgttgagagggaaacgtatagcactaaatgtatatgttagaaaagaagtctcaaatcaataattaagcttttcctcatgaacctaaaaaaagatcagaataaactcaaaacaagcagaaaaacaatataaaagataaaatacttgaaaagaatcaaagttcttctttgaaaaggtcaataaaatggataatttttgcacaagcctgacaaagaataaaagagaaaagacactaatgaccaatatctggaatgaaatggaatatcactagagattctgcaggtataaagggatactatgaacaactgtatacttgtaaacttggcaatatagatggaaggaaccaattgcttgaaaaacaaaaattaccacaattcacctacttttcaacagatattagacctgtaattcttaaggatattgactttgtaatttaaaagttcctcaaaaagaaatatccaggtccagatggtttcacaggaggatgtcaccaacttctaaagaaaaaccaaaaccaattatacacaatcttttccagaaaatagaagagaagtaaacattcccattataaaatgaatttttataaagctagcattaccctaatatcaaaagcagaaaaagacagtacaaaaaaataaaactatagacctcatgaataaagacacaaatgttcttatcaaaacattggcaaatagaattcagtaatatatataaagaattatacaccatgaccaagtggaatttactccgcttggatgggatattccactttcagaaatgcaaggcccgttccatatctgaacattaatgtaatctattgataccatattaagaggctaaggaaaaaaatcatatgaccctatcaactgatgcagaaaatgcatgtaacaaaattcaactctcattcatgataaaaagtctaagaaaaatagaaataagagcgaatatcttcaatttgataaggaacatctaaaaagatctacagctaatgatatacttaatggtgaaagacagaatgttttccccctaagatcatgaacaagacaaagatttccactcttatcatgcttattcaaaagttctggaaattctagctagtatggcaaggaaataaaaggcatagagttggaaaggaacctagttcacctaggctcaaaaccaccacctagttcaaaactgtccctgttttgtcttgtcatctgtttgcagatgacatgattgcctacaaaggaaatctgaagaacttaacaaaaaaacttctggaactaagtgaattcagcaaagtcacaggatataaggctaacatacaaaaatcagttgtatttctctatgtagtaatgaacacctggacgcagaaattaaaaatccaataccatttacaactgcttagaaaataaaatacttaggtgtaaatctaacaaaatatgttcggatctggtgagctgaaaagtacatggcactgatgaaataaatcaaagatgattttaataaatggagacacatagcatgtttatgagttgaaatactcaaaaataggagaaatgtcaattctccccaaattgatatgcaggtttaatgcaactcttatcaaaatctcataaagatttttgtagatatagacaagattttttaaaaatttgtatggaaagtcaaaggaacaagaatagctaaaacaattttgaaaaaggagaaggaagggggaggattcagtctattcaaagacatactctatggctacagtaatctagactgtgtagtattggtgaaagggtaggaacacagaccagtgcaacagaatggagaatcaagaaagcccaaaacctccctaactgattactgacaaaagtgcaaaagcaattcaaaagaggaaagatggcctttctaataaatggtgctggagcaattggacatccacaggcaaaaagacgtaagtctcccaccttacgcaaactcaaaattgatcaagggcttaaatgtaaaatatgaaactataaaacttttagaaaaaacattgaagaaaagctttgggattctaagctaggcagagttcttagaatcaacactaaaagaatgatccataaagtgaaaacctgataaattggatttaatcagaattaaaaactttagctctgtgaaatacctgattaagaagatgaaaagataagctagaaatagaagataattgaaaatcacatatctgacaaaggattagtacctaatataaatacagtactttcaaaacccaacagtaaaaaacaagcaatccaattagataatgggcaaaactcatgaagaaacacttcacagataaacccaggagaagagttcaacatcactagtcattaaggaaatgaaaattaaattcacaataagatagtactccactcctatcataatgactacaacaaaaaattaatgacagcaacaaatgttggtgaggattcaacgaaaagggatcattcatacattgctggtaggaatgtaaaatggtacaaccactctgtaaaacagtttgatggtttgtctaaaacctgaatatgcaactactatatgacccaagaattgtactcctgggaatttgtcttagagaaatgaagcgtatgttcactcagaaacctttataggaatggttacagcagctttgtttataatcgccccaaattgcgcacaaccaggatatccttcaaggaatgaatggttaaactgtagtacatccatggaatacttctcagcaacagcctggatgaatttccagagaactatgctgaatgaagaaagccagtcccaaaaggttacatactgtgtgattccattcatgtaaaatgacagagttacagaaatggagaacagattggtgattgcgaggggtaaagaaagtggtggggttgggagggaagtgggtgtggctataaaagggcaacatgagggacccatgcaatgatggaaatgtttgtatcttgactaccagtgtcaatatcctctttgtgatattgttctacagttttttgaaatgttaccacggtgggtggggggggaaaactgggtataaggtgcatgagatctctctgtactatttttacaactacatgttaatctacaattatctcaaaataattttaatctcaaaataaaattttaattaaaaaaatcccaccttcagacaatgaatgagtcaggatgcaggaaaaactaatagtgtggttcaccatctagttcaaagctggacattggaactgagtttgtacctaagaataagtagaaccaagttagtctccaaatttttaaacgtctgccatgatgaaccagggtctgtgtgtgtggcagtgagaagagcacacttgaagaatgtactcatgggtggacttgggacctggttggagacaggcactactatgcataaggcctgcatcttccattttccctgtctgataggtcagtgctgtcactgtgggagagagaaggcaggcaggagaagggaggtggtggaattttcctcttattcttctctgagtctctagaaatttgggtacttcttaatgaccagacacatgtcctgaatattgctcctgccttacccccacatcactggctactgcaaactcctaatagtcaccttgatgccataattaaggcaaaaaagactggaggtggccataggaaaaggcatttaaaatacattttgatgtgccatgaaacacagatgaatgcccattcattggctatgttttacatgggctttagctgtagaaatgcaacagctctgaaatttatacttagagaaaataactactcattcatctgaacaaaaacataaaagttttccaggaaatgtgaagaatcattaacttcacagattctgaacagaaagtataattgcatacgctataaggcagaagtatatttgaaagcatttgtgagtgaaatggaaacatgccccatcaatccattatcaccagaatcacatagtatttaaatggccacagatactctgactaaatcaattaggtacaaagacagaaataatgagtactgttggtggtcaaaagcttttccagataggtgtttaggtgttggaaagatgacttctacccacttttattacctttatgccatggtaaattatagtaatttcttatgccttgggtgaaagaatggaaagataatattcaccgtattgaggatggtttaacttttctatagagaagcaccgaacaatcactaccacatgaaaagggataaaagctttctggtcaaaatgtactctattatgctagcaatataagctattcgacatattctgttgtggaaattcccaagctcccaagattccgataaggaacgtgctgcacgagctcagggcagcaaggagattagacaataaataaacaaagctcccctttcacaagctgcggtcccatggctgagaatccgctcttgttcttctctcttctaacccctgggtcttgttcttcccttcctcttctctgggtctttattaattgggctttgtgtctattctaatgaaaaaggcaccgatgctccgtcccactccttcctgcgcccccgtggaaggacggtggggggacgacggcgtaggtccaggggagctgagagtgcgtctgtgtttccccggagacgcgctcggcccgggggcgggtggcggcgtcagtcccggggaggaccggcagggggcggtcgaggctgaggactgcgcaggaccgcccgggcgggacgtgccgtgtgtactgcgggacttgcataataccactctccaagtcagggtgccttccaggaaatcctgagcgagttgctcattcaagtttttccatgtttgacgttggtgacttaatcaaagaatcaaaggatgtcaggggcctggattgctgttatcttctttcaaaggctctccttcaacggataaaaaattaaggctcagagcagctctgggtctaactagctagttagtggcagagctgacgctgtaactgaggtctactaactgcctgccctagctctgaaaaaaaaaaaaaaatccatgtggccactgccagcttctatttacaagataaatttctaacgctgaaagaacattctctcctctcccggtcccttctgagttcgcatttctgtggcttaagctgcaagtggtgaagcttatttcgggaacagaagcgcaaatttaaaatacaatagaattatgaatagattgcaatatttgactattttataacaaccatagactctgatggtaaaaacagttaaaacctaagcctttctttcttttcttttctttcctttctttcttttcttttctttctctccttccttccttccctttctttctctccttcctttctctccttccttcctttctcttcttctctccttttctttctctctttcttttctttctctccttccttctttccttcctttctttctctctttccttcctttctctccttttctccttttctttctttctctccttccttccttcctttctctccttctctctctctctctctttctttctttctttctttctttctttctttctttctttctttctttctttctttctttctctttctttctttccttccttcctccctccctccctcccccccacccccctctttctttctttctttctttcttctgtcccggagatcttaatgagctccttgtgtattctttctttcttttctttctggtctagtgtagctgcctgtcgtcttttaatatatttaggaataaggaggctttgtgaattttacattcatgtgatcattttgggaattttattaataatattattatatcctcaatttctgagccccaccccagaacaattaatttaggctctaagggtgtttttaaaaacaggctattcaaaatgtggttcttggaccagtggcattggcaccccctgggagcttgttaggcatgcagaatcacaggccccacttcagacccgctaaattagcatctgcattgtaacaggacttccaggtgattcttaactgcactaaagtttgaaaagaccaactctaagcccccgataactccagtgaacatttggcagagggcctcacctcttcagcatggtattgaacggagcccctggtccttaccttagtgttcctgtccataattaacttggcagagcccatttaaaagaagagaacatttttacttgtgctttaagatcaggctgaaagaatactggaatgaaggagttcttaatgagctccttgtgtattcttagatgggacttaaaaatttttttttatttttttaatgtgaaagggcactattgatacacaaggaactcgtgggaactgaaaaaaggaaaccagtttctaggtgggctctgttgcctgtatttgactcactcaccgataacacactcataaactgacacacacataaactctgttgggctctcaggatataagaacatttggtaataaactaatattagcagataatttatcttttttgttttgttttattatactaccaagcataacacagtgttttgtatataccaggtgactaactattgttggcagcaagaacagtagataaatatttatggaaggaacgctgtgcaaacagtaccctctaggaacaaaatgttttcctaattagttagaatagttaatagtttattgttattcatgcaagaattgagcaattgggattgatgatttcagttatctggtttgcttttggataagatgacttttgatcccctagtgctgaaaacaagaactggcagagcaagttctggtgtacctaacaatagtgttcataaataacttcctgccacactgataaaaacatctagctaaattcatttttaactgatagtaagtgctatttgtttttaactgattttccatgccacatatttgtaaatctatttcactgtgttctgggagcacgaaagactggtgctacattaattcaagcatatattagagggaaatggatataaactttctgctaatatttccaggtagcctgacagtcagatgttagaagtattcaattgccaagttaaaaagtaacaggaagaatcaaaaaatatttttctgtgattgggaatccaagctgggaaatgagacttctttgccttgtcttctactttcaaattggggtgctcaccttccccaacatctcccagcagctgccacctcacctccttcctcctacttaataggaataattttcagctgctctctgagggaaggtctgcagcagtcgccaacttctgggtttaggcggcatccttaagctgttccagtaactcagtgccaaaaagttcctcttggtgagtgccaggatacaaaaaagctgagatttcctgttaaggacttagcaaaagcctggtcaagttcaacctgggtctgccaggtacccaaagccttttctcgttagtgacaaggtaattcaagaggaagaatgtgtaatggtcagtgacggcaggacttgtggtaactgtggagtcttagaggcaggggtgctgagaagtcgttatggtgtgagtatcatataggacatgatagatggatggaatactagtgatgccttttcttagcccatttaggagagactgtgtctgggatgtctgaggggttctgtttcagatggcaggagctgtgtcatggaaaggtgacatattcgtcctgctggaagggctggcttgctcaccgctgctttgcctctcgctcctggagatgatgtctcttatgaaacgggctagtgggggatagtggtggtgggcccagtcgttccattcggttatttggcctaacttcttaaaaatacggttttactgaaatataacataaatgcaagagtacatggtcaggtcataagtttacagtgttggggctcagaaacctgtaccccaaaatatggagctcggacatgctgaactgaataagcctctcaagtctctctgagctcccagtcccagtctctcatcctggctctctctgaagacatagagtgaagttgttctctaaagttccctcatctgcctaaagtctggacctgccaaagaaaacaaccacccccttcctcccaccacctcctgcactccctgcctactgtccctttcctgcgttttcactaactgaactcatatcgcaggaagaaagactgaagtctgtccaggtaaagaaagtctcatctggacggacttttttcacaaaccactgtcgctctgcaggccccacaggctttgtcccaggtcactgtgtgttctttaagcccattgaactctcctaaaaatcatttagtacctccctaaaataatacacacttccccatctttctttttccttaagaagggtatgtaagcatctggatcccactgggttattttgtaacaattctccttccattcccctgtgttatgcacatcgatatggtttggctttgtgtccccacacaaatctcatgtcaaattgtcatcctcacatgttggcggaagggcctggtgggaggtgactgaatcatgggggcagacttccctcttgctgttctcttgatagagttctcaagagatctggttgtttgaatgcgtatagcacttcccccttcattctttcttcctactgctccagcaatgtaggacatgcctgcttccctttccccttccaccatgattgtaagtttcccgaggcctcaccaagcacgcttcctgtacagcctgtgaaaccctaagccaattaagcctcttttctttataaattaccctgtgtcaggtagttctttatagtaatgtgagaacaaactaatacattaaatttgtgtgccatttcttctattaatctgccttttaaaagttgattttcagcaaaccttcagagggtgaaggggaagtttccccttggcccctacaacagctcaaaaaattgtcacaaagtgaacatgcccatggaatcaactttcagtccagaaagtgaacattagttatattccagaggcttgctaccttctttccccttcccagagataaacaaccctggcttctgataccatagattcgtttggtctgtttttgaacttgagataaatgatgtctagatctagtaaatggtaaaggtgcagcttgaactcacgtccttggaattcagaacgaatgcccatgtcactgtacattctgccaagacactcagccctcaagagctgtcagcttctgtgagtttcccacccccatccggcacaggattgatgagcagagaaatgaccagtgagcagcctgagggaaaagacggggaagatggtaagtttgtgcattccgcatacgggatcaccagcctctgagtaacagatcgtgtgcactgaatggaaaacagcattcagaaagggactatagatcctcagaaatctagaagaggatatgtggctaattttagaggaaacattaactttggcttttaaaggttaccagtctcataaccatcatctggagctctctgtctccagggaaagtagtgctagcaagtcaggaggagtgtattcttctgtgtttgtacagccccagtgaaatgaatcctctgaaagtagtcagtctcttctgttttttcattttccaggttgcatgggcctcagtctagatccaagagaccggcctcttggatgaacaaatgcacgcttaacctttaacatgggaccagttcttggcttccttgcttagggagcatgaccactcttggggctgtgccgactctccgttataaccagaaagtgaagatgctttttctcctcaccccctgccttccctgcgccagtgccagcacatttctttagggacattatgctatttctctaagcctgaaagtgataaagaggaaattatgtaacatttgctcagttgctatttaaaaaacaaaaacaaaaacaaaacaaaaacaattcaaagagatcactgggaaaattatttcatttaattaattaattaattttgagacaagttctcactctgtcacccaggctggagtgcagtggcacaatcatggctcactgcagcctcaacctcccaggctcaagctatccttccacctcagcctcatgagcagctgggatcacaagtgtggccaccatgcctggttaatttttaaaatttgttttgtagagacagggtctcactatgttgcccaggtcagtctcaaactctcaagcaatcctcctgcctcagcctgacaaagtgttgggattataggcgtgagcttttgcacctggtcagaaaattattttttatgtgctttttgggaaaattattttatatatgcttataaaagcaaattttcaaggccccatacattaaaaaaacttacatttaaacaatagttcagtttctttttaaacacccattcataggtatggctggggtgttttggcagagagcggggaaagggtttagatgaatattcggaaggaaattcagaaatacccccagggaccagaaacttcatgataaaatgcatcctccacagggagaggcatttcaaaaccagcccatgtgaatcaagtgaccatttcagggaagaaactgaatatgttagagacaaaaacaaagtgtagataattttataaaagtggaggtggtggaagaatacgcggatgtggctggagagaagggagcgatgggttatataagtttatatcttaaaataaatttcttagagctctgtttgttattatttcatattgagaataaaggaagcaaagcagttctaagcctttttatttggaatttttcatacaatattatgatgatcatctcctcttgaaaaaacaaaagagatgtaaatgtcattccaagggcatttggggtagagagtatgtttcaattctgaaaggggttccaaatcagtgataaatttgggtcagcaagacaagaaaaatgttttgcattttgatgttcaatactgtttctttcagtacaatgacataattggactaataggaattggccccctgacccctcagatattaagagaaaaggctgaccagaaacaaattctttagatctaaagtcagagtcctgggtaggtggtccttttctgagctggggggatgtgtagtgtgtgtgtgtttgtagaactcaaatggaatgaatccttcgtaagtaagcagactctcacatctgttcttctgtttttgctttttaccagccctttactttgtgttcttatcaatgagacttactctagaatttctgattaaagatatatctttaggagaaaaatttaattgcatgcatcatagccttgaactaattatatttttgggtacaggtaaaaagcaggtcaaggctgggcacgatggctcatgcctgtaatcccagcactttgggaggcagaggagggtggatcaccggaggtcaggagttcaagaccagcctggccaacatggtgaaacaccgtttctactaaaaatacaaaagttggctgggcgtggtggcaggcacctgtaatcccaggtacttgggaggctgaggcaggagaatcgcttgaacccaggaggcggaggttgcagtgagctgaaattgtaccattgcactccagcctgggcgacaagagcaagactccatcttaaaaaaaaaaagcaggtcatgcctcttattttagctgatatgaggaagataagacttttgaccaaaggatctaggttagcaataaaaacaggtttctcaatagtgtgggctgtataggcaggtttttcagggctgctggggatctctcactagaaggcccaggcagggagacctgtgcacagcagcggcaagtggggagagattcaaatcccttaagaagcaccagagtggatgactttggagccagacaactccatttgtgaagcagaaaggctaggcatggatacgggaaagaggaagaaatgatcattatgttctaaggataaatattccctgggagagctggccaggaagcaaatggataagcagaggggatgaggacctgacagaaagggagatcctgccctggagacatagcgtggctcagggtcctctctccttggccccagccagtcctgcagccttgtaagtcacgtggcgtttatacagggaactgcagaggcatgcaaaacccagtctatcccaacctgagctcaccctccatatcatattactctgactaggtcatccccccacgacccaggcccaaagaccaccgttccttttcttgaccacccgcaggtggtgagtgagcaagttttccaaatctagctcccaaatttctgtctgtgttgtcctccctccttctgtcccgatctcagagcctagatcctggtagagttctcctgtcctgtctccctgtatctctctgcatggaaggattaatccttaaaaggcaatgccaccagttttgctgttgttgttgttgttgttgttttagagacagggtctgccatgttgcccaggctggtctcgaactcctgagctcaagtgatcctcccaccttggcctcccaaagtgctgggattacaggtgtgagccgccatgtctggcccagcaatcagttttttccccaaaactccaaaactttcagtggtttccattgcctaccaaattaagcccaaacccatagtaatccatccaagccctctcggatcatgcctgaacactctctgaggatacaggtaatactgcactgctgtggacaagaaagacgacacttgattgtcctccagtgggcctgcctcattgctttgttcatgctgccccattgttttgatctcctccatctctgcatggcaatattctatctattgtttaagatccagtttaaatcccatctcctccaggaagcttgcttgctctgatgcaaagagaaggaagctgcctcttcatcttttccacatctttaatgggctattatatagagtggtcagtgcaccctttttttttttttactctttctttcttttctttttttttttgagagagggagtgttgctctgtcactcaggctggagtgcagtggtgtgatctcggcttactgcaacctccacctcccgggttcaagcgattctcctgcctcagctttccaagtagctgggaggcgcacgccaccacgtccagctaatttttgtattttttagtagatacggggtttcactatatgttggccaggctggtctcaaactcttgacctcaagtgatctacctgcctaggcctcccaaagtgctgggattacaggcatgagccaccgctcccggcctgttactctttcatagaccaccccacaggcttaaaaaaaattttaaattacaaaatatagacatgctcatatggaaaatgtaataactggcatgggtaaaaaataaaggtatcctttctccacagtttagttatttaaagataagttattatcatgtatctgtatttattccttattgctactgtaataaatcaccacaagcttagtggattaaaacaacattaccttattatgttacattcctggaggtcagaaatatgaaatgggtctcattggctgaaatcaaggtgtcaacagtgcggtgtccctttctgcaggttctaggggagaagctctttccttgccttttccagcttttagaggcctcctgtattcctggatgtgtggcctcttcctccatatgcaaagccggcagtggttggctgggtctgtccaggtccccctccaacgctaacttttccgcctcccttttcacgtgtaaggctgcttgtgattatccaactggatcattccagataatctccctattttaaagtcagttgtttagtaaccttaattccaactggaatcttaattcttccttgccatgtaacatattcacaggttccggcattaagatgtggatatctttgcaggctattattctgtctgccacaagatcctttcatgtatttctcctactttataatatcaatatcaatatggaaaaggatttatttatatattttttagagacagggtcatgctatatgttgcccaccaggagtgcagtggtgcaatcttagctcactggctcactgcaacctcgaattcctgggctcaagtgatcctctcacttcagtctcccaagtagctaggactacagacatgcacctccatgcccagctaattaaaaaaaatttttaaaaacgttttttgtagagatgtggtcggtcttgttatgtttcccaggccggtcttgaacccctgggcttaagtgaccctcctgccttggcctttcaaagtgctggggttgcaggcatgagccactctgcctggcccaatgtttatttttaaatatgtgattgttaaaggtgtgagataccagacatatgatattatgtatcttgttttttaatagataatttatcttgtacattttttatgtcagttcattcagaggccctcattatttttagcagttgcacagtatcccatagcatgaatatttcatgatttacttaatattttcctactaatggacagaaattgtagcagctttcaatttttttttttttttttgagatacagtcttgctcctgttgcccaggctggagggcagtggtgcgatcttggctcactgcaacctccgccttcctgggttcaagctattctcctgcctcagcctcccgagtagctgggactgcaggcacctgccaccatgccggctaattttttttgtatttttaatagagatggggtttcaccatgttggccaggctggtctcaagctcctgactttgtgatctgcccgtctcagcctcccaaagtgctgggattataggcgtgagccagcagctttcaattttgtaccttgtgtgtatatgtttgtgtccttagataagattgtctacagcagagatacccgtaaggggacctgctgggagcaaaggataatttatattttcaaagggcatttacaaattttgatctatatttacatattatataccattaaataaagtagaaattttaaaaacatattgctgttcaaattcttataaattcaacaagttcagatcttttcttgatggattcaactacttctcatctaggtacaaggtacacaccgctacatttgattaaacatgcttgatttgattaaaatacagctatccttgttgttgttattgttgtttttttgttgtttaaaaactctacgggagattctattccaagcttggaacagtattccaagcttggaacagtattccaagctgttcccaatgaccatcttggtgtggagacacaaagaatgcctcaatgatcattaaagttcacttttgctctaagatttttttttttttttggacagagccttgttctgttgtccaggctggagtgcagtggtgcaatctcggctcactgtgacctccgcctcctgggttcaagcaattctcctgcctcagcttctagagtagctgggattacaggtacgtgccaccacgcctggctaatttttgtatttttagtagagacggggtttcaccatgttggtcaggctggtctcgaactcctgacctcaagtgatccgcctgtcttggcctcccaaagtgttgggattacaggcgtgagccactgagcccggccttggtccaagatttaaagtatgaagcattcggcacaaaacaaagactaatcatgtgaagagagactttgcaggtgttgatgatgcataaatcagaagaactcaagggagacgccaaatccctttagaatggcccaagtttttctgggtagggggaagaaaatgcaatggcaatgactcaccaaagtccaccaaaatgttttcactgtactgatgagctatcaaacatctttacagaccttcaatgcacaattcctctttgttcttttaaataagaacgtgacttcccatcttttcaaacttatatttgaatgtcttttaaaatgcctttgacctcaattattatgacttttcttgttttttaaatgttggacttcaccaaaattaaaaatttttgtgagtcaaaggacacctcaagaaattgaaaagacaatccaaagaatgggagaaaatttttgcaaaccatatctctgataaagaacttatatctagaatatataaacaactcctacaactcaattattcaaagacaaatacctcaatcaaaatgggtaaaaaatttgaatagatatttctccaaagaaaatatacaagtgaccaacaagcatatacaaagattctcaaatggttagtcatttgagcaatgcaaatcaaaaccacagtgaattactacttcacaccttctaagacaactacaataaaaatggatagataagaatatgttgtccaggatgtggagaaattggagcgcttatacacatctagtgggaagaaaaagggtacagccactttggaaaacagtctggcagctcctcagaaggttataaatgaagttagtatatgaaccagcaattctgctcctagctatatacttgggaggaatgaaaacatatgcccacataaaaacctgtacacatatgttcataggagcattactcatgatagccaaaagtgaaacaatccaaagttcatcaactgatggatgaataaataaaatgtgggttttccacacagtaaaatactatgcagctctaaaaagaaatgaactactaatgcatgctacaacatggattaaccttgaaaacattatgctaaatgaaagaaagggtcacatgtgcaaaatgtccagaatgggcaaatccatagagacaaagtagaatggagctatctggggctgtggggagggctggagggaaatggggcatgactaccaataggcatggggatttgtgggtgctgaaaatgttctaaaattgatagtggtggtgcacagctgtgaagatacaaaaaaccattgcatcgtacacttaaaaaatgggtgtgttatatagtatgtgcattatatctaaataaagtggttactacaaaaagcaatatcctttggaagttgcttacatgtgaatataaggcttttccctttctatggatgccacagcgatttcgagaggggtaatactggtggtggtgagaatcttatgtgtcctcataagtgaaaccgatgtttaagcactgaggtaaagtgcttaaattaatctgctttttgtctgctttttgctcctggcccctggctggtgggctcatttttctctctgtatgctgatcttgtgtgtccaacaaaagcataatttccaaatttgagcatgaggtcttttgtctacaatggaagtcattgcacagactagagtgtaaagaaacaaattgtgtttgtgtgtatgtttgcaaatccatgtgtaagtgggaggccgatgaagggagaagtgtcagcccccaagccattgtttgttcctgtgtgctgcatcctaggctcccccgagttggcctgtttaggcgcacaaggcacctcatctcggctgcttctttcttggaccccccctagttgttgggtctcgatgtgtagcaacaacctgggggccgggtactcaccaacctctatcctagccttcttttctatcaaggtttgttttccgttttcttcttctttttcgtaagctgttatagtctctggaatgacttgggtctgccgtgtatgtgttattttttaagaatcctggagaatctatttttactcctctgttcaggtgtccaaatgctgaagacattttctcccaatcaacggcaacccacccacaatgtcagtgcgttctctgattaggcctcttgatgacggccggatccctgcccggctctgcgcccgcgatgctcctggggtgcccacacagaactgctcctgacgaggaaaaaagggggacgttccaggcccagtctggatccagtgcaatgagcgagagccttggggaaaaggcgctgccagaattttattttgttaaaaactgtattgagaaaacaaagataatctctagaattggttctaaaattcaagtgaaacctgtaaacatgcaggtgacagggctctggctgcctccctggcctcgtcttctaccccttgtcccttgtcctcctgctgccagccactggccttcttgctgctccctgtatcatacaaccacgctcctgctgcaaggccttttctgggtttgtaaaatgaaaacccaggtacttctccctttaaaaaaaatccaccttactttacagactgaaaaataatgactgcttcccttctcatatgtttttaaataatctatgcagcagttgtgcattcattcacttcatttgtgctcccactgatggaagtagttttgaagaacaggctgtattagtttcctgttgctgctgtaacaaattaccacaagcttagaggcttagaaaacccacagagttattatcttacagttctggaggctggaaggctggaatgggtcttaagggctgcagtcaaggtctcagcagggctgagttgcttacggatgctggaggggacagcctgttcctttgctttgtaggggcccaaggaaaacatccccttcgccctctgaaggttcactgaaaaactggctgacaaaaagcagattaatagaaaaaaaggcatgcaacatttattctaatgtgcatagcatgggagaattgcaggagaatgagtactcaataactcagtggagtacagatcttataaagccttctgcctaggggagggggacatgggggaatgtagaccattcttttgaggggcagtaaatgatcattagggagaatgaatgggcctagaagacagaaattaacttgtaaatggaatttggattttgaatgaacctgggaggtattgtcttgtgaaaaggtctgtccaggtgggtttgcatcctcagtgttcttttctgagatagcgaatgagatttacagggatgggaggtggaaggcaactgtggttctctttggggtctggttcccaggtggataagagaataccgaagaaaagcttcgccctatgccttaggagaaacagaggattgaaagggagcaggggagcaggtcagagagaccttgaggactttgaggctacttctgtagttcagtcatattttggggtaaagtgtgctggcttccttcagccttttttccctcctagaggcagtctatatttcttggctgtggccctttcttacatcttcaaagccagtggtgcagcatcctccaatgcttccttctctctccaactctgcttctgctgtcatctcctcccctgacccagaccctcctgcctcccttttataagatccctcagatgacattgatctcactgggataatctcttcatctcaagatcctgaacttaatcacatctgcaaagtccattttgtcatgtaaggtaacaaattcacaggttctagggattgggatttagacatctttggggggcattattctcccatccacagaggtcaaaggctgagataattcaaatgcattattttgcaccaaatgctcccatttggtttttatgatgacgatgatgatgactagataggcccctatgtagtactaggaaaccaaaaatagttacagaaaatagaaataaacctgttaaaatacttaatgagaataaaccagtaaaaattacagaggcacatgtgggcttagtgaataatatctttctaatgcagagaagatgtcatccatggaaaaggctatcagtggtatgtgtggtcttgggtttggactagctatggtgcgtgccagcatggaactctccaacttcagcagtccttggttctgacaaggaactctcagcatttgaccaatcacctgcagtcacaggtgagaacatggggccctcactgagcaaagaccaagccttttaagtgtacctcaaaaataagctaagttaatggaaaataggagtgaatgactgcagtgtttatttttaaattgctttcaagtggtgcatctgttgtataaaacaagacatttcagctcaataaatttttggacaatgtctcctctagttatcagaaacttggtattaatgacgaactctggcttctagctcaaagtcaaagaacagtggaaaatgaatgtgcttcaatgaggaaccacaacctaatagagatttcatggagtgtgttgttcgcatttttacattgtcttagatgaaagcagtgaataagtaccaaatggtgaatcttgaaacccatcatgggagaattagcagtggttatttgtgcaacaagcagaagtaatgagtattacaagagaacttaggtttctaaaaacaagtttaggaaaaatgctcatgataatcaaaataggaacatcatgaaatggctttagattttttgggcatagatatatggtcacattaaagtaaatgagaggggccaggcgtggtggcttacacctgtaatcccagcactttgggaggccgaggcgggcggatcacaagatcaggagttcaaaaccagcctggccgatatggtgaaaccccgtctctactaaaatacaaaacttagctaggcgtggtggtgggcacctgtagtcccagctacttgcaaggctgaagcaggagaattgcttgaatctgggaggcggaagttgcagtgagccaagattgcaccactgcactctggcctgggtgacaaagcgaaactccatctcaaaaaaaaaaaaaaaaaaaaaaaaaaaaaaaaggtaaactagtggaaaatgaacttctattaatatgaatttcctcgtgacttcactgtggtttgtattatttaactaagatgagtcatacgaaagtagtattaccatgagtacaatggaggctgcatgatcctcttggcagttttacctcgttcttaccggtattcattccttctaaaatattaccagaaaactatgcaaaatgtgggcttccttttgactctgttggtgctcagaaaccgataccccaaaatatggcactttgatatgtcgaactgaagaaggctctcaaggtctctctgaccccccgccccaagctcttatcctctgtctcttgcaaaacacaggatgaagttctctgaagtgccctcacctgcctaaagtctggacttgtcaaaaaaacaattccctttggttctttcccaagtctttattaactggacttatatcacaggaagaaagacttaaatctgtcaacacgcctggactgacttctgtcacaaaccattgcctgctctgtgggtccaatagactttgtctcaggccactgcatgttcttcaagctcattggattcccctaagaagaatttactacccctgtaaaagcatccacacttctccatcctcttttccctaagaagaggggtatacaagcatctgtgctttttccaaagtctttcttcatctgaaacatgagagttggactagttataattcctcagtttccttccagtgctaaaatttgatcgtatcgggaaaagatgataatatggcagaaagatagggaggaaacttttaaaagatgaagataggtgactccaaaacaacagaataagctagatgtttttgcctcattcccccctgcttaatcctttcaatcctcactgcttgggaaaggtcaattttcactaacctgccctgccttcaaaggaagagaccatggagagtgagttgtttctatcccacaaacatttcaaacctgtgagatactaaaaataatttctacttctacaacacctttttttctgaggattacaaacaactatgattaggttcatctggcaaatgggaaaatttgctctttgggttaagtagcttttcaaggtcattacacgttggcaggctcctctggcactcagctttgtgaatcagatgtaatccttacagggtcgggcttggcaatcctatcactatcattctagagctacttttgccatataatgtagccattataaaggagagctacaaagcacctgtaaatacacagagaaatagttatgaatcaatgtttaagtgaaaaaagggtagaacacaaaactacatgtccattattgttacagccacctaaaaatatgtgtgctatgaacaaaacagtgaaaacacatgctgaaaacaaacaacagccacaacaaaaccattcctgttctgtggtgatattacagctaattgtttcattttcaaacattcttctaatgtgacagatcatttatacatttatcgattcattcgcacaattaatttagcacgtactctgtgccagcacctacagtgctagtatatcacagaagaaacagatggatattatggtgctagtccttgattgagccctcgctgtgagtctagcaggggagagacacatgtagacgaacagttctgacacagtgcaatatgtctcgtaatgagggcctttcggataatttactagagaaatgtttagaagatataattaacagactttaataacctactgcaatagaggctgtgggaagaatggcaacaaacagagaggaaagaacaagtaagagtctgagcatgaaaagcccccttgtgataagtttcaacacagaggtgccagggagccatccagaaaaagctggaaacttctcagagatgtggagctcagacggaaggccggggccgaagaggtaagtttgggggttaaagtcaagcagataatagatgaatctgcaagggtggatgagattgtctaaagagactatattggataagaagaggcagtgatcaaggcaggaccatagggtgtatcaatatttaaagggacaatgaaggaaggggacccccaaaagacactgagaaaatgtctgatttttaggaagagagcaaagagagaggggcatcacttaagtcaacaggaaagttcctagaagatagtggtcaacagtgtaaaatattaaggaaatgtcaaaaaagatgagcttgcagaaatatccctcggctgtggcatttgggaggacatgagtgaggttaagagtgatgaggacccaagagttaatgagaaatatcaaggaggtaacagatatgaaacaacaataaaaaggaaatatctgaatttaggcaccatgctaagataactagcaatgatatttttaatggtcagaagctatgttttaggaaatatcataagcagtagctctgatacatagattatttcagagtcaaagaaaattcttttagcctaactgtgggcaaatgttggtaagttcttcatggctttcaaatatcaactaggtacagtagctgacttttagtttgaggagatgcctattagcccccagatggtatgttagaatcagtggaaaattgtaaaattctcagtctccaaaaaaaattttagaatgaccttctttctctttgttcagttggtagacaagcagatgcccagtgaatggtggaacttggctcttctttgtttggacagtttcaaaatcttcctaagtctttgcttcttttactttttttttcttttttttttttgagacaggatcttactgtgtcacccaggttggagtacagtggcatgatgatagctcactgtagcctcgaactcctgggctcaagcaatcctcctgccttagcctcctgagtagctgggtccacaggtgtgcatcaccatgaccggctaatttttaaaattgtgtgtagagatggggtcttgctatgttgcccaggcttgtctcaaaatcccgggctcaagtgatcctcctgccttggcctcccaagtgctaggattacaagcatcaggcattgtgcctggccagtctttgtttctttaatctttaaaatgaataagttggattaggtcatgattttcattatctagttgattagaggaaagcaggaaacagacatcagatttaactcaaggaagagtatttgcctgcatttccttttaaattggatatatccacgaaagaagttggggaaaagggaaggactcatggcttgtagggaagtggatagtgcatttgtggcggcaggcagtggggaaggtttcctttgcaggagtcattgtgaggggtttggcagggcttcagcatctgtcacaagggggttggtagatttatgtgcttctctaggaggcccctgaacttgctttcagcatgagataaatcactgtcactttgcagacaggcacagacaaacatggaggctactttcgcttcattaaaacaaaagaaccaaccaggctcccgcagatgtggtttctgcctctcagaaatgacagaatcaattagtgcaggttcacctagatggtacaccatggacatggcttttgggctgcggcaataaagacctgtcaactatgatgatgtttctggggaacggtgggggaatatgtggcagctcctcaggatatgaaaaatgatatccctcagaaaagtaggcacaggcattgtaataatacacttgacaagcaccttatcttctaggaactttgcaaggcatgatgataattactaatcaaaattggcttaatatagcgtagcagtactcactagaaatcagcgcagatgggaaggctgtgaaaaccagcatttttttctcttgtaatttcatatacagttgttactacaatggtgtcagaaagctcaaagtggcttataagaacaatggatccaaaagttggcttgagtccagagctgtcaaagcttagtctgcactgtatgatgccatttattgaaggaaggtgatgtgcacatgtgcgtgtgtgtgtgtgtgtgcacgcatgtgtgtgtgtgttagacagggaaagagatggattgatagaaatcttattcagacaaaaacacaatatttacttaggagtcaatgataatcattatgcaatacatggcattatacacagtcatgtattttatgtgaattaaaatgtattttcctagagagtataacaatttcagtaatactgaatgtaatctactgaaatgaagcacaattgaaataagcaaatgaagctgggtgtggtggtacacgcctgtggtctcacctactcgggaggctgaggcaggaggattgcctgagctcaggaggttgaggctgcagtgagctatgattgtgccactgcactccagcctaagcaacagagcgagattctgcatttaaaaaataaaattaaaaaaaggcaaatgggcaattcatcattttttaacagcaaagtaatgtgttaatccctgtctgctcccacgtccacactggggaccaccccccaccccactatagctggctggctagagccctaccccaggccacatctaacctggtatcatcgcactgcagaagccctatgccccagccctgtaaccagctggccctgtgtactcacgggcctgcagggcagcagccctcttccctaactccagctgtgggtacttaagatattatgatggggctgggcacgatggctcacacctgtaatcccatcactttgggaggctgaggtagatggatcacttgaggcctggagttcaagaccagcctggccaacatggtgaaaccctgtctctactaaaaacacaaaaattagccaggcatggtggtgcatggcctgtaatcccacctacttgggaggctggggcaggagaactgcttgaacccaggaggtagagattgcagcagtgagccaagatcataccactgcactccagcgagactccatctcaaaaaaaaaaagatattatgatgggacatctgccttggcgtcatactgatctctttgatggaaactttgacctcttacttcccttctctcaaccccttctgcatggagtttggaccttgagctctgcaattccatttgctgtcttggcctccactgcagaccagaaggaatgggatggtcccactaacctgacaatgtgtggcaccaccatctgcggccacacctcaccatacaggccagcttctttgggcacctgtgtcagcccagattgagcctgtgttagctgaactgctggaataatgtactggggcttgtgcatgtaccttccagatcctgttggtcctgcctgacccctcagccttggactctggccctgcttcctggacagagcagcctcaggatggctcatgctgctgccatctgtgaagcctggccaccgtgcttcttcctccacctgcggcactgctggtgtctcgacctccctcagggacgggtttgcccaaccccattgagccgctgggcctgtggaggctttttcactaggagtctcaaggccctcagtaagtatcacagctcacaagtgcggcgctgttaatatcccatggaatacgactcgaccaatgaaaggcaggagaccaggaggaattagcagatgaattgcttgccctctctctctgagaaggactgtttcagcacaccacggttccatatggcctctccagagtcatccatgtgatccaatggccagctctgttttcttccacagcccatgtctgatccgtgaatgcaccctgccagccctgccctcaggatgggcacatacctgtccactgccccaccctgttctcactctcactgtcccggagggctgtgtggctttccctgacttccatccttgcctccctccaatttcttctcgatagagcagccagatttattcctttgaagtgctgctcctccacccaaggctgtcagagtccccgtgtcactcagagtacaacccaaagtattgacttccattcttcccccttccaatttcttcttgatagagcagccagatttatccccttaaagtgctggtcctccacccaaggctgttagagtcccatgtcacttagagtacaactcgaagtgctccccgtggcccatgctgtctggctcccttccctcctgccttcttgagcctagctctctctttgcgctctctgctgtggccacccctgctctcctgcatggcctcctgcacaccaggcacacctccaggacttgctgctttctgtctgactcactttccccttgcacagctgcatgccccactctgcgaccccctgacactatccccttgtgagtgtggcctttcgtaatcactttctctgaacagcacctcctcctgcttaactttttccttcttagccgttatcctagtcttccttgctctttatgtcacttatctgtcttgctggtttttgtcttccctactaggatgcaagctctgtaagggcaggggctactgcctgttttgttcactgtggtatccccagtgtccagcacagtgcctggtacacagcaaggttaagtaccagctgaacaaatgaacccatgaatgaacgaggacaccacatatacttaaatgcttcattcctaactctgcacgtctcctcccttctcctttgtcaagaagggcctggctggctaggtcccagttgtctcttagttccacctgccctcagactctcctgtttggctgcacaacttcctttaacccttctctaactgtggcagcatggaaggtgacagcttggaggtcagtgatgaggcaggaaacttgttagctaggacagaacatatacagaagagactcagtgcagctgacagtgtgcattattgtgatacatgttcaaagcccatctcaattataggcatggattcatttatttctgacttcaaaactctccgtgtcaaagtcttgctcttactaccttgttgaacttgactatagcaatggggaatggcacctggaaagggtcccgtggagaacccacccaggatgctgtcagtcagcactgaccatggggctgaaggtggaaggttcctctatgtataaagagagcttctcacactcggggcttttgtgtgggacaggaaaggctgacataaaacaatgggattgagtcattcatgtgggaccatacgtagccacaaaggtgtgacttggcccactgcccccctagagggcagattgcagaagttggcagaaatgtcacctaattatcaaggtggctgtgtggctgggagttactgctcaatctattcagcagcggaggaagctctgccagttctcagcacataggatctggctaatctgataacatatggaggagaaaaagtgcgtcactggtttcctctcgcaccacgcctgacttctgcaaagcagcttctctcccacttatctcccactgcgaagccttaggcattcattcctgtgtgatggagtcagcatcctgaagaatatggaatatcttagagatgcaaacgatccaatgaatacttatttattggtcagggagaatgtaactgaagccaatttcccttgtgagttactcacttacttccaaattggcatgagtgtaagactccgtggacatatataactcattctagccaggatccagaggatcacagagacacccactgagtgtcctaagtgacaggggagatggatgtcatgaaaagccaggaagaaacccccaaattccttgaaacagacacagagattttcttattggaaactaagctaaacacttatttaaaaatatattttctcccttgtcctcatctgttttcttttctcttttcttttttttgagacagggtctctctctgttgccaggctggagtgcagtggcatgatcttggctcactgcaacctccgccccctgggttcaagcgattctcctgcctcagcctcctgagtagctgggactacaggcgcccaccaccacgcccagctaatttttgtatttttagtagagacggggtttcaccatgttggccaggatggtctcgatctcttgacctcgtgatctgcccaccttggcctcccaaagtgctgggattacaggcatgagtcaccgcgcctggcctgttttctatttttaaatttacttgtattatttatttgtttgtttatttttagagatgagggtctcactatgttgtccaggctggactcccaactcctgggcccatgcgatcctcccacctcagcctcccaggtagctagaccgggagatagatagataggcacatcacctattttcttagggttccagggcttgttgaatacaaattatccaaataaaacacaaaggttctcctcatatataccaaccaaaacccacaaaaaaatttgttatccttgtattgtatgatctcgttggacatctggcagtgctgggaggaatgagcaggtggaatgagcagagccgcaggattgggccagtcttaaagagatgctatccgatggtcaaagggctaatacgattaaggagttaaggaccaacatcgcccactgagttattgccaattagtagccaggtttccccagcagccccaagcaaacattatcaccagcattgattactgatatcgcccttctgtatctctgttctgggttctaatgcagacatagagagagagaaattaatttgtgattaagacaggcaaagcactcagaactgtagactcaagattgtcctgggaaatcttccatagtgaagatttggagggaacaactcttctcttctcatttctcactggcatttaatactatggaaaacattctggttgtggagtgtgaagtcctgggcttttggttctgcccatgacctgtcattaatgcaacagattctccggtatacaaaggggctgtttaataatcaaatgagatacaaatgacaaacttttacaattgtaaaaactacatgaaaacttaatgatttcatgagtactgtatatgaaaaatgtttctaataattgtaacattccattggtaggattcaggtagtgtgttctcttaagaggccctaaagagagggaacatgcgctgagtgacagcccaggaggaagcagacacgtaaggtgagctcgatccacgaatatgctctagacctgtcagtaacagccgcttagccactgagctaagagctgaagtcagcaggagatggaaactgtcggatcctcaccatgctatcaaagcaaattccagcagcaggcacattgctggtaaaaataatgctcagaattcatattttaatcacttaaaatgcatttactcatagtttcttcttcatggctgaggtgcatcacgacccttccatgagctattatactcaaagatagaaaatagtatcagatgctatggactgaattgttttcctcctgattcatatgttgaggccctaatgcccagtgtgatggtatctggagatggggcctttgggaggcaattaggtttagatgtgatcacaagggtgagaacttcatgatgggaatagtgttcttataagaagagacactggaggccaggcacggtggctcctgcctgtaatcccagcacattgggaggctgaggcaggtggatcacgaggtcaggagatcgagaccatcctggctaacatggtgaaaccttgactctactaaaatacaaaaaattagctgggcgtggtggtgcacacctgtagtcccagctactcaggaggcaggggaattgctttaacccgggaggcagaggttgcagtgagccgggatcgcgccactgcactccagcctggcaacacagcaagactgtctcaggaaaaaaaaaaaaaaagaagaagaacactcaagagctctctctctgtctgccacgtcaagacagtgaggaggtggccctatctgctagccaggaaaagggccctcagcagaacctgaccatatcggcaccctcatctcaaacttccagcctctagaaaataaacttttgttaagtcacccagtctatggtattttgttatagcagcctgagaatactaccagatgtaggtcaaaggatgaaaaatatgaataataacaaaagaaagaaagctttgtactgttaaaggctggtgagcatgaaaacagaagcttctgaacagttttaaagcgggagggaggggtcaggtgggtcactacacatagtgttggaagagtgtgttttgcccaaattgatcaaatgagaaaaggactcagtgtatcataatgtactagggaaaacaatctgggatactgtaagtcctgcttccccagtgatatggttttgctgtgtccccacccaaatctcatcttgaatagtagctcccataatttccacgtgttgagggagagacctggtagaagataattgaatcatgagggcaggttcccccatactgttcttgtcattgtgaataagtctcaagagatctgatggttttataaggggaaacccctatcgcttggctctcattgccgctcttgccttctgccatgattgtgaggcctccccagccacatggaactgtgagtccattaaacctctttttctttataaattacccagtcttgggtgtgtctttattagcagcatgaaaatggactaatatccccagtcattgaattcctgtaaacacaggcaaacacattagtttagaataggtaaaacacttagtgtaaccaaacccgaggttaatcattcaacttgccagtgaaacgcttccaacagaggagaggagtcagtgagagacgaataaaggacagagacacaaaagcagccacacagatccatagtcagaggacaaagctggaggcagcttggtggagcaggttgcttcatggtcagccagtgagccctttggggtcaatgagggaaggaagtaccttccttttagggacagggacagggacagagatggacctacagggatcaaaggctacaggcagctacaatgtaggaaaaaaacacagtccagggccgaccctgggggattgacttggagaggaaagtaggattccagttccctgaggaagagcctcatgggacttggcacatggagggtggttgagtaccctggtctctgagcgtatctgtttctatggttttatcgttgtctattccctctaaggttgtttatttatttacttatgtatttttgagtaacatttgtagcttgcacacaggagatgctaagtatatgcttactgtatagggcattccaggtgaggtgcttaacataagttgctcagttaactctcacaatatttatttaataatagataattagaaccatttttaatttaaaaattttaacattctgatctcacttaatggcctcaatagacttttttttttctttctttctcttttgagatggagtcttgctttgttgcccaggctggagtgcagtggtgcaatctcggctcactgcaaactccacctcccaggttcaagcgagtctcctgcctcagcctccccagtagttgggattacaggcacctgctaccacacctggctaatttttgtatttttagtacagacggggggttttcaccaacttggccaggctggtcttgaactcctgacctcgtgatccaccagccttggcttcctaaagagattacaggcgtgagccactgtgtccggcaatagacccattttaaaaatgaaaaagaaaaagccacaaccagagaagtcactcacataaggctgcaaatttgtaaagtccagatttgtacactgttctgccttctcttattatttcaggctgcctctaagtcagcaggactgggaccctacaggcatgggtgctaccagaaagggagagggaagaagaggagtgtggctaaggcgtgctgtcccttctgcgggggtttcttcatagcgttcctctcattcctgaaattattccatttccagtggtattgagggtgaccagcagaccctgttgtaccatgtcacttaaaaaacgtagtgccttttttttttttttaaatacaggaaacacaaaaacattgttaatattttaaaattatcatttgaattttacattgttacctccggggcacagtgaatgatcatggaagctagacagaggcttgccaagctgtctccccgcaatactcagctcagctacttaaagtgtaggtggttgctatgggcaaccacttaaataaactcagggaaagtgttggggagtgagggctgcggagtgcaggcagttaatggatttacctaattcaaaacaaaacaaaacacctataaatttttccccaaggatcattcctccctcccgctaatactcctctacctgagatgattgttttctttaagacagccaaggaaagagaaatgacaatgaggatcttaacctgttatctgaatagtgaagtccatctcaaaatattcaaaaaggaagagaagctggaaaattctaactgttgatcaaatattaccactgctgtaagttaaaaaaaaatccacctaattttaaaatggcccctagattgttcttcccatggtagattgcttatactcaaccccgagtggcatagtctcagaacccagtcttcccagcagggaattggaacagcaggttttatgattatactttcctattttggtgggtgggaacatattttactttatatcttgctttttgcttcattttcattttctttaagtgattaagtgctttgagatgccaagccttcatgtttattgaagttacttttacacttttagctaattcctgcactcttgtccaaggcctgtactc

SEQ ID NO: 44 - DNA, 6617 bp, Homo sapiens
aaatttccagaggaaatcttatgttctcacctctcaattaacagatattcatggggcaaattctatgtacaagaactatagattttgtgtttagatggctaattgctgaaccactgcaaagctacaaagtgactggtatttaaagtctttaactccttgtagggtcacaaggtagtagctgagatcttatattagagtggtaggaagtaggaacttcaagactgctacgtgccaaagtcaagtgcttgcatcctatttatttaactaatttagaaagtgttatgggcttttggattgtgagtttctcgttctctttttctgagaacgagaacagctcttcatgtttcaggttaccaatttttaaataaaaagaaagttgctttaatttgtgtcagtttaacctggatttatgtcaacattctttttatttaaagggatatagcaaatgcaccattaataaaaccagaaaaggcccggtgcagcggctcatgcctataatcccagcactttgggaggctgaggtgggcggatcacgaggtcaggagctcgagaccagcctggccaagatggtgaaaccccgtctctattaaaaatacaaaaattagccaggagtggtcttatatcaataagaggcactgtgtgctgggtacagtggctcagtgtaactttgactggcctcccctttgtgactgtccatgtgaaagttgggtcatgtttgatgggggcatttctaggatgcgtggaagaaatattttttgtattcaacaagcagatgatgttatatgatggagatgaaacagtgcctgcccaactatccacctctaaggaaaccgccttgcccaaaacccccactgacagaattgtggccatttgtgtcactggaatctcagaaggaggaggatgaaaaagtagccacagaaataatgactgaaaatggccaggcacggtggctcacgcctgtaatcccagcactttggggggtcgaggcgggtggatcgcctgaggtcaggagttcgagaccagcctggccaacatggtgaaaccctgtctctagtaaaaatacaaaaattagctgggtgtggtggcaggtgcctgtaatcccagctactcaggaggctgaggcaggagaatctcttgaacccgggaggtggaggttgcagtgagccgagattgcgccactgcactccagcctgggggacgagagtgagactttgtctgaaaaaaaaaaaaaaaaaaagaaataatggctgaaaatttctcaaatttggcaatttgggaaaaaaatacaagcaaatccaatagactttccttctctaaaagtttctaaattatatttgacatttgaagcagaaagtataacattgtgtgatgtaactcttcatgtatgtgtaggaaatatttaagataattttaagttggagagggcaaagagacttgaagggaggtaaggtttctatacttcatccaactggcaaaatgtggatactaggagatctttgtggtgatggaatggttctacatcttgattatagtggtggatacagaaatctacacgtgataaaattatggactatttggccaggtgcggtggctcgcacctgtaatcccagcactttgggaggccggggtgggcggatcacgaggtcaggagatcaagacctgatacagcaaaaccctgtctctactaaaaatacaaaaaattagccgggtgtggtggcgggcacctgtaatcccagctactaggaggctgaggcaggagaatggcatgaacctgggaggcagagcttgcagtgagctgagagcgcgccactgcactccagcctgggcgacagagcaagactctgtctcaaaaaaaaaaaaaaaaaaaaaagaaagaaagaactattcatgcacattgtaacaatgtcaatgtcttggttttgatattgttgagatgtaactgttggggaaactgtgtgaggggtacagggacctctatgtactatctttgtaatttcctataaatctataattgtttctaattaacaagataaaaataaaagacaattgaaagaagtttcttgaaaatgataaaagcaaacatcaaagtatcattgtgattctctggccataatcaacattttagaaaagagaaaggttttcaaaagcaacatagtggatgagatggactcaccaattttcataaattttaaaatttcattatgggacaaatatgtaatggaataagaaagttaggtgaaaaagacatttaaggttggatttgaagagagacaggatggcagtcttatccagaaattcaggatgaacttccgtcttgattagatctgatacttcttgtcagacatacatctctacagcatgaaactggttaaccaatgtcaagtgtaataatattatgtacccttttgaaaccacagaatattctagggataaaagctaattaaactttgacagtttgtcatatattagagataacttagactagttatcttcttccataagtttaattagaagttatagaattagaattagtattctcagtaatattgataattggaagaaaaaggtaaaacaaaataaaaattctcttgtatgttggtggaaattgcatgtcagtaggacaccagcagatggcaaagaaagctttcaaaatgttgatagttacatgatcattgatttgtcattaaaataaatgtgagactgtttcaaatgccgttatagtaaaatcatggtactattcattttggtcttctctatttttaatcaaggacacttggcagcaggaaagttttgccctgaaaacttgacagaaagtcagtggcagtaggtgtagacagaaatgcaaaacttcaggtcttggatttaccacctggagctgaataatgttgctcttaaagtggctttgcagcattgtccaactgccagtgttaattacatggacaatttccaaccgctattagtttgctatatttgttaacatttaatatgaactggatcagacaactctggattatgaaggcttttttaaatggcagtttcttccatcataaaagtgcttatgggccaggcacagtggcttatacctataatcctagcactttgggaggctgaggcaggaggactggtttagcccaggagtttgagatcagcctgggcaacatactaagaccttgtctctacaaaaaaaaaaaaaaaaaaaaattagctgggcctggtataatctcagctatactgggggctgagttgagaggattactggattgctcgagcacaggatgttgaggctgcagtgagctgggattgcaccactgtactctagcctgagtggcagagtgagactctgcctccagaaaaaaaaaggtgtctgtggaggtatcataaagacaaaagtgaatgataaagattcacattgagagagcctgtttttctagtttgtgttttctgattgacctttgtaactgagttgctattgttcacatctttgctctacagttcaagcaagagaccagtcagatcagaattacattagtttagtatttttttacttaacccaagggcacagacatctgaccacttcatcagcctcaaaacagaatttgccacctgcttaatttacgcatgagttggcaaaaattattttctccatttagtgctgtctgacaacaccatgactagatcaggggattggatatttgatcttccaaatccgcataatgtgaaaacgactaagtgtaacaggaaattttaaacccagagagtattttcttttcataggcttttaaaaaaatttaatttcagtctagtttttttcatctttttctttaaacagatatttcacagacaaaccaacatgagaggccatgtcaataatatgtgaacaaatgtttctttaaaaaagagaattttttagaaactgatatagaaaatacagatttcaaatatggcaggaagctaaatgcatatttgcgagaggaaagaatgaaagaaaaaagctcctaggccttttattctataaatggatttgtattaaattatttcagattataccatagtttccaaggcatttattggtgattacagagagaatttcacttactagctgtgtggcctggtcaagttgtgtaacctctctaagtcttacatttttttttctctgtttgatttaaatgataatatcatgtgcaagtcatagagtattcattacggttacattagacaatgtatgcagctgtttgtatgcttgtcaaataataagtgcttaaaggttagctattatcattattattaaactaagccacattgagagatttaaaatcaaagccaaagtagggcattctaatttgtaatttgcataatgcttccttgtgaatgatctcatgtgaaccttacaacagcctttaaggccagtgtgccagaaaaccctggaagccccttcactgtttgccatgcaataaccccgaatgtgggcaaaggtggacttgcttgttggctgtctgtgaggcatagcccctcaaggttggcactccgttcccaagaggtgatttatgtacttcaaaacaactgcaggagatggaagcacatggtattcttcagattttaaatcttgctctgtgcctgataggacttttgcatttttatgacttcctaatattatagaggaatcctacctcgagtgccccacagaagaaaggagaagttataaccaaaagtctcctgcaaatcatcactgtcagtttccttcaatgtaacagcagacaaggataagttgcctcacaaaaggagtaggttgtgtcataaatcttgctcttttttctttcgtctgagcctgcaagggtggaagtacgcgatgtctccagttccacttggagagattcaaagaaggaaaactcattagcagagggacaaggaaccagtccaggcaatatctgaatatttattatttgattttatcttgaatagaaaagaaaggtgctttgttcagaaagcttctgattgatatctgtccctttgacttctgaacctttgcctccctgctttataacaaggatctattaattaacttggtgcttggcagaaagaactgagctttccccgaactctaagaattctccaaaaatggtcattaatgctgggaagaggatcagcattgtaatctcattttatacatgaagaaactgaagttcagattaacttcatactcaagcaataaataatttgtagagccgggcaccgaaggaacaaagggctgtttactgagagacctgagcttcttattctgactttgcctcctgttggaggttcaccactttgggccttagtttccttacctttgaatgggtttgatgaattagataggtgcagcagactttctctgtaaagggccacatcataaatgtatttggctttgtgggccaaaacattcctgcagagactactctgcaggaactattcaactctgcttttaaaagagggaactattcgctgaaacttctgtttacagatagcaggtaaacaaatgggtgtgagttatgcctgatgacagttaatttacaaaaacaggcagcaggttggacttggtccatagggtatgtttgcagaccactagactggatgatgtagaagtttgtttataactgctaatatttgatgactcagcttgttttaatagcaatgctattttccctaggaaagtcagcttgattattcaatcgtctgtggcttgtgcagtttgtggagtacttaaagatttttctgcagcttttcctttcttcttccatttttgaatgcctgctgtgtgtattgcaattacaaattattatcttaatgtcattctgcttagggtttagggtttgtgtggggggggagtggggagcaaggtgtgtgggattggagtgtggagtgcatgaaggtgggtgaggtgtggtctcctgggtaggatgactgacttggaatgaagacccaaacccttaggagaactttctgaatgttagttctgacctcagatgatcaacagattagctgcttttgctatattaagcaaggcttgagcaagtgtttcagagctgccaggaatgggggagggtgtaaggtaggaagatggaagaatgtgtctcaacttagaggaaaatatgatttctcctgttacaaaaatcaaactgtaaatacttctgttactgtggtcccaagctacatccaagagggtaagcactgctttcccatgggggacactgtaccctaggttcttactccccttcctgaactatgtgaaggagaggagaacagttcaactccatcattgtttaataaattcctctaataagagaattagagtattggtggggcatagtggctcacacctgtaatcctagcactttgggatgttgaggtgggaggatcacttgaactctggagtttgagaccagcctgagcaacatagcaagtcttcgtctctacctctacaaattgttttttaaaaattagccgggcacagtggcatgtgcctgtggtcccagctactctagaggttgaggtgagaggatcacttgggtctgggaggttaaggctgcagtgagccataatcacaccactgcactgcagcctgggcaacagagcaaaat

SEQ ID NO: 45 - DNA, 65172 bp, Homo sapiens
tgccataaaccttaatctccctatctataaggactgagttgagtatatgaaagaacagaatgatgagcttatagctgtaaaaaccacgaagatccttgacaagtagtagaatggagtcatgttattagcagtagtgggagattcctgggtatccagggagtgtagctgcttaaaggaaacaaaagtacaccagatttgatacctaaactaacaagaatattataatatacttgaggatcactataaatatcagatagcaggtattagagaacaatttaggtttactttgaaaaaacttcctggtggacatctatggcttataaataaataatttcaattgagataaattcaattcaagaaaaatagtctgtggaaaaaaaagctatgacaaacactgtgagaaaatcacaaaaaaatgatttcctgaatattaaaaactgcttttactggaatatttttaaattggaaaattagtacgtttactacctttcaaaaagatctgagcaaaagttttaatacaaatgcaaataaaaccaaatccactttgcataaacttccttttattttttagagatggagtcttgctctgtcactcaggctagagtgcaggggcacaatcatagctcgctgtaaccttgaactcctgggctcaagtgatcctcctgccccagcctcccaagtaggtgggactacaggcatgtactgccaggctcggttaatattttatttttttgtagagaggggatctcactaaattgcccaggctggtctcaaactcttagcttcaagtgatcctcctgccttggtctctcaaagtactgggattataggcatgaaccaacacacacagcacataagcttcattttaaagcacagctagacaagtgtgatagctggatgctcaagtttcctttgcattataaattctaaccaaacttctaactgacctgaagaaaatcagtttacttcttcatgcttccgtcatttctcttacctcttgggatcctgtgacctttctcatagactgtagggttacatggtaattacattacagatgtgaaatcacttagaaagtagaaaagcaatcttagaagacttatcgcacttaaactaatctgatcatacccatcaaaatgtgatttacagtgtttgtgagcgagcatagtctattttctaaaaatcacagaaaaacttatgtctcttcatgtaaaaaactatttttcaccttacacaagcccccatctatcccaaatatttctcttaagtagtctcaggaaaaacaaaaaaaataaaaaatcaaaaacaactaacctgagaataatttaacaggactttcaactctgaaaaatccagcatcgaacactattttatcaacttcctttggtatcacagaaactgctgtttcagcacattcttcctgcctaattctctctctcattgcattttttatggcagctaggcgatttctcgctgcaattcttccagcatcatcctgttttggtttacttgctatacctgagacaacttttttctgcaaagagaaactaacatagtaaagctgcccattaccatcttacaagaaaaacacacaacaaacacaaattcatcacttaaaaatttaatttttaaaaataaagtatacataaaatatttcacattcatcatatatttatcaagttcctagtatgtgctaaaaggtaaaaaggtaaaggacagagttgctgccctcaaggagtttgcagcttagtagaagatctgggaagaatagtaagaaggataaatgtcctgttagaaataaatttaggggacatcctttagattataaccatgacaccccccccccataaaaaagaaaaagcaaaaaaagtaaataaaaaaaaagtaaaacattaaaagaaaataaataaggatgacacctaaaccaatcttcaggcatcaggaaaggttgtaggaagtagcacctatgctgaaaccatatttcatcaaactaaaagatggggtgaggcaagtgctagagagatgtttccaaagccagaaatgaaacaaagaaaagtggatttaaacaatagctagattataataaaaatcacctgcatgtaatggtcttaagaaagtcacatttacacagaggacaagggaacagagagttattggtaatttttaagcagaagattaacatcaagctggtgttttagaaagatcactcagactaaggagtaagagatgaaaaaagtggacagattcaagagatatttgaaaggtagaattgagaggacttactcatctattggatgtgtgtggggtggagatggtgaaataaagcaagcaaagggtatcgctcaaaaggatatctcaaaagagatattgagacttctatcttgaacacctggtgggatggtaacagcattatgagacagggcaacattggtgtgtgtggagatgctgtcagtttgggatatattgatttttaaggtatattgagtcatgatatatagaattagagcttagtaagtgtggtctgcaatacagacttgagaatcatcacaggttgggtaagattgcacaggaaaattacggaaggaaagaagagagtagaggtaggaattctaaataacaaaaacatttaagggataaatggaaaacaaatatgcaaatatgactgaagaataggcaaagaagaaggaaatataatttcaaaaacaaggaagtaggccaggtacagtggctcacaactgtaatccccgcactttgggaggctgaggcaggaggatcacttgaggccaggagttccagaccagcctggccaacatggagaaacaccagctccactaaaaatacaaaaaattagctgggcaaggtggcacatgcctgtagtcccagctactcaggaggctgaggtgggagattgcttgaacctgggaggctgaggttacagtgagccaagattgtgccactgcactccagcctgggccacacacctagactctatctcaaaaaataaataaaatacaaaaataaaaatacaagaaaaaaagttagctgggcgtggtggcacacgcctgtaatcccagctacttgggaggctgagacatgagaacagcttgaacctgggaggcagaggttgcagtgagccgagatggcgccactgtactccagcctgggcaacacagcaagactctatataaaaaaaaaaaaaaagtagaccatatttaatactgcagaaaggttagatttatttactactttttgttatttttgagagagtcttgatgtgtcgcccaggctggagtgcagtggcatgatctcggttcaatgtaacctctgcctcccgggttcaagtgattctcctaccccagcctcctgagtagctgggattacaggcgcccgccaccatgcctggctaattttttatttttagtagagacagggtacaccatgctggccaggctggtcttgaactgacctcaggtgatctgcctgcctcagcctcccaaagtgctgggattacaggcttaagccaccacgcctggcctagaagagttagaatttaaaattaagtgcctaataacttaagcaactagtggattaataatttagataactattctaaagttataggggggtaaaactgaattgcaatgagttggagaaataaaggaacaaaaataatagagtatagaaaacattttaggatgcttgtcagtgactggatagaaagaaaaaatgggggtgtacaagtaattaaagggagaagcagacaccacaggtttgttttaatgtaaacaatgataagacacttaaacatgtttaaagactgatggaaaaaagggaggaaaggaaaacaagactaactgatggaatgagggattaataaataagaggtagtagggagtggtatccaagtatagtataaaagattagctttgtttgataatcttaaaggtagcctataaaataaagtaggagagagacacctggtgataacaggcagaattacaaatctctataggacatagccatgatctgcatcactgatgatattaatatttccaggactaaatccttaataagaaatacccacagtagctttaataatgaagtagcatccttcactatttagtagttttgaaatccattcaatcaatttagtcactgtcctcagggtccttgtcatgagactttattagtaaaaaaaaaattttttttttttttttttttgagactgagttttgctcgttgcccaggctggaatgcaatggcgtgatctcagctcaccacaacctctgcctcccaggatcaagtgattctcctgcctcagcctcctgagtagctgggattacaggcatgcgccacctcgcccagctaatttttgtatttttagtagagacggggtttctccacgatggtcaggctggtctcgaactcccgacctcaggtgatctgcccgcctcagccgcccaaagtgctgggattatagacgtgaaccactgtgcctggcctagtaaaatattttttaaggccgagcgcagtggctcatgcctgtaatcccagcactttggaggctgaggcaggagaatcacttgaactcaggagtcagaggttgtggtgaaccaaggtcacgccactgcactccagcctgggcaaaaagagccaaactctgtctcaaaaaaaaaaaaaaaaaaaaaaaaaagaattttttaaaaataaggtttaaaaaacaatactttaacaagttaaactcttaagataggatttaagacagtttttatttggattacatagtataataaaataccaatctagacaacctgagtttataactacaggcatttttctcatatcataaagaaaaactgacaatgcttagtttgaaaagtgtccacccaaaccaaaaactttgaattcaaaaacattactagaaagataattactagaaacaagaacaaaatctgtcatgttaacaaagcacaagaataacagcatccatttcatacgactgttgtaaggattaatatatataaagtaattggaataatatttgacacatactaagcattatataagttacctactactattactattataacaaaatgtgtaagtacagtttaaagaataaaacctttaggccgggcacggtggctcatgcctgtaatcccagcactttgggaggccgaggtgggtggatcatgaggtcagcagatggagaccatcctggctaacacagtgaaaccccgtctctactaaaaatacaaaaaattagccgggtgtggtggctggcgcctgtattcccagctacttgggaggctgaggcaggagaatggcgtgaacccgggaggcggagctggcagtgagctgagatcacgccactgtactgcagccttggtgatagagcgggattccatctcaaaaaaaaaaaaagaagaagaagaataaaaccaacactcatatatccagtatgtggtaacttagaagccctctgggtaccccaattcaatcacagcccctcctttcttctctctagacataactatcctaaattttatgttgatcgatttccttgctctttcttcaaaggcaatcaagtacactctaagtagtataaagacttaactttgtaaaataatgagaaatctaaacctaaatgtttttaaaacttaaaaacaagaagtagaagaatctatattagaaatttggatgtatgtataacagttccttaactaaaaaaaaaaaaattggatataaaacccacaaacttaccctaaagacatttttgttcatattatgattcatattattattgacttgccacccagattcctcaagtttgatcagattgttgaatttgtggattacatcttctatctgttaataaagcacaagtttaccagattaatgctagccatattaaagttataaacgaatgagctgaagactaaaaaaaaattaaaaatagtgattcagaaatgatgagttattaaaactggactgagtcattctcaatttagtgttcaaataatttttatggtaaagtttttcattatctttcgtcttacaaacctccaaaatctacataaagaatatcatacatgaataactctcctagattatttttgactaaaatgctaaaatggtagaaaagatatcctaaatgttgtttcttaaattacacaatgtgaacacaatctaattttttttttatttatccattcctccactgaaggacatcttggttgcttccatgttttggcaattatgaataaagctgctatattgctaaaaacatccgtgtgcaggtttttatatggacataagttttcaactcatttggagcgcaattgctagatcgtatggtaggagtatgtttagttttgcgagtgactgccaaactgtcttctaaagtggatataacattttgcattcccataggcaatgaatggaaagttcgtattgctccataccctccccagcacttgctgttggcagtgttttgaattttcactgttccctagtaggtatgtggtagtatctcactgttgttttgatttgtagttcactaatgacatatgatgttgagcatcttttcatatgcgtatttgccatctgtatatcttctatggtgaggtaactgttcaggtcttttgcccatttttaattgggttgttcgtttccttcttgctgggttttaagagctctttgtatcttttggataacagtcttttatcagatacatcttttgcaaatatttctccgaatctgtgccttgtcttctcattttcttgacataatctcattttaaaagatacaagtgtatttaataggatggaaatataatccccatctttctgatacttccagtctcctacgaagagttacgccactgacaacagtttggtaaccatgcttttagtctccatgctatgcacttatacacacatatcctcttagctttgctctccctcaaaaatatgtaaatgtctctgggcactgtggcatatgcctataatccaagctacttggtaggctgaggcagggggattgcttgaaccgagaaggtcgagactagcctgggcaacaaggcaagactccatctcaaaggaaaaaaaaaagtaaatgtcaaaatgactcagaattacactcatgaccaactgattttcaacaaaggtgccaatacaattcagcggggaaaagacagtcttttcaacaaacagtgctgggaaaattggttatccataagcaaaaagatgaatttagactcacaatctcataccatacacaaaaactaaccaaatggatcatagacttaactgtaagtactaaaaccgtaagactgttaggagaaaacacaggagaaaatctttgtgacttgtggttaggtaagagttcttagatgtggtgtcaaaatcacaacataaaagaaaaaaaaaatggccgggtgcagtggcacacccctgtaatcccaggactttgggaggcagaggcaggtggatcacttgaggtcaggagttcaagaccagcccggccaacgtagtgaaacctcatctctactaaaaatacaaaaattagccaggcatggtggcatgcacctgtaatcccagctattcgggaggctgaggcatgagaattgcttgaacccggaaggcagaggctgcagtgagccgagatcatgccactgcactctagcctgggcgacagagtgagactctgtctcaaaaaaaaaaaaaaaagagaaatttgataaatttaactttaaaataaaaatatttgcacttcaaaacatgccattaagaggattaaaagtcaagctacaaactcaaagaatatttgcaaataatatttctcataagggacttttatccagaatacataaagaatacttaaaactcaataataaagacaatgaaatttaaaaatgggtgcaaaagatttacacagacatctcagtaaaagatacatgaatggcgaataagctcacaaaaagatacttaatatcattactcattagagaaattcaaatcaaaactacaatgaggtcaggcatggtgacacctgtaatcctagcattttgggaggctgagaagggtggatcgcttgagctcaggagtaagacctggccacctgggtaacatgatgacaccccacctctacaaaaaaatataaaaattagccagtcgtggtggcacatgcctgtagtctcagcaacttgggaggctgaagcaggagggttgtttgagcccaggaagtggaggttgcagtgaggtgagattgtgccaatgcactccagcctgggttgacagagcgagaccctgacttaaaaaacaaaaaaaaaaaccccaaaaaaaccctacaatgagatacctcatacccactaggatggctatgcaacaattcccccttatcttcaaagaatctgttccaagacccccaggggatgcctgaaatgcagatagtactgaaccctatatatatgttttttcctattcatacatacctatgataaagtttcatttataaattaagcatagacatcaatcaacaataaaatagaacaattataacaatattccgtaataagttatatgaatgtggtctctcctccctgccaaatatcttattgtactatacctcaggtaactaaaaccacagaaagcaagactgctgataagggggggctactataataaaaaagacaataagtattagtgaggatgtcgaaaaacagaacactcatacattgttggtgggactgtaaaatggtataatcactttggaaaatagtttgggcagtttcttaaaaagttaaacataaatttacaatatgacctaccaatatctaggcatctgcccaagagaaatttaaaaagatacatccacactaagatttgtgtggaaatattcacaggttattcataatcaccaaaaagtggaagcaatttaaatgaccatcaattggtgaatagtgatatatccatacaatggaaaaccactcagcagtaaaaaggtgtgaagtacacaaggcaagctacaatatggataaaactcagaaagatgctaagtgaaagaagccagatgcaaaagaccaccataaggtatgattctatttatatgaaatatcccaaaaaaaggcaaatctacagagacagtaagtagattagtggttgcctaggtctaggagtagaaatggggattgactgcaaacaggcaggaggcatctttttatactgatgaaaatgttctggctgggtgtactggctcacacctgtaatcccagcactttgggaggccgaggcgggtggatcacttgaggtcaggagtttaagaccagcctgaccaacatggtgaaaccccgtctctactaaaaatacaaaattagacaggcacggtggcacatgactgtaatcccagctacttgggagactgaggcaggagaatcgcttgaactcaggaggcacaggttgcagtaaactgagattgtgccattgcactccagtctgggcaacaagagtgaaactccatctcaaaaaaaaaaatacatatatatattctaaatttggattgtggtgatggttgcataactctgtaaatttactaaaaatgattgaactgtacatttcaaatgaatgaattttatcatatgtaaattatacctcatatagctcttttgtgtttaaaaaaaaaaaaaaaagtgccccaatggccaacttgaagtggctcccactaagccaaagctgggaaatgagcatcagtcaagataatgactataggccaggcacagtggctcacacctgtaatcccagcactttgggggccgaggcaggcaggtcacttgaggtcaggagtttaagacaagcctgaccaacatggcgaaccccatctctactaaaaatacaaaaattagcctggcgtggtggtgggcatctgtaatcccagctactcgggaggcagaggcaggagaatcgcttgaacccaggaggcagaggttacagtgagccaagatcacgccaccgctctccagcctgggtgacaaagcaagactccatctcaaaaaaaaaaaaaaaagactataaacaatgtaaacatatcatacttttaaatctgcaactaataatgatacaaaaatcaccacagaatctaacaatcagaattgaagggtgctagtgaaccaactattatgaaaactggtaaatatataaaaactcatcataaagtaatgcttaattatgactaaacactattcatgtctgggccatacagctgctgagattccatttccttcctcacaacgttttctttagacttaataattgttttgctttttgtttgctcagggttttggtttggttgagacagggtctcgcctctttctgggaatggagcccactctcctcttttcttgggtaactctctcatctttgtgaaggacattctcattttcctgagaaagggtacatggaaggaggtgaactttgagatcttgtgtgtctgaaaattgcctttccaccctcatgcttgattggttcggtatagaaatccaggttggaagttaatttccctcagaattttcagagtattgttctagttcataatattgctgttgagagatcaatgctactctaaccattgatgctttgtataaaatttgttttctttccctggatgctttagcctaccctctttatcccagagttacataacagtatctaattatgtaagttgctgtgggtctactcagtgctaaacactcaacaggctccttcattgttcacttgctccccaatttttttttctgttctctttttctggaattcctataatttggctatatttcctggactggtccatgtaattttcttatctaatctcttctgtcttacagcttgtactacaggcatgtgcaaccatgcctggctaagtttattttctgtagagatgggctctcactatgttgcgcaggctggtcttgaactcctgggctcaagtgatcctcccatctcagcctcccaaagtgctaggattacaggcttgagccactgtgcctggctgagatttccttaacttcatattctacctattgtatcttacatttctgttctcatattgcttaacttcaaagagctatttattctctgaatgttctttttctaacaggtatttttacttgacagatgaaacgtctggtctctttgagaatatgaatacttgcatttaaaagtccatccaaatagctctcttcctagatgtttgctttggcctttttcttttaggtttgaagcttttttcaatgtctattgttggctgttggttcttgaaatgctattttatatgcttatttctaaaataagttcaaaacgctagagtcatcttcccccatacctttactgatcttcctagtaacttcttctatcacagcaatttatatgttagaattatattttgtatctcagtcactaatcaaattacaaactcctctgggacagggaatgcactattttatcaactcctaatacaatactcctaacacaataagagattaatacaatacgggcacacaacaggaactcagtaactgttagctgaactcaactaccaaaggccagttgactcatttctcacaggtcgaatcattatagactattaaagagttgaaaataatttcagttttcaacctatatagaaattatcctggccgggcgcggtggctcatgcctgtaatcctagcactttgggaggccgaggtgggtggatcacgaggtcagaagatcgagaccatcctggctaacacggtgaaactccgtctctactaaaaatacaaaaaattagccagatgaggtggcaggcgcctgtagtcccagctactcgggaggctgaggcaagagaatggtgtgaacctggggggcagagacagcagtgagccgagatcacaccactgcactccagcctgggtgacagagtgagactccgtctcaaaaaaaaaaaaaaaaaaaaaattatcctgagaatatatgggagaagaggacatcagtcataaaatttagatcatgttttacagtttatcaaagtgctttataacatcttatttaatattacaggtacataagcagctactattaccccattttactcctgctacttaaaaaaaaaaaaaaaaaagccctaagttaatatatttgaaatattgaaccacatacctgaaaactaaccatatcccaaaatccatccagatctgtacaggtagtctcctttatacctcgtttatattcacaatcatcaaccagtccttcaaactgtttaaacctttccttcataaggagtcttgtttgaccaactgctgtgcgaataagatctttagctgaaggaaataagagattttttaaaattaaaggacaaaacgggacattcattgcaagtcagcccactgataagacttcactccaaacatcctagggcctacaggttgttaagcaaaacaaaaaatatctaccacaaaactttgtcatacaaatactgagtactaactatttgcttcaattcctgctcaaaattaacaatattttctcatacatattgctatatactaaatagcattctacttcttgttgtactttataagaactcaacgtcagccggtgtggtggctcatgcctgcgggcgcggtggctcatgcctacaatcccagcactttgggaggccaaggtgggcggctcacctgaggtcaggagttcgagaccagcctggccaacatggtgaaaccccatccctactaaaaatacaaaaatcagctgggcctggtggcaggcacctataatcccagccacttgggaggctgaggcaggagaatcgcttgaacccaggaggcagaggttgcagggagccgatatggcgccattgcactccagcctgggcaacaagagcaacactcatcttaaaataataataataataaataaattaaaaaaaaaaaactcaacgtcaaacaactcactgcaaataattatctaagaaggacttcatactgacagcacataattttttctaaacagcttcccaaataaatcagattaagaaactcttcagaaaatcttttccatattgatttaggtaattttcattcagagtatatttttgtgtaaacaatatcagatatcaattgatatcacccataaagtcatatttaaaaagctaataatattcactgttacttgcttggttggttagaaaaatgtctaagtcaaaggaacgacagtcaatattctaattacttacatcttttaagttatataccattttagcacagatgttagggaacatatgttgagatatgaaaaacacttgctactttattgtagacatcaagttaaaaaagaaaaaattcttgctactttgaatgataatgaaacaataaagttaggcaatgctatatttttatgtttcagataaacgtaaccatagtaaaagaaacaaagcaaacaaaaaatacaaatgttgcctcaccatcatctggaatgtccaattcaagtttcctgtcccactcgaagcaatgtgaagttaatttctcagtttctgactggaggatatttctaaaattatgacatacatttcagttctacaagtggtttttacactagtagctaagtattagcataacatcatgatacataacattaggaagttataaaagggagccacaatattttcccaaagttgatactgaattatttataaactgtgatatattaaaatccataaatacaagttgataccctttgtatgtacatccttttatacctaaaacttatgtggctggataataccaagaacctactttttaagctaacatttctagtttgttctgttctttttcagaggttgatcaaagtcagacattcctaaatgtgcatcagattctcagcattgtctatgaaactaaagccaactcaactgtcaagagtaaattaaagctaaaaactgttaatcccaggattatagtgatggggcctcacagatcctaattattaggctttgcttgcttaaaggtagtggttctcaactgggtcaattttgccccattctagggaacatttggtggtgtttggaaatatttttgattgtcatgactggaggagtgctactggccagggatgctacaaaacatcctacgatgtataggatatatacccacaacaagtatacaatctaaaatgtcaataatgctaagattgagaaacccaggcctaaaagaagtttaatttgtgtctatggaaaaagtatcctagcatgtagagaaactggaacccttgtatgctgttgatgggaatgtaaaacggcaaagccactgtagaaaacagtatggcagctcctcaaaaaattaaaaatagacttaccacacaacccagcaattctacttctgggtatacacccaagataatttagagcagggtctcaaagaggtatttgtacacccatgttcatagctgttcacaacagttaaaacatggaagcaacccaagtgtccactgacagacaaagggataagcaaaatgtggtatatacatacaatgaaatattattcggccttaaaaaggaaagtctgacacatgctacaatgaatgaaccttgaggacattatgctaagtgaaataagccagtaaaacaagacaaatactacataattctacttaaataagatacttagcagagtcaaaatcagagacagaaagtagaatggtatttaccaggggctaggagggaatggctgaggaatggggagttattttttagtaggtacagagtttcaggcacctaccaccacgcccagataatttttgtatttttagtagagatggggtttcaccaagttggccaggctactagtcctgaactcctgacctcaggtgatctgcaagcctcagcctcccaaagtgctgggattacaggtgggagccaccgaacccggcaggttttgtttctttaaaaaaaaaaaaaaaaatttagggccagactcagtggctcatgcctgtaattccagccagcactttgtgaggctgaggcaggcagatcacttgagcctaggagttccagaccagcctgggaaacatggcgaaaaccaatctctacttaaaaaaaaaaatacaaaaaaaaaaaaaagtatttaaaagataaatgaaaatcacctaacatcagtttccctccactgtattaaggttataaatattttagttttggttttaaatgtctagatattagtacaaaattctttatttttattttttttaaatacaaaattcttacgctagaaacagacatagtcccagctcctcaggaggctgaggtgggaggtcgggaagtcaaggctgcagtgagccaagagcgagacactgcactccagcctgggtgacagagtgagaccctgtctcaaaaaacagaaacaaaaacaaaaaatttgagttgttcatattcaatgacacaacatgacgattaataaggaggcagagggtcgggcacggtggctctcgcctgtaataccagcactttgggaggctgaggcaagcggatcacaaggtcaggagttcgagaccagcttgaccaacatggtgaaaccccgtctctactaaaaatataaacattagctgggtgtggtggcacacgcctgtaatcctggctactcaggaggctgaggcctgagaattgcttgaacctgggaggcagaggttgcaaagagccaagatcgcgccattgcactccggcctgggcaacagagcgagactccgtctcaaaaaaaaaaaaaaaaaaaaaaagaagagatagcagaaatggtttagttctgacattatctagttaggtagattgcttaatatttcaataactcagtggaatgacacaatggattagctacctctaaaatcccttataattctaaaacccagtgctctaaaaaagaaattaagctggacatagtggctcatgcctgtaatcctaacagtatgggaggctgaggcaaaaggatcgcttgagcctgtgagttcgagaccagcttgggcaatatcataagacccccgtctctacaaaaaaaaaaaaaaacaaaaaaaaaaacacacacacaccaaaattagccacccactggcaggaggatggcttgagctcaggacagagaggctgcggtgagctgagatcacatcactgtactccagcctgggcaacagagtgcaaccatttcaaaacaaaagaaaagaaagaaatgaagtcactctcaaaaagtatatttataatagaacaaatgaatagtaaaactataatgagatacttacttctcatctatttgatttgcaaacagaatagtgtgtattgtatgatattgtctctctctatagatatatgttgtctctctctctctctctatatatatatatacatgttgcaggaagtcagggaccccaaacggagggactggctgaagccatggcagaagaacgtggattatgaagatttcatggacatttattagttccccaaattaatacttttgtaatatcttatgcctgtctttactgcaatctctaaatataaattgtaaagatttcatggacacttatcacttccccagtcaatacccttgtgatttcctatgcctgtctttacttactttaatctcttaatcctgtcagctgaggaggatgtatgtcacctcaggaccctgtaataactgtattaactgcacaaattgtacagcatgtgtgtttgagcaatatgaaatgtgggcaccttgaaaaaacaggataacagcgattgttcagggaataagagagataaccttaaactctggccgccggtgagccgggcggaacagagccatatttctcttctttcaaaagcaaatgggagaaatatcactgaattctttttctcagcaaggaacatccctgagaaagagaatgcgcacctgggggtgggtctcttaactggccccctgggcgtggccgtctcttactgtcgaaactgcaggggtgaaatagaccccagtctcccatagcgctcccaggcttattaggaagaggaaattcccgcctaataaattttggtcagactggttgatctcaaaaccctgtctcctgataagatgttatcaatgacaatggtgcccgaaacttcatttagcaattttaatttcgccctggtcccgtgatctcaccctgcctccacttgccttgtgatattctattaccttgtaaagtacttgatgtctgtgacccacacctattcgcacactccctccccttttgaaaatccctaataaaaacttgctggtttttgcagcttgtggggcatcacggaacctaccgacatgtgatgtctcccccggatgcccagctttaaaatttctttttgtactctgtccctttacttctcaagctggccaatgcttaaggaaaacagaaaagaacctacgtgaatatcagggcagattccccgatatatatatgtatatagatatatatatattttgagatggagtctcactctgttgccaggctggagtgcagtggtgcaatcttggctaactgcaacctccgcctcccaggttcaagcaattctcctgccttagcctcatgagtagctgggactacaggcgtgcaccaccacgcccggataatttttacagttttagtagagatggggtttcaccatgttagacaggatggtctcgatttcttgaccttgtgatccacccacctcggcctcccaaagtgctgggattacaggcgtgagccaccgcgcccagcctattgtccatattttttaaaaaagaaaaaaatgtacatgttatatttgtctacatatgcatgaactatccatggaagtattcacaagaaatgagtaacacttgccttcatgaaaggttcaaactatgtggttgggtcacagtgctgagaagaagtcttctcacttgtaccttttcctaccctttgaattaggaaccacatgaatgtactagttatcaaaaaaataattaaaatttaaacgtgaaaatcacctaacaccagttttcccccactatattaaggttaaaaatttttagttttggttttaaatgtctagatattaatacaaaattcttacactagaaacacacagacatacctgaaatatggcacaccatggtggggctgagcaattcgaccttcatttctttcaagtgatgggacttcttttattggaaggccatttaaatttttagtagtagcttcatttttatttaaaacatgttctataaattaaagaaaatcttacatataaatttcaaagcaacaattcctaaaatgacagcccctaaaaagacattttaaaaatccttttcaatgtttaattttaaaattttatttctgcctcaatcacttcacatttcctctaaagtagctctcaatattttttctttaaatttacatttatttcccctcttctgtctgtattcttcattccaatattctcttcagatatctttacccatgctttcccgtcttttctgaccctgagttcacatccccaaatgatatggtgaaaaagagctccaaacaaatctgacaagtaataatccagaaaagtaaaaatgtaattactatacctgaaagcaaaatattttttgtattaacattattctaaaaaatgaataaattaattaaatactataccttcatgccaaacagttagaggacccaaaggacatggcaatttatttgaatcttgctgtattgtcttggtagagtaagttttacatttttgtgccaaaatttcttttgttgcttgagactcatcactaaaaacaatagcaaaaatatacttcatgaaacatgaactccatatatctaatataaagggtttcaaaattgtgtcacttgtagatctgggctaaaatagaaatgtttctatttttttaaaatgtgtattctggaggggagaaaatgtaaacacctatagtgtgaatgtccatttttactaattaattgtaatcagattcaaagattttgaagatttcttaatggaacataaacacttaacagtcttagatgctgctgagcagtttttagtatatttgctgccagccagtctttgcaaaatgatcttgccttttcttttaaaggttccaactgatttttcccttgttttgcaaattaatcatttttgtcttcagggccagtttttctaaatactaagccagaagaaaatgaggaaaaagtcgtatctgagctaaagcagtatagcaattttcttcttttgaaaaatgtatgtgttataattaagtcatttattaaaaacaaaaaacccaaattgtatagtgaaaataacaatgcataggaaatataaaaactgtcaattacattattgtaccttctgaagaattttttttaaagaaaaaaattgcatgattcctaattaacacagttcactaataataactttttaagagcatagaccaaatataagaaagacatttggccgggcgcggtggctcacgcctgtaatcccagcactttgggaggccgaggcgggcggatcacgaggtcaggagatcgagaccatcctggctaacatggtgaaaccccgtctctactaaagatacaaaaaattagccgggcgtggtgacgggcgcctgtagtcccagctacttgagaggctgaggcagaagaatggcgtgaacccgggtggcggagcttacagtgaggggagatcacgccactgcactccagcctgggcgacagagcgaactccgtctgaaaaaaaaaaaaaaaaaaaaaaaaaaaagaaaggcatttattacccatcttagcaagagacttattattaagatcatattcttacacttctgtttttaaaggagtccaggtgtaactgggtgtcaaaaaagcattggcacttctgggagtcataggtgttacttgataggtcttcagaccatccagtggctgaaacataaaatccttaggtgcaaaggaattcttcccttttatttttgcagtatttatctcaggtaagttttccatttttgataagactccatctggattcattccacttgttgcattagtttgtgaattcaaagtattttcttcactatcgactttacaagaaataccctaggatgtgagttaacaaagtagagtaagatttctctcttctgaggatatattcaaccaatttttataggtctgaaaatatgacaacagaaatatatgttctatgtacataatttgagagacaaaaacagatacaattaagtgtatacatggaatcagaagaccagttacgctaaatccattgctattacccgggaatagaatcttttttttttttttgatacggagtagccctccgtcgcccaggctggagtgcagtcgcgcgatctcggctccctgcaagctccgcctcccgggttcacgccattctcctgcctcagcctcccaagtagctgggactacagacgcccgccaccacgcccggctaattttttgtatttttagtggagacggggtttcgctgtgttagccaggatggtctcaatctcctgacctcgtcatccgcccgcctaggcctcccaaagtgctgggattacaggcgggagccaccgcacccaccccgaaccaattcttatttaaagactaactaataccttttgggtattacaacaaattaaaagataatggaaaattaatatggaaaaacttattcaacaaatacgtatctttttacttaaattatgttgataattacggccaggcacggtggctcatgcctgtaatcccagcactttgggaggctgaggcgggcggatcacaaggtcgggagatcgagaccatcctggctaacacagcaaaaccccgtctttgctaaaaatacaaaaaattattggggcgtggtggcaggcgcctatagtcccagctacttgggaggctgaggcaggagaatggtgagaaaccgggaggtggagcttgcagtgagccgagatcgtgtcactgcacttcagcctgggcgacagagcgagactctgtctcaaaaaaaaaattatgttgataattacaatggtttaaaatcagaaatctaacattatggaatgactatcattaaggaccaaattcttaagttaaataaccttagattataaataaccttaacacaagagcaatactttcaatgtgacacaaaagattaaccatataaaatacaaagcatatttactatttcaagtcaatttgttacttggtatttaaataatttctagaggtttccaggtttctgatttttaataagatatgaactcaaacccaggtatttcaacctggacaagagtttaagtggtaacactgttgaagccagcatggcagtcaaagcaaaaactagtgataatccttaagggttaatcttaaggggggacctataaggtccagctgctttatctgtgaagattcactgtgtgtttcctttcttgatctgtgtttgattttttactaagaatctagccaggttacttaatctttggtactttttttaaattaagaaattatactggccaggcgtggtggctcacgcctgtaatcccagcactttgggaggccgaagtaggtggatcacctgaggtcgggagttcaagaccagcctggccaacatggtgaaacctcgtctctactaaaaatacaaaaatcagatgggcgtggtggtgcacgtctgtaatcccaactactcgggaggctgaggcaggagaatcacttgaacccggggagcggaaggtgcagtgagccaagatcgcgccattgcactcgagcctgggcgacagagtgagactctgtctcaaaaaataaaataaaagaaaataaactatatcatagattataggccaaggggttgggtcctcaaatggggcatcttttttgaagaccttattagaaaccatgctagatgcaggcagaaattttagtttatttaattcttacaactactctatgcaggtattccatgttaggaataagaaaagaagctcataaactacataacttgcccagggttatgcaactaattggaagcagagagagtattcaaacccaggcctaaatgaatccaaagtcaatgcatttcaccccacttcaccctatgtcttggctaattcccacatacaggtttctctcagctgtgtttttattatttttctccatcttctaacaaaattatgctttctctacctataaagctctgaaaataagatacctgaaaaataacaagagtaaatcctcttgatgctttcttatggttcaggaagttttaacacacatgtaggttaaccttttgaagcagttctttatgtttaatttcaactttatgaaagtagcaatgagattttcaaagcatctagaattaaaaagatgtttattctctaccttgtcgggttttgtttctacatttttggcaggtcttcctttacttggcacctttccttctggttcgttttctaaaacaacaataaaatatttattttactagatagaaatgctacatgaaaatactaggtaacttgggaaaggaaaagaagcaacagtaggaatatatgtcttgaaggatttttttattaaaagccatattataaaaagggttatggaatttcctgccaaatacaaaccatctcttttcaaaaccagagtgttttacccttttcatctgaataccaaatacagattgagtatcccttatccaaaatgcttgggaccagagatattttagattccagattttggaatatttacattatacttacaggttcagcatacttgatacaaatatctaaaatctgaaatgctccaagagcatttcctttgaggatgacctttgaacttcatgtcaatgctcagaattttggatgttttgattagggttgctcagcctgtacatatttattacagacaattagaaaaataacagaaaactacaaagaacaataatgacaaatcacccaggattccattactcagctgtcacttcagggtatggttttccagtcctatgtccacatattcccataatgctttttagaactgcgatcctactgttcagagtttgacctgcttttctttgcccacttaatatatcatgaaccatgtcattaagtgttctttaataatattattcttaatggctacgttgtattgcaccaaataaatgaactgtgatttactcggaccattaatttttcactttgaaacactgcttatactaattaaggtcttcaatgattgggcacccattgtgtgctaaccagatgtcagggcacagaatctattttcaggtattagaatttcctgtttccttctctcctactcaaagaagtacttgttgatttttgaaacggaacacaaaaacctcaaggaccaaacattctagttcagtcactgatcaaggaatagttctcaccattagcagctcttgtgactggctttcttgctgtggtagatgagactgttctgggaacctgctttgctgcttgagtagctgatcgagtcattctcaacgacgtgggcattacaggctgcacaactgtgggaaaaaaaaataactacatcaaatgtcccttgtagttatgaaattattgctgtgaagccaggcatggtagtgcaatgcctgtagtcccagctacttgggaggcaggaggattacttcagcccaggagttcgaaaccagcctaggcaacatagtgagaccccgtctctacaaaaaatataaaaatcagctgggcatggtggcaagtctgtagttgcagctactcaggaggctgaggtgggaggatcacttgagcccaggaggtggaggctccagtgagctatgattgtgccactgcactccaacctgggcaacagagcaagactctgtcacaaacaaacgaacaaattccagttgaccttcaagacacttaaaaaaaattatggctgtggtagcctcagaggatttatagtaattgctaatattcctaccttttttctctttgtctgacactttcttttcagaagtttgtcttggaccaggtcggattgctcgaacatcactctcgttatcaatctatttaagagattaggtgctatgtgatttaattgcataatgaatcagaccatcatatttttaatctgtaaattgattcctcatatgaaatctgatcatcgtaaatgacccaacaacaacaacaaaaaactaccccaaataaaatgagataaagaaaagctttccattaagcttccaaaaaagcttacatcctttttcacaatcacagaatttggaaaatgctaataacccaagctattaaaaacagctcactataacttgccttctgaaggtccttaaacactcctagacatactttcacttcaagaccttttaattttgcctagaaaatacttctcctggataaaaagcgctttcccatggttctcttctccacttccataatgacttcactcaaaaggctttcatctcagggaggccttccttaactgcccaatcaaaattctaccccatacctatttctagtacaccccatctcccctttttaaaatctcttccataatacttatcatcttctggcatattatgtatttttttaaatgccttacatgtaagttccacaaagagaatttagtttattatatccaaaagcctacaacaccaggaacatcatagcaatgcaaaatatatatgcatacgtggaacttagcttcctcacctgataaagaggcatattatttcccttcttgcccacttcactttgttttagtaaccctcctgatatctctattacagtattttgaagacccgtaagtttataacacctaccctgtgtgctttcctccccatatgcatttcatgcaggtaacttggaatgcataataggagcccactaaacaaaacaagagtgtgacacaaagacagtttgccatggatctcatacggaatgttggagcaaatattttaagtgaaattgctctacatcaccatactaaaaacagtgactttggtacctgttaactctagtaaattaatcattatgtttgaatctgatactagatttaaaatgaatttacttactaaaaaagtgcaatttatcattttagtaacaattatctactatcaactataccttagtctgctccatttggtctttggcctttgaccttgtaatccgtacagaagatggaatagccttagaacagtcaaaagaagatgaacttaaaatatgaactggtaaaggtttacttccatatcttattacaaaataaagttcccattttaaagttaaattttatccttaatctcttatagcaaaaagatacttaaattcctttttctggttctagcttgatttaaattaagttagtaacttcaaaaattactcacatttctcagtgagaaagaaatttcaaaccgtattttccaggtattggaatcatcattaatatgagcttctatcctctcttagttctcctgcctctctgaccagtcctcagcctggtacctggcttctgcctacctaaaagtgctctctagagcccactttttcataattttatatatccttattggaatggtctcatttagtcctacagcttaaacactcatccatattcccaatattatatcctaaatcgacatcttagcaccaatttccatccttctttccaaatttttactaatatctaggtggcccacacaagtttaagatttttaaaaaggttattaacatgcacccacttaagcttgttccttatcttccttatctcttttagcagcagagcttctctctgctttttcaatttcctttacccctcaccatctacttggccaccagtcctgtcaaatgcctttatttagatgtcttacacctattttttccttttaaaacccactgcccctttccatctattctattacaatagtctcacaattggtctccctatctataaatgcttccctttccagactaaaatctttagggctatggtattttcctgaattattaatttgacaacggcactacccttatttataaacttctcctgattctgcaaaacctacaggataaacaccaaatcctttgcataacattgttcagcctgattctaccaattttcctagttttatcctatctcaacttacctacagctatcttaagagacctgattttcattcttctgagctactattatgtcattcccaccttctaccaaccagttaataatgagactaagggaaaggggttagtcacttaatgtcttgaagaaaataccaaataaaagaaactattcctttatattaagacactaaatttaccttttttggctcagctttcacagcattctggtttgataaaagaaaacaaggcatatcaggtctataacgacccactttaaatattcctcgtttagctttctctctctgctctttcaatttttgaagttgcttttcttctttgtatttttggagcatctgttttcgttgatcacctagaatagttttcattgcccctaggcagaaaaaaaaccaaaaccacacagtatataaaacatttcagatgaaaagttatgcaaatgtataaacaattatttttgtgtcatttcaactgctgctaaaaaatgctttcaggccaggcacggtggctcacgcctgtaatcccagcactttgggaggctgaggagggcggatcatctgaggtcaggagtttgagaccagcctggccaacgtggtgaaatcccatctctactaaaaattcaaaaattagctgggtgtggtggcggtcacctgtaatcccagctattcgggaggttgaggtaggagaattgcttgaacccaggagatggaggttgcagtgagccaagattgcgcccctgcactccagcctaagcaacagagcaagactccgtctcaagaaaaaaaaaaaggctttcaataagccaggcacagtaacacacctgtagtcccatctactgggaaggctgaggtggaaggatcatttgagcccaggagttcaagttcagcttgagtaacaaagcaagacctctccgcacaaagggaaatgcttttaatatttcttgttaattctttagcactctaaccacaagttatttcaacccctagtcttttaaaatttgtattcattttgccttcatgtgttcaaatattaactgcttgctatgtaataggcatttattacttcacttttaaattaattaacttgtatgatagccagcatccaagctgccctctactgatcctcacttcctggtagtcttgccctgtgtcatcccctcacactgaatagggctgacttgtgtgaccaagagagtattacaggaataatggaatatgacttctaaaactagggtagtgtttgccttgctctctcttgaagcgtcgcttgctctgggagaagccaggtgccatgtggggccttaagaagactcaagcagtcctatggagatgtccacatgacaaagaactacagcctccttccaaaagccagcatcaacttgctgttcatgtgagtcagtcatcttggaggcagatcctccagtctcagttaaggcttcagatatatctctggatgacatcttggctgctatcttcagaatcacccagctcagccatacccaagttcctgacccacaaaaattgtatgaaataatcaatatttattgttttaagctgctaagttttgggataactaatacaattataggtgctatttattataatagatgtactctatttcttctcacctactcaaggacattcttccagcaacttatcctcttactcatctattttttcctctactgaattgttgccattatgaagttacaagcatgcggtaatttctcccaacctacatcctcatctagcacttatttttctagtcccatttaaggcaaaattcttcaagagagttacctgtatctctactatcaacacttttatttatttatttatttgaggcagagtctcgcactgtcgccttggctggaatgcagcggcgtgatctcggctcaatgcatcctcggcctcccgggttcaagcgattctactgcctcagcctcccgagtagctgggattacaggcgcccaccaccatgcccagctaattttttgcatttttagtagagacggagtttcaccattttggccagggtggtctcgaactcctgacctcatgattcacccacctcggcctcccaaagtgctgggagtacaggtgtgagccaccacgcctggccttttttgagacagagtctcactctgtcgcccaggttggagtgcagtggcgcaatcttggctcactgcaacctccacctcctgagttcaagcaattctgcctcagcctccctagtagctaggattacaggcatgcgccactgcgcctggctaatttttgtattttgagtagagatggggtttcaccatgttggacaggctggtcttgaactcctgacctcaggtgatccacccaccttggcatcccaaagtgctggaattacaggtgtgagccaccaagcccagcctatttccaacactctttacattccctctcttttcaaaattatgaaaaacttctaatatacacacaattataatgaaccccatatacctattaccaagattcaataattatgaacattttgctgcagttgtttaaaacaaattatgcttagaagatttcatctctaaatactttagtatatacttctaaaaaataaagacatttctggaagggtgcgatagctcacgcctgtactcctagcactttgggagactgaggtgggcggttcatctgaggttgggagtttgagaccagcctgaccaacatggagaaaccctgtctctactaaaaatacaaaattagccaggcgtggtggtgcatgcctgtaatcccagctactcaggaaggctgaggcaggagaatcacttgaacccgggaggcagaggttgcggtgagccgagatcgtgccattgcactccagcctgggcaagaagagcaaaactccgtctcaaaaaataaaaataaaataaaataaagacatttcctttcatagccacgatatcatcatcacacttaacaaaatcagcagtaattccttgttatctattacagggtccagatttaaacgtctctatttgtttcaaagaggtcttttaaaccatctgtttacttaaatcaagaaccaagtaagagcaacacgttttatttgaatgtctttttaaatctcttcatctaaaacagatcctcctccccactcttcttttcatgccattgtcttactgacaaaaggtagtcagttttcctattgaatgtctttgcaagctgtatttgtttatttactcattcctccaggctccatgttttctacagactacaaattatatctaagggtttgattatactcatccattccaatctttcactccctgaacctcactccaccaaaactattcaagatcaccagtgacctccacagtggtgaagtccaaattctcacctctattatacttgatctaacaagcagtactgactaacatagttaatcagtctctcctcgatatgcacttttctactcggtttctaggatagcacgttcttctggttatcctcttacattactttgcattgttccttggttctttactagttttcccttgtcttttttttgagacggagtctcactttgttgcccaggctggagtgcagtggtgtgattggctcactgcaacctccacctcctgggttcaggtgattctcctgcctcagccgcccaagtagctgggactacaggcacgcgccacacccagctgatttttgtatttttagtagagatggggtttcaccatgttggccagaatggtcttgatctcttgacctcgtgatccactcaccttagcctggggtactgggattataggtatgagccaccgcatctggccccttgtcttttaatactttagtatcaactaagttattgcagtagtctacttactgctctccctgatgtcatacataccaccctataatctattctcaacacagcagccaaagtgatccttttttttttttttttttgagatggagtctcgctctgttgcccaggctggagtacaatagcgtgatctcagctaactgcaacgtccacctcctgggttcaagcgattctcctgcctcggcctcctgagtaggtgggattacaggtgtgtgtcaccacacccagctaatttttttatttttagtagagatggggtttcaccatgttggtcaggctggtttcgaactcttgacctcgccatccacccgccttggcctcccaaagtgctgggattacaggcatgagccactgtgcccgacctgatccttttcttttttttttttttaggagacaggatctccatgtgtggccgaggccagagtgcagtgacttttcacaggcaccattgtagcacactgaagcttcaaactcctgagctcaagatttcctgcctcagcctctggagtagctagggctacaggcctgactccaaagcgatccttttaaaacatgaatcagattacataaacacccattaatggcctctcatttcagagtaaaagccaatgtccttataatgatggtccttaggattctatgtaatctatctcccttgctcattcttttctacccagttacctacttgcattcactaaaacatatcaggcacactcctacctctaagcctttgcaaacgggaaataaaggatattttaatagcatactgagatagttagactttaatttgaaagatttttggttaagaaatggagcatttgagaggacaagatgagaaaggaaccaccctttctcagataaaaaatgtttggttctttctgccattccctatttatcctagcattatttcaatgccatctagctcctaacgcctgctatatgaacacaacaaataggagtagggtgactcctgactaaacacaagtcatttctcagtttgctttctcttttctgtagcatcctttgccttctaagatgctctattttcatctttttctgagattattcctttcttctttagttggttctttccatcctaatggtcccaatccttctgggcaaactgcaaggatgaattctttgctcttttcttactaatgtttccattgacaaagtactctcatttcatggattctttaattattctatttttacatttcttatcaatttatcttgtcaacacttatcctacccaagctccgtaagaactttaggatttctatgaagcaatatagataataaagtgttataatactccacaggtaaaggcttttgccttaaagacagtagttagttgtagataacaggttattaaggggccaggcgcggtggctcacacctgtaatccccacactttgggaggctgaggcaagataattccttgagcccaggaatttgaggttacagtgagcacaccactgcactcccgcctgggtgacacagtgagaccctgtctcttgtaatttaaaaaaaaaaaaaaaaaaaaaaggaaaaagaccaaaaaggaaagttatttatagaatggtatttcaaaactcttctggccagagttttttactcacacaggcattaaaccaactattattcactcttcaaagtacttaaaattacaacagacctttacttacttggcttaacattggtcttttctggaacaagcccttgagatgtctcatctaattcaacaagaattctaccttccaaggttggaatgtttacatctttcaaaccaaagtgtctatttcgttcgtattccttatgtctattttctttctgagacagtgatttcctatgagcaattttagttctaatcatttcagtacttatatccttcctgtgtcgactggcaaaatgtgatgaagacatcctgtcaaggaaaaggacaaaacccaacttacatgaattttcattatttaaaaaattaagattacagttcatttcctgtcccacttcagggccttctgaaataaaaatataaaatgtgcaatgaaataaatatgtaacactgaaaagtgagaagaagattatcagagaataagaagctacctatttgggggttttaaataggaacttgcttgaccagtgaagagaaagccagtaagtgatagtccagaataaaagaggctctgggcttaccacagagaacactgcaaaaagaaaagcgtgaaataaaggtgaaaataggttaagtgaaggaccatgtacacaagggtttccttacccatgatgaggaatgcaggtagtctaacatttcttctaaagccaaaagaaaaccaaaaacaaacaaaaaccccacaccaggtacctattagtcatatagggataatcaataggcaaccggatacagatagagttggatagagaggcacagggcaaagtatgtggaaaggaacaaggagcttccatgctctctcaggtagcaccactgtttaggaaccttcatgtattcacctaagaagctctccaaacacaggtgtttttttttggtttttatggcagcttcattacataagcatgagtgattaaatcattgaccactggtgatcaagtcaaccttcagctcctctcccctccccagaggttgtgaggtggggctgaaaatgccaactctcgagaaatcctgccttggtctgtctagtgaccagccccaatcctgaagctatttagaggcatccagctatcagtcaatcattagcatacaaaaaggtaccactttgaagactccaaggattttagtagttgtttgccagaaaacagaacaagaccaaatatatagttcacaataaccctatcagtttgctccattattttcatccatacaagaaatcatacagtttaggccggcacggtggcttaggcctgtaatcctaccactttgggaggtcgaggcaggactgcttgagcccaggagtttgagaccagcctgggcaacataacacgaccccgtctctataaattttaaaaaagaaaagccatacacacacacacacacacacacacacgcacaaaatcatatagtttaattggcacatgcctttttcttggaaagatctttgagaatgtattcaagcaaaacaaaagaggacaataaagacgacgtcagtagatccaactagggagaacaaagaaaattagaaagtttgagggggtcacctgtgtagctggtatagagaactaccaagccaaactggagaaaggatactgattctcagaagtcttggcagttaaaaaacaaaaacaaaaaaaggtaagggggaggctctgtgatagacacactatggtatattcttcaacaagaattaactaaatccactagaaaactccagataatagaaaaattggcacaagtaatgcaatacattgttacatgattctaagcaatcaacaaaatataaaaaacgagaatctgtctgacctgcatgctaataacattctcctctaagacccaaggaaagtgacaatggactgtgcttttcataaagaactgtcttctactatttatctcctgcaatattaattcgctaaagattgaagaaaaattaagacttatgtattaaatacaggatagcactatccacagcaagagaaagagcgagcgaggacaacattaaaggtacaattatcagaataaccctgaaaggtagttaactattatcgctctcatacagatgaggtcaattaactgctcacattagcatatctaaaaggtggtgaagctgggatcccaagcaaggcagccctggctccacacacacctaaattttgtttggctgagtggcgtttcctccagcttgaaagtccagaatgcgttaatcttgcttgactagaggttctcaaccgggcgtttttagttgccatgggacctgggaagagctacgggaatttaatgtcggagctagtgaagaacagtttcaccccaaaggtcaattacgccccggtggtgaaacgctgactattacagaggtcagggcaaacatatggactcttctaaaggctcgcattatcagcttcgggaagggcaggtaacacggtcctaaaggagcctgcctctgacttgctcccgctcgcagcccccggtcctcagacccttctagaccttcaacggaagcgggccagtgttctccgtccagctctccagcacccacctacctgagccaccttctagcgtgaaacctcaaccaaacaaaaagtaaagaacactcggtctggacgaccaccgccgactccgaagcaggaaccctcacaacccgagcctccacgaaattcaaacttgccgcaccgagccgctgattggaggggctttaaccaacacttccggggaagatcccaccccttccactcaacgaggcttgcgattggtttgctccgtgcgatatttgaattgattgaaaggtgaagggccagttcaaaagatgggtgagagagggaaaataggcgggaccgcgacgcgggatgagaaggagtggagcagtcggggcgctcacgtcaggtgaagggcgggagtgggcggtggagcccgaggggtgaggctgggtccctggcaaagctgggctgcgggaaatctcccccagagctcgcaaggctttttttttttttcttttttcttttttttgagacaaggtctctgtcccttaggctggagtatagtgggcaccgaccactgctcactgcagccttgagctgctgtgttcaaaccatcctcccacctcagcctcccgagtagctgggactataggcgcgcaccactacgcctggctaactttaaaaaaattccgtagagacagggcctcactacgttgaccaagctggattcagggctttttaatgtccttgtttagtcacagaatctagcagaccttcttggaatgttttctttactagacgttttaaagaaaaggcttaccccaattatcaaatccttacatagtttagcgttacttttcaacgtcgccagcccccctccccttttttttcttttttagttcattttttgttgaggcgaagttttcgtatacagtgaaaataatagtttttcccccccagtggacaatttgatgagtttggtaaatgtaaacagctgtgtaactaccacccaatcaggacgtagagcatttccatcactcagaagagtggcctgtttctttcctgtccatctcccaccacatcagcaaccactcctcttatttctagcactataaaaatgaaggtgataggtactcttttgggtctgcgtgaaccagaagttagtagtgtttgttattgagaggcattccattgaatactttatgcattcaccagttgatggatttgtattgctttcaatttttggtgatgatgagcaaagttgctataaccattctcgtacaagtccttgtgggcatattttatttatcttgaggaaatacaggagtggaatttctgggtcattctgggtatgtttaacttaaaatttttttttttttttagaagcagggtctctccgtcccccaggctagagagcagtggcacaatcatagctcattgcagccttggcctcttgaatagctgggactataggcgggtgccgtcacccatgtctaactttgtaaggaattgccaagcagttttccaaagtggttgtaccattttacaattcccaccagccacatataagagttccacttgtttcacatgctttccagcacgtggggttgtcagtctctaatgttcacccttctggccaggcactgtggcttgcgcttgtaatcccagcactttgggaggtcaaggcggggggatcacgaggtcaagagatcaagatcaccctggccaatatggtgaaatgccgtctctgctaaaaatacaaaaattagccgggtgtggtggtgcgcgcctgtagtcccagctactcaggaggctgaggcaggagaatcgcttgaatccaggaggtggaggttgcagtgagctgagatcgcaccactccactctggcctgggtgacagagtgagactccatctcaaaaaaaaaaaaaaaaaaaaagagactgagaatggtggctcatacctgtaatttcagcactttgggaggccaagatgggagaatcagttgaggccaggagttcaagtccagcactggcaacatagcaagaccccatctctaccaaataataataataataataatacaatattagctgggcatggtggcgcacatctctagtcccactacttgggaggctgaagtgggaacatcactggagcccaggagtttgaggttacagtgagctatgatcgcaccactgtaccctagcctggacaaaaaagtaggaacctgtctcaaaaaaaaaaaaagaaaagaaaactattctgctattaagaaactctgatgcattcttcagcatgtcaattatattttttgaccctagaatttctgcttcttttaaattatttcagcttctttgttaaatttatctgatagaattctgaattccttctctgtgttatgttgattttctttgagattcctcaaaacagctgctttgaattctctgcctgaaagttcctatatctatgtttctccaggattggtccctggttccttatttagttcatttcatgagatcatgtttcctggatggtgttaatgcttgtagatgttcattggtgtgtgggcattgaaaaattaagtatttattgtagtcttcacaatctgggcttgtttttggctgtccttcttgggaaggctttcagggtgtttgaagggacttgtgccccaagcctaataatgctgtggttttttcagacttgtagaggtaccaccttgatagtcttggcaaagatctggaagaattctctgaattacaggcagagactcttgttcttttcactcacttgctccgaaataaatggaatgtctctctctgctgagccagctggaactgagggtggtggctcactgtggccaccaccactgggactgtgctggatcagaccttaagccagcacctatcatggcagtgagttcccctaggccccggctgttcccagagctgggctgtctgggagccagggattggagtcagaaatcttagcaatttacctgaagttctttttattattattattattatttttttaaggtggagtctctgccgcccaggctggagtacaatggcgcaatctcagctcactacaacctctgcctcccagattcaagtgattctccagcctcagtctcctgagtagctgggattacaggcgtccgccaccacacccggctaatttttgtatttttattagagacagggtttcactatgttggccaggctggtcttgaactcctgacctggtgatccacccacctcggcctcccatagtgctgggattacaggtgtgagccactgcgcctggcctacctgatgttctattctactgtagctaacctggcattcaaaccataatacaagccctttcaactcttcccttccctttccacaggcagaggagcctctcctatagccaccaccaccacctgttcatgggggtttctgccaggccacggctgatgatcacataaagctcaagcattcttctgtcagcttgcggtgaatgctgccaggcctagaactcacccttcagggcagtgggctcccctctggcccagggcagatccagaaatgctgtcaagagcctaagcctggactcgaggactcccccaagaaccctcttggtgctctacccctctgtggctgaactggtacctaaggtgcaagacaaagcctcctttatgtttccctctgcttttctcaaatagaaggagtcttccattgtagccaccacagctgggaatgtgctgggtcacccctgaagccagcatatctcagagcccaaggcccacagcatactcgctggtattgctgctattcagggcccaaggactgatgaatcctgccaggactgagtccttcctttcaaggcagtaggttcccttttggcccaaggtgtgtctagaaatgttgtctaggagctagggcctgggatgggagcctcatcaccctgctcaatgtcctatcgtactgtggctgagctggtatcccagatacaagacaaagtcctctttactctttgctctcctctacttaagcagaaggaaagagtcactttgttgcagagagctgcactgcctggggtttggggaggtatggcacaaggtgtgccagctggtgtcactctaggtcacttaccatgctagttcactggctgtaaggcaagcctagcattaggaattgcctaggacttgcagtccttgtgttcagactgcctttcaggtttacctaggaccccagagcacttcagcctgctgtggtgtgccttgctgagaagctcaagttccaattgctaggctattgccctctggctagggatggtccaaatcctccctccatgcgtgggtgctggctgaacccagcacagctttaactctgctgtgacaaggcagcactgaatataatgtgaagtccatcagtcactgcgctctccctccccaaagtgcacagattctctctccataccacatggccactggtggaggatgcgggaggggtggtgtcagcaattcaagactatttctcttgccttcctcaatgcctcttttggaaatttgaagtcaaaaccaggtaccatgattgttcacctgatttttggttctgtgtgcagatagtcattaaaatttgatgttccagtaagagatgaatggtgtgggcttctatttcgccatcttgcttcctttcccctcattacttatttatttaatcatttgcctatatcaggatggattcttagaatatttattttatactttgggttatactcccatactactttattttattgctcaaattgttccagctatagccattggcagctctttcagtttgttcctctatcactttgacatattcccatcattgtatagtttttttttgtttctgtttatttgttttagcacttccttactctttgataccacaagatgctcataactcatcttatatgttttcctgccacagtactaaaatcagcatttttccaagtagcattaatttgtatttatttacttacttgtgttttttaaatcagagaacctgtgaaacttagataagtggttaaatcatttaaatcattctgtggagcttaattcaacatggcattgagccctactacgtaccaagtgctgtatttaagcacaattgaagaagatacagttcctgccctcaaatagttctaatggtgaagttgaaagcaatttttttgtttcaagtccagaggagccatgataaccccattcactgttaatcaactctgttacctgagcagtcgcttgatcagccaactagcaactgcttattgaatgcctaatattaatgacaaacataaaattagtgacattttaatgaacactgataacctctgaacgatgtacaattttcagtctttcaaatcttagtcttttatattgtatactaaacattttaaaaatgagtacagtttcactaggatgccagcaaattgtatcctccataaaaatcaccaaataattattcccagaaaaggattctgctgctatctggaacaatggcagtattcatgagtcatttatttatttatttattgtttgagtcttgctctgctgcccaggctggagtgtagtggcgtgatctcggctcactgcaacctctgcctcctgggttcaagtgattctcctgcctcagcctccagagtagctgggactacaggtgcacaccaccaagcctggcaagtaacttgccttaaagcaacctactcaagatcacacaaggaaagtggacaaataaaaaatatttaattaattatttgatccagagagtataattttgtcatttatattttcttcttatggttacgtgttttcctagtttttccatatgcacctaatatgttttgcaattataaaattgtttaacaataaaacatccaagttttatgatcagtaatattgctcaataaaataggagtaaatggagtgctgtatgccagcgtattttgtttcttttgttttgttttgttttgttttgttttgtttgagacggaatcttgctgtgtcgcccaggctggagtgcagtggcgcgatcttggctcactgcaagctccgcctcctgggttcacgccattctcctgcctcagcctccagagtagctgggactgcaggtgcctgccaccacacctggctaattttttgtatttttagtagagacggggtttcaccatgttagccaggatggtcttgatctcctgacctcgtaatccacccgcctcagcctcccaaagtgccgggattacaggtgtgagccaccatgcacatgccagcatatttcaatatgagcctacggttctttactgttgaacatgcaaagagcctttgtattgactatttgatgacattttcttgcagctttgaatagggaaatgaactgacttaggaggcacattgataaagttagaatgttcctttttgagtgtgaaaatccttgggcttgcattttttttctcttcatgggaatacatgctatataaaaaaagtaactttacacaaaagttctacagaatgaatctaatatacacatattaatccaatcataatctaacaaaacagtgcattgcagagtcagcagtcctgctatagtagctggttttaaactccaactctcactttaaacagtggccctagctacatcttggtgtcttgactacttggctcctaatttgaatccacatctctctgaggagagataactcttcattgtttatttatgctctttctagaacaacaagctcccttttaaaatgattatatcactttgcttctctttgatttttttattcttaaaaaaaatttttttttgagtcagagtcttgctctgttgcccatgttgggagtgcagtggtgcaatcctggctcactgaaacttctgtctcctaggctcaagcaatcctcccacctcagcctcccaagtagctgggactataggcatgcgctaccatgctcggctgatttttttaaaacttttttgtagagatgaggtcccactacattgcctaggctggtctcaaactcttgggctcaagaaatcctcctgccttggcctcccaaagtgctgggattacaggtgtgagccactgtgcctggccagatttcttttattctatagattaaaaattctctcacaatactgaagcaagtatcagtgtataccttggaaaacatactgatttaaattatttacccattgattcataattagttaatggcagaactgaatcatgaatatgggtacacttttccctttgttagatcatcattgggcacaagcatgttttgtctctggaactgggcacacggaaccctattttaaagtatcgatgcaggcaggagcattgtctgtagtctgccaaagttctttactgttaacttgaggaaccttgtaatttttgtatcaggaaacttgtaatgtatcttacttgtcatggcatctggtttcagggaagagctctgaaaaactataattcctttgtgccattatgtatgtacttggaagtcgtagaagattatatgcttgtttcgcaatgatgatacaatcccttgacaggggagtggacagggctggacagcagccctgagcttcaagctgaaaagaaaaaatgaaatataataaaattgagagttcatgtaatgtggcagagaatttatggctacaaaaaaggtaaggtaggagaaagagaactaaagatagtatggacctgcaaagtctggtttttagacatcaagggcagttgatgagaaaacttgttctctcaaatcacagacctgagccatccaacatggttgccaccagccacatagctattgagcacctgaattgtgcctagagtgactgaggaactgaattttacattttactttcagtacagttgaccttgaaccacacgaagatgaggtgtgtttcaggcagtagaaaattcgagtataactagtgacttccctaaaacttaactactaatagcctactgttgaccagaagccttactgataaacagtgaattgacacatatttcctatgttttatttgtttacttatttatttattttaaagacagagtctcgctccatagcccaggctgcaatgcagtgatgtgatcatagcttgctgcagccttaatctcctgggctcaaccgatcatgctgccttagcctcccctgttacaggtattatttgctatattcttgcagttaagtaagctagagaaagaaaatgttattaagaaaatatgtttactattcattaagtgaaagtgggtcatcgtaaagatcttcatccttttcatcttcacattgagtaggctgaagaggagggattggtcttgctgtccagaggtgccaaagcagaagacaatccatgtataaggggatggggcagttcaaacccatgttatttgagggtcagctgtcatttaaatttaaatataaaactggtatgtgttttaaattcagttattggaaaactcttgaatatgttggaacaactggagtatgtaaatctacctttccaactgtaaattcactttttcaactgcaaattttctaaatacaaagcaagtatttccaatgaaaatctaaagcccaaattgatatctgctatactggatttattttttttttctttttctttttttctttttttagagacaaggtcatactatgttgcgcaggctggtctcgaactcctagccttgatcctcctgcttcagcttcccaaagtgctgggattacaagcatgagccactgtgcccagctgtatactggatatctgagacttggtaccaaaaaaaaaaataattaagaaagtaagttaatattttcatattgatttcatgttgaatattgggaatatattgagttaaaatgtattactaaaattaatttcacctgtttctatttactttttaatgtgtctattagaaacatttaaattacgtggatggttcacattacatttccattggaaaacatcataatttatgagaaactttgctgtttgaaattttatcaatgagaatgaaatatctcactcctacttgaaagatctgagccatatgggtcactttgacataggagagttgcctcaatttccaacccagagcttcagataaaaggtttttaaactgtaatttccaaggaaacaggcaatcaggctagcatgttcctaacagaacctaaaaaaaaaaatgtttctaatgagaggaggccaaggccatgtaaagaatgtttcttcttgggctatacagcccctctccttttgagtgattactgctcttttaccagtgacatccccagttctgctttgttcctgtcagctccagaacaaagattattgagaactctcaattgctaaactgcccctgcttcatgacagcaccattccagagctgacccctacttctccccgtccctcgtcagaatcattcggcacaagcccaaaccccatgataagcctctcccaagtctctcttgcccagaaaccccaggacagcaaataaacaaaccaaacattaactacaagtgtgttcctggtggtcttcatctgatgggttctatctgtaaacatactgaaatggagtaaaattggtacttgtcttaaaatcttgaagttggagccaaaagtataactgagtacccccatttgctaagagatacaaaatgagttattttttaattatttttttctgtttccttcttttcccctgtgctccacttcctacatagctctttatacatgtaattataattttttacctcccctgcaccagatgctccctacagggcaaggtcatctaactacgtccttagaagcttcagagcagaactcccaccaggagattccctcaagagacaacagtcaatctacaatccaaagtatgcctactatgaaactctctcccacctggagagtttcagccattttacaacctagttctgcccacaaaaggcaccagctccactgcccacagcagtggaggcaccaaatcaagctatgcagattcccatctgcattttcctctctgcatgccattcatgccaagtccccctttaaaagtgcctgcttccggccgggggcagtggctcacgcctgtaatcacagcactttgggaggccaaagcaggcagatcacctgacgtcaggagtttgagaccagcctgactaatatggtgaaaccccatctctactaaaaatacaataattagctgggcgtggtagtgggcacctatagtcccagctactcgggaggcggagacaggagaactgcttgaacccgggcagcggagggtgccgtgagccgagatcgtgccattgcactccagcctgggtgacaaaagcgagactccatctcaaaaaaaaaaaaaaaagtgcggctttctgctccaaaagcaaagcggtacccttaaaagcaagagcctgtacttcttccactaagctagctttggaacaaaggtcactttctttataacaggcctcactcttaattggactcagcaagtggtgagtgactgagtctgtcttttggttacaaaaggagcaaaaggaatcattcattcattcattcaagaaatactgataacataaaggttgagagtggagttttagtttgtccaccctgagctatagtcgtggagctgctcaaatcttgttctcaaacttcatctgtaaggtggagatcatatcaacatctactttatcagattgttgtgaaaattagtgtggagagggtgtgggcttgggccccacagactggttcaaataccaatcttgccacgttttaatctatgtggccttgggcaggtgacttaatctttcctgagctttggtttcctcatctggaaaataaagattttcaacaacaacaataacaacaatgtccttgaattattaccagtagaaactctacgttgttttgtgagttaacaggagagtagaaagagaaaaaaaaagaagaaagaaagaaagaaaaagaaaagaaactatatgcattttaattaaaatgttgaaaaataaagagcaagaagttttgctgtcaacaattagtaagaatggccgggcacagtggtgcatccctgtaatcctagcactttgggaggccaaggcaggaggatcacttgagctcaggggttcaagaccagcccaggcaacatggcaaaatgccatctctctacacacacacacacacacacacacacacacaaacaaacacacacacacaattagtatgaatgaaaaattttaatgtaattgatcacaactataaactggtggagtctatgaagaaaacaaaacatgtttcccatcaggtgtggtggctcatgcctataatcccggcactttgggagctcaaggcagcagactgcttgagtcaggagttcaagaccagtctgggcaacatggcaaaacctcgtctctaccaaaaaaagtgcaaaaaacttagtcaggcatgtcggtgtgcatctatagtcccagccactcaggaggctgaagtgggaggatggcttgagcccaggaggttgagggtggagagagccatgattgcaccactgcactccagcctgggtgataaagcgagatcctgtctcaaaaaaaaaaaaaaaaaaagatgtttcctaatcagtaccacttgcttaaaacatggataagatttcacttaattcacaacattgtgagccattgctttgaatcagcctttttccccactacatgttccttttgagattttaacaaagtagaactcatccaaagttttctttattcatccatttattgctgctttcttccaccaatcatcaaaggctgttaataattcttcccttaggaaccatctgagaaagcatagcagaaatgcaataaatatgctgattgatatttttattatgtagatgttttacatagtgacaaatatttttatgatgctgtaaactcacataatatgattaaaaacacttcttaattgaaaatctctaaaatttaagctcacacctcctaaaacacctctgaaaatatgtaagcacaaagttgttaaatgacaattatttaaaagttatgtgcacgtgctgacaaagcctggaacttaccgtgtgatgtgacacaactgtatgaacctttcttgtattttaatttctactttgtgttctaataatggtttttgtacaataaataatagcttaaaaatgactgcaaatagctgaatctaattataagtcctcaatgaacgaattaaatgttacattttccagttattaaaaaaatattttgttaacatcattttctttaacatctgtccaatttgttgttttaaacatattatatattacaaatcaatctctttttgttagctattttacattttcctattataaataatcctctaattaacatactttaaaatgttgatttttgttgaggctgcttttttatatcactaaagtatttcctcatttttaaagtctttataatgagggaggggagtactgtaattttttaaaaaactatttttaggctgggcatggtgggttacacctataatcccgcagtttgggaggccaaggcgggaggattgcttgagcctcggagttcgaggccagcctggcaacatggcaaaatcctctctctacaaaaaatacaaaacttagccagacatggtggcatgcacctgtagtcccagctactcaggaggctgaggtgggaggatcacttgagtcagaaagttgaggctgcagtgagctgtgatcaagccactgcattccagcctaggtgatgggagtgagaccctgtctcaaaaaacaaacaaacaaaaaataacaacaaaaaaccaaacaatttttaaaaacggaaagaagtaaaaacacctggcaaacaatgcaaaatgtatacgttagaaagtgaatccccacttccctcctcaccactaccatctccacctaactgtgatccctttcagggtgtccaagtttctgatcatttttcaagagagaaccccagatggggaattactgagtaataaggaatcagataatttagaaattataaaaacattaaagaaaatcattgacaacaaaatagaaaaattcaagctatatataaatttatataaaataagaaaaatggccagacgtggtggctcatgcctgtaatcccagcatttgagaggctgaggtgggaggatcacttgaggtcaggagtttgagaccatcctggccaacatggtgaaaacccgtctctacaaaaaacacaaaaattaggtgtgttggcacacgcctgtaatctcagctactccagaggctgaggcaggagaatcacttgaacccaggaggcagagattgcagtgagctgagatcatgccactgcactccagcctgggcaacagagtgagactctctgtctcaaaaaaaaaaaaagagggaaacatttgcacaaaagaaagataaaaaagaacaccaacggagtggggaaatgagagagcacagttaatattacagatggaagtttggtatctaatatagataactgaagatacatttctctggaacataactagtattcaatggataagtaaatattttacaagggagaagaatgagagctagggatgaaatttatcctgccataagtctgctaggcctatgtgattaatgattatagtatcttatacattcttttattcaagatttatgatttacgcaaatttgctacataaagtttagattacatgtaatatacattaatagagattacatataggaactgtgatttattttagcaaaatgttggaatatattattgttattattttcaagacagggtctcactctcttatctgggctgagtgcagtggtgcaatcatagctcactgcagcctcaaacctctgggctcaagtgatcctcccacctcagccctcctgagtagcggagaccatgggcaagtgccaccactcctggctaattaaaaaaaaaaattctatagagatggggtctcactatgttgcccagactggtctcaaactcctgggctcaagtgatcttcccaccttgacatccaaaaatgctgggattataggtatgaaccactgtgcccagcctggaatatattcctaaaaatagttttactagatcaaatgacatgattatttttgtgattctgataatgaaaggtttgaataatttcattttctgaaaaaaatcgtgctcgttactattgcttcatcaggccaggtacagtggctcatacttgtaatcacagaaccttgggaggctgaggcaggaggatcacttgagcccaggagttcaagaccagtctgggcaatgtagtgagaccccatctctatgaaaattaaaatttagccagttttgctggagggagaatcacttgagcccaggagattgaggctgcagtgatccagcatgaatgacagagtgaggccctgtctcaaaaaaaaaaaaaaaaaaaagagtgacaaaataatatatatgttgctttgtcactagttattttttgttactgtttccttctagttattttccaagtgtttcttcttgggtaaattacttgttcatctgtataaagttaaggatttatttaaaatgtgaacattttagcagatgcttacattatggaaaggaatttaatagtaaattttaaaattgtaaaattaagacaaatcagacctttaaagagttacagtcagttttattcagaagtctcactgaggattataacccgggagagtttcctagagaatgtctgtcatactactccaatgcagcacttcagttcagtttttatacaagcagtaaaaatacagtgtaaaaaaaattgcagtaaagcttgaatgcaagagtacctttggttccagtttgcaggggcataatcttgcaacaccttggcaggctttgtcttatgtgtcagaaaaggcaaggaccaaggtcatttatcttttaaggagtgtagtatctcaggcaagagactggggagctatgtgctgtatcccatttatcatctttaaggcattctttggagagctgcatttttaacagagtcagggtgactgcaaaattatgctggcaagcaaacatggcttcttatgtttgctactctgtttcacgaaagccaagatctactgcccgtgggcatattttaacatgaaatgtttattaactatatcttataaatatttatgaggtagtgtgttgaaaaggaggtagtgttatttatttttaattaaactaactgttgttagaaaagtattacatttgcataatatcaagataaggataaaaaacttgaagtgaaaaataaaatctccctcctctgctcaactatctcctccccaatccttaattcacttcccagaaatcacccctgctaagtttctgcttttagtttaaccatacttacctacttcaagatttatcaagtttacgcaaaatctattgattttctactatgaaagattaagaatttatcatgacctacctacccctccacctctgggcttatttgtagtttatatttttcttcttcttcttcttctttttttttttcagagacagggtcttgcttcgtcacccaggctgaagtgcagtggcacaaccatggctcactgcagcttcaaactcctgggctcaagtgatccttccaactcaacctcctaagtagctgggactacaggtgcgtaccaccacacccagctaatttttaattttttcgtagagacagagtcttactatgttgcctgggctggtctcaaactcctggccccagcaatcctgcctcagcctcccaaagtgctgggattacagatgtgagccattgtatgtggctttattcactttaaacaatgtatttaaatgtttaaatgttgctttattcactttaaacaatgtatttaaatgtttaaatgttgctttattcactttaaacaatgtgttaaaatgtttaattctttatttatcaaatttaatatggattgaataaccacaatgaaagataaaaatactttctttctacttctcttccatctgcttctcaatttttttagttatattaatatgtgtctgaataatatttatgatatttgtatttctccctttccacttctccattcaagcaagtaacagcctctgaattttatcatatcaggtaggtatgggacagggaggaaagtggaattagtctgtgcaatttttcctggattttgttttctgtaaaactaaattcactgagaagtgcaggattgaagggaagcagcgtggtgactgggagatacaggaggtggggagaggcttctcccctagagattccatgagggtgggtggtggtgaaaaggtatacaggattcaaacattgctccatggtggagctccaaggaggaggctcagaagggttagatgtgttagatatctggggaaggaaggaccctagtacagggttcccaagcttagctaagactctcatgcctcacatagggccacaaaagtcccaaaagagcaaagatttgcagcatgggaaacaatcattcgttgaggctctgttacctgggtacagagatcactcatgatgggagggtctcccttttctctgatgcttttgtaactgtgtgccattgaccagaccaagggagggcagagtaaccccaggaatgtctgtgattacatttcccatcaagcaggacctatgagggaggtatggggagaaagaggacatttcctagatgcagaaattaagttgaagtataaaaaataaggtggtatttcttgcacacttgaatttgttgagattttacatgcgattctttaatataattattaaatatcctgagctttgggtattgttatacctgaaattgaaaatcagtagatagcacttatgataatatgattgcataagtattattcactataaacaaatatcgtgattggactaagctagaaggaaacttaatcttatgacattaaaactttgctgctgaaatctttccttcgtttctggttctacttagctgccagcataatcgcataacctgataccttagattccttcttttgcactgaagaacttcctcaagtcatgctttttcatatcgggagcttaaatggtatctttttttacttccgaaatgtctttgtcttgtcctcatgcttagttaataataatgctgagttccaaaaattttttccttagacctttgaagatattactcttttttttcctatattctcacctactttttgtccactgctgtaacattgattaaggggggttaattgaagtctacctctagggtatttctagttctccttgtaactcctacagtttttgctctgagtgttgatgctgttatttggtgtatagattttttttttttttttgagacggagtcttgctctgtcgctcaggctagagtgcagtggcgcgatctcagctcactgcaagctccgcctcccgggttgacgccattctcctgcctcagcctcccgagtagctgggactacaggcacccaccaccacgcccgcctaattttttgtatttttagtagagaaggagtttcaccgtgttagccaggatggtctcgatctcctgacgttgtgatccgcccgcctcagcctcccaaagtgttgggattacaggcgtgagccaccgcgcctggccggtgtatagatgttataacttcattgtgactatctagtttaatgcttttttcttttttcctttctttttttttttttttttttttttttttttttttttttttgagatggagtctccctctgttgcccaggctggagtgcagtggcgcaatctcagctcactgcaacctctgcctccggattcaaacgattcttgcgcctcagcctcctgagtagctgggactacaggcccgcaccaccatgcctggctaatttcttgtatttttagtagagacagggtttcaccatgttggccaggctggtcttgaattcctgacctcaagtgatccgcctgccttggcctcccaaagtgctgggattacggatgtgagccactgtgcctggcctctagtttaattctttctttctttttttttttggcccagattctgcaattattctaagtctggctttcatttttctctcaggccccaattctcttatagcccacttctccctttgaatttgctgatgctgaacctggagcttatctgaggctttcttggaaagaacctggcttgtctttggtgttctgagatgcaattttttctcttttgatttttctggaaattcaaacctatctgtgtttttctttccacatagttatcaacatttctgatatattgatgatactctaattgttttccactgttatgtgtctgtgcttttaaaaaaaattgtcttggttatttaatgtgacttttaacgcttaaaaaagtggagatgtatacatttgttaacaatgccatgaaagcattttctttctcctgaggaaaagtgaatttcttaccagaatatctggctgatcctgtaatttaaattaaaataaaattttggagaaacagcaaaacaaatcaacaaacaaaaaactgtcttgacgtttccgtgggaggtatagaattaatcatgtgtgtacagtctactgcagcttgacctagaacctttcctatgagagattcttaataataagctctgcatctataggaataaaacttaatttagtggcccatccatttatttcttccctctctgggtcttcaacatgcattatatgtgcacactaaatcatttattcctttttataattttccttagtattcattaagctggcggggcacggtggcgcacatctgtaatctcagcactttgggaggccaaagagggtggatcatgaggtcaggagattgagaccatcctggctaacacggtgaaacactgtctctactaaaaaaaaaaaaatacaaaaaattggccaggagtggtggcatgcacctgtagtcccagctacttgggaggctgaggcagaagaatcgcttaaactggggaggtggacattgcagtgagctgacatcgcaccattgtactccagcctgggcaaaagagcgaaactccatctcaaagaaaaaaaaatttatttatatgtatatatatatataatgaatatatatatatatataatgaatatatatatataatgaatatatatataatgaatatatataatgaatatatatataatgaatatatataatgaatatatatataatgaatatatataatgaatatatatataatgaatatatataatgaatatatatataatgaatatatatataatgaatatatatataatgaatatatataatgaatatatataatatatatatagtgaatatatatataatgaatatatatataatgaatatatatatatataatgaatatatatatatatatatatatatatatatattcattaagctatcaatgcttgggttctcttttttccctatcctgaaaatgtaaaatactggaaagacgtatttgaataatgtatccccaatgagcattaaaaaatttcagcatacagccaggcgcggtggctcatgcctgtaatcccagcactttgggaggccgaggtgggtggatcacgagatcaggagatcgagaccatcctgactaacatggtgaaaccacatctgtactaaaaatacaaaaaattaggtgggcgtggtggcgggcgcctgtagtcccagctactcgggaggctgaggcaggagaatggtgtgaacccaggaggcagagcttgcagtgagctgagatcgcgccactgtactccagcctgggctacacagcaagactccgtctcaaaaaaaaaaaaaaaaaaatccagtgtacaatttaagatatattgttattgttatgtagctgttatagattgccataattctaaagggaattacagtaatttatagtcagaatacagtttataatgaaaatataccagtaagttcaaagatttgaataaactagttgcatgtaattttattctttctttctttctttctttctttctttctttctttctttctttctttctttctttctttctctttcctcctttcttcctttctttctcccttttatttttttcggggttttgccatgttgcccaggctgatcttgaactcctgagctcgggcaatccacctaccttggcctcccagagtgatggggctacaggcatgagcgagcccatcaggcctattctcatgctttctatacattaccagcctcaagacattttacagctagtggctaataatacttgaaatatctgccaacctaaaatgcaaggaaaattaacataggctgttgtatagtagaccatgacatataaatggagatgcaaacccagtgctgaagctgtgtctaaaacagaataataagatactcctggatttctgaagctatttaactaccccattctcttcacaaagcagaaaggaaaataacactgacagatggtacccagtgctacaaaagacaacaatactgtctattctaaacagatacaaagtagtgatttcacgttttaaaaaagacaccaagaacagttttcaccattgcttttgaccaactccttcttatctgcccttcagataaggaccccttttatctgcccttcagagtgatacccaaattccagctcatggaaagccggtagtaatctggactccatcttcctctgaagctttatttcctagtagttactctcctgttggccatgttctaaccacattgagcttctttctgtctgcttatggacaagtcaagtttccattccccatacctttctcatgatgttcattctacttgaagagtcattcctccctcttgttgccttacacacacttactctttttcaagactgaatccgaataatatctttttggggaaagtcttacacaaagaatcaacattgacctttccaatgtttaagaaatatgttgtgcctttattaccattggattgtgccatatttcagagattaaagttggcctgctgggcttgaacaccatgacttttacaaaaatcctgtgtttaaataaaattcatattgatgtaggattttttactccttagctcagctagatccgagttattgtctcatgaccaggaaaaattaggcacgggaacatcaaagagtgagtggaatagaatttattaagcgaaaaggaatgatctcagcaaaaagagcggtcctgaaagcaggttgctggttgtcttccttcatagttgaacacaagggcttctatatccgctgatggggctgggttccctatttgcatagggcatcaattcttggttggctccaccccatctttccagtgcgcgtgcgggtccttagtctgagccactccacattgatttatttccttactgcgcatgtgttaagggacggaatttttcattgcgggcatgtttgggcaagccttctgtgcacaatgagcttggcgggtcgggggttctccagggaccctcccctatctgcctaggagagttctctgcctcctgcctctatcagtattctcatgtcaatgccaggctgcaatcatttttttctttatatgctaaatatacaagtagaaaattatagaatcaatttaactgtaaacatgtaatgtcattatgtacatgatcttaaattatccttttggaagataagtctttttcttttttagtagaaatattaggtcctctgttttcattgttaaccacatcagaatctgtattattactttttattttggaaatcaattgcagtacagcaggcttaccatatggtggcacccaaaagcccagaaaccaacatcatgcggcccagtattagacatgtgttcaaaaatgtaggcagtcagctttctagtaggtagcaacaggaaataaagcgtcgtaagacagtcatcttaagagggtgctggaaatgttctacatttttatctgggtggtgattacataggtgtatatgtaaaaattcataaagctgtatttttatttgttcattttattatttgtatgttgcacaacaataaaaaaatttaggctgggcacagtggttcactcctgcaatcccagcactttgggaggccgaagcgggcggatcacttgagtcaggagtttgagaccagcctggccaacatggtgaaaccccgtctccactaaaaatacaaaaattagccggacgtggtggcgcgtgcctgtaatcccagctagtcagtaggctgaggcactaggatcgcttgaacccgggaggcagaggttgcagtgagccgagatcatgccattgcagtccagcctgggcgacagagcaagactctgtctcaaaaaaaaaaaaaaaaaaaaaaaaaaaaattaaatgactataaatgagaaccattttatataagccatcttaaatttttccctattaatgaaaacaataacaacagattttagagagtactaaatattagcaattttcctgcatagtatgaaactattttatgatagttattttattattttattttttcttttattattcccattttacacatgatatagttatttgggctcatttctatacatttaaaacattaaaaaattgtcagtttaagttaaaactgtaccatcagcgcataacagtacaatggatgaataaattatgggcacaatcacatattggaacatttttatacaaaagaagaattaaagaaccacagctgcatgcattgacatggataaactgccaggcacggtagcccatgcatgtaatcccaacactttgggtggctgaggtgggaggattgcttgagcccaggagtttaagaccaccctgggcaacctagtgagaccctgtctctaaaaaaaaaaaaaaaaattagccaggtgtggtggcatgtgcctgtggttccagctactctgcaggttgagatagtaggatcacttgagcctgggaggttgaggctgcagtaagcggtaatcatactgcagtactccagcctgcgcaacagagtgaaaccacgtctcaaaaaaaaaggacacgttttataaacacagtgttgggtgaaagaaacaagtcacaaagatcacttacatagaaacttttgtataaagttcaaaaatagtcaaaatgaactatattgtttatggatgcatatataggtggcaagcctaaagaaacaccagacagaatgattatcataaaagtcaggatagtggttaccccttaaggggaaggagaatgatgccatccgaggagaggaacacagatggcttctaaggtactcgcatagtccttctattgctatatttctggcctggcgcggtggctcatgcctgtaatcccagtactttgggaggccaaggcaggtggatcacaaggtcaggagttcgagaacagcctggccaatatggtgaaaccccgtctctactaaatatacaaaaattagctgggcatggtagtacatgcctgtagtcccagctacttgggaggctgaggcagaagaatcgcttgaactgaggaggcggaggttgcagtgagccgagatcatgccactgcactccagcctgggtgacagagtgagactctgtctcaaaaaaaaaaaaataaaaataaaataaaataaaaatatacatatttcttaacttgagtggtggttacacggggtcttactttataattgctctttaagtataaaagaggcagatctaaaagtaaaattccaacagtcaggtattttgtagtctggaaagtccgtggtattaccctttagccaactaaaaattgtcataggcccttagaattatgtgtaaggttgccagatttagcaaataaaaatacagaactacagttaataaatattcagggttgtgagttgaatgttaacttcagataaagaacaagtttctagtataagcatatcctcatgcaatatctgagacatacttataataaaaaacaaatcattgtttacctgaaattcacatgttactgggcatcctgtattttatctggtgaccctagttatatggcaagttgcacaagcagaagcagttcatggtggcccagtgtaaggagtacccagaggaggctcagggaaagggaagagaaggaagaaaaatctttaagtaaattagcctgaccctaagttcctatctgaataattgtgtaaatgaatttgctggccaggtgtggtggctcatgcctgtaatcccagcactttgagaggccgaggcaggcagatcacctgaggtcaggagttcgagaccagcctgaccaacatggagaaaccctgtctctactaaaatacaaaattagcagggtgtggtggcgcatggctgtaatcccagctacttgggaggctgaggtagaagaatcgcttgaactcggggggcggaggttgcggtgagctgagattgtgccattgcgctccagcctgggcaacaacagcgaaacttcatctcaaaaaaaaaaaaaaaaaagaatttgctgagttcaaccattattgcagtagttcatagtaatgaatctccatgatgcattgaataatttatatcaacaaaaagcaaatgtttgaaagagccatcagtgtttctccttaaaaaaaaactctctcactgcatcagcctctcttctatttactttggatgaagatattgtagatgatagtcttgatgatacttttctataactaattttttttgtaatttgtagccaatgcttagaagtgaagttgcaaggtaggttgttttgtttttcttctgctaatacatgtattctcctgatcatgtaccaggaactgacttaggcccaaaggacaggataatgtatgataccgacacagtcccttcctatggagctcagaatctaggccctagaagactgtaacgtgtgtgtgtgtgtgtgtgtgtgtgtgtgtgtgtgtgtgtgatgcacttggtaaagcattatctagcaacagtgaatatctgttgtttgttgcatagcatcccaccttcttttgggaaaccatccagactccattctgttatttggtttaggtgaaattgaccacaaatcaatcactaccattgatgaagattgattcaagaatggtcgtataatccagtaagaactgatgaatgcctgagagccaataaataaagacttctggaaaagagaggcattcattcttgcctttgagctttgcaaggtggtaaagcttggtaatagtcgccatatagctaacttgagtggagccatcaaggtaaccaaggctgtcagacacccccagagagaatcattcacatgtgcaaaggatgaactcaacacccagaagaagcatcctagtgacattgggcagctctgattcaagaggaacctgaaactactcacagaattcattgaaattgagccaataaattcattcatttcttagggcggcttcagttttctgtcatttgcagcataaagatctggtgtaataaaagtctaggaggaaataaaagatttctttcctattctcaacctccggtttcatctcctagagataatcactgtttcttacagacatatgtttgcaaacatgtatctaatgtatgccttttaatgcaaataggattgtattaaatatatagttccaccacttgctcttttaaacttatgttgtattatgggcatcttcctttgtcaacatatagatctaccactttttctttatagttgcatacaattctataaattagatgtatcatcaatttaatctcttcctttgatagaaatttagtttttcctcaattttttactttgacaaacattacctttatacgtatatctttgtgcacttgtgcagctataaaaggaaaaaaaaatcctaaaagtgaaagtgctcaaagagaatgtgcacttaaaatttttggcctccagaattattacagcaatttatactcttttcagaaacatgaggctacgtttcctagtgctggtaaaactgtgtttgataaacttcagaaaagtttgccagtacgataatgaaaagcagtattgttttcttgatttgcatttgtttagtgagtgcatatatatatatacacgtggagacatacatggagcgacacatacatatttaggctattttataacttcattaactattttaatgtaaattttttattcatatccttagttgatttttctgttgggtcatttatcttttcctcatttatttgtctttatatattaagaaaatagattcttttctcatacgtattttgaatattcttttcagttttgttgtttgtctttttggtaatttatttctgaatttctttttctattaaatgttctaagtagagaaaaaacaggagaggattatataatgagcactcatacagccactacctagttttaacatgttgtcattttgtaatatttgcttcagcgttttttttaaaagaaaaaatgttgcagatacaactgaagttctttcataccctctccaattccattcctttccacccctccccagaataactagcatcctgaaggaaatgtgcctgtgtttttggaaaccctttatacccctcaaatacccctcacatgaactatttaaatattttcctttgtctttcaggaaaaaaaaaaagaaaatgttaaaaagacagaaataacaaatggggccaggtgcagtggcttatgcctgtaatcccagcactttgggaggctgaggtgggaggatcatctaaggtcaggagttcaagaccagcctggccaacatggtgaaaccccatctttactaaaaaatacaaaaattagccaggtgtgagaagctattctcaaactgtgcgagcctcttgacagatgttgctaataaagaacagagaagaatctgcccatcaaactttcctcaaatgaggtcactgagttatgatcagatggcatcattataatttatttcaacctcagaagaggttatttttttaaggtcatagtatctctttctgtccactttgaagcatatattagttggcatcaaagccctccatgtctgcttctgtaaaaggtcatggttgagggagttgggggtgttcaggcctgcttggacacatgaaaaatgaagaaacttcataagcactgtgatgaaaccaacgtggtcatgtctgaacatttttgaagaatgaattttaaaacagtttttaaaaaacccacaagccttttgaatggtctccagttatttggtatgctgaaacttctacctcattgctttttcttttctattaaagttttgtttgtttgtttgtttagagctagtgtctcaccctgatgcccaggctgatctcaaaaccttttgaatggtctccagttatttggtatgctgaaacttctacctcattgctttttttttctgttaaagttttgtttgtttgtttgtttgtttagagctagggtctcaccctgatgcccaggctgatctcaaactcctgggctcaagcagttctcctcccgaagtgcttggattataggcatgagccaccatgtccagcaacttttttttttaaaggacccaaaataggcctagtgtaaacaagtgagtcacctccagttttgacaagtaccttaagcattataggaagggtcttcaaaaagtttttggaaagtgccttttatgaaaaaaaataagaatggatttcaaaattttttggcaccaaaggaaactcacactatcttgtcataacatgtctgaacagaatctagtttaagacactaagaagaataagacatcagtttgaaaagagcccctcttggagcaacataaattctgctaaaattgaagcaaaaacaaacatcatatttatggtgaagtgaagcttgagtggaagaatggttaaatcactgatgctttatgaaaagactatggggacaatgtcccaaagaaatcagcagtttacaactggatagatcattttaagaaaggacgagacagtgttgaatatgaagcttgcagtggcagaccatccacatcaatttgcaaggaaaaaattatactttaagagcaccagtgatgaacaacagaaacaaaaaccaacaccacagacatctcaattggttcagtatacacaatgctgactgaaaaattaaagttgagcagtctttccacttgatgggtgccaataccattgctcccagatcagctgcagacaagagcagagctttcagtggagattttaagtaaatgggatcaagatcctcatgcctttctttgaagaattgtaacaggagatgaaacatggctttagcagtatgatcctgaagacaaagcacaatcaaaacaatggataccaagaggtggaagtggccagacaaagcaaaagtgaactggtcaagagcaaaggtcatggtaacagtttgcggggatactcaaggcattttgctggttgactttctgcttatcgtgagagtattttcagaaagttaggaaagctttggcagaaaaatggctgggaaagcttcaccagagagtctttctccaccaaaacaatgctcctgctcattcctcgttcaaacaatgcaatcttgtcattgtttccatgggaaaccattagacatccacctcacagtcctcacttggctctttctgactttttttgtttcctaatcttaaaaaaaatctttaatgggcacccgtttttcttcagttaataatgtaaaaaagactgcataaatttccagaaccctcagttctttagggatggactaaatggctagtattatctcttacaaaagtgttttgaacttaacggaacttatgttgagaaataaagtttatattttttattttatattttaattccattgttttcatgaactatttgaagtcctccaatacttctatggttttatgcttcttccacagatccatgttttttaaattttgaattatttattacttgagacaaggtcttgctctgtcatccaagctggagtgcagtggcatcatcatgactcactgcagccttgactcccaggctcaagggatcctcccacctcagcctccaaagtagctgggactacagatgcacaccatcacacccagctaattatttttatttttgtagatatggagtctcaccatgttgcccaggctggtctcaaacatctaggctcgagtgatcctcctgcttcaacttcccaaagtgctggggttccaggtgtgagtcacgatggctgaccctaacatttttaaataatatatttttgtaaaatgttaacatttatataaattgcatctactttgcctgtcattctggacttcaccgttgttattcaacgtgacctcaaaacttatctttggtgatacatgtagatggagtttatttattttaactaatgaatattattacattttatgaatttatttttctattctaaaattaataaacatttagattatttctccttttttattagtaaaaacaatgctgctttgaacgtacctccttatgcaaatgtctgatttctctaggttatctatttacaaatgaaaccgatgggttataaggtttgcacacctctttactggatattgccaaattgctcttcaaaacagttacatcaggcctggtgcggtggctcatgcctgtaatcccaggactttgaaaggtcaaggtgggcggatcacttgaggtcaggagttcgagaccagcctggctaacgtggtgaaaaactgtctctactaaaaataaaaaaattagccaggcatggtggtgcccgcctgtaatcccagctactcgggaggctgagacacaagagttgcttgaacccgggaggcagaggttgcagtgagctgagatcacaacagcctggctgacagaaggaaactccgtctccaaaaaaaaaaaaaaaaaaaaaaggctacatcatataattcctactcagtcagcagtgaagattactcacatcctttctgcctctggtatttttgttttgaggttgtgtgtttttgatagtagtgtaatttatcaaactttgctttatgactcctagtctgtgtgtgttgtggggtgtgtgtgtgtgtgtgtgtggtcatgtttagagattatttttgtcttgtttagttttggtagtatatttactactggcatttggtagccatttactaatggctattctagtttaagttgcaagtactgtttgtttcacaatgatgaaaagaaaagagaatagtgctaatagcccacaaatctggtaatcctacaacaggattttatttttattgtacaatgctttgcctgccaagtattaagaggggacaaaagttaaatcaaattaaattcagaaaaccatgtttgggaaactgcactaaatactgtatgtaatagccagacatttttcattgacagtttttgctcattgcacagaactgggttatctaatggagcattaattatcgtatcaggtccagggtacacagttaatctggtaggtcccaaactattgtttctttcctccatcttcctcctcctccttttgaaatagtgttgactttttcttccttatcaggtcagtctcaaagtctcaggaaaatcttagatgtagcatagttcaagataaaaatgtttgcagcataagcttatccaaggcattaaactctgtcatgccatccagctaaaaacaaactaaaactccaacctgtaggatacctagatgtgacatctgctgagctgtcctgtatttaaaaaaacaataaattacagagtaaggcaggaatgtagcaggtgtggtaaatcaggaatggcttcttgacataaactgatgatgtgcttacttctgaaacaaagaggtgttttatcttacacattcaaccctttttgtaaaagatatttcataacactataagatctaacaacagttttctatactattcctgactgtgagggtaatgattactttacttcatcatgtata

SEQ ID NO: 46 - DNA, 11515 bp, Homo sapiens
tcattttgtctctaaaaattttcctaatacctcataattctagactccaatagccaagcacattatctagtaagggacactgatggttgcctacccaatatccattccatttcctaagagccatggttttattcaggtgtgatcccagattcaacagggaattctgattaagtcagtcccctgctggctcactgatctgcagatggggatgtggcattagttggtctaatcaggccaaagggaaggacataactctaactgccactagcagccatcttatgaccccaaaaagacccagccatagaggagaagccgacatcaaggataacagaatgaactaggaatagaaagttggaccttgatgtcatcactgagctattgattatatagtacctgaaatcactttgataacttgtgaaataataaatttccttattgttaagccagtttgagttcattgcttgtttgggtaattcaaataagccatgtaggaaaaagaaatatacataaactagggttttctaatggcccagggccatgaacagctgtaagttttcgaaacaattcagtgatacatcttattaaagacatttactgacattgtcttattatgatctgctttatttttgagagcaaaatattgttgtgttgcatattgctttgtataaactgtaaatcttgggtttctttgcaccaatcttttaaatgctcatgtgactgatatatgattgatatgatttttttcaaaagaaaaaagcatttccttaatggctcttggccatgccaatgggaaaataaaaacaaaaaggtaaggatttaatgcgcatctctaatgattgaactgtttgaaaccgcagcatgtcaaactgacttcggaatccgaaaagctcatctaaagaaattcagaatactctggaatatgtaatacccaaagctgttcaacgtcaacaaatttaggagttcaaactaagaataaagtgtaaaaagatgcaaatatttctgtcacaggttaatatttcaattaaactaaagaatgtttaaagtgctaataagtatacttagccttaagcttattccttttaaacaagagaggcaaggcacagtacattttttattctgtgttgaaaatgtacaaaatatccccacttcccttgagaaagagtatatctaaaatacactttgatgaacacagaatattaaaacattatatgctatagaagtgaacacaaatacattttctccaaaatttcaatagtctaaggaatatataagcattgataatatgaaggaaaatgtttggatttatttttaaattcaaaattctcctggttgtagaggtgaaaaagtaatcaggttaccaccaaaagaaatgtgtctggcatgttcttgatgtctcctctccagctgagtaaatggattactgcagtttagacctggctggagaacaaatccagagaagtcagtaaagtatccatcaagagtttcaccaattaattcttcaacattctatagtggattaattaataacaaaaataaaccgggtgcggtggtgcacacctgtagtcccagctactcgggaggctgaggtggtaggatcacttgaacccaggacttcaagaccagcccgagcaacatagcaagatcccacctcaaaaacaaacaaacaagaaacacgtaaacattttccctatataacaataaaattataaacaacaatgattatgctactttccagtagatcttatttcaaatgtatattacagttttttttattggaaaggtatattcagaatatatgtacaaaaatgtgaataatatgtaaatggactcaagcagtgtatgcagaatgaataaaactgaggctgtatcttaagccacttacatagattccataaatcctaaaccatataatagcacttaatagaccttttaatactgtgtgatcctgctgggatctttttactccctcaagccctgcttcaagttcaaattatgctactggggcaaccaataatttgggtctaaaatagacatctaaatactaatatttacagaagtgaaaaaaatatcagactaaatgataaggtattaagacttaacaatgagaacatataagataattgtgatgtactcttaatcacattactattaaaatattacgatttggtaatctctggatttacttataacaacatacattctcagaatcaatcattcagggttcgatctgggaacagggttaaatcaggtttacataagttggctttatgctgaaagccctgatcctctaggtctcagtttatgattaaagaaggctaaaaccaagaaagaatggtacgtgggtcacagtaacacatttcattctgctcctgagacacagggcagcccagagcctgaccacaaaaaaggcagctttgaaaaataatgaaagacaagatatacaagggtctttaaggaatttgtggcttatggaagctaagtatttgccaggtttcatgaagttaactaaaactgtggttgtttgatcctatacttgctttatgaatgaatttctcatattctgagattaaagaagaataaaaccaagaccgttttctgatctattctagtaattagtcctggaaaattccaaggtaaggctgtaaccacaggtgtaaaccataagaatcacttgatgaagaaaaaaatgacaaatccctaactccagatcattgaaataaaaatatcggccaggcacggtggctcacgcctgtaatcccagcactttgagaatcggggcggggggggggcatcacctgaggtcagaagttcgagaccagcctggccaacatggtgaaaccccgcatctctactaaaaaatacaaaaattagccaggtgtggtggcaagcacctgtaatcccagctactcaggaggctgaggcaggagaatcgcttgaacccaggaggcagaggttacagtgggccaagatcacaccattgtaccccagcctgggtgcaagagtgaaactctgtctcaaaaaaaaaaaaaaaaagtctgggatggggctgaaaccaatgctatatatataaacagcaggaaagagagcactatttaattcgtgccatagtgccagtatcaaaggtatgaatcagacagctctacctaatgtggaatttacagttaataaggaattttattccttaagttatatttttggaatgcgttcatattataccctgaataagagatgaaatgtaaacactgtatgcctatgtgcatctgtacctatatataaattaacatgagagagataagagcttttacagaaggcttcacaaaagggctgtttgaactagatttagaggcaagaggtcaccagaagtaaaagcagggaagtagccactaaaatagcaggacataaataaccaatgatgactgaaggtgggatagatattatttccccagaagggcagaaactttgccttatatttttcttgaatcacttagaaatatattcagatattcaagtacccagtttgtcagagcaaatttgatagaaaaaccatatagaaaaacatatcttcagggttaatattaaaacatactatattttaaagtatataaacaccaaatttttcttcattctgtgaaaaatgaagagtgagtaagcaaaacaatgacaagatatacattttaagccttgtacacaaatagaaaagcaatattcattttataaaacaaatctagaatataaagggacttgtcaagttggaaaacttactgaatcaagaaggtggcattcagtagtgagacttttattatcaaatagttctgaaaaacaacaaaaaaaaactttttaaagaatattctcacattcgagggctgttagaaatggacaaagccatgaaaaatatgaaaagttccacatatcaaatgctaagacaaaaatatagacccctatgctataatgttttttgaaagtagttaaattcttatccttaactttggtataaaagcagacttctgtaaacaaatctcatgcttgtaacattaaaggtacccagaaaatgctgatgaagaacagctggaggacattaaatgtctggccgaggttaaaaccttttgttttaccataggccccagttagaccagctacagactaactgatgaaaatggcaggtaaaactggcacacattataacaaaaatataggagccatttcctattgcagaaccatcacaacaatataggtagaactaggcagtagggaagaaaaataggatattttgaagaaagacttggggatatgtgttgaaaaggacaactaaaaaaaaagcccaggctggccaatgtggtgaaactctgtctctactaaaaataaaaaaattagctaggcgcggtggtacatgtgtaggagaatcgcctcaacctgggaggtggaggttgcagtgagctgagatcacacgactacactccagcctgggcaacagagtgagactccatctcaaaaaaaaaaaaaatcttgagggaattgttctaattcagggtcttcactaacaatgaaggatcctcaatagttagatctaatgtaaaatggaccttataggataatttataccttaatccaagttcatttctttaataaaggctcgtttaaatatattttaaatatctcacctgactgagaaattttagtttccccttcttctaagatgctattttgtgaagctgtatttttttcagggctactcatcaaaacatcctgtgatgtaattgaagaattcagttccattccttccacaacatctgaaattccttcttttttgttagtattaatatcatctgctactccaccagcaagaagaggcaaactcattctctcactggataaacaatccaccttcaagtctgtcttatttacaacctggaagtaaaaatggcattatatttaattatcaatttaattacttggaacaaattttaaaagtcttgttgctattaaatacaagaaaaacagaaggatgacatcccggacacagtcttaagaacattataaatcctactatcctgcttcttcaacaattagttcagataatattatagaaatagtatgattgaaggcaagtttctcagcaagtacctatactctagctcagggactggcaaacattttctgtaaaagatcaaatagtaaatattttaggtttgtgagtcacagggtctctgtcataagtactcaactctaccactgtattgcaaaagcagccagatagaatacataaacaaatgtgtggctattacaataaaatatgatttgtaaaaataggggccaaagtttgctgatttctgctctagttcactggttccatattcattctgatatgagttgaagaatacaaaatgacactatggttttaaacaacccaaatgtcattgaaacaagaactacaattctacatgactgatttagatttccaacggaaattctggggatgctttacaaagttactttctataatgatataaacatatgacatactgggctatctaaccacactggaattgtacttacatgattttcttcaattaaatctggtaatccaggacactgagcatcttctatgctgctcctaaagaagaaaaaaagcagcattacactcataaacatattgttattgtttcacttgtattttgagtctttcctttaatgatggcaattagtttagggaatggatcaaacatggagcctggtgcaagatcaggcgtgatccagatagattagttttggactatagctactgcaggatggccttacaaactaaatgcattcttccccagaaagctcacaagtctgttaccatggtggtcagtcagggtcaggtggctctaccagcaatactctgaatctcagccaaatccagagctatatattaaagaaaagtcaaaaagaaggtgacttctggagacagaagcaacaattcaattattgtctagctggagttagctacatttactcgttacttgttaatccaggtacctgctaagaaacttgacttcaatcatactatttctataattttatccgaaagttcaaaaagcggaacaggagttacaatgttcttaagtctgctgcttgttaacaagtaaatgtagctaactccagctagacaataattgagttagaatacaaggtattctaatcctgaagttactagcttgtatcttattagaaatatctgttttggccaggcgccttggctcacgcctgtaatcccagcacttgggaggcagcggcgggtggatcacgaggtcaggagattgagaccatcctggctaacatggtgaaaccccgtctctactaaaaatacaaaaaattagctgggcgtggtgacatgcgcctgtagtcccagctacttgggaggctgaggcaggagaatcacttgaacctgggaggcggaggttgcagtgagccgaggtagtgccactgcactccagcctcagcaacagagcgacactccgtctcaaaaaaaaaaaaaaaatttatctccacttctttcaagttactttttaaaaaagatatgctctatttttctagtgtccagctttactttgcctttattacacaaagttgcttatttgtatgatgccctttgaggatgttttggggaatccaaaacatttttaaagagtacttatgactcaaatgcaattatgaatcttcttagcaaacaatagtaaactacaagatatacaaagtaggccgggcatggtggctcacgcctgtaatcccagcactttgggaggccaaggctggcagatcatgaggtcaagagatcaagaccatcctggccaacatagtgaaaccccgtctctactaaaaatacaaaaattagctgggcgtggtggcgcgtgtctgtagtcctagctactcgggaggctgaggcagaagaatcgcttgaacccaggaggcagaggttgcagtaagccgaaatcgtaccactgcactccagcctaggcaacagagtgagactccacctccaaaaaacaaacaaaaaaatctagaagcatatctagcccataacagttgttcagtacacattaactccccccccttcaatatgctctgccatctgtcaagaaaacaatctcaaggtactttctacaaagcctggtaaaaagtgtccatctctcaaccaccttggggaggcattagcactgctgctttgtagatgatgaaagtgaagctaaagagaattaattacttgccccaaagttgcatagctagtaagtcacagagctcttctcagctcagaactgttgagcaccaaagttgtagtatgtttagcaccaaaggataccatattgcttcttttcttcttactgctgcagaatttacccaactaaacgtgaccatttagtatcctgaaaccttaagctttagtttcctcatttataaaaagggagtactgcctatatgttgcagggtcattatgaaatttattaaaaatatatgtctggcaccttttaccatcttaacaatctgaaatggtatttagtatcagcaactgttaaactcttattaacatgttaaagaaatacctgctttcaggaatactcaaaaacaaagtcttcttcacatgttcacttttcgtattctgaggaccggcattttctggtgatgtagtttgttgtggaatgcccatctcatttctactctgagatacagctttgttgacagacttaggtgttccaagtctttgagaagggccttcagaagagacagaaagtcctagaagatgagagaaatcacctcaataccaaatagttcttttgcttttcattataactaggaatacggtgaaaatcctatcaattagcctctttctcctgtcaaataatgtctgttaaagacaaatgcctgggactttctgttaaagatagtatttaaatgcatattagatgctgcttccttttgacatcccactacttttacatgaacagagataatttttttgttgttgttgagacagagtcttacactgtcacccaggctggagtgcagtggtgtgatctctcggctcactgcaacctccgcctcccagcttcaagtgattctcttgcctcagcctccccagtagctgggactacagatgcatgccaccacgcctggctaatttttgtatttttagtagagatgaggtttcaccatgttggccaggctggtctcgaactcctgacctcaggtgatccacctgcctcagattcccaaagtgctgggattagaggtgtgagccactgcgccaggcctgaacagagataacctttttttttgtttttgtttttttagagatggagtttcattcttgttgcccaggctggagtgtaatggcatgatcttggctcactgcaacctccgcctcctgggttcaagtgattctcctgcctcagcctcccgagtagctgggattacaggcacccgccaccacgcctggctaattttttgtatttttagtagagatgaggtttcaccatgttggccaggctggtctcgaactcctgacctcaggtgatccacctgcctcagcctcccaaagtactgggattacaggtgtgagccaccgtgcctggacacagataatcttaaaaagcagaactctacaaggacaaaggaaactaaagaagagatagcaacaataacaatattttggaagctataatgtagattgttgagtgggacttagcagactcaagaaaactaattctaagccaccaatcaagaaaaatgaattggccgggcgcggtggctcatgcctgtgatcccagcactttgggaggctgaggcaggtggatcacggggccagaagatcgagaccatcctggctaacatggtaaaaccccgtctctactaaaaaaataccaaaaaatcagccgggtgtggtggcaggcgcctgtagtcccagctacttgggaggctgaggtaggagaatggcgtgaacccaggaggcggagcttgcagtgtgctgagatcgtgccactgcactccagcctgggcaatagagtgagactctgcctcaaaaaaaaaaaagaaagaaaaatgagaatcaacccaatttctaccacataacccctcaaaagaactggtggctccaagtatctctgcaagtggagatgaaaatggagctaaacacagaaggaatggctcaaagtcagtttaaacaagaagagctcagattcctttcctcattctgcacagcaaagcaactgtcatcacccacccccatcaccaaaaacagaagggtctctggtttagaggataccagatacagttgagagacagggtactacatggaaaataagggaaataagtgaatatttacacaaagtgttgagacacttagctttcttcccctacatggctcctgaaagactggcagccagaatgataccttccaggaagcagatggaaagcatcttctctggggaatctgagtagactatgagaaaagtcttaaatgcagtgatgtgtaggttcccagcataatggccccgctaacagaagggccccgaaagtaaaggtcctacccatgtgcagagagtttccagtcagctttttagtgccctattcttaaccatgtgcaggcagtgagagatcaccagattcccgaggaaagcctctaaatacaagagacagaaaccaaaaacaactagatgaaagtaccctgaaacaaatactgtctatagtggatgaagaaaacataaaagctatcattaatatccttggaaagataaaacaatacactgatgaaacaagtgcagaatgttataaaatgaacatttggagagtaagaaagggctcttgggaattaaaaacatgatagccagcatgaaagttgaggaaatctccaggaagtagaagaaaacagtaagtacaggaaagaaagattaaaaagtctaccagaagaaaaatgtgtttttgaaaaagatcaaaccttgtcaagagagatggtggtaaacaacaaaactccagtaagactccagtaagtccaaaagactccagtaagaattgaaagtagttgcttctagggattggcaaatggaatgagaagggcttcttcagggactactgttttgtaattagcctcatatcaactatgtgctctgtaactaaaactcaattttaaatgaccaatttttgccataaaccttaatctccctatctataaggactgagttgagtatatgaaagaacagaatgatgagcttatagctgtaaaaaccacgaagatccttgacaagtagtagaatggagtcatgttattagcagtagtgggagattcctgggtatccagggagtgtagctgcttaaaggaaacaaaagtacaccagatttgatacctaaactaacaagaatattataatatacttgaggatcactataaatatcagatagcaggtattagagaacaatttaggtttactttgaaaaaacttcctggtggacatctatggcttataaataaataatttcaattgagataaattcaattcaagaaaaatagtctgtggaaaaaaaagctatgacaaacactgtgagaaaatcacaaaaaaatgatttcctgaatattaaaaactgcttttactggaatatttttaaattggaaaattagtacgtttactacctttcaaaaagatctgagcaaaagttttaatacaaatgcaaataaaaccaaatccactttgcataaacttccttttattttttagagatggagtcttgctctgtcactcaggctagagtgcaggggcacaatcatagctcgctgtaaccttgaactcctgggctcaagtgatcctcctgccccagcctcccaagtaggtgggactacaggcatgtactgccaggctcggttaatattttatttttttgtagagaggggatctcactaaattgcccaggctggtctcaaactcttagcttcaagtgatcctcctgccttggtctctcaaagtactgggattataggcatgaaccaacacacacagcacataagcttcattttaaagcacagctagacaagtgtgatagctggatgctcaagtttcctttgcattataaattctaaccaaacttctaactgacctgaagaaaatcagtttacttcttcatgcttccgtcatttctcttacctcttgggatcctgtgacctttctcatagactgtagggttacatggtaattacattacagatgtgaaatcacttagaaagtagaaaagcaatcttagaagacttatcgcacttaaactaatctgatcatacccatcaaaatgtgatttacagtgtttgtgagcgagcatagtctattttctaaaaatcacagaaaaacttatgtctcttcatgtaaaaaactatttttcaccttacacaagcccccatctatcccaaatatttctcttaagtagtctcaggaaaaacaaaaaaaataaaaaatcaaaaacaactaacctgagaataatttaacaggactttcaactc

SEQ ID NO: 47 - DNA, 254193 bp, Homo sapiens
gaaatcaggaaaaaggagaatagactctttatgcataggtaggttcagaattaacaaagttttgtggtggtggttctttgctttgacacagattcaatgtaataaaatttgtaccacctttaggcaaaattgagaccaatagaagaaaaatgtaacatagagtcttgaagttgtgtcaatagaagaatttaaaaacatatttgcttttaaaaattgttttatggccatataatttgcattcaataaagtgcacacatcctaaatgttcattttgatgagttatgataattttatacactcctgtaacaaacaccctaagtaagatatagaacatttgtatcaccctagaattacattatatgcctttctattcaatttccacctagaagtgggagctactttctgatttccaccaacacatatcagtttgttttgcatagtcctggattcttataaattgaatcatgtagtgtgtaatcttttgtgtgtctgacttttttcactcaacataatatcgttaagatccatgcatatggttgcatgtatcattaatttgttagtttattgctaaatagtacaccattataggaaaatatcaaaatgtattaatccattctcttgttgatagatattcgagttgtttctattttatctactgtaattaaggctgttataagcatttttatataacatgtttatggacgtatgttttatttttatttggataaagactctagaacacaattgagtgatcataacattagattgtatatatttaagtttaactgtataagaaattgccaaagtgttttccaatagtgttgtagtattttttgtcaccaccagcaatttttgagaatgcaagttgttctgtatgttaggcaacataatggcccccagagaagtcctaatcccaaaaacctatgaatttgttactttctatggcaaaaggagctttgaagatgggattagtttgaggatcttgagatgggaaagttattctggattatctgctgaatcgagtataatcacagggtatttgtaagatgaagacaagagagtcagcgtcaaagagatataataatggtggcagacacagaggggaaggagagaaagagaaagcagaagatgctctgctgctggctttgaaaatggtggaagaggccatgaactaaggagtgaatgtggcctccagaaggtagaaaaggcatgggaataggttatccctttagagccttcagaagaagcccagacctcccaacatcttgatttttaggacttttgaccacataacataatatttaaaagttgtgttgttttaagccactaagtttgtggaaatgtgtattagcagtaacagaaaactaatatgcatccttgccaacatttgctgtcgccaatctttttagttttagtcattctagtgggtgtgaaatggtttagcattatcattttaatttgcatttccttgatgacccatgatgttgagcaaattttcatactctatcaggccatttgtgtatcttttcctgtgaagaatttcttttcaaggctttgaccatcattctactgaattattgtttcttctgttgttgattatcaggagctttaatatatagttgacacttgaacaacatggatctgaactacacaagtccacttattggtggattttcttcagcctctgccacccttgagacaacaagaccaatacctcctctttttccttctcctcagcctactcaacttgaagatggtgagaatgaagacctttatgatcatccacttctacttgttgaatagtaaatatattttttccttatggttttcttaataacactttcttttctcttgattactttattgccagaatacagtacatagtacatataataagcaaagtatgtattagtttactgtttaagtgataggtaaggcttccactcaacagcaggcaacagccaggtgttgtgacacatgcctgtaatcctagcattttgggaggccgaggtggaggatcgcttgagcccaggagttcaagaccagcctaagtaacatagtgagacccccatctccacaaaaaattaaaatacctaatcatggtggtgcatgcctgcaatcccagctactcaggaacctacaataggagccaaaaaggtggaggttacaatgagccattattgcactactgcactgcactcctgcctgggagacagagtgagaccttgtctcaaaacactacaacaaacaacaacaacagcaacaaaaatcagtaggtattaatagttaggttttttgggagtcagaagttatacacagattttgactgtgcaggggatcagcgctcctaacgcctgcattcttcaagggttacctgtattcttgatacaagttctccttcagatttaagtattatagatatttttccagtctatagcttacctattcattttcttaataatgtcttttgattgatttttaatttttaactttggtgaattccagttgtatactttttttatgattagcatttttgtgtcctatgaaactgttgccttcctcaatgtcactaaattctcttaggttttcttctagcaagtttatgtttcaaattttcacccttaggtctataattcgtcccaaatttatttttgtctgtaaagcaatgtcacgattcattttttttctcaatataattacccagttgtttcaaaactggttattaaagtttttctcttaatcattgaattttcttggcaccaaattattaactcttgacaaaaataattgacccttaagtaagcagacagacaagcagtgcttctattttatagcaatgtaaataatacacaacttacacaaagactttttagaagctaactaacagtggtcctatctaagtacgtacaccagattttttataaccacttttaaaataaaagtatttagattttaacacatagattaggacagagaaagcatatggtggaataaactgtatctttttggccagatggtgctatttctaggtcatcttgataaagagaggaggcaaacatgaaaacttaatgaaaaactatttatgatgctggagagaacatcttggctttgagtcacttttaaatcatagaagaggattattccataaaattatttataatgcctaaaattattctttgcccaaatcataaattttcagcattaccaagaagccatttagtatgtatagggtgtttcagcaagtgcagagatgcccaggtggttgggattcaatacaacgagctgtcacgctgcacattcttggagtacaaccttaatgggcattttcccacctgtgcaattcctctgttttcaccccactccattcatatttcacaaactactctaattatagtatttattattgacctcaggaaaaagaagtttgaaagggtggaaaaaacatgcattttgtctccatggatagtaaatcactgagctattgttccttgggaatcccaattcatgagaaattacatagacttttgccctaacactaatcagctgcctgatctgtaaatatttcagatccttgcctgtatctatttctccttgcagaaaactgtaatttatctagatttttctaataattcactgacattttactgctatccaatgagtaaatcattgttgcttttggtatcttatgattttgttcttttgtgtcaaagtttagctagtttcatctatcaggttggaataaaaaatgcaaattatgactataccacttatatagttacatgatctactgaccaaagttaatcatcactttaatcttggtaactcattcagagccctaattgtaatagcctttgcctgagttacctagagagtggtctcaataatccccttttatttttcatgtagagaaaagggcacacaaaatgatattatctcgatcacccagcacatgtattaaactataacagactttttaaatcatgtgtgatcttttattttttgactgaaagggactaagtttgctgcccagagaagtctttagggagcaaggaaaggtaagcaaataaacttatctggagtcaaaggtctcaaggaaaatcttgctttctataaaaggcagacaacgtcaagactcatagattttcccagggctaaaaatcagagccaattgcctcccatcttgaaaagactcattcatcatgctggttgaagtatcacagatcttgtcaaaatattcatgactcacatacgacccatccaaaagacaaaagccaacaaaatattttaccaaattctaaaatagtgtttgttttattattctttgttattcttcaacaattattgttacctttactatatgaaatataatagcaattccttgtcttcatggtctttctgttacagacatgttttacactgattataccactttagtgaaattcatcatacatattcctgatccaaattccttttttattaaccatatatgagagaaagtggatattaaaataattttgatggtaaaataagcgaaaaaataaagcaagcatggttaaaatgattaaattatggaaaagtgacccatgtgtttcagataaactgacgcttgagggtttttgttgttattgtggtttaaattttattttattttaattttaagttccaggatacaagtgcaggatgtgcaggtttcttacataggtaaagatgtgccgaaatggtggtttgctgcacctctcaacctatcacctaggtattaagccctacatgcgttagctccctcccactgcccctgcagcagatcccagtgtttgttgttccctccctgtgtccatgtgttctcattgtccagctcccacttgtaaataagaacctacggtgtttggttttctgttcctgttttagtttgttgaggataatgacttccatgaagcttgagttttcattctacaatttactgaatgacatttgagcagctagctgactttttaatgccttgattttaataattcaatgagttattgggtgagataatttagaacagcatacatgatatcgttattattagtcaataaaatgctatttatcttatttattactcataacaaaaatatgtatatgacccttcgctatgtttgaatatgtgatatattgaattgaattcactgtgaggcttcagtaggtacctataatattcaaatatgttacctgaaagctgtgaaaaatatatttttaaaaattagatttacatgcagtcaagttttcttttgatgacacactctcttgatatatactaagttttatacttggaatctttcacttttatccttactcagaaacgtgaatattaagaatcagtagagccagctcttctacatgttccctgccaattgctatcttgcctacttttaaaacacctctaacttgagaaaatgaaaacccacaaactaacaattgttccagggaagtccatggcatcacttggaacttttcatcattagtcccagttacactcttttgtgttgtatacaacattggcatatactctagtcatctgtatgccaagttaaatgagacttcattcagcaaccagtaatatgtcatgcatcagaagtctctctcatcatattgcttatcaccatcaaatagtttccattttgtctttattccttaaaaattgtcatgcttaaaattggtgcaaataatgtagatacttgtgattctattatatctacatatatttttctattttgcaagagaagtgaattttaataaattagttctcttagattataatgctacagaaaaactgaatgacctgactcgttggtgatttgattgggactggatttgtgttcctgcccaaatctcgtgttgaaatgtaatccccaatgctggagatgggaactgatgtgaggtgattggatcatgggagtggtttctaatagtttaacaccatccccgaagtgctgtttcgtgatagagttctctgaagatctggttgtttaaaaatatgtgtacctcccatctgtctcttcctcctgctctggccaggtaagatttgcctgctttctcttcaccttcaccttccactgaagagagaggttaaagattaacccccccactctaatcacatgtactgtctataaatctcaatctatcaagaccctttcacgtggaccccttggagttgtaagcccttaaaagggtctggagctctttctttggagagcgtcattcttgagatgcaagtctgctgacgctcccagccaaataaagcctcttccttctttaacatggcatctgaggggttttgtctgtggctcatcctgctgcatttcttggttccctgaccaggaagtgaggtgattaacggacagttgaggcagccccttaggtgacttacacctgccctgcagagcatccctgcagtgaactccagccagcttgagcgatggggatcctgagaccgctcctgggtaggtgtttgtcctggtagaactcctcgtcagagtggtgcatggcaggcccccgcagatgatcaatgcaatgtctgaacactgggaaggaaccattgcttggagtccagacatctggaatacagaaggaccggtcctgggaacttgcccactgcatttgagtggaagcgtggcctgatcacccactgtgtgcccttatgggcactttggtctcagtattgattttgatttggcttgacctgtttgcaaaaaggaaagtgaaagtgagtgagtgcttgagttttagatgtgcgaggtgagcgagtgacctctttaccctttccttcttgtggtgtgagtgttgttttgtctcgggaggaaaatgggtgttatgcaaagtaagcccactctgctaggaactatgttgaaaaatttcaaggaaggatttaatggagactatggagttactatacaccaggaaaacttaggactttgtgtgaaatagactggccagcattggaagtgggttgggcatcagaaggaaacctagatgggtcccttgtttttaaatgtatggcacaaagtaactggtaagccaagacacccagaccagtttccgtaaatagacacttggttacagctggttttagagccaccacagtggttaagaggacaggcagcagtagtactagtggcaaagggacagacagccaaggaagaatcctgctccaccaacctaagggagtcagctcctaaagtcctgtctgatccaacaccagaggattcatggcaagaaacagcaccagtggccccctttccaccaagaagaaaggtctcccactccgataccccatcctataccaaaaagccacaagctctgatggatttgctccaaactgttatccagacccacaaaccccacctgggctgattgccactagttgctcatatgcctctttaacacagatgaaaggaggagagtgctccaagcagcaacgaagtggctttagaacatgttccagctgattaccaaaacccccaagagtatatgaggatccaattaccaggaacagatgccgagtgggacccaaatgaaagacagggtatgcaaaggctaaaccggtacaggaaagcccttctggaagggttaaagaagggagctcagaaggtcacaaatgttaacaaagtctctgaggccattcaaggaaaagatgagagcccggcacaattctacaagagactacgtgaggcctatcgtatgtataccccctttgatcccagtagccttgaaaatcagcacatgattaacatggctttagttagtcaaagtgcagaagacattaaagaaaatttcaaaaacaggctgggttcacggtcatgaatacttcacagttactggagatagccaagcaggtgtttgtgaatagagacacggtaagctacagagagaactgcagagagagtgaacgccaagcccggcgaaacgccgacctgctagccacagctataagaggggcccccccaaagagaccagagaaggggggccccaggaaaaatacccagtctgtccatccacgcttgcagcgtaatcagtgtgcttactgtaaggaaataggacgttggaaggacaagtgcccacagttgaaagggaaacaaggtgactctgagcagaaggcctcagacaaggatgaaggggccttgttcaatcgggcagaagggttactggactgagggggaccaggctcatgtgcccccaaagagcccattgtcaggatgacagtcgggtacgaggacatttagtttcttgtcaatattggtgctgaacattcagtagtaaccaccccagtcgcccccttatccaaaaagactattgacataatcggagccacaggggtttcggcaaagcaaacgttctgtttcccccagacctgcactgtgtggggcatgaagtgattcatcagttcctgtacatggctgactgccccttgcctttgctaggaacggacctacttagcaagctgagagccaccatcacttttacaaagcacggctctttaccgctaaagctacctggaacgggagtcataatggcccttatggttccctgggaggaggaatggagactcttcttaactgagccaggccaagagataggagcaactctggctaagtgttggccaaaggtgtgggtggaagacaacgctctagggttggcaatcaaccaggcccccgtactcatagaagttaagcctggggcccagccagtcagacaaaaacagtacctggtccccagagaagctcttgaaggtatctggatccatctcgagtgcctgagggcctttggaattgtagtcccttgtcagtctccatggaacaatcccctcctgcctgttcccaagccaggggccatggactgcaggctggcacaggatttgcgcttggtcaaccaagctacagtgactttgcacccagtggtacctaacctgtacacattgttggggttgctgccagctgaggacagctggttcacttgcctggacctaaaggacattttctttagcatcaggctagctcctgagagccagaaactgtttgcctttcagtgggaggatccggagtcaggtgtcaccactcagtaccttggacccagcttccccaagggttcaagaactcccccaccatctttgggggggtgctggcttgagacctccagaagtttcccaccagagacctaggctgcttgctgctcgagtacatcgatgacctcctgttgggacaccccacggcagtcgggtgtgccaagggaacggataccctactccagcacctggaggactgtgggtataaggtgcccaagaagaaagctcagatctgcagacagcaggtaagttacctgggatttactatctgatagggggagcacagcctgggatcagaaagaaagcaggtcatttgcaacctaccggagcccgagaccagaaggcaggtgagagaattcttaggagccatggggttctgcaggttatggatcccaaactttgcagtactggccaagcccctgtacagagtcacaaaggggagcgacaaggaacctttcaaatgggggtcccaaaagcaatgagcttttcatgagttaaaagagaaactcatgtcagcccccgccctggggctgcctgacctgacaaagccatttacactatatgtgtcagagagagagaagacggtggttggagttttgacccagatcatgtggctctggccaatgctggtggcctacatctctaaacaactagatggggtttctaaaggttggcccccatgtttgagggccttggctgcaactgccaatggacggatccagttatcagataaaaaaatagccatgccacaactgctaggagccacagtcgtactggctgttcttgaggccccacatgctgtggtgactttaatgaataccaaaggacatcattggctaacaaatgctagactaactaggtaccaaagcttactctatgaaaatccccacataaccattgacgtttgcaacaccttgaaccccaccaccttactcctggtatcagagagcccagttgaacctaactgtgtagagttgttggactcagtttattctagcaggcccgacctccaagaccattcttggaaatcagtagactgggagctgtatatgaacgggagcagcttcgtcaacccacagggagagagatgtgcaggatatgcagtggtaatgctgggcactgtcattgaagccaaatcattgcccagggtacttcagcccagaaggccaaactcattgctttaatttgggccatagagctaagtgaagataagactgtaaatatttatactgactcttggtatgccttcttaaccctgcaagtgcatggggcattgtataaagaaaaaggcctgttgaactctgggggaaaagacacaaagtatcagcaagagattctgcaattattagaggcagtgtgaaagccccaaaaggtggcagtcatgtactgcagaggacaccaacaatctttcaccttgattgccttggggaactcccgagctgactcagaggcttgaaaagcagcatccaccccctaccgggcatcagtcacagcaccccctgctccttcaggcacctgaccttgtacctacttattctaaagaagagaaggactttctccaggcagagggagggcaggtgatagaagagggatggatccagttatcagatagaagaatagccatgccacaactgctaggagctgcagtcgtactggctgttcatgagaccacccacctaggccaagagtcacttgaaaagttgttaggctggtagttctacaactcacatccggcagcccttgccaaaacagtggtgtatcagtgtgtcacctgctggcagcagaaaggtaggcaaaatgcaaatgtcccgcccagcatacaagcctgtggagcagacccctttgaagatctccaagtagacttcaccaagatgcccaaatgtggaggtaacaagtatttgctagttctagtgtgtacatactctgggggtggtggtggtggtggtgtggaggtctgtccaacacgaactgagaaaactcttgaagtaacctgtgtgattctccgagatctcatccctaggtttggactgcccttacaaatagactcggacaacaggctggcatttgtggctgacttggtacagaagacagcaaaggtattggggatcacatggaaactacataccacttaccgaccacagagttctggaaaagtggagcagatgaatcagactatcaaaagtaatttagggaaagtgtgtcaagaaacaggattaaagtgggtacaagctttccctatggtattgtttaagattagatgtaccccttctaaaagaacaggatattccccttatgaactattatatcataggctccctcccatactacggggattcccaggcactcctcaagagctaggtgaaattgagttacagtgacagctacaggctttaaggaaaattacacaaacaatttcagcctgggtaaatgagaggtgccccatcagcttattctccccagttcaccctttctccttaggtgatcgggtgtggatcaaggattggaacgtaacccccttgcagccattgtggaaaggaccccagaccgtcatcttgaccacagccacaaaggtagagggaatcccagcctggatccaccacagccatataaaacctacagcacctgagacctgggaggtaagaccaagccaggacaacccctgcaaagtgatgctgaagaagacaataagccctgctcctgttacacccagaagctggctggtccatgcctggctgaagcataaggaaactcattgtgggtctcattttccttaaattttagacttgtacagtaagtacttcaactgatcttcctcagactgaggactgttcccagtgacatcaagttactgaggtagggcgaaaagttaaaacagtctttctgttttataattattatgaaggtactggaactctaaaagggacttgtttgtataatgccacccagtacaaggtatgcatgccaggaagtgaccagcctgatgtgtgctataacccatctgagccccctatgactacagttttccaaataagattgaggactggcaactggggaaaagctgataagagtaaagtaatatctaaaacagaagagaaaggagttcccaaacaaattatcttaaaatttgatgcctgtgtggcaatcaacagtgacccgtatggaaatagaataagatgcggctgtctagattgggaaagtggctatatagtagaaaataagtatgtttgcaatgaattaggactgtatagtgatgaacatagttactggtcctgtgtcatttaggctacctggaaaaaagataagaaggaccctgtcctccttcaaaaaggaaagagtaactgttcctgcactagtggtcactgtaactcattagaactacctgatcaccattggaaaacaggagagtatgtaaccctaggaatcaatggaactggactggatccccaagtaaatatttaagtgcaaaggaaggtccacaggctctttcccaaaccagtgtttcagaccttttaataataatagtgttaggagcctgcatgttactcccctgtatgttacccatatttctaccaccttagttcatcaaaagacctcagcacaagtgtattacatgaatccctattgatctgtctcacaggaagacctgggtggtgactatgaaagtgagaactcccactagtgagtgaggttctcaaagtgggggaatgaggagagaggccatttatcttactgtctcctgtctctgaagagaaagaggaagtaaaagctgaaaaacaacaggaatgaaatcagtggcaagaccagccagtgcaccgatgaccaggcctgaggttaaaagattaacccccaactctaaccacatgtgctacctatagatctcaatctatcatgaccctttcacgtggaaccccttagagttgtaagcccttaaaagggccaggaaccctttcttcggggagctccattcttgaaatgcaagtcggccaatagtccagtccgaataaggcctcttccttctttaatctggtatctgaggggttttgtctgcagttcatcctgctacagtcccagtgctggtggccacaggagtgcttatgtcgcccctcccctaaatgcagacagcacagcatggagagagagagagactccatttgtttgggggagagtgaaggaaaagaacaagagcctctgcctcataatccagggaattctgccagatcttactgcagaccaccaaggtggtacatctgtgagtttgcaagagtcatagtgttactgggcttgagatgcctctaaagcagatatggctgcagtgaccaaatacttagatcacaaccctcaattccctttgaatactgggaaagccttctcaaggaggatgggaggctgggcatggtggctcatgcctgcaatcccagcactttaggaggccaaggtgggcagatcacctgaggtggggagttcaagaccagcctgaccaacatggagaaaccccgtctctactaaaaatacaaaattggccaggcgtggtggcacatgcctgtaatcccagctacttaggaggctgaggcaggagaatcacctgaacctgggaggtggaggttgcagtgagccgagattgtgtcattgcactccaacctgggcaacaagagtgaaattccatgaggaagaagaaggagaaggagaccagatgtggtggctcatggctataattccaacaatttgggaagctgaggagggaggatcacttgaatccatgagatcaaaaccagcctgggcaacatactgagatcctgtgtctacaaaaaatacaaaaatcagctgggcatggtggcatgtgcctgtagtcccagctacttgggaggctgaggtgagaggatcgcttgagcccaggaggctgaggcctgcagtgagccatgatcatgccattgcactccagcctgagtggcagagtgagattctgtattagaagaaagaaacaaacaaagaaagatgggtacacacaagcacagactgtggagattataataaataactaattctttaatggccagacattgaccaatagccacaagcatcaagagcatccaggaaaacatgacctcacaaaattaaataaggcatgagtgtccaatctcagagtgacagaaatatgtgatctttcagagaaaaaattcaaaatagctgctttgaggaagctcaatgaaactcaagacaacacagagaaggaattcagaatcctatcaaatatatttaacaaagagattgaaataattttttaaaatcaagcagaaattctcgacctgaaaaatgtaattgacatactgaagaatgcatcagatctcttaccagcagaactgatcaagcagaagaaagaattagtgaggttaaagacaggctatttgaaaatacacagtcagaaaagacaaaataaaaaagaattaaaaactataaatcaagaaataaagtaaaataaaaacaatgaagcacacttactagatctagaaaatagcctcaaaagaacaaatctaagcattacaggaggtagagagagagatcagcatagaaaatctattcaaagggatagtaagagagaactttccaaacctagagaatgatatcaatgttcaactgcaagaaggttatagaacaccaagtagatttaacccaaaggagactacctcaaaggcacttaataatcaaactcccaagagtcaaggatgaagaaagaattctgaaggaagaaagagaaaagaaaccaataacatgtaaggagatccagtatatcttgcagcagacttttcagtggaaacattataggccaagagagagtggcatgacatatttaaagaattgaaggaaaaaaaactttcattctagaacattatatccagtgaaaatattctgagatcaggagtttgagaacagcctgaccatcatggtgaaatgctgtgtctagtaaaaatacaaaaattaactagttattgtggtgtatgctgttaatcccagctactcgggaggctgaggcaagagaatcacttgaacccagaaggtggaggttgcagtgagctgagatcacgccactgcactccagcctgggtgacagagtgagactgccacaaaaacataataatagtaataataaaagaaaaaggcaaaaattcaaacaacagaaactgggcaaagccctccacaaaagaggaaatgtgaaggaatagctaataaaaacacgaagagggtctcagcctaacagggggagatgtcacgtgacacccaccagactggcaaaaatcccacaacccaatccatgcaagagttagggagaatggagagtagcaggaacaccaggcactgctaagaacggttgtgaaatatatttttgttatgcttctatatgaaagggtgtgtgttgtgggttatgagaaaaattacatttcttacctgggatgaaattttaaacattggaagctattgaccagaagaaacttgcacttttgtacaaaagaaatacccaagaacattcctaacaaaacagagtcctaaaggccccaacctggccaaacactcatcaacagggaaatgaagacatttcccatgctcctctcatatgaccggagatcatgcagcaataaaaatgaatcatgtcaatgtgggtgggtctcaggaagagaatggaggacaaaaatagacatcgagcagatgctcagagccatgcagtgtaggagcagccacacaggagaatttctcacatcaaagttcaaaactacagccaaggcaacagagcaagaccctgtctcaaaaagacaatggaaagttccaaaactaaatggcatattttttagggatgtacacataagtggtggaagaaatgtactatgaagaaaaatatgggaataataaagactaaaagaggaattgattccctctgtaggagaagggaaggggctagggctcaggcagggcctccggggagcatccaaagttatgtctcttcagattctattccctaaacttggtggaggtcctctgtgtccaatgtgtctgtattctttataccttacccatattgtacaaatgctttatttctattcaacatttagaagacaatcataaacaaaatgcattaaatagcaagatggcaaatgaacctcaggaaggaacatcaggaacatccatgaggttccatccacggaacctcaccatggatacgcttgtgatcaagggccttgtctcccctcaagacagtcagagatcagaggctgccctcatcatagcagtggaacaggaccagctgggacagggtccttctgtgacacctgctgtgtcaccaggctgtgcgaatggactcagctgcccgaactcacagaatatcagtaacagcaccgaaacttcacaggaaaaatggtaagttgtaagtttctccattaatagtaactctcagattagtctatgtcatccatcgcttctccattaaataactttttatagctttacatgggtcgatttttcaatttatattttattttactaactgaatgaaaagatatatattgtgtgtggtgtgtgattttgtctcagtcaggataatcatagtttaatttctattattattataccaatatcatttagtttttttaagctgttcaattcctgagggtattaatcagggtctttctgtctcatgagacaaaaaacaaatccaaactgtgtaagagaaagaagaatgcattgatcacgaggactgagaagctcccaggcttaacttgcttgggattcagctacatgtacagtttcaagtggtgtcctgtaaactctctctctctctctctctctctctctctctctctacttccccaacatctgctccatgtttagctccacgaacttcagacttaaaaagcatcactggctcctgaccaggattccagctccatgaacctcaaactagaacaccagcccggcttctctgcaggtctccagctccaaaacctaagacatcagtggcagtacaaactcatcccaggggctccagctccaggaccctcagacttgaaccgcagcaccaactcttccctggatctccatctccatgaccctcagacttaaacagcagcagcaccagttcatctgtgaatctccagctccacaaccctccaactagaaacacaccagctcctccctgggtctccagctgcacgaccctcaaactacaacatcagctcctccccgggtctctaactccatgaccctcaaactaaaacaacactgctcacccctgggactccagatccacaaaccttacactagaacagaaacaccagctcctccacagatctccagctttacaatctaagacattagtggcagcaccatctcctcctggggtctcaagctccaggaccctcagacttgaatcgcagcaccagctcttccccggatctccagcttgacgaccttcagacttaaacaacaaaagaatcagctcctccctgggtctccagcaccacaacccacaaactagaagaacaccactcccccatggatctccagatccatgaccctcacactagaacaccaacacctgctcctccgtgggtctccagatccacgaacctcacactggaacaccaacactggctcctctgcgggtcttcagctccacaacctaagacatcagtggcagcattggctcctcccatggattccagctccaagaccctcacatttaaactgcaagaccaccttctccctgtatctccagctgcacaaccctcaaactagaacatcagctcctccaatggtcttcagctgcacgaaactcaaactagaaaaacaacagctcctccctgggtctccagctctgcaaccatcaaactagaacaccatcagctcctctccaggtctccagctccacagctctcaaataagagcaacatcagcttctccctgggtctccagctgcacaaccctcaaactagaaaaacaccagctcctgcctgggtctccaagctccatgaccctcaaactcgaacaacatcagctcctccccacgtctccagctgcatgaccctcaatctagaaaaacagcagcaaactaataaaacctccccgggtgtttctagtttgagggtcatgcagctggacacctgggaaggagctgattttaatctagtttgagcatcgtggagctggacactcagggaggagcagatgtttttctattgtgaggattttggagctggagatccagggtggagcagtgttgttatagtttgaggtcatctgagggtcagctgcatgacccttaagccagaaaaacaccattttccccctgggactccagctccacaaacctcacactaaaacagcaacaccggctccttcgcaggtctccagctttacaacctaagacattcgtggcagcaccatctcctcctggggtctcaagctccaggaccctcagacttgaaccgcagcaccagctcttccccggatctccagctcgatgaccttcagacttaaacaacagaaggatcgactcctccctgggtctccagcaccacgaccctcaactagaacaccatgagctcctccctgggtctccagcaccacaacccaaaaactagaagaacgtcactcccccatggatctccagatccacaccctcacactagaacaccaacaccggctcctctgtgggtcttctgctgcacaatctaagacatcagtggcagcattgactcctcccatagattccagctccaggaccctcagatttgaaccacaagaccacctccttcttggatctccagctgcacaacactcaaactagaacaacatcagctccaccccgggtctccagctccattacactcaaattagaacaacatcagctcctctttgagtctccagctgaaagatcgtaaaacaaggacaacatcagctccttcccgagtcttcagctgcagggcactcaaactagaaccctcccccgtcttcagctgcacgaccttcagactagaacatcagcaactctcctggtctccagctgcaggatactcatattagaaaaacgccagctcctcccgggttctacagctgcatgaccctcaaactaaaaaacacccgctgctccccaggtctccagctgcatgaacctcaaactagaacaacatcagctcctccccgggtcttcagttgcctgaccctcaaactagaacaacatcagctcctctccaagtccccagatcacggccctcaaactagaacattagctccttcccgagtcttcagctgcaccaccctcaacctagaacatcggctcctctctgggtctctagctgctggacactcatactagaaaaacacaagctcctcccaggttctactgttgcacgaccctcaaactaaaaaacaaccgctcctcctcaggtctccaggtgcatgaacctcaaaccagaacaacatcagctcatccccgggtcttaagctcatggccctcaaactagaacatcagctcctccctgagtcttaagctgcacaaccctcaattgaaagcatcagctcttctccaggtcttcagctgcaggacactcacactagaaaaatgcaagctcctcatgggttctacagctgtatgaccctcaaactaaagaaacaccagctcctctctgggtctccagctccatgaccctcaaactagaaccaaatcagctcctctttgcatctccagtcgcatggctctcaaactagaacatcagctcctctcctggtctccagctgtaggacactcatactagaaaaacgccagctcttccccggttctacagctgcatgaatctcaaactaaagaaacacccgctcctctccatgtctccagctgcatgaacctcaaatcagaacaacaccagctcctctctgggtctccagctccatgacccttaaactagaaccacatcagctcctctctgggtctccagctgaaagaccctcaacaagaacaacatcagctcccctccaagtcttcagctgcacaaccctcaaactagaacaacatcagctcctctccaggtctccagctgcaggacactcatactagaaaaacaccagctcctcccgggttctacagctgcatgaccctcaaactaaaaaacacccgctgctccccaggtcttcagctacatgaacctcaatctagaacaatacctgctcctctgtggatctcaagctccatgatcctcaaactagaataacatcagctcctctccaggtctccagctgcagtatcctcaaacgagaacatcagcttctccctgagtcttcagcggcacgaccctcaaactagaacatcagctcttctccaggtctccagctgcaggacactcatactagaaaaataccagctccccctgggttctacagctgcacggccatcaaactaaagaaacaccagctgctctctgggtctccagctgcaggaccctcaaaccagaacatcagattctcccgggttctgcagctgcccaaccctcaaactaaagaaactcctgctcctcccagggtctatagctgcatgaccctcaaactaaaaaacaccagctcctccccagatctccagctgcaaccctcctattgctcctttgtttgttacccatatttctccaacttctaagaagttttgttactaccttggttcatcagaaaacttcagcacaaatgtattacatgaatgtcttgtaatacacaagtgtattacatgaatcactgtcgatctgtcttgcagaaagacctgggtagtgaagatgagagtgagacctcccactagtgagtaaggttctcaaatgggggaatgaagagagaggttaaagattagcccccctctaatcacatatgctatctctgaatgtcaatctatcacaaccctttcacgtgaaccccttagagttgtaagttcttaaaagggccaggaactctttcttcagagagctcagttcttgacatgcaagtctgctgatgctcctggccaaataaagccacttccttcttaacccggtgtctgagtggttttgtctgtggctagtcctcctacaccaccatgattctaactttcctgaggttttctcagaagccactatgcttctcatacagtctgcagaaccttcagccaattaatcttcttttccctataaactacccagtctcaggtatttaatagcagtgaaagaatggactaatacttgattattccagctaaacaaaatcaaagtagacaccatgccattgttagcaaattcaggctaaatcaccaaccaaaaatatgtgtgaatgtctcttgcaatatgtgtaatgcatctttgtgtaatatgcatatttgaatacaatttatatttatgttttctgaagagataaaatcattgggattcttttacattcagaatccatgaaggtccttgaactagaaggtatgattaatttcaaaataaatttgaaaattagttcataagtcaatggcaaaattaacataggtgggaattaatgttataatttcatatactgctttcataatttagcagtttttcatactgggaaaattataaataataataggaaatatattaatataacaaattgtatacttctggcccaatttcttcttcttttctgagaatatataattactatttgatatagattttttatgttagccatagacaatccttaattgaaaaatcatttagacaatctctcaaactttaagttaattttctatgccacattttcttaactcatcaaaatatgcattatattgattttcaattaatttattttgaaatgaatgaaataaaaatgtgaaaaaagttatccaaaatgaaacaacagtataggatgattaacaagattaacatattagtcaatataaaattccactgctatattgccatagctatggaactgttgtgatatgttcattctactaaatcctaatatttaaaaaaaaaaaaaagaaaaatgacctccagtacatatagaaaattggttgctttagtatgcattaactaattttgaagaaatagcaaagaaatgttcaaactttctttgttttattaaaacaatgctgtattgtgttagactattgaaaaacaaaacgaatagggacctgtattctttgaactgatgagcttcttgaaaatagaataaataaccctggcattggacttttaatatggtattgtttaaaggagcacttttggctagcaaaattagaaaggattttttattttttcatcctctatatatgctgttcctttctccagaagacaagccaatggtatgtgaaagagctttaaatttttcactcaaaataatcacgtagagataaaaaagaaccgaccttctattatatcaccggtctaagagaaacgtgcgttttaacttcaccctcaacagagtaagctcttgtggccttagtgcttatcatgcattttcagtagggaaagaaaatcacaatgaagaacaaaacattttcaacttttaaaaactaaaagagggaaaatttaaggcagaactaaattaagtagcaataaattagggctggtttagttggtggtttccaataagctctacagccacttccttcaccaagtacatgagtgttgcttcagcaatcattcctttaattcatgtcctttctctctctagaaaaactcatatattcattatcctaggagtatcaggtttgcaaagctggaccaaactaaagactcttcgaggtgcactttggcttcttaaaagagctaccaagattttggctgaggcatgtgacttaaaactcagcaggtatgattggcaagctatcctgtgaaacttgtaatcaatcaccatcggttttagtgaattgtattatctttgttcttgtaaacactttctttcaagttatcattgcttgtgattgaatcatgagctcttagatttctaagggaacagaaaacctatgaaacatttgaagcacttttgaaaagaaacttcgtggccagaaactcaccaaaacctgaggaaatcttttttattttgaaataaaagaatgcttcctttgtgtttctgtccttgaatccagttgttttacttgagattatagcaaagtcttctctgtcttttatataatgattctttaatatttgacctattcctcttcccccacctcatttatgagttatgtctattccatcttaaacattctcaggttcttaactgtatctgctactgtaaatggtagtttagtttttgttattttgattttttttgtttattttggtttttttctagctttattgctgtataattgacaaatagaaattgtgtgctacgagttgatgtgtagctattcatatatgttctgaaatggttatcacaatcaagttaattaacatatctattactttatgtagttaactctgtgtgtgtgtgagtgtgtgtgtgtgtaatgagaatatttaacacctaccctattggcaattatctccctattttcctttcccccaaccccacccttctactctgtgctgctataaatttgactattttagatttcacatgtaagtgagattatgcagtgtttttttcctctgttggattatttagcttagtatcatttccttctggttcatacttgttattacaaatggcaggatttccttctttttcaaggctgaaaaatactccaatatatttgtgtgtgtgtgtgcatgcacgtagaatccttcatggagtcatttatccattcctccattaacatttaggtttccctgaattggctattgtgactaatgctgcaatacacatcggggtggaggtatctctttgaggtagtgattttatttcatttggatatacatccagaaatgaaactgctacattttatgagttctaattttattttttgaggaatttccatactgctttccacgttgactgtattaacttacattcccaccaatagtttacttgggttttcttttctccacatctttgctaacacttgttatcttttatctttttgttaatagccattctaagaaatgtgaggtgataactccttgtggatttgatttacatttccctaatgcttagtgatatgaaacatttgtttcctatacctgttggccatttgtatgtcttctttggagatatgtttagtcaggtcctttgcccatattttaatagggtttttcatttttttcactatggagttgtatgtgttccttatatattttagatatgaaccccttatttgatgttttgaaaatattttctcccatttttcaggtgtgtttttatcctattcattgttttgtttgatgttcagaagcttcttagtttgatgtagccccactagtctatttttgcttttgtagcctgtgtatttggtgtcatataaaaaaaattgccaagaccaatgtcaaggacatttttttctatgatttattttactagttttacagtttcatgttttatatttgcatatttaatctgttttgaggtagtttttgttcagtatatggtataaaataaggtttcagtttcactcttttgcatgcggatattcagatttcccaacatattttattgaaaacaatattccttccccactgtgtattcttggcacccatgtcaaagattagttgagcatataggtgtgaatttatttatgggttctctattctgttccattggtctgtgtgtctgcttttatgccagtacaatactgttttgattactatagttatgtaatacagtttgaaaccatgaagtaggatgcctccagcatttttttccttgctcaagattggtttgactattcaggatttcttatgtttcagtataaattttggtttccaaatccaaatactgtttaatatagtgaacaaatctttgttttctttctgaaaccatctttccaatatatctcagaagtcagtggtcttaatgaattggtgccaccatctttccttgctactcaaatatgtgttacataaatttgaaaattatttgaaagaaaatggccaaatatatctccttcatatttctccttcatgtgtttttttatcctgaaaataaaactgcaagagggaaaaaacaaggaacaagcaacaataaagaaaaaaaaagaagtagagactaggtaactaagagcaagataaaaaggtgagttttttcactggaggattggatgaaagaactaattaatttgtctctcagtttgagcttttcaagagttctttataagtccttcatactgtgacatgatctgttagccattttcactgtggtccccattctagaagcattttactctctctctctctctctcttttttttcttttttggcgggaatgggggatgggagtaggggaatggagcctcactctgtagccaggctggagtgcagttgctgatctcagcttactgcaagctccacctcctgggttcaagcgattctcctgcctcagcctaccgagtagctgggactacaggcacgtgccaccactcccagctagtttttgtatttttagtagagatggggttttaccatgttggcaggatggtctccatctcttgacctcatgatccgccctcattggcctcccaaagtgctgggattacaggcgtgagccaccgcgcctggcagcattttactctctttcacatactttcttatatttatccttagttttttgaaaatataagagtgacattataaggaaaacttaaattgtgagtagctcctagtagaaatggcctcctacttgacttttctctcctgttttgcctcaaatcattcttcctggttaattgagtatgatttctaacatgaagaaacttgacttctggctattagcaaaaaacggaaattttttctctattgttatattatcatatggcttcagctcatggcaacacattttcactttagtcaattctaacagcatttggatttagcagtgaaattgtttgcatctttcattgataattttttccaaagcagtgtaaaataaaatgtggttttgatctggaatcactttttcctacatgcacatgcacacccacccacacacacattattaggtgctcacatccttacaatggcacaaacaactttgcactgaaccctttactagtcacttacacttctcttgacttgaatattctgcttatttatcagtgtaatggtttttatccaaataaagtaaaacaatagaattcaggccaattagcctttatatccttgttgaaaatatttaatattacaaataattttgtttttatttagtcctctttaaatttgtctttcactgtataagacaggcaatatattcatgtttatcatgtcaaaaaactgaatcaaatgttaaagtgctttaagaaagcaacagtatgaaagctgatcaagcccactgtggtctgcatcttctttatatgatatactgcctttcagaattttggagatgttattaaaaaatcaaatttttgaggtcattgatggcatagcatgtattacattctttatctcttcagttactagaactaaaacactagatcgattttatatgtatgtatgaattgataatctcaaatttttacatttttaatttaaatatttacatgtttaaattttcatctcttttctgctttttttcccaaaatatattgtgttccttagttctatgtttatatttaggaatgaataattgaacaaactaatttaggcagcttgagtggatgtcctcttcacatacttgcctctaccccagaacatgagaagtaactgtcagtaattattggcaagtattagttttcagagatgtgagcaaggaatggacatgccctatctccagcctacgtgtatcctcaattaaaaatgatttggattctgttccatgtctccatgcccactcttggatccccaattttgggcagacagatcgatcaatttctttagaatatattaatctggactcagcatgaaagaaaataccccattgcaaatatggcttggaaggcagaatagtttatctaatttatatacccatcttctcaaatctgagatctctgtaaataccaacttccaaggactcttttgtgaagagcagctttctccttcactgactcctttttctgctaagtctatgagcatttcagttcattcctaaatgtgatatcatttgccttcctactgcaaggaatgtctttgtctcctggtatcttccttttctcctattcttaatagatttatgaattattctctattttaatgtcttgtggttacgggaatctcatggaagttgacacatttctcaatatgtgttatatgttggatcccatcacattgctcaatttgcatttcataattgtgtctttggtacttgttcatcttcattgtgttcctagcaagcaaaaccatccccttagcctaacatcactgtaacataaataagcactcccctagtttctatgcatccccaaaataaattcagcttcatgtaaatatgactattgataaagatgtccacttattgaatacacttatcaaaagatttttctggtgtaacatggatataatttctgtcttaagaactctaattctaaagaaacctgtgtatggatttcacctttaggccttagtttaaacttatttaaatttgtcttcatagatcttaccctctcaagctattctgttttatgacaaagaccaacactaaggttttttatatttatatatgtgaactgaaataacgttctaaaatattttaaatcctacaaattagtttctttcattaaacagaatcctttctttgtgttggacattaattcagtgttaatgtgaatataattgtcatggattaatattaaatatttgccaatatctccctttacaacaggattttttattaaagtgtgtggatgtctttttttctttataatgtcttaaaaagaagaaaactttggtcatactataaaagttgagtctgataatgttttattatctgggaaaccatttaaaaatagtttcattgttattaaaatgacatctgggttacatgtgaataattattaaaataattatagaacaacatgcatttgtgaggaataatacaaagagattctgtatacactttgcccagcttcccccaatgacaatattttgttaaactatagtgtaatatcatgacaataatattgacattttacagtccgtccaacttactcaggttaccccagtttggcttggactcatttgtgtgtgtatgtgcacatgtacatgtataaattctatagatttttattaatgtgtaggtttatgtatctaccatcacagtcaagacactgagaagttccatcaccacaggaattccctatgctaccgtttgacaaccatgagaaagcatttttaatatatctatttttacatttgggaagggtcaaaagtcctttcattagcccagctcctgtccagataatttaaattaatgatgtctgtgttcttgtatggatggcatcactgcttgaaatatagatctccagggtgctcctgctctcactctttctgagccatgatctattgcatgtctgtacatcatcaaagcaaattgcttcttcaatgatgtgtaagtataatacatcatcacaatgggacatggtgataatgcattacccagaaaaagatgactgtcatatttgacagacaaggtcaaggagcaaattcaggcagccccagcacatttcatcagcagcattcttggtatagaagaaagtttgtttgcttagaatgatccacttgaaatgtggacaaggctaaatacatacgtatgccctgggttgattcctttggtaaattaaaaacgaggtggttgagcttccattaaaatgacatctggatgacatgtgaatagtttttctgtccacagggtgttttgaatcatgtgtgtttcttactcattcagcatcaaattgttttccagagaaagctcttcaacaagattgcaaagtccttcagggtagtaactgtcttatacatcctttgtttctttcacagtgtctaaagcattgctgagcacatggaagacactcaataaatactcgtttaatggaattgaatttgtaagcaccagagactcatgcttccttttcacatagcttgacacttggctgcccaggatccttgcatgcaaggtggtaaggttactgtgggaaaattctgttggcttactatcccatttgctgtctgctctttctttgtttcttcctcctttttttttttttttttttttttttttgtagagtctttcagccaggagctatttttataaagaatttcattttttgctcatgaggattaaacttttaagtttggcttcagggtgtgagagaagtacaacttatgaaggttgctctgcactgcaaaaaggataggatttgaggaagggatgtttctgacattggcacagcagtattccgttctcccccatcccccagttgctgccaaattggcctttctttaaagcatacagtatttatttctctagtccttggatcatagcaattttatttcaatgtcaccagtgaaggagagaaaggcaatattttgtccaagagtgggatttgaaaatgagtcctctgaggatatgttagagcaacctaagtattagatgctggaaaaatggatcatttcttgatatttcggtaggacacatctccatttcaaatatatgcatgctacaatgcagtgaatacatagtgcattttagtcagctctaaaagtaaccaagccaaattttatacaattgatacagacaatgggtgttcaagtgggaatacatgttactggctctctgccggcatgatgaaatagaggaggcaaatagatacagctcacgtgccaattctggttgctcagtcacagttatatcaatatcatgttgataaaagttataaatcagggatcaatttgcaacatctaccaggggcccaagtagaaacatgtggtatgcatgacagttatgaatcaaccctggtggaggaaaaagatggagagtcatggaccatacgcctaacaaagtaattgtacctggtccaattttggaccatgagtaaaccatttaataaaaatatatcatagaattgttttgagattacattttaagttgcataagctataatgtttgttatgattatgctaattgtatatatcattagagaaaataatcactaaatattttgaaacaaaagaaacaatgaatttaagtaataaatataatcccactcagccagagacgacaagttattgatactcttgtagatacatttattatataaaaacaaatatattatgtgatttatattttatcttacatattattttaatatcgatatttttctctcataatacacctttaatatatttcaatttcaaaagataatttctgaaaaactgtttttatatttgcatggtagttaattatatggctatacataatttttttaaacaaacacctatatttttacattgaagaaggatctaaattttgtatatgaatcatactcatattaaatatttttgcaataaaaatgtttctacttctttagtaaaatcccaaaggctgatatattggatcaaatgttctacagatttaatgggatttattcagtacttaaaaggaattgtattaaattaaactgcacaaagtctgtgccaaattatgcacctgcaaacaaatgtatctgattagaaggcagtgcagtaagttcttttaaaaggcttgttttttaaaaaatgaattagctccaaaactatttatatattaaggaacaatttgagcatgacacaaatttcttgtttgcctatgtgttacctcatctttgagaaacactaggcggatgcacaaaatggcacctggcagaacaaagccatgtagcaatacataaaatgtaagcataaacaaacctcaaacatccaacagctacttcagctcagcacaggtgtgatgagaccacccatctatatctggtgttacagctttctgtctgatttcagataattcttatttcaccactttgcaattcctcccaagctgaaaccctttcaatactcacttccacaagcaaaccttagtttttcttcaaaaaggaagtgtcatatttcttttatgaaactatatatttctttaccacttaatatggataaaagtatgctactatttttattaggttcctatgattttcttctgtgtatgtcactgaaaaagtttttgactattgtttcccaacaccagtctccccataagccatgtaatttttttttcataaatttgcatcgcaaggtgaattttaggaatacatcatataacggagctgattctttatgtgtgtatactttctgaaagattccctatgtgagataagaaaaataaaaagcgttttccttgctctcatattcaattcaaatttatgaaccagatgtattggttccccgtgacacacaacaagcagctaattctctaacagataccaactgggtatactataacttagctcaattttgacactatctacctagaattattatcagatgctacaggttaagcactcagtctcataggactaacctcaatttaaaatgccaattgcaagcctggggttttgacctgtgcttctgagtgattggctataaatctgagttcccatcaccccttcctcagattcagctaatttgctagagaagctcaaagaacttagggaaacactttacttagtttacccattcactataaaatacattacaaagaatatagatgaacaagacagatgaacaggtgcatttttaaaagagccagggcaacgtatgaaagctatttacccaccctcccaggcacctccagggaaccccgacttttggattttttatagaggcaacattacatagacgccattgattatatcatttgtccttggtgatcaactcaaacatcactccctctctcttccctggagggttggggtggggctgacaactccaactctaattatgccttggtccttctggtgaccagcccagtcctgaagctatctaagggtcccaaaccaccaatcatctcattaatatgcaaagacacatcactctagaaattccaagggttttcagagctgtgtgacaggaaccagggtcagagagcaaatggatagttcttattatatcataatatcacactccaataagtcaacacttgcctcattcaagactgattctaataaagaatgataactattatttttcactacttaaagagtcagacctatgtggaagttgcactaaatccagttacaatttattccaccacgaagcttggaagctctatgacccttaatacaatgttaatgtgaaagttttatattgtctgcaaaccaaaaactatctgagactggtctcaattaatttagacatttattttgccaaagttaaggacagtgcttgggagacaagactgtgtctttctccaaagatgattttgagggcttcaatatttaaaggggaaagggcaaatgctggagagagagaaagacatttttaaaagctgtgggtagttaagaggcaagcagttgcattcttctgagtctttgatcagccattcacatgtgacagtagggtagaaaaatcgtcacttatgcattcatctagctcagtgaatctacattttttacataaaataaaataaacttaaggctgaagaagcaatcagataagcatttacctcagatgagcgaagtgaagactttgagttctgtcctttgtcctgtatttgtgaagacaagctatcaatgtacatggtcagggtaaaattcaacataactgtctcaggataaagatcttggggcccacaaggaatttgctcttgggaaaattatgagggagctatgtagctttttcatgtttttagccatcttagaaacaaaatgggaggcaggttgcatgacgcagttcccagtttaaattttccttttgactgagggagtttggaatcctgagatttattttcctttcacatattttgctcaatttattcatgaactgtgattttattcaaaattattttattttcaaattcattgcattcaaataatcataaaatgtgtacctgcattaaatgaggcagtgttgttctttttcttccttcatttacaaaagcttttttccacttttttcattgaataaaaaagaaacttagttatggctaggataaataatgtaatatgtgactattttgccagttatgtttcttctactgtgaatagcctatgccataaataacccatttttcaaatgagcaggcatttcttctattattagtttgcatgagctctttaaatatatcttatgtagcaattttcagttggttagatacatgagtttatccctagcttttctaatagcactatttccaatgttacacacacacacacacacacacacacacacacatacagcactcacttataagttgagtgaactccaggtaagataaaccaaagaattccatgccaagagacatttacaaatcttgaagagccagagaaaacccacaccgtacctttagagataaataatacaaatggcagtagatttcttatcagaaaccatggagtcctgaaacaagtggcacaatgcaatgctgaaagaaaaggccttttaattgagcatcctagacccagtgaaaatgtcctcccagattgaaggggaaatcaagccattctcagatgagaaaacattaatttgttattatcaaacctaccataaataatggctaaagaaatttgttctctaaacaaaggaaatgacgttccaaaaatcttggaacatctgaaagaaagaaacaatacagtaagcaaaacttttgtaaatacagtaggatttgttgagttttctaaaatatgtttgatggtagaagaaaaaattataactttgatgtggttctaaatgcatgcagaggaaattttttttttttttttgagatggagtctcactctgtcacacaggctggagtgcagtggcaggatctcggctcactgcaagctccgcctcccgggtttacaccattctcctgcctcagcctcccgagtagctgacactacaggtgcccaccaccacgcccagctaatgttttgtatttttagtagagatggggtttcaccatgttagtcaggatggtctcgacctcctgaccttgtgatccacctgccttggcctcacaaagtgctgggattacaggcaggagccactgttactcagtaatgcgatggctgggtcaaatggtattatttctagttctagatccctgaggaatcgccacactgacttccacaatggttgaactagcttaccgtcccaccaacagtgtaaaagtgttcctattgttgtttcctgacctaccgtctggcactccccagtgagatgaactcggtacctcagttggaaatgcagaaatcacctgtcttctgtgtcactcacactgggagctgtagaccagagctcttcctcttcggccatcttggctcctcctcaatattagaattttctatccttttttgtgactcatttttctctctgtgttaactacattctcttcaactacaagcaatttcctccacgtggctgaaaaaggtgactgcagtcaggtctatatcgtagtggtcatttattctaagaacacttatggtttgtaaggtcaagttagtgacttgattgtatatgaagtagagtcaaccccacacaaattacatgaaatgagagcgaggggatttttccaaagatgagaacaatggacatgcttcatgtctatttgtgtcttcagtcagtcagttttcagcatgtaatgtacattcccttcagagaaaacaaatgaactaacattttaaagactggactatggagaaaataaaagctaatacccaacctatttgtttttacatttggatttctccccattcatatgttgaataggaaatttcacgtttcttaaatagatttttaaaaagtatttaaaatacgatttcctcaaatctttgcacgtattttttctggttcattttgtttcacatgctagagaaaaataaataccagctacaaatatgaagcagaaattgtctattgagcattggtatcaaattttctactgagaacactgaaaacattatctcatttaaatatatatattagagtcttaggatggtcataacaaagtaccatagaccgagtggcttaaaacaacagaaatgctgttggatcactgttctggaagcctgaagtccaagttcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgcctcgagttgctgacagggcaatggtccctctggtgtatatagaggaacccttccttgcctcgagttgctgacagggcaatggtccctctggtgtatatagaggaacccttccttgcctcgagttgctgacagggcaatggtccctctggtgtatatagaggaacccttccttgactcgagttgctgacagggcaatggtccctctggtgtatatagaggaaccttccttgcctcttcatagcttttggcagttttctgcacacctttgctgtcccttgaagctgcaaaatccagcctcttcgttgccacattgttccttccttgtgtgtatattggtcttctcatggccacttcttacaaagacaccagtcgcattggattaggaaccgtccttactctggtatgacctcatatttaccacttacatccacaacaaccttttctacaaataaggtcacactttgtaatactgaaggttaggaaacactgggtgtttggacttcagtatatctttttgttgttgttggggggatacaattcaactgataatactgtggggctaatataactcacattttacagatgaagaaatttgtgcatattgagtcatttacatagtatcacaagtaacagagccaggatttaaacagattccatctaccactgaaaaaccacacacagaccagttattcacctcactacttcctgcagccgataactgttttccattgcctgaatagggtataactgccaaaaataagaacaagaaaaatgtatgaaacaagaggactttcatagcaaaagagacagccactgtatagaacccagcacactgcatttttcagaacaaaataatagatattttaaaatgaatttgttagccaaatagaaagtaaagtctggggcaaatatctctaccacatagataatccactgatgacttacagttcagttggacatataaaatatgatagaacttttcaataattatccttaaactctagaagaactttgaggagtccttgttcatattgcttttctgaatataattaataagattattaagatcagtctgcagcagtttccttgtagatggaaaagttaattctcagttcagggtataaacgagaaagaacataattactattattggactaattttcctaataaagttaggcttgctagcccttagtacaccattgttaatttatacacatgttgatgaaaggcaagataagtaaagtctagtgagtttggaatagtttagaggtccccctcaacttttaggtatgtgaaggggatttttaatgaatgcttttaagttaacaaggaaaagaagggactgaatgatcagttttttgtattaggtggtctgtttcccactggaaaagttgttatgtggctaaagagcctggtttaaataaaaacaaacagacaaatttatgcagaaagttaacgaagactaaaaaccccagtgcccattgtgctgggacagcagatgccatcagcagatgcactggagtttactccagttctttactgagcccaactatataatggctatgcacatttaaatactttaaacacaaaacaggtaataaacacgagtggattgaaacaatgggcaacatgtgtggatatgagaaagtggagcgtgtgagaaaaagtcttttagagctaaagtgcaagcctcttctaaagccattaaaatcctttttgttttttctttttgagatggagtcttggctgtcactcaggctggagtgcagtagtgtgatcttggctcactgcaagctccgcctcccaggtacaagtgattctcctgcctcagcctcccgagtagctggaactacaggtgtgtgccactacgcccagctaattttttgtatttttagtagagatggggtttcaccgtgttagccaggatggtctcgatctcttgacctcgtgatctgcctgcctaggcctcccaaagtgctcggattacaggcatgagccaccgtgcccggctaaaatccatttcttacccctaacatgctgtgctagaaataaaaaagcaactctgaggccctaatcagattccgtagtctaccaattcgatctgtcatcttcagaactctacactaaacttctccaacatataatcacagaaacaacacaatagttacaacagcatgaatgttttctatatcatttcaagtcttccacaccataaagtcactaagaataggaaattcatatttacttatacttgcccattctcatttctaatagaaaaataatatagcaaaatgatttgaatgcctacactttcacaatactcactgacttatttgtaatatgaaacaaaacaaataaaaactaacctagtgacccattcatatatgcatgctttctaaaaggttttgtttttgtttttaatgattctcatttgcttaccacatcagtgttgcaatgttagtcatctggaattctagaaattgggggaaggaaaaattagaacacctaccaagttaagctaatagaatagtattttgtaatagaaacctaaaggtacatagaagatagatacggttttatcaaaataaactaccaaaactatactaaggatagggatggagaaaggaacgaaatcaagctttcaaatgactctggagagggtggttggaaaaggctgaaaatcattcagtaacatttctgaacatatatattcatacagaggaaataaagaaagtaaccctctaagataaaagaagctaggagtgttaactgctataaatatgtgaagagaaagaaacatcaagaaaagaagaatttttaaaaatttcgtggactgggaggagaaagggagttgatatttaaaaagacattaggtccatggagggtgccctccagatgttcccaagtcttgggcattcagactctaatcctttgtatgatgcataggaataaattagccagcctcttgttacccacagtgtgatttgtaaagcatcagcttcaaggttatcctggagcttgatagaaatagagacctggcggtgtcactccctgcttaacaaatgagaatccacattttcagaagaccccaggtgattcctatgcacatcaaactgtgaagagcactgagccagactacagagtgcaaagccctgttctaagccacagtgatgctgactctcctcaccattttctctctcaaggtcctgactgtgggcaaaatatagaatcttagagcctggattatagcagttttacacaagcagcacactgatggaagcagctacagaggaaaagagaactggcagctcttgaactttcaccctctttcagaattcttaaaaattcagagagctgttctttaaagagacatttttctctcagcagttgaatctttgtagtctgacttgtgagaggacgtcaaagacttcctctcaggagtcagttccctgccattgcacccagctccttgcctagccttcttccacatctcctttatcacaggggcctcaaaactatagatggcagtgacttggcacggaccatacaattctaaaaggaagtcaacttagtgttatacttccacatggaatctgcgtttctaaagtagaggatagcattgaatataccaagaagtttcttcccagaaacaaaaccccgttctggatatagtgttaagaggaagctgttcctgtttcatgaggtcgtaatactcagatcggtgtgctgtcatcagccctgttgaatacatttccaaatcctttaggcttttgtcttttgccatactctagaaagtaaaaactataatcaaactcattttcttcgcccctttacgtgaattaatgttataatcaattgaactgcatggacatgccagtatctattttcaatctgtgtaggcagaatgaagaaagcataattgagcggtgctcatcttttaaaggcaaaatgaagttttcagtttggaattgattagttgttaggggattaagacctttgaggtaattccctgcagctggggcagttagacggcaggggatttgagtttccgccttgtaaacaaatctttaaagtggatttgctatttctgtggggaggggagcctctgtggaatttggtagttggcaagatttggcaattttctgcttgggaagaaaacaagatgggtctcaaatctaagtcctctttttctcagatcaacatcaccttttgaaaaataaattgattctttggccttaatgactactaaaggaaattaaaaacaaacaaacaaaacagaagaaaaatgattaaagaagccgggcgcagtggctcacgcctgtaatcccagcactttgggaggccgaggcgggcagatcacctgaggtcaggagtttgagatcagcctgaccaacatggtgaaacctcgtctctactaaaagtacaaaaattagttgggcatggtggcgcatgcctgtaatcccagctactcgggaggctgaggcaggagaattgcttgaacccggggggtggaagttgtggtgagccaagatcttgccattgcactccagcctgggcaacaagagtgaaactctgtctcaaaaacaaaaaaaaacaaaaaaaaaaaggaaaaatgattaaagtaagaatgaaaatttagttaatgttatttaggacagtaaaagcagatgtagtcacagaaagacaatgtgcagatgattatatggaaagaagaatgtgaaaccttcagatctctttaaaattttataatagctttgtattttcaaataaattgcaaagagtttctatacttgtatctagtttcccctattaacattgtacattagtgttgtgtagtgttttaattaatgaaacaatagtgataccattgattacgatttcatgaagtctgtagttcatttagagtcctttagtttttaagaagtgtcctttctctgttccaggatctcatccaggataccacattacatttagcagtcatgtctctttagtcgtctctttactgtgagtatttctcacacttctcttgtttttgatgattttgacagtttggatgagaattggttaggtattttgtaatctacacatcaactgaggcttgattgatgtttttctttaaaatatttttcccatttgtatacatgtgtggtatacaagtgcaattttgttacatgcatatattgcacagtggttaactcagggctttagggtatccatcacttaaatgatgtacagtgtacattgaagtaatttctcatttacccccccaaccccctcacccttgtgggtctccattgtctattatccactctacatccatgtctacacgttttataacacccacttatgagcaagaacatgcaatatttgactttttgtgcctggtgatgttttccttttgattaaactgggacacacatttatgggaggaagaccagacagataaagtggcattcttatcacatcatctcaagggcatacgccattgacatgacttattgctgttgatgttgaccatggacactgggctgaagtagtgtttttcaggtatgccactgtgaaattatattcccctgtttacaatactgtatactttagacataggttattatgtacaacccacacttaaaaagtggggagttatcttccacctccttgagggagtgaagtagtatctacataaattatttcatattcttatacaaagggtatttgtttatttcatttatttatatacttgtcttgatacaatgtaaatgaatcactacttatttatattattataaacatataaatatctatagtatagtttgggttacaatccaatacttattttgttactcacattgttcttgctttgaccactgggagatctttcagttggttcttgtaatacaccatttttaaaagcaaaatggagctaagtgtggtggcgcatgcctgtagtcctagatactagggaggctaaggtgagaggatcgcctgagcccagaaatttgagactgctttgagagctatgatcacatcactgcactccaatctgggtgatagagcaagaccctgccccagctaaaatgaaaacaaaaaacaataacaatgctacatgggaagtgagcatgacaatgtggtattttataattatatccaaagattagtaagcatgattcatggagaagtggctaaatctaagcattgttttcccatgagattgctgttggaaaagcaatagaaaaaaaaaaacaaaaaacaaagaattgagtgagtcaagagataggaagtctttcagttaccttagagtcacgttaggtatgtagagaagcagttcagattaacaaagttcaaaagatcccaccgtcagatctgtataacaagctttgcacacgaaagagctagagtatctgtgactctgatgtaagaaggtattaacccagtggaaaataaaaacaaaattaaaaatgcctaggtagactcatttatggttttatagtatccctactggggcacagatgggaagggagaaactgtttttaaataaaatgatcagaaacttagactgtgacattaatttgttggttcagtgttttaatttggaggtaaattatactaaacagtattatgacattttctgtagaaagtcttctacgtgtattgagtcactgcctgttatattggtttaatcagcaagtcatttttgctgaatctcttagtctccactaatattgtcttgaaggtgtaaatggcatgcaggttgcctaaataaagctacaacattctgtaaggcattttgtgaatgaactacttttgcagatggtacaggtgttcacccctgtaaactcacaattattttagaagtgatgtacaggttgtcagttgtccccatctgcctcattccccacatgcattgtcacctttgtgtcaatccagatctcattagctctttgtagacaaagatagaatggtagataatatataagtaaatgtggctgtgtttttgctcttcaagagaatgcacaagagactcactcttaattcttactatttcatgtatgtgcagcctcttaatgcttactatttcatgtgtgtgcagcttcttaatgcttactatttcatgtgtgtgcagcctctacaactacagtgcatctctattgtttgtacagtgacaataatggtaagaataataacttagtacataccatactgcagaaactgtttaaattacatccaatgtgcccatttaatcatcactttaaaatagtaactcctactcagtagcaatgtgcagtttatagatatctttcacatttgaagatatgaatctcagtgtacatatattggtatgcaaaaaaatcagttatatacatgtttagaccacttatattttaatcccaccaagcatatggaaagcttaaccttatgggtgtgtgtgtgtgtgggtgtgtgtgtgcaggggttctctaaacttaaaacctgttgtggatgcacatgaaattatatacagtgccaagaaggggcacaggccctgctcagtgagtcatctgactgcacgagttaatagatataacgtgaagggtcacagttctctatttgggtttttttgtacagcctctgtttctctgtctctacaaagcacgtagcctttttttcaagtctcgatgcctctttcacagctcagccctgggcctgctatcctgttttcactgcttcccttcttttttctacatgactttttattttactttaagttctgggatacatgtgcagaacatgcaggtttgttacataggtatacatgtgcaatggtgatttcctgcatccatcaacccatcatctatgttttaaggcccgcatgccttaggtatttgtcctaatgctctctctccccttgttccccaaccctccagcgggccccagtgtatgatgttcccctccctatatccatgtgctctcattgttcaaccaccacttatgagtgagaagatgcggtgtttggttttctattcttgtgttagtttgctgagaatgatggcttccagcttcatccatgtccctgaaaagggtatgaactcattctttttatggctgcttagtattccacctacatgcctatttctgagtcaagcacgttgtttatgcccagtgcattttctttatacacagaggctgagaaagaaccaggaagcctctgactgtttcaagtgtgttctctgctatatctatctactgattcaataagcacaagctcattgaatggaaaagggcaatatgcaaagggagcaaaatgagacatatatgtcaaaggaaagttccactgcaaatgtctttatttgatgtacacagagggatttgaattaggtctaggttttatgcccactttacagaaaaattgaaacttgatcaaacctatagaaccagtaaatgtcaggaccagacctggagacacactcccctcggtgcatattttatatcttcttcattttatcaccccaaatcatttactcctgaagtaaattcatttaatatttaacaaatgtttacaaaagttgactatagtaaaagtattatgttagctgctatgaagtagaaatataatcacacgattatcttaatgaagcatctctactttatagaagggaaattgagattctgaatcattaaggttttaagtgtcatcacagggattgttagtgatagaatacagagttgagtctagggcttattaaactgtatctgtcactctattcgtgtattagtctgttctcatgctgctaataaagacctacccaagaatgagtaatttataaaggaaagaggtttaatggactcatggttccacatggctggggaggcctcataatcatggcagaaggcaagggagaagcaaagtcacatcttacatggcagcaggcaagagagcacatgcaggggaactaccttttataaaaccatcagatcttgtgaggcttatccactatcacaagaaaagcataggaaaaacccaaccccatgattcaattacctctcactgggtccctcccacgacatgaaggaattatgggagctacaattcaagatgagatttgggtgaggacacagccaaaccatatcaattggcctatttcagtttgagaacatacatctgaatttcaaggaaatttgactacaattgaagaaattgagtatcattactgatttctaatggatgttgctgtatgtaatattttctatatgagagacaagatgtaaggatgaagatgagggacaagttcttcatctagaaagatcaagggtgctgtcaaggaagagttgaatttgattcagaactgaagaatatttgggctttcaactagctcagagaaattctgtagtcactagaagatccttgcatttgagagggcaaatttgaatatgttccacaagtaaaatcagaaattgggctttttattttactaaccagattaatgctctattccagaaatgcaaataggttgtacttttattttaacatggggctacttttgcctactgttttgctggtttttgttgttttattgcaaaaccacaattactgttacacaatggaagctccatcagtgaagatactttatctactttcttcactgttatattatggggtaaaaaagtgctttgcgtatgagaacaagtaataatgaaactggttacttttggcagagtctgcgttatacataggctcttttgtgaagatctaaatatggttatgtaatcagttgttcagacaagagaaacgtagattaattgaattagataatcccagtggtctctcaaagatcaaacaataaaacaaactattatcgtaccccatttgaagtacttttgtataacaacagcgttttaacatgtttatttggattaagattatcagcgactttggaagtcaattaagtgtgaaagcgaaacatggtatttgacgacagtaccagccctgtattgctgcaaatacattctataatagcactggacgcatcattcagattttatgacaagatgcaataaccagctacctgtgatgataaaatagacttttttcaaataagatttctagcaacctttactatgcatgttttctttgttgtcttgtaacattaaccatggacatcacatggcaagcatgatgaagagaatttctttagaatcgagttttataacaaagaatgtattccaaagtaaggatttatgttggtggataattatgagccaggccgactactatgaataacttacatcagggctagggttggagaaaatgaggagagagtagtacaattaaatgatcaatcataactagtctatttgtttatacaataatgaaaaatagtagtttctattggactgaaatgtttcaggtaaaattgatgttatatcaaattaattaaataataaatgtaattgccttaaatcaatgcatgcttaggattaatactgattaaaaatctaaggatgcaaaaagatttataacaaaatgacagtaacagtggtctttcctcaatctctttttctcccaaaagcaaaatctgtttataattttaatttttatgagagctacttatataaaaatgtagacaagaagaaattattttttctacttgtgcatctgaaagtatcttttcttttctttccttccttcctttcttccttccttccttcttctttccctccctccctcattcctttcttccttcccgcctttcttccttccttctttccctcttttctctttcacttccttcttctcttatcactcctcccaaatttaaaatcatctgtccattgtctttgtcatccagtatagataataaggaatctgatggtcttctcattaatagtgaacttgctgtttttctctcaaaaatgagaaagcttttgggagcttctttttatcttaagtgttctgaaatttcaagacagtatgcctgggttctttttaaattccttttgctggatactcaggtttcaaatcagaaggtttatgtccttcttcatttctgcaaaattatcttcaattatttcttgtactatctattcttcatctgtgttcttactgagataccgaatcatctgaatttgttccttttttgtatttttttctttcttcatattttataagaattattcagctttattttaaagtcctatttttattctctaagtgactattcttgtatttaactttttatagcatggtctacattttaatggttgtcatatatttttgaatgtttatttacagagcatcacttttaaaattgttttctttccataaattgggtctgtttgttttggaacaagcttttccatgtatttttctttttcactctctttagtgatctccagctgtcaattcatgttgtagaaggacagtgatgttggtcacagattccccaaatgctaaggttaggtgagaaccagcatactcatcaaagatcttcattttccccaaagacaaaatgcagtgcttttagaaaaaaattaattacttttgggatgttatttccctcatgataaacatggttgccatttacactctctactgctttgagagagaaatttctgtcaagctgtgaaattggtccacacacagcacttcaattaatttcagtttttgaccctcattgtcttctcaaaacgatcagcaccttctcaatctgaagtcacaggatggcagaggttctgcttagcagactctcccactttgaattgcagtgttttgttttacctctttcatctattttccaatttttagaaatttgttgactttttttgtaaactttttttgcatttgcacttctacatttatttatattattacttttacttctgtgggatctcagtaatgaaggaaacatatatgcctaggttaccatattgaattcaacatagagagtatgattttttaagtaaatcctgaaagaaaactttctataaatctacaaatcctcttgaaattttctttttatatttatttgcaaatttttaatttcttgtatttcgtaaactgagaattttagatacttttacatttgtagcatcaaaaataattttttaaaatgatgacatacttagagtcaatctattgggattgagtgtatttttaaaattagaattgttaaaatagtatttgacatttgctttgcttctggtactggtaggctagtttgctgcagaccaactttcacaccaaaaatctctagaaaaaaagacacaaacttcttatctcaaaatatccatgtttcagcagaggttagctgagttttgctgtattcagggtgtcattgggactgcgatctcgtctgaagcttgaggtcctctcctacacatgttcaggttatcgttccttgtggctacaggactgaccaaagttgtttcctttctggctcttggccggaggatatgtcaagcttctaaattatgctcacaatcccatgccaagtgtcctccatcataggacttctcacaacatagaagactgctttgtcttcaagacgagcagaagagcatctttctcacattaaatctgacttatcttgtccctaacctcttgacagcatttaataaaagctaaattcgttagatcagactcacactgacctaaacataagattaataaggatcagctttctattggttaatttaaagtcaagtgagtaagatgctaattacatctgtaaaccgctttgctatataaaataacaatcttggcagtaatatcccctcatattcacagtttcctcttacactcaaggggagatgattatgcagggtttatgcacatggaaccagacatcttgggagtcatcttagaattctgcctaccatgaagtctacataaccaaaaccaggagaaagaaaaagaaaaaaatatatagttcatgggaaatccagatattggggttatcttaagtaatttcgaaataaatatttaatatgttaagtattttaaatgttttaaatattcaaaaaattagatggccatggaaatgttcattagagaacagaaattaggattgctagacttaccaaataaacatatagagttccaagttaattttaaatatcaagtaaatagcaaatactttatacaatatatcgcatgaaatatttgggatatatttatactaaaagtttattgttactgaaattcaggttcaactgggtgccctttatttgacaacactaactgtaaactatcaaaataaataaaatttttgaaccttaaaatataacaaatacaattaaagactcaagaggttcaaagcacaacagactagatatgactagatataattgacaagaggatgagtaaagtgctaagtaggtcagagacaacatatactgaaaaacagagagaaaaaaatggaagattcagaaaagcataagaaacacatacgacatagtgaataaatgtcaaaaatatttattgtggttcagaacagaaaaagaatggagaaaaagtattatttaaagaaataatggctagggatattctaaaactgacaatagaaaacaagtaatagattcatgcaacactgcatttattaagaaggataaattcaaataagccatacctaccacatcatggaaaatagtaaaatgaaaaaaaaaatcctaaataagctagataagaaagtgtcatactacctttaaagttgcaacaatattataacacgtttaattgatttactataagaaacattggaaactagaagtcaaaaactgtgatccttgaatttttcttagggggcaggtaccatattgccaaactagaattttattcctggcaaaaacattctttaaaatgaaaagacaaataatggagaatgaacttgaaattgaacggtttagaattacaaagattttttcccctatttccaggtgagctcaacagccaattaagttttattataaaaaataaagcagcttatatctacttgaaaaagtgaaggcaaaattaaaatgttttcatttaaactaaaagtcataggatttatcactagcagaactacactaaagagctcttcagccatcatgagaatgttttgaaatataagcagaaaggaatgaaaaccagtgaaaaggatattatgtgggaacatctaaaagaatacttcccatacaaagcaacattattaattacatagtttcatgcacgtccgtgtgaagagaccaccaagcaggctttgtgtgagcaataaagctgtttatttcacctgggtgcaggtgggctgagtccgaaaagagagtcagcgaagagagataggggtggggccattttataagatttgggtaggcaaaggaaaattacagtcaaagaggggttgttctctggcaggcaggagtgggggtcataaggtgctcagtaggggagcttttgagccaggatgagccaggagaaggagtttcacaagacagtgtcatcagttaaggcaggaacaggccattttcacttcttttgtggtggaatgtcatcagttaaggcaggaaccggccatctggatgtgtacgtgcaggtcacaggggatatgatggcttagcttgggctcagaggcctgacattcctgtcttcttatattagtaagaaaaataaaatgaaatagtggtaaagtgttgggacagcgaaaattttgggggatggtatggagagataatgggcgatgcttctcagggccgcttccagcgggattggggctggcgtgggaacctagagtgggagacattaagctgaaggaagattttgtggtaaggggtgatattgtggggttgttagaagaaacatttgtcatttagaattattggtgttggcctggatacagttttgtatgaattgaaaaactaaatggaataagagaaggagaaaaacaggtataaaaggtctaagaattgggacgactcaggacatctgattagagagtccctaaggagattcagcatagtcctgccagcaaagattatttacttcaagagttaagagtggcagtttggggatagcaccaggagatatcagctgtgatggcttggagaaacagtgtaaaccggcagtgtaaacaagagcagggcatgtatgagtagttgagaatggtgaataggagtatgactagacagaagatagtagggatgactagttttttggggcacagtctaagttggtctggtgtctggaatgagactggggcctaataaaaaggagcgtctatacaggagctcaaatgggctgtactttgtagcattctgaggacaggtctgacttctgagaagggaaagtggtaaaagtattgtccagtcctttttaagttggtggctgagcttggtgaggtgtgttttaaaaagatctttagtctgttttacttttcctgaagactgaggactgtaagggatataaaggtttcactgaatactaagagcctgaaaaacttcttggctgatttgactaataaaggctggtctgttatcagactgtatagaggtgggaaggctaaactgaagaattatgtctgacagaagggaagaaatgactgcggtggccttctcagaccctgtaggaaaggcctttacctatccagcgaaagtgtctacctagaataagaggtattttagttatctgactcggggcatgttgagtaaagctaatttgccagtcctgggtgggggcaaatccttgagcttgatgtgtagggaatggagggggcctgaataatccctgaggagtagtagaatagcagatggaacactgagaagttatttctttgaggatagatttccacgatggaaaggaaatgagaggttctaagaggcgggctagtggcttgcactatagcatagcctgcctttgctgatgtgtggcgattaggcctggtggaactgccatcaataaatcaagcatgatcagggtgaggaacaggaaagaagaaaatatggggaaatgggataaatgtcaggtggatcagagagatacagtcatgggggtcaggtgtggtatcaggaataatgtgggaggccggactgaagtccgtgccgggaacaatggtaattgtgggacttaacaaagagtgagtacagctgaaggagccgggggagcagaaagtacatgcatcaggtatgaggaaggaaatagattttggaagttatgagaaatgtagagagtaagttgagcatagtttgtgattttgagggcctctaaaagtattagggcagcaggagccgctgcacggagacatgaggcctaggctaaaacagtaaggtcaagttgtttggacagaaaggctacagggtgaggtcctggctcttgtgtaagaattctgaccgcactaaccatgcctaggaaggaaaggagttgttgttttgtaagggattgaggtttgggagattaatcggacatgatcagcagggagagcacgtgtgtttttatgagaattatgctgagataggtaacagataaggaagaaatttgggcttgactgaagtaatgggggctgtctgtgaagctttgcggcagtacagcccaggtaatttgctgagcctgatgcgtgtcagggtcagtccaagtgaaagtgaagagaggctgggatgacgggtgcataggaatagtaaagaaagcacgtttgagatccagaacggaataatggattgtggagggaagtattgaggataggagagtatatgggtttggcaccacggggtggataggcaacacaatttggttgataaggcataaatcctgaactaacttgtaaggcttgtctggtttcaggacaggtaaaatgggggaattgtaaggagagtttataggctttaaaaggccatgctgtagcaggtgagtgatagcaggctttaatcctttcaaagcatgctgtgggatgggatattggcgttgagtggggtaagggtgattaggttttaatgagatggtaaggggtgcatgatccgtcgccaaggagggagtagaggtatcttatacttgtgggttaaggtggggggatacaagaggaggacgcaaaggaggctttgggttggggagaagggcggcaatgagatacagatgtagtccaggaacagtcatggaagcagataatttagttaaagtgtctcggcctaataagggaactgggcaggtggggataactaaaaaggagtgcttaaaagagtattgtctaagttgccactagagttggggagttttaagaggtttagaagcctggccgtcaatacccacaacagttatggaggcaagggaaacaggcccttgaaaagaaggtaatgtggagtgggcagcctccgtattgactaagaaggggacggacttatcctccactgtgagagttacccgaagctcggcgtccgtgatggtctatggggcttccgaggtgatcaggcagcatcagtcttcagccgctaagccgagaagatctgggaaggagtcagagagccttgggccagagttccaggggctctgggagtggctgccaggtgagttggacagtctgatttccagtgggttcctgcacagatgggacgcggcttatgaggaatcctgggctgcaggcattccttggcctggtggccagatttccggcacttgtagcaagctcctgtgggaggaggttctgggggaacgcctggctgctgtgattcaggcgtttggaagttcttgtgtgctggagatgtggctggggtttgtctcacagtggaggcaaggaattgcaacttttttctattattgtacaccttgaaggcgaggttaattaaatcccgttgtggggtttgggggccggaatttaatttttggagttttatttaatgtcgggagcagattgggtaataaaatgtactttgagaataagatggccttttgaccttttagggtctagggctgtaaagtgtctcagggttgctgccgaacgagccatgaactgggctgggtttttcatatttgatgaaagagactaaacgctcactgatttgggaaaggtctgataaagaaaaaggagcattaaccttgactatgcctttagcttcaccacctttttaagagtaaattgctgggcaggtgcgggagggctagacgtgcaatgaaactgtaagcaggacccggtgtgaggaggggaggtgataaaaggattatagggtggaggagccgaggctgaggaagaattgggacctagctcagcctggtgaggagcagcctggggaggaggggagaggtcagatgggtctgtagaaaaggaagattagaaagactcagtgacacttggggttgggactgaggggacaggcgggagggaaagaaggaagattgggggcgagttgcactgggtacagagactagggagggactgatgtgtaaaagaatgcctggacatcaggcacctcagaccgtttgcccattttacaacaagaattatttagatcttgcgggatggaaaaattgaaagtgccgttttctggctatttggaactactgtcaagtttgtattggggtcaactggcattgcagaggaaaataagatgcttagattttaggtcaggtgagagttgaagaggttttaagttcatgagaacacaggctaagggagaagaaggaggaatggaaggtggaagcttgcccatagtgaaagaggcaagcccagagaaaagagtagagacacggagaaggggtcgggggttcttgccctccagaaaagcagagaaggggttggggcacagagatattaggtcagggtgcagaaataagggatcagggtgcagagatataagaggtcggggtgcagaaataagggatcagggtgcagagatataagaggttggggtgtggaaataagggattggggcacagagatataagaggttggggttcctgcccctcctctagaaaagcgggacttgccgctaagagtgaaggagaaggggttggaggtttcttgccccccagaaaggcggtgaaggggtagagacatggagagaaggggttgaggtacttgcccctcccctagaaaagcgggacttgccgctaagggtgaaggaccaaggcaggtgtccctgtgtggtctgacacctctgaaatgtgggtgaataatcaggcatccctgcaatgattaaacaccaagggaaggctgccttcccagtctgtgacaggcaccggagttttgggtccatggataaaacgtgtctcctttgtctctaccagaaaatgaaaggaattgaaattaagagaagggagagattgaagtgtggcgccaagattgaaaggagaaagaggctgagggatagtgagggagattggagaagagagtaaaaagaggctgcttactagatttgaaattggtgagatgtttcttgggctgattggtctgaggacctgaggtcgtaggtggatctttctcacagagcaaagaacaggaggacaggggattgatctcccaagggaggtctcctgatctgagtcatggcaccaaatttcatgtgcatccatgtgaaaagaccaccaagcaggctttgtgtgagcaataaagctgtttatttcacctgggtgcaggtgggctgagtccaaaaagagagtcagtgaagagagataggggtggggccattttataagatttgggtaggtaaaggaaaattacagtcaaagaggggttgttctctggcagacaggagtgggggtcacaaggtgctcagtagggaaacttttgagccaggatgagccaggagaaggaatttcacaagacaatgtcatcagttaaggtaggaacaggccattttcacttcttttgtggtggaatgtcatcagttaaggcaggatctggccatctggatgtgtacatgcaggtcacaggggatatgatggcttagcttgggctcagaggcctgacacataggatttaaaatatggagagaataagaatacatggcaacaatagcataatagatggagtgaaattgagttaacatctaaatgccttgcatttttgcggaagctttaaactactatcttatattagaaatgaataaggatatatatcgtatgtttaaggaaattcaccatagaaaacaaaaaggatgtactatataatagtaaactaatgaagaatgtaataatgaactactctcaatataaaagaaataagtaggacaatataaaacagataggacaatttattttattttattttactctaagttctgggatatatgtgcagaatgtgcaggtttgttacataggtatacatgtgccatggtggtttgctgcacctataaacgtgtcatctacgttttaagccctgcatgcattaggtgtttgtcctaatgctctccctccaattgccccccaccccctaaaaggccctggtgtgtgatgttcccctccctgtgtccatgtgttctaattgttcaactcccacttatgagtgagaacatgcagtgttttgttttctgtgcctgtgttagtttgctgagaatgacggcatccagcttcatccatgtcctggcaaaggacatgaactcattcttttttatggctacatagtattccatggtgtatatgtgccacattgttctttattcagtctatcattgatgggcatttgggttggttcaagtgtttgctattgtaaatagtgttgcaataaacatacatgtgcatatgtctttatagtagaatgatttataatcctttggctatatacccagtaatgggattgctgggtcaaatggtatttctggttctggatccttgaggaatcaccacactgtcttccacaatggttgaactaatttacactcccaccaacagtgaaaaaacattcctatttctccacatcctctccagcatctgttgtttcctgactttttaatcaccatttaaactggtgtgagatggtatcccattgaggttttgatttgcatttctctaatgaccagtgatgatgagcttttattcatatgtttgttggctgcataaatgtcttcttttgagaaatgtctgttcatatccttggcccacttttggatgaggttgcttgatttttcttgtaaacttgtttaagttccttgtagattctggatattagacttttgtcagattggtggcttgcagaaattttctcccattctgttagttgcctgttcactctgatgatagtttcttttgctgtgcagaagctctttagtttgattagatcccatttgtcaattttggcttttgttgcaattgcttttggtgttttagtcatgaagtctttgctcatgcctatgcagataggacaaatttttaaaaaattcatagaatagtccatttaaactcaaatagttcagctattacattaagttaatatggacaaaatcctgcaattcgtaggcaaacaatttaaaattgaatactgaaacaaaatgtaactgtgttctgctgataagagatgtgtctttaatacaaaaataagaaagactgaaagtagaattacggaacatgataaacctaatcaaaacaaagcttgtaattctaaagaaactatactgaaaagcaagaaatatttatacataaagtttgaaattttataatgataaaaagataaaacaacagaaaaagatgacaaaaataactttgtaagcatttaataacctaatctcaaaatgaataaaacaaaaaagtacaaaataaataaacaatagaagaaaaataatgaatagctacatttacagtcatagttgaataatgcagtttttctcagtaactaaagaataagcaaaagatgattggataaattaaatatgttatatacatataatgaaatataattttgcaataaaaataaatgaagtattgatacatattacattaaacataaattcaacttgaaaactaagtgaaaatccagtcacaccctagacaaaaacttacaaaaagatattgtaaaattccatttttatataatgtatgtaataagtaagttcatggagttagaaagtattttggtgcttgcctgggactgatagatgaaggtgggggaataatgagaatgactgctgatgaggacaagtgtttccttttaaagtgatacaaatgttccagagtttgatgatggttgcacaaatgtgtgaatgcaataaaaaccactgaattatacactttatttgataaattataaattatttatccataaaactgcaaaaatgattttttaactaaaacttgcattcaatctcatccacctgtaaatggcattaaaattattttcagttcagtatattctagaccagtggttttcaaccaagcctaactttgtctcacaaggaacattcgtaatgtccgaagacatatttgattgtaacagtagaggtggagtgggtatttgcattaactaggtagaagccagaaatactagtaaaaatcttacagtaggtaagacagctttcaaccaaaacaatacaaaacaaaacatgtaactgccccaaaatatcaatagtgcaaaggttaacaagccctcttttagagacattgatctctattcctatataatttttaagcctcatggtaatagagtctatcttggaatgtgaatgaagcataatgtaaacattacaagcaacaacatgtcacatttttagaatttacatcattcagaataccccttagtatcacctgaccccaaagcttagaatgattttgccaattttgcaaatatgaaaacttagattatgttattctttttctaatgggccaagaaaggtataacactacactgtcactttttttttacttctatactaattactttctgaatatatatagatatctaatctatctatctatctattcttttaccacttaaaaatattattttaatctgtttaaaactaaggcctagcattaagagatatacctaatgctaaatgacaagttaatgggtgcagcacaccaacatggcacatgtatacatatgtaacaaacctgcacgttgtgcacatgtaccctaaaacttaaagtatcataataataaaattaaaaaaaaaactaaggcctaaaaataagaagtgctattttgtctgacagcaaaataaataagtagtttttaaaatagtaagctgaagtttaataattatgttaaaattatagtaacttttttctgcagtaattatttttgataaaaattaatgcaattacatgacataaaattaagatatagtttagtaagaaaaacacaaaacaataaccattgtagaatgaaaataagttttaatatatgaaagacttaagaatcctttaatacattaaactgactgatactagtgttctttgctgaatcataggtaacatatttattgatttttaaaatagggttagcgtagaataaatgaaatttataatttaatagtcatcaacttcacattcattttgcataccacaggagaaaaaaagaggctcagaaagattaagttctaaggataattgattttaaaattggggccagaattaggactcaaacgcatattttctgaggtctagccctttgtatattacacccttgctgaagactaaattcgagtgtgtgtcttattggcagtgagaaggcagatttgccaatatgtagtttctaaatcttgcatttatttctatacattttaaatttaatttagaaatagaacagggagagtaatgttagcaagatggtcaatcagagttgtttggcactcatccccacaaaaagggttgtggggttcccctccaacataacaaatgaacaactatatttcagtggaagttactgaggaagtatgctggggaacataaggggagtgaaaaaatccctgtgaagcacagaaactcaggatagaaccataaaagaagagggagacacacaaactctaccaaattgttccctcactgggattggctcatagccaggaggggctactgcttatcgagaaaaggtaagctggagacaccagttgtccccattactactgcagatgcctgcaggctgctacgggagggtcctgcaagcctcacagtcaacaaattctatctggggagctttctggagttcacatagctgtgttgccctatactaggagcccatttcgtatacccaccaactcccgtgacctaagttggaactgcatagtaccatcctgaaaccagactgactgctagagtatgtcctactctgggggccagtagccactgtgtctctccatccctgaggccccagcatcattccaccatgctcacaaggaaggccacagaactacaaccccagctactttaagcttaggcccagtggaatggcccaaatccatgcaacatcccctcctccctgggaaacaggcatatctgcacagcaagaaagccaacaagcagctgattggcctgtggtgcctgtgtgcctgacccaacaggaaggatggcagcagccccacccattgaagaacccacctcagagttggccagcccactatacctatgtaagccatgcctgacagccagactaggggtggccctgcagccctggaaagtccactacatagccagctggcccaccatgcaagtctgtctaaacagtgaggctggtagcgttgcccctaacaaaactgagccattacaatcacaaactcctgtagcctaggccactgatgaaattgcagacatcattgatgagaattatagctaatgaaactgcagagaaccacacagaaccaaagataatggatcatactcaactgacatcctagacacacctataggaaaaagtctctccttacaaaagttagcccgtaaagttggaaaagataactgttccaccagatatgcagatatcaatgcagagatataagaaacatgaaaaagtaaggaaacatgacatttccaaaggaaaataataattctacattaacagccccccataaaaaaatttatgcaattcctggaatttaaaataatgattctttttaaactatgagatataagagaatatggacaaacaattcaatgaaataagaaaaataatttattatctgaatgagaaattcaacagagggacagatataaaaaaagaacaaaacagatatcttggagctgaagaattcaatgaataaaagaagtacaactgagaggtttaacaacatactagccattttggcagcatatgtatttatgatttgtatagaagaaacagtttctaaatttgaagacagttcttttaaagtaacctaattagaggggagaaaaagtaaacaaaaataaaaagcaataaagaaagtctacttatgggacaccattaagtgaatgaatatttgcattataagaatgccagagggagaagatataaagaaaggcagaaatattgaaatagtatgtggaaacttcccagtcttagcaaacatatgaacaaccagatttagaaactctaagactcccaattagattacaacaaaaatgatctactccaaggtacattataatccatctatcaaaagtcaaagacaaggcaagaattctgaaaactgaaatggaatagtgtcaagtcacatataagagaattctattatactgtcagcagatcaatcattagaaaccttgcagcccagtagagaatggtatgacatattcaaagtgctgaaagaaaaaaaaaatactggcaaccaagaatactatatcagcgaagctgtccttcagcaatgaaggagaaataaaaaccttcccaaataagcaaaatctgagggaattcatcaccactacactagtctttacagaaatgcttaagatgatagtgctacaactgaaagtgaagataattactattatggaaacacatgaaaatataaaactcaccagtagagggcagctcataaccaaaatcagaatatcccagtgctataatagtgctatgtcaatcttttaatcttctgatataaagtttaaaaaccaaaggggtcaaaaaacaacttctacaattagtcattaagaaaaacaatagataaagacacacattaaggcaacaaatatataaattacagggaggggtcaggaaaaaatgtctagagtatttttatgtgaccaaaattaagttgctctcatcttagaatagtcgattataactacaagaacctttatgttagcttcatggtatccacaaagaaagaaattacaacaggtacacaaatgagaaagggaaaggaagcaaagcttagcacagcagaaaaccacccagccatagtagtaaataataaaagagaaaaaaagaacaaagagtctatacaacaatcagaaaacaattaacaaaatgtcaagggcaattcattgcctctcaataataaccttaaatgtaaatggattaaattcttcaatttaaagattgcattgttgaaaggattttgaaaaactaagaaccaactgtatattgcgtacaagacactcactattaaagataaacccagactgaaaatgagaggataaacaaagatactccatggaaaagaaaaccaaaagcaaaaggagtggccatatttatgttagataaagtacactttaagtcaaaaactgtaaaaagagacaaagaaggtcattatatttaataaagggagaaattcaacaaaaggatataccaatgataaatatatatgcacacaacaccagagtgtctaaatacataaagcaaatatcagatctaaagggagagatagactacaatgcaataatcacaggaaatttcaacttcccacttttaacaatagataggttgtctagatataaaatcagcaaagaaacatcaaacttaagctccaccatagtcaaaatgaatctaacatatacttacagaacattccctccaataattgcagaatataccttcttctcagttgcacatgaaacattctcaaggacacaaaacatgtttcaacatatttaaggtagagagtatatcaagtatcttttttgaacacaatggtataaagctagaaatgaacaacaagaaaattttagaaactttacaaatatgtggaaattaaacaaattgcttttatatcaccaatggatcaaggaataaattaaaaagaaatttaacaaattccttgagacaaatgagaatgaaagcacgtcgtttcaaatcctatgatatacaatgaaagcagttcaaacaaggtaagcttatagtaataaacacctatcacataaaaagaaaaagctttcaaataaacaacctaacgatgaacctcaaagaaataggaaagcaagaaaaaaatatataaattggtagaagggaaaaattaataaagcctaaaacataaataaatggacacaagaaaaacagttcaaaagatcattgaagagaattgttgattattttggaaaaaataaacaaaatttacaaaccttcagccagactaagaaaaaagagaaaactcaaattagtaaaatcagagataaaaaaagagacaatacaactgatactacagacatacaagagatcataaaagactattgtgaagaattttacaccaacaaatttggtaacctaaaaaagaaaagataaattactggacacatacaacctaccaaaattaagttgaaaatcataacagaccaataatgagcaagaaaattgaattagtaaaaagtcttccatcaaagaaaagcccaggatctggtggcttcactgatgaattctaccaaacattttaagaagactaataacaggtttttttgaactattttagaaaattaaagaggggagaatattttcaaattcattttacaaagccagcattacattgatgtaaaaacaagacaaagacacaagaaaaaaaataaataaactgcaggtcaatacacctaacaaacatagatgcaaaaattcttaacaaaatgatagcaaactaaattcaacagcacatcaaaaagatcattcactatgatcaagcgggattcatcctagggatggaaggatgttttaacataacatacacaaatcaataaatgtggcacaacacattaacagaaagaaagacaaaaacaatgtgatcatttcaatagacacagaaaatggatttgacaaaatttaacatccttttataataaaactctcaacaaattaggttcagaagcagtgtacctcgacccaataaaggccatacaaatgacagactcacagctaagatcacatttaatggggaaaacccaaaagattttcccttaagattagaaataagacaaggatgttcattttcactacttctattcaatatagtactggaagttctaactagagcaattagacaacagaaataaaataaataaataaataaatatagattagaaaggagaaaggcaaaatatctctctttttacaagtgacatgatgttacagaaggaaaacactaaagattataccagaaaactgttagaactaataaacaaatttagtaatattgcaggacagaaaatcaacatacaaaaattagttgtgattttatagacaaaggttaactatttgaaaaagaaatcaagaaaataatttcatttacaatagcaacagaacagaaagataccttggaataaaccagaggcttgataggtatttacactaaaaactatgaaacatcaatgaaagaaattgaagaggacataaagaaatgaaaagataaactctgtgttcatgggttgaaagaattaatattgtttaattggccatattacccaaaactgtctacagatttaatgcaatctatatcaaaataccaatgacatgcgtcacagaaataattttttaaaaatctctaaaacttatgtggaaccacaaaagacccaaaatgtccacagcaatcttaaacaaaaagaacaaagctagaggcatcacattacttgacttcaaaagacatcacctaactcccattacaatggctatgattaaaaagacaaaagaaaacaaggttggtgaggatgtggagaaaagagaactcttggtggtaatataaagtagtaaagcaattacaaaaaacaggatgcaggttcctaaaaaagttaaatgtgggaccatatgatccacaaattctactgaatatatacatacgaaggaaataaaatcaatatgtcagagacatctgcacttccatgtttattgcaacactatttataatagccaagacttggaatcaacctaaatgttcaacaaatagtaaatgtatacatatttacacaattgaatattattcagcaataaagaaatgaaactgtgtcatttcagaccaaatggttgaatacggaggactttaaatgtattcgtctgttcttaggctgttaataaagatatacccaagactgggtaatttataaaggaaaggggttttattgactcaccattcagcatggctggggaggcctcaagaaacttacaatcatggcagaaggggaagcaaacacgtccttcttcgcatggcaacagcaaggagaagaatgagtgcccagtgaagggagaagcccttcacaaaactatcagatcttgtaagaactaactcactatcaccagaaaggatgggggaaaccgcctcccatgattcagttatctccattggttcctcttacaacacagggtattatgggaactacaattcaagaagagatttgggtgaggacacagcctaaccatatgatatcatgttaagtgaaataaataagacacagaacgacaaacaccaaatgatctcattcagatgtagaatctaaataaatacgttgctcttacggaagtagatagtagaacactgttttaccagagatgatttggaaggggaaaatggagagaggtttgtcaatgggcacagagttacaattaaatagaagaaataagttctgttgttcgattgcatggtagggttactaaggttaacagtaagttgttgttaaatgaatttttgttgttgttttttttttttttttgagatggagctttactctgtcacccaggctgaagtgcagaggtgcaatctcagctcactgcaacctccgcctccccagtgcaagggattctcctgcctcagcctcctgagtagctgggactacaggtgcatgccacgacacccagctaatttttcatatatttagtagagatgggtttcaccatgttggccaggctggtttcgaactcctgacctcaggttgatccacccacctaggcctcccaaagtgctgggattacaggcgtaagccaccatgcctggacattaaatgaaatttaacctaaagctgcattcttacatattttaagttgagcctaagagtctcttcctacatagtgaactgtaacctaagtggatgtgtaaccagattataatttaaccttgtgccaatcactgggtttcagctaatcaaagcagccagttatccaaatcgtgttcaaataaggcaaacaccaagctgtaaccaatctcgctgtttctgtgtctcacttctgttttcagtacttcatttttctttttctgtccataaatcttctacgtggctgcactggagtcccctgagcctactctggctcagaaggctccctgctttgcaaatggttctttgctcaattaaactttattaaattgaatttgtctaagatttttcttttaacattacaaaacagctaggactgatgtctttgaacattctcatcacaaagaaatgataaatgcatgaggtaatgaatatgctaactaccctgatttgatatttatgcaatgtatacatgtattgaaaatcaaatggtaccccataaatatgtacaaatataatgtgtcaatttagaaaaaggaaaaaatagaacttgggaagaaatatatcttctaagaagatggcattttaggaaaacaatctctactaaacttattttcaaatgtttataaattgcataatttactttgaaagaggtatgaatgacttaaaattcagagtatcaagacttctaagttattaattgatatgtaaatacatatgctacattatgaaatataacatgttaataaatatatacctattgaaaaagtgtatacgtttatttctaagaaatataaactctagtacaattctattcctatttgaccagatgtctcctcacaacctaggtgtttgttttaatcatctctcttcctgctagactaacttgacatgtataaattctctactaatgcaattaaactgacctgcgtaagagacaaaatagccaatgacaaatctattactaagatcttgcattagtgtggtacatttgttacaattaaagaaccaatagtcacatattattttaactatagtccatggcttacattaattttcattccttttatcatacagttctatgggtgttgatatacaaactgcatatacctacagtttcatgaaaaatagcttcacctgtgattcacctatttatcctttctcttcctcctcacaagcctctggcaatgactgattttcttttttttttttttttacagtctctatagtttttctctttctaaaatcccatatggttaaactcatacagtatatagacttttcagatgggcttctttcacttagcaaaatgcatttgatgtttccctgtgtcttttcatggcttgatagttcattttgtcttcttgatatgccattacactaatatatcatagtttgtttatccatttgcttactgaagggcatcttggttgtttctaggttttggtgattataaacaaagccactgtaaacaggtttttgtgtggatgttagattttcacctcactcaagtaaatacctaaaagcataattgctaggtcatatggtaagaatacgttatgatttataaaaacctgccaaaccattttccacaatggttgtatcattttgtaatcttgtcagaagaaataagtgttcctgttgctgtgcctccttgtcgatatttggtgttggcaatgtgttgggatgtgatacatccattctaacaggtgcatatttcattgttgttttaatgggcagttcacatgtgtattttttttccttttctacagccgtattattccaacacttccacttgttgaatcgatggcctatgttgcttcattgggacggcagaaccaggtcttgaccataaagtaagtctttaattccaggcttttatatatgggagaagagtaattttttaaatccacaagaaatccttcacatattatgaatatatatggggcattatgtcaaaccacagtgtgaagggagaacatgccatctggagtgggggtttggaggcaccgggaaatgcctctgctttgaggagtcgtcgtccaggatttgagagagatttaaagtttattgttctagagaaggctttcattacccaagatttccccttccccaggctcttagccacagaagaaggggcgaggaggcagcaaggtgagtgagttgataggaaagggctgaaggaaaatgcttgaaaatactgtcagggctctggttgcttgagccttgcctcccactactccaccagcagagagcagcagaagagaagcaatggaatgggaagagctcctctataacttgtggaggggttcatttctcataggtgccatgggttctgcaaccagcaacacctgggaaagcagcatcttattctaagtcagagagaggctgagtccacttgccatgtccaagtggggcacctttgttctcactcgcagaaatatatagtatgagcctgtagtgccatagatggtagatgaagatggtctctacagacattggtcagtgttagctctcctcagcaggtatatggcagaaacagtcagcagacgtatggtggaaactcagaaaggacaggatcaatacacagaaggtagtggggaatgaagaatagggctgactggggacagtggttcatgcctgtaatcccagcactttgggacgccaaggcgggaggaatgcttgagcccaaaagtttgagaccaacttgggcgacatagtgagaccccttctctataaaaaacaaaaacaaacaaacaaaatagctgagggtggtggtgtgtgactgtggttccagctactcagtaggctgaggtgggagtatcacttaagcccaggaggccgaggctgcagtgagccgtgatcatgcctctatactccaaactggatggcagaattagtaagaccatgtctcagtaaaaaaaaaaaaaaagtaagaaaagaataaggctcagggcaaaagtaccatggcagaggctggtggtggacattaccaatgtgggagattaaagagtcccagaaagccagcagagtcagcaagattcaagatggaggcctagtcattgggccatctggctaagctccatgaacactattattgtctatccacacccttgcggatctcaggaacaatcaacacacgacagtagctacagacacatcagtccagacccagagagaacagaacttatgtccataactcaagtgacatatggtgttctccaatcagaggtcacagaagcaagccaaaatgaacatggaggttgatagagtttggatatttgtccccatccaaatctcatattgaaatatcatcttcaatattggagataaggcctggtggtaggtatttgagttatggaggtgaatccctcgtggcttggtgctgtcctcttaataatgagttcttgagagctctaggtgttgtaaagtgtggcacctcccctccgatctcactctgttcttactctcaccatgtgagaggcctgtccccccgaccttctgccatgattggaagcttcctgaggcctctgcagaagctgagtagatgccagtgccatgcttcctgtacagcatacagaactgtgaaccaattaaacgtcttttctttataaattaccccgtctcaggtatgttttatagcaatgcaagagcagcctaacacagagatccttgcttcttctatgagaatgagtaaacttaccttgaatacggtaacacccaggaaaagggcaaagaggaggtagaagggggagaaacctgaaataccaagcagttatccaaatgatgctgaggttacctgaaataaactgttttatactggaagcaacagaaatatcttgaagagatccattcaggatttttgtctttctccccaatactgagcaagaaaaaataatagcaaatacttaggcaacatttactatctaataggaactattctgcgtgtttcaaatatattaacctatttaatccttacaagaaccctgtgaaattattatacccatttcacaaatgagacccacagagattgagcaaattacacaaagttatccagctagtaagtttcagagccagaatttaattcaggctcttagccacaatgctatttttaagctttgtttctttttattttatttagaaacatggtctcactctgttgcccaggctgaagtgcattggtataatcatggctcactgcagcctcaaactcctgggctcaaacaatcctcctgcctcagtctcctgagtggctgaaactagaggtgtgagccactgagcccggccagccactatgctatgttgcctacctaaggcataataaacccagtgacggaaaataaagtttttgtggtcattgttttgttgttacacatatgaattgtagcaaatgcaccatgatccctactatagaaatgcaagagaataatttcaataacaacgataaagattggtgcgtagatgtactcaggttaatgggggcacaagaaagagggaaatggatttgtaaatacattcctgcagagggtaacacatgagctgggtctcagaaaaagagatctgtggttctgaaagttgactgtgtgctagaattaacaggaaggctttgctaaaacatgaaatactggggaccatccagagtttctgattctgagatctaagctagagccatatcacttgcatctctaacaggttcctaggtgctggtgacacagagggatcactcttcgaaccagagttagatggaaaagaacattgggaaagaaacactgggaaagaaagcaggttgagtggaggattaaatatgattagtttcatgcgcgtccgtgtgaagagaccaccaaacaggctttgtgtgagcaacatggctgtttatttcacctgggtgcaggtgggctgagtcggaaaagagagtcagcgaagggagataggggtggggcctttaataggatttgggaaggtaaaggaaaattacagtcaaaggggggttgttctctggcgggcaggtgtgggggtcacaaggtgttcagtaggggagcttttgagccaggatgagccaggagaaggaatttcacaagacaatgtcatcggttaaggcagggacaggccattttcacttcttttgtggtggaatgtcatcagttaaggcaggaactggccatctggatgtgtatgtgcaggtcacaggggatatgatggcttagcttgggctcagaggcctgacagtatgaagcaaggcaaaggagagagaaagcagaagttgggtaatgcttagtggtgtgaatttggagcagaaaaataacatgagccaatgtgtaacagaattccttggaaacctcaaaaattctgtttaaatgtgataattttaaagctaataaggcttaatgagaagaaaatagttctttgtgtataaacattttgagaaagagaatcaaaagacgctgaaatgcttcagtctgtgcacaaatatctgtgaatatctgtacctaacagaagttttatcttttgcctcttccctctctgctccatgcacaaacttactcatggtgacactccatccactgatgatgtctttttttgtcaaataaaatgttgaacattcttgaaaaaagcttgaagggactatcactgcccttctatatctagtgacgtctttttgttcaagaaggtaggttcactctgtgtaaagttttacctggacttgaatgtgagattgtaacactgccaacaaaagcaacattccatgtctcgaattgaaatgtaatctgtcaacccatttaaaacaaaaaaacaaaattacaacaaatttaggttagatatttaattggcttttatttacaattcatgaatgtgggcagcatctcattttataaaatagaataagaactccgatgagcttgttggatacagtgagttctaaacttctcttcaaagaatcagtatgtcagtatgttcagttctttgtcctccattttaaagtttaacttcctcgtagtttcagtaagcaacctttcccaccagttttaatcagtagttcacatctgttcccctggtcacctgctctgacctgagtcatcccagtcacctgctctgacctgagtcatcccagtcacctgctctgacctgagtcatcccagtcacctgctctgacctgagtcatcccagtcacctgctctgacctgagtcagttttagtcaccggttctgtcccaccaaactgctcaccccgccactctggctcatacccctgctctctttaaaatacccaatcagaattagcttagactgtgcagtccaaccctagccaacaggggaacgacacagcagtaggggcaataagaaccccttcccctccctcgttcaggtgtgctctcgccattgctccaaccatgagtcgcaccctactacagaagtaaaattaccctgctgagagaaaattatttgtttgagcactagttcgtcttttcggcatcgaagaacaagcatttgtttctaacaagctgagcagaggaggttggctttgtaggcagaaaagagttgaagaaaacagaacaaaaagcagattagtcatttcaaagttactatcgatatagagttaaaacagggaattccttattacactggttcagataaactgggctgcccctgattgtttcctgtgaataatgtgggttttttggtttgtttgtttttgtttttttaatactggcttgtttcaaagttcagtttgattatgtagcacctagcatgagtgaatccgttctggtttgttatagtctgttggggctgtgaaaggaaactgaatcttagggtccccaaatcactaagcaaaagggaaaagtcaagctgggaactgcttagggcaaacctgcctcccattctattcaaagtcatccctctactcactgagataaaagcatatctgattgtctgctttggaaaggctcatcagaaactcaaaagaatgcaatcatttgtctcttacctacctatgacctggaagcccctccccactttgttttcccacctttgcttctagttgtcccacctttcaggaccgaaccgatgttcatcttacatacgttggttgaagtttcatgtctccctaacatgtataaaaccaactgtgccccgaccaccttgggcacatgttgtcaggatctgctgaggctgtgtcatgggggcacatcctccaccttggcaaaataagctttctaaattaactgagacctatctcagatactcggagttcacagggccaagtataggcacttactctaaaacaaggatttcataaatttatttcgtacagcagtcattgacatttgttcagtttctatgtatgttcaggtgcatgcacattcatgcacacaacaaactgaattttactttttccctctgactctactgattgtgtaaataattgaattggtagacataactgatgttttgggttttttcttattgttttttttgtttgtttgttttgttttgagacagactctcactctgccagccagggtggagtgcagtggtgcaatctcgactcattgcaacctccgcctcctgggttcaagcaattctcctgtctcagcctcccgagtagctgggattacaggcaggcaccaccacacctggctaatttttgtattttcagtagagatggggtttcatcatgttggccaggctggtctcgaacccttgacctcaggtgatctgcccacctcagcctcccaaagtggtgggattacaggtgtcagccacagtcctggctctgatggtttcttttcccttgagttgttagagattcttcattgagagaactttgagcagacatgtaaagaataaagttttcttttccatctgtctttttctctctgttcccactttaatgtttcaaaattgttttacattaagctactcattgcatacataaaatgatttggattaatgtttgtgtgtgtgtgtgtgtgtgtgtgtgtgtgtatttaattgtggaatgactcaattggttcagcaaaacaatttcatttaacaaagaactaattttttcttcaaatatattatattctttttttcaatttttgtttttaagttccaaggtacatgtgcaggatgtgaaggtttgttataaaggtaaacgtgtgccatagtggtttgctgcacctattaacccatcacctaggtatgaagcccagcataacatagagctaatcttaaaccaaactgccttctaacattctatcccctatatttgtatctgaaaaggttccattatattctttagactcttccaacatttgcctgctagaaatgagaaggtttttataacatctgatcctatgtatttatcactcataaatcagaaactcaatttgaaccctgtgaagtatggaggtttaaagcaaacctttatttaacattttgtatgtcaacatttttccaaacttgacctgccaagtggatttaatagcagatgactctggaacctgaacaagtgtttgctcttatatttcaactattagtattgaattaaagactacaaggtttggatcacatggcagacttctttgatgccttatgctgctgatgctggccaagaagaggaacatctgagtatttacatgtttatgcctggggaattctaagaaatctttggacatttgacaaatatgtgcctataccactaagcctaagattgcatccaaatcatgtgcaaataatttctcatagatgggaaaaatatactgatgctaaaaagatgtcatatgagctgtttaaaaataacagtccaggaaattcactttttgtgaatctgaaattatctctcaattatctcaataattgtccaaagtataagatcatctggggaatgatgaaaccaatgagagactccgtttaacatttcttgtgcatttccgatgagtgcaaattataccacctttttaacacattactatctccttttgttctcaaagcaatccactaaaatgacggccagtgctacttccatctctaattttctctcccatcagcctactcatatgtatgcatttggtggtttacattcatcaaggttatggggctgcttgcccgtagcttattctacctgcaaaataaagtattacatatatatatatatatatatatatatatatatatatagttttctatttccagcaacagtgatttattttaaagtagtttgtcatcagtcttacccttggctatcatgatatacatttgattgttctctctacttgcaaacttgccctcccccaacatatacgaatttaggtttgtattgataaacattcaatggtttttttaatcaagcatagaaatgtagaatacatctgaactctttagcatggtctacacgcaggttgccaaatcaagcaaaatatatacataataaatatgtatgcataagtgttataaaatgttacattttctacatttataaagtatacatataaatatatacatttaattatctatacacacacacagagttgattatcattatttgcagcactcatattctataaagttactgacagcactgaatgaaggaacacagaatcactgcccctagaggaaatagttgttactgagaacctctacttaaaacattttcataaatcaatcaatacacaaccttgtgttatgcatgtttctgtttgaatacactttattttatacatagtgtatttaacactattatagtattaattcattaatggttgaactcacagccaacagtatcataactcattcctgaatgaaggttttctagcacacattattttcttcataagacgtagcaccgtcttcttgcatttagaaagaactgcatttaaaaagcacaatgcaaaaagcaaacataacaacaaatagattgtgaaaaagacacgtgtagtatgcgagttataatttaagatcgtgttatttatatgtgtttttttattttaagctgtctccccaaggtccatgcttatatccatcttgtgctaagcctgatataatatctgatacatgaaaccttttaaaatatttgatgaagaatgaatggtttaaagaattaacagaagtggtgtgaggatatatgaaacaagagaatccttagttatgtatctaaacctagttactcattatttcatttattggctcattctccacatagttagggagtaccttgtgcctaggcactattcaaggctctaaaaatgaagcaagtataagaagaccaaggctcctgtcctcatggagcttacactctgctggggcagacagaaagtagacagaaaattcagttataacttacatcatcgccatgaagaaaacaaatcaatgtgtggaaagccagtgcaataaataggacactgacatcttgacactcctccccccaccactgtttcacaatgtgcagagtaaattaaacacacacaaacacttccatatatattcagttaattttcaccactctgtatgcagagaacagtgtaaatgacataaacagtgatagagaaaagcaattaaattcaaaataatcagtatgttaataatgtaactttttcaaagggtttttgcaaagattttaatttatttatgaaacacaagtttattgaatacattttatgtcaggcattcttataggcacagaggcagaaaacttaagattgtatttcagggaagggaaacattctaaacaaattccaatcttcaggcatctgatttagagcagcgagaacatgatatatgaatgtgttagcactctatatcctcagcatgttaatcctcatgaaactaagcctttagtaaagctcgtgtattaaacatgcctgttcttttaaaacaaatggcaatcctcataaacagtgtgtccattaacaaaaatccacctattttgatttttaaactccataaagctcagagtgcaacctgctgctgaaagttgactttttctctgttgcttgggacatatggattttgacagtagagttgtagaaactgtttagctatttttaaaccatgagttgctcattctcatgttaacgcttgagtatttcttacaggctaggtagggaaacttgggtgagatgtttgtgattaaacacataattttgacaagttacctaaagctctccttatgtgtttgtgctatagtccacaggtataatgcctctcctacttaaccatgtgtgtattacatgtggtatatttttacatgtggtattattatatatggtatacattatataggtattatatgtggtatatattatataggtataattatatatacatatatatcatataggtataattattattatgtgaatcagaggatcacataaaataatcatgtcatcctctgctggaaacaatgcattgacttcccactgaatctagaataaaatgtaacctccttaccatttcctgcaatacttaaccttctaatagccttgatcacctttccagcttctctcctttacattgtcccacttattctttcctttctggtctcacttgacaactttcagtctttcaaacagactgaactctttctttgccactagttctctctgcctggagtatttttacttccacttttcacatacttggctgttttcattttccagatttctgcttaattttcacatcatcagaaagaactgcacttattatttaccactgcaaaggggccctactccgattcattgtctcatagcaccctgctcatcttatataatgtttatctgaattgttttgctatgtttagacatttacttattggaggtttctctacagccaaataggctctaaatcccgatgaggaaaggagcatcggtgctttattcaccactgtatgtctactacaagtacagggtggacacatgaggggtcttaaccattacttcagtataaatgaattaatatataatgtaagggtttaggatctttcactactagcttacttcaaggaaagatcagggacactgtgttgagaagaccttacattgttcttggtttagccattgtgtctcttttactttagccaagttgttccgcatttttagattttgattcttatttgtaaattataaataacagatataattaatataaacacactatataatgtaaaaacataaggtgctattataataatcaataatgtattttaaaagcagataattccatggatcctcacatttccttatagacttctagtttttcatcaataaagcacaaaagatatagagtaaatgcaagaaaataaaatctctgtgaccctttttgatttcctatttccaatcctctttttacccctagtttagcaatgtctttattgccattctttatttctccaatggtttatgtaatataaaattataataataaacttgataaatttagttaatgaggaaatttatggaatgagtaaaaaatacaagtaaggaagacaattttttttaccacttctgaagactgttgttagttaatagaacaatatagttgaccctgggcagtgaaattatattcattgtccaatcacaacatctgatcaatggctcattaatatctaatagtaattacttatattgcttcacagttttttttaatctaaaatataaagttcttattgagaaaagaaaaacagataagacattggtcttcataatttccaatgttctctgttatccagttatttattcagggagaaatcttaggaaaatctatgaaaaattagaggaatgatactctttctggagaattaatttacctgctactgcttcttcccactatcctattagaggcataattgacttagacacacgggatatgccaacctcattaaacctgagagcccataatgtgcagaatcacagatctaaatagcttcttttaagtttccttatgccacatatttgtatgccatagaatactgcctatggtgggacgtgcttcttgcaggatacttggaggccatctgtttattctggcatgagatcctctatgacatttgaagacttggtagcacttagtttttagtttacttcccattaataaaaaaataaataaaaataagtttgctttctatttgtatcacatacataatcaacatttccatgtgtaaaacagaaggtatgagcaaatctgaacataattgtttagaacttctcctgcagctccctgggggaattgtgtctcaaacgccatcagtataggttatcaacaagatgagaattgaaaagcccaattagagattagaatagggatagctgataagaaacatgaccaagcaccccaaattcagcttgggaagtcaaattaaagtacagagggtgaagtggtctgcatcagctgccaatgaggaatggcaatatttaaacaatataagcaaggaactcagaattcattggccaattggaggtcaaaagcccaggtttggaattaggataagattttgctgtgaaagtgagtgtctgattcatcttcattctagacagacagttccaacactttttaagtctcaaagtccctttctattgatgcaccccaattaactatgaggaatcactgctctgagatctaattaattctaatgttggtttcagggttcccttctgtaccagcagtagtagcacatggaattttgtgggattttgacaaggaaattacattactaacatatcttgaagggattcctataacagtttcttgataccataacaggttcaggtcactaagagtcctgccaaagtccaggcatggtggttcactcctgtaatcccagtactttgaaaggccaaggcaggtggatcatgaggtcaggagttcaagaccagcctgtccaacatggtgaaaccccgtctctacaaaagatacaaaaaactagccgagtgtggtggtgcacacctgtaatcccagctattcaggaggctgaggcaggagaatcgcttgaaccttgaaggcggaggttgcagcgagcccagatggcaccattgcactccagcctggatgatggggcaagactccatctcaaaaaaaaaaaaaaaaaaaaaaaaaaaaaaaagagttctgcaaagacttcagtttcttaaagaaaaagaagatgtgttaatttgtatgatttgcctatttttttctgttgtaaatactcacagcatggtcagtttcaagttatcaaaaagttaaaattcctgaattcttcacattggtgttctctaactgattcaaacaggctctggcccatcactgctggttatacaaaccttctagaatgaggaaggaaattaacttttccaagatctccagattatgagataaggtcaatctccttcttttgtgtactgaatttgaacccggtctttcttagttgggaaattcactcttacatgtgttatctttttattctgctatattggatcttctctctcagctgacacattttcaatagctaataaacagtttctgccatcagacattcttaataaaaagccataccttgaccccacacgtaatggcaacctaaattttctactctgcttcccagcaaaactttgtaaaataatttttttattgttctcatcacttctacttacattccacagggacttgactcttagccaccaataatctctagattgccaaattaaatagtgtcatttttacttctatctcaatcttttattagctttagacagggatcgctacacccttcttctgggagcttttttatcctcggtttcattgacactaaacaatgttggtttttttctttctaacctctccttcttgatctcagaattccaactcttgaaatgtttcaagacgttatccttgggtctcctttcctttttttgtctacacactcaggactggtgatttcattcaatacaaggtgttaaaaagtcccaaatctcaatctcaagcctgatttctcctcagaattccagaattatatatccaaatgtctattggatatttccatttgaatgtctgataaacatttcaaatttaacatgtcctgaacaacatttttgttctattccaggtgctggcaaactatagctgtgagtcaaatctgggtcacataattttgttcaataaaattttattggaactcaaccacaccaattgtttgcatttgtctatagcttatttcacactgccacagagacctctttagtctgcaaatactaaaacatttattatctggctctttatagaaagttggccaacagctgacctatataccaaatttgctcttcttgaagtacgtatttatctgagttgataacactaccttaagtttatatctcaagtcaaaattctcataattgtctttaatgttcatccttttcttgcctactacccccaacacatcagcagttcatatgggctttaccttgaaaataaaccctaaatctagttttaaaatgtccactgaaaccaccaatgttgcttgaagcattgaaacaacttcctaatgatttccttgccaatttttttttacccttttacaactttatagtcttcttaagttatagaaaattcttcttaaatcacatatcagatcatcttttccttgcttaaaatcatccaatgggtatgtatttctcttagaattttctcaactccctaccttctcttacaaagttctgcataatctggattcttactcctccgcctaccagttctcttctcgctcttggcccactgaactgcagctgcactgagctttctcttactccaacatgctaatttttcagttctggccctttgagctagctgggttctctgcctggaattctctcatgaacgcctttcatgaatgtctccttctcatcaatcaggtttcagttcaaatgtcacttctttcaagaagcttcttcttaataattcattctaacagagtcgtacaagtatatatcatattatcacttacctagtttttaatgttcttcaaagcattttaactataagataggtcttctatttacttatttttgtatttatttgtttgctggtgatttttctgcctcttcaaaatagaatataaattctccaagaataggaatcatttctgtcttgttcattgaagcatccatagtatttaggacaatggtgaacaatattggttgaatggatgaatactcagctattatattccagagaggtttctcaaggtggtcttgaagaatgtgggccaggttaattttcttagactaattatgaaggcagaaggaagagcaatctattctattaatttaagtaatgtaagtatccctataaaagaattaatttatttttattgtatttttcttaaatataaataagtgtaacattagttataaactcttatatttgctacttttatgcactaaaaccaaaacaattaccataaattaatcaaattaagatgtttacttatgcaattattttattagttgccctgataaactctttgagggctggatccatgtacgaatgtgctcactaatgcgtcatctgtggttgaaaacattggctgggacatagagtttggcaaatacttgtggtaaattagtgctgaatagtaaataaatacatggcctctgcaatcaaggtatgtgtgtctagtaggataggcttaaagacacaaaccagttgaccatccatctgctagaaaattcctcagaacaactctgagcttcaatattaattgtgggcatttatcggcactaactatggtacactcttaaagaaataacaataactgaacccttataacaagctttgaaagcatttatactctgattatttccttattacaagatgaaggtgagaagaaactgggaggttgtctggccacagttaataagtagtagagccaggatttacagccagtgggtctgtatatagagcctgagttccattgattcccagctaatgagggagtaaatgattctttttcattggcaatgacccagatcccagaatcacaagttatatcccactagagcagactggattttactcattaaggttgcatttttaacaagataattcattcctactgctcgatacagtagctatagacagttacttttatctaaattactcaccaaaatttgaaggtagaaggaatttagaaatactcttgtcccacctcttcatttttcaactgaggaatccagagttctagggagattaaagttacatagctaggtaataacaaaactaggaggagaaactagaatcgttttcctctgaatcacatgccctctcaaattttgcctgtgtttaatgccagaagggcaaaaacaaaaaaaacaacaaaaaagtttgctttcccttagcagaaaagtaaaaacagatcacctaaatatttctgtcctactgtgctttacttttggaatcattgccagaatgtggtagtctgctcatcaactgttggaaatataatccttctgtatctttcagatgatcgggaatccttttcatttatgcatgcatacttacactcacctttccattcctttatttacttattcatcaagcatttcttgcatggcaattatgtgcagagctttgtacttggtaaaggggaaaataaagaatagttgaacatgattttattcaaattgattctatcctctattacattttattttttaatttgcctgaagtcccttcaaaggtagacaggttgtaatttctcaataaaatagatatgaaaaaccaacaaaatcttctagcatcaatgtggcaattagctgctgactgcaacatgtattttcttaaagttgctatgtttctgcttctatcaatattaatagctaatattattgagtgtttaatatgtgccaagcactctgttaaacactccatgtatgttaactcatttaatctcctcagcagttccacaaggacatatagttattatatgtatttatagcataaggttacactcctattaagtggtaggaaatccaaactttctttctccagggagtatatgcttaattgctttatcaaatttgtaaattgataaatttgtaaattaaagttacatagctaggtaataacaaaactaggaggagaaactagaatcgttttcctctgaatcacatgccctctcaaattttgcctgtgtttaatgccagaagggcaaaaacaaaaaaaacaacaaaaaagtttgctttcccttagcagaaaagtaaaaacagatcacctaaatatttctgtcctactgtgctttacaaacaattgtttgtaaattgttagcttctatagaaaatatccaagaatttcagtagaggagtgttcaggagcctgtgagttatcccacattgaaactaggagacacactgctcttcattttctccaacaaatacacctcactttctcttgtatgatttttcacagaattcctgccctattagtaacatagctgtgattttatttaatccaaatactgataagcaattgtgaaaaatgtgaatatctgagaacctgtactttgcaaaatacatttttacttaaatatgattctcttttagaaaatgctgttgcaaagtggtgcttatttgggctctgtatttttttggggggagcgtcccgatttataagggcaataacaactcaaaaaatggtatgagtaaaaatggctgttctcctgagcttggtagaagattggagaaagcataaatagcaatctactcccctgatttattctgagtactcacacaactgaggcccaaataaattataaagtgtttggctccagtggtgttattaaattccttgtaggctggaagcattgatcatttgatacccttaggtttgcgtttcattcaaatggtggaaagatatatactaatactatatatcatttcaacttcatgcatgagacttgaagcaagaaacttctgttatagctagcaggaatagtctgtgaggtgaattggatgtacactgcacatcaaagtattgataaattgacctacatttttaaagccgaaatgtaaacctcattgtgcatcaggaggtcgacactgtcagttacctagatatttctcagtgttaagtagttatattatgaaagatgaatgattctgtacaaccctgtataaatgtgactgcatttggactttctaaaagaatataagcatgtatgcttggaaatcctctacctatttggaaatagaacacactttgcagttgatggtagaaattatagatttcttctagagaaacatagaagttacagggatttggctgatgacaaagacatattcccacagcaccactaaatgctttctaaatacttgttatacttaaatacagtattccatataatatgggagaaacagtttgatgccattttagttacattgtgtatttagcatgaactccaaaaggaaactcagctaaactccataatctctccacttactggttcaagagtcagagttgaggagactcatgtggaattcttgacctcatttacattcttgtgtttcataacttctggccctcggtttcttatttgcatagacatttagtgtctagtaatcaacgtgttgtagattctataatgaccgtataattagcatcttctgtgcattatttctgatcccctacagagctcactttgaacatgagacataagactctgggagcactgtagggtaaattttgaaacagctattcattctggctcctatatttattgtttctgttttaaacttaatttcctattagttgttaaagtgttcacttatttttcaaagctctttgaaattacaaaaatgggtagctattctctaaatcttgcctgattttttttccctaaatggaaagtagtatagatttggaatccactaaataatacttaatttattcctttatctgggtggagaattaaatgtcacaattagtcattatttatatttattgtattctagagcaatgttttcttaaatacctcagttaccttcagataaagtcctttctaagagatacacattaactccttcaaaatcagggatatcatttcatagctgccttaagggcacctctgaaacatctaatgtgtttgcaaagattgatttagatgaagcatgaatactcccataaaatactaatattgactaattattccttgcttagaaatcatacatttaccattttatacccttgctcccttcactgctagaggtattgccatagatggtagaataagttaaatcagaatgtgtttccactttcaaatttcatcatctatcatataaagtacttgttttttgtcatattttgctatgaaattattaatgctggtgggcatgaataaaatatgtcatttgtatctgaactagtaatatgaatcttagagaaatgatgagttgctgaaaagataattggaacgagtggaataacttaatttatcatattatgaaatttatttctgggcttttaatctttattcgtatacgttggctccagatataatgacatatccatccctaccattacaaattattacttctttcaagagaatatattttcatgtgacttttgttttataactaaagggaaaatgaaaatacgtatatataaaacatcagttcagaaacattccccatgctatataattaattctaagtgatatatgcacagaaaacggagaccatatgtggtagagaggaatctgacgaagtcccccaaatactcctgttttctggttattcaaacaaacactaatctagatgtctgtgtaaagaaatattacagatggaattagaatcactgatcggctgactttaacttaggggaattatttagcattatccatgtgagtccagtgtaatcacatgggtccttaaacgcagaaaccaacgcagaatatttagtcagtagagatgcattggagatacgaggcaaaaagagaaaagtcagaggattcaaagtcccattatttctggctttgagggtgatgggaattagcctagatttatcgcctctcagagccagtagtgaaatgaaggccttaatcctatgactgtatagcacttatggaaccaaccacaccacactgtacctagacttgggacccttgtgaaattatacatttgtgtggttttgagctgctaactttgtggtaatttgttaccataacaaagagaaaataatattccatatttacttgccataaccaatgcttaagcaggcaaaccttactttttaaaccatgctttagagaagttatgccagtttgcctcattaacagcctcctttttagtaacattccggataatgagtgggctcatggaaatgataagaatttcaaggggaccccaagtggtcatatttattttgctattgagttcaagtattttcaatattgttaacacaaatgctgcatccagattggacttttcataattcacacctcacaatgtcacttccccatcatatcttttgcttaaacgctttcaacgacttttgacctaaggaaaattgggcatttttaaaaagtccatgcctgatttcacctttatctgtgtctccagtgccgtacttcattcctctatgattccttgcttggaatattgtctttatatcttcaccactttacccacttgatacctagaagcactgtggtataatggttaatagggtggactctggggttattctgtcctaatttcaaatcctggccttaccacttccttgctctacaacattaggcatgatactttacttctctgtgcctcaatttatttatcaataaaaccgggaaaaataataatacctactttagcaagttgtcatatgcagaatttactcatttgtgtctcctccattttttgtgtactttcatttttttctcttacacatttaatgaatatttatttctataaataagtgtctatgatcctagacataatcaggagatgcaggtataaatttgatatttttctcctcataggaccaagtaactattcccatagctgcaaacatagattacttataactatttttttcattcactgaaaaaacatttattatgtacctactgaatttcagaaactaaggatacatatatgaataaaatatagttacttatctattctattgttaactatatgtttgatggaatatagcaaaaaatgtagtaaatctggtcaaattgtcatttattgataaactagaaatatttcagccagtagagttaggtggatataactagaatttaagcaaacttttgcactggaagaatcttttatttttacaaacttgttctattgagtgtttgtaatatgtgaagcacattatagaattataagaaaaaatgcatgtgaagcacctaggataatgcctggcatataatgagtgtttattttaaaaaatatatattgtttgagcccctacaaagtgctaatcattttctaagaaacaaggacatatcaggaatgtgataagattctgttccaatggaagaaaaacttgttgagcaaataaaatgtgcatagcttaatagcaaccagcatggtttaaaacacatggatagcctgagctacttttgatatggcatcagggatgatttgggagaggtgacaattgatctatctcctggggcccagagattgaaaaaaaacaaaaacaaaaaacaattgcttgcaacttaatccttagtgtcgtgcccctttttgttcaaaaaaacccctttcccttttgtaattcattgtaggtttttcttctcaattaaagttatgtcagaaaactaggcttaataatttagcttagtattccatatgccaaactgattagttcatattatatattgtcatggttaatactgagtgtcaacttgattggattgaaggatacaaagtattgatttgggtgtgtctgtgaaggtgtagccaaaggagattaacatttgagtcactgggtcgggaaaggcagacccacccttaatctggtgggcaccatctcatcagctgccagcgcagctagaacataaagcaggcagaaaaacatgaaaaggcgagaccggcctagcctgtcagcctacatctttctcctgtgctggatgcttcctgccctcaaacatcggactccaaggtccttagttttgagacttggactggctctccttgctcctcaagcttgcagacagtctattgtgggaccttgtgattgtgtaagttaatacttaataaactcccatatatagatatagatatatatctcctgttagttctgtccctctagggaaccctgactaatgcatatatgtttatgttatttgttctcatgtccaccaaaaaggtcaattaaaaaaaccttcccttagctgtggtaataccacacacacacgcacacacacacacacaaaaccttcccttagctttggtaatatcacacacacatgcacacacacacacaaggcatgcacaagcgtgcacgtgaacacacttaatatgtactttttaaatcctcttttacattaatggcctatttattttaaaacttgagctaattttcagaaaatcaaattttgcaagtgttgctttgtgtgtttaattgtatcaattaattactgtatttgcaaggtttaacagcccaaaagctatcaaagaaagaatcattttaagagcttcaagttgctgacacttctaaggcaaaactggaaaagacacaagctgaagaatgattgatttcttagggatatctttctgtcataaacccaagatatttgagaaaggcatgctagattttattcactgcatagtgcactgccaatatcaacattttaaaagcttgaagatatgaaaagtagaattgtgtatcaacagtaaaactttacaaacatcctacaacttatattttaaatacaataacttttaaaggtcctagcggtcagtgggaattgagagttattttattcggtggttcagaccctgtgtttatgcagaaacgatcttctagtaattttaactgtagtgagctttctaatgaaggctgtgcaaatattaaacagctactacaattatgcttcggttttcttttcaatattgaatgtttacattcttaaagcatctctgatcgatagcttttattgactgtgttttctccttcctcagctatttctttacttgttttgctttattcatttcttcatatggtatgttatttatttatttcatgttgatgtgggaaaaaagttgccctctttttattaacagattgaattatcagcaggcactgaggcttagtgccaagcaagaaagacacagacaagcttattttttctgctaccactttgaaccttgaatacagacctctgggtaatgtcacactggatacttgctgaatatttgctgaggacttcttttatgtttgtctcagcattggtttaaaacaagatcagggctaagaagagccaagctgctcttgcaaaggtcttccttcatttgccttttctctcccagactttccagcaactcctgctctcctgcatattgatctgtgacttgactctggacttcatgtgttcatgtgtttatatgttaactacttggtgatttcaatattttttacatgatgcatgaactcagcatgaccaattcaaacctataatctctcgacacaagtcttcaaacctggtctacttcagtgtaatcttatcaatgaatggagaaacatgactgtccagctcttacacaagccagaaacccaggagtcactttttgaacaactccctccctctctcattgttcgtattcattcctaaatattctatgattacccacttctccccacctccatggccatcagcactactcaaaactaaatagtcactatctgttttctggagacgggagtgtcctaactggttaatcctagaaacttttgtgtctctttacatggttttcacactggatttatctaaatagatatgaaatgatatcatgtgctccatctcatatatgaaacacttcaatggattctcattacaatcaatgtgacttataaactctacaatgtcttagctcctttttacagattctgcccaaaccacattggaccatgtcaattttattataagacttcaccatatgctatttcttttacctagaacaccatcgttcattcataccctcaaacacacgagcacacacacacacaatcatctttcgcaaagttaatttttttcttattcattcatttgtttcagaatcccattcaatgtgttcttccatgggaaaccctttttgacctctctaactagaccaatttcttttcttcaaagcacttatcacagttgtaacttcacatttatttctagaatttattagattctgagctgaaatttccatgaagggaggtaccatatttgcttttgctcaatatctgatccatgccatccagtttatcatctgacacataatatgtatttgataaatgtttttggagtgaactgcctttagttcatgtgaaagaaatgtaattcatttttggcctaatagttcttcaggcaatcccgagaagcatcatacttcccactctgacttggactttctcacttcagaaataaaatgacctgaatttatttaaccattttcatgttaaatatttagtgaccctttgtcatcctgattgtcttgccctgcacatgtttttcatattctatataaaatatagaaaactctgaaaattgggtgcctagaaatgaacccaattctctaagtaacaagcctttctttttttaccctccatacatcactgaagtccatgttcattcaattttgtagatggtagattagctaataaaatagccataaacatttctattataaggctaggcaccctaatctgttttatcagggaatttatttacctttttctgacataactcccagtttgttttagtttacacagtagttctgtcttacccacttgagtcaattatgactaaacttagaatcatgaaccccaccacagaatatctcattactgggttcttttattttgatttttttcttgttcttgagatgaggaaaggaagttaaaagaaaccaacattatttctctaaaacttccacaaagatcaaagttgaaactggaacatagctttcctgatttatagaccagaattctgaaaattacaccaaaggtggctaataattagaataaatcatatctgtaagaggctttaaaaaataagtattctgtttttcacattattttttcctattttatgcccattatccaagatgttgtttcaccttatctgagttagaaactagcaatcagtagcaaaaaaaaaaagaaaaaaaaatcctaaactaactttttaaaccttacaatgtatagacttgttgtactatgcaacttatatcatgttaagatattaaatgaacaataataaaatataagagttgaaagtcaatttactcaatcattacataaaaaatgaaatacttctaaatttttaaaacccttagattttatgtagctatgaacatttagaaaaactatgctatgcttttaactgggatccctctatattggtacccctttcaaattccttttttttttttaatagaaggactcaaaccacccctttctatttctaagcctcccagcagcaattgtgagaatgtatgccacaccacccatatgttcgtctccagatggctagcctgcttctctcagctcccccacctgcctgggccaaaggcatgctgtgcccagaaccctgtgtataacatgaaagatgctgatgcctgctgtcatccatacccttgcatgtccacagtttaatccgagcacaagcaaggaaagaaagagaggcaaagctggaaggaagcagaattagagttaaaggagagggaggatggaggaagaaaagaggagggaaaaaagagagtaagaaaggatgcaaggaggaaaaggttacagtgtgatgagaaaagtatagttattttatgagagtcaatcattattttggtaagattaagaaaattgatattgcacactcaaaaatcaaataaatagacttaaatttagtcacatgaagacaagcacaaatggtttctttgtgtaacattagaattgatgctgtgttgtactggctctgaaagtggatggtaagctgcaagtggttgttcgtctgctattctctatgaaagacacaggtaccatcctatggatttgagagaagtgtttcacatctaatgttactgagcaataacacccaagattaaaaacataacagaaaacacatacatgttgctgatgcatatgggcatcacgtgtgtgagttgcaactcaagcagaaaccctcagataaaggagggcggtcaaaaaagttataaaggagattttccttctttctaatgtttcttccctgcccttagcccagtgtatcttcaagtatgaccctgaggtaacccactttagagtcaccttgagtagtcaaggagacccatagcataaataattaatcagccaacaaggatctattgagtgatatctcaatactaagcaggtaatttgttcattcaacaatatttattgagaatcaattatgggtcacatactaagttcagcactgggatatattattttgaaaaaacatagttctggctcttttattcaactaatattctttgaaaacctactgtaatctaagcactgttttaagctttaggaataaagcattgcaaagaaataaaaataaaaatcattccttatgatgtggaggttcttgttattgaaaaccataataaataaataaatgagtcatttgtatgaatacattatgcaaaaagacaaaatgtgctggagagaaaatagagcagagaagggagtatcaggagcaagaggtatgcaatgttaaatagagtggctaataaagccttttctgagatgcttaaacttgaggaaaaacttgaagatggtgagggagtgagccatgtagctatctggcagatacctggaagaaatagccagtgagaaaggctctggttcaggatggtgtctgtgactgaagagtgagtggaacaagagagagagtggtagcagatgagaccagagagtggcaggatacctttacaatggcctgcaagacaccacaaaatctggtatcttgtaggccattataaagtctttgtcataacttgtctaaatcaatttgtattgagggatccacccccatgacacaaacacctcccatcaagcctcacctccaaccttgggaatcaaatttcaacatgaggtttggaggagacaaatatctaaaccattgcataagccctccccgaatccctcccttctttagagtgaaagccaaattctgctatatagaaaaagcctgaacaggactaaattggaagaagggaaagcaggtgggaggcaattgcagtaatccagtgagagaggatgaaagtgatggaagtgacagagttgaaaagatgtaggtacattctagatatattttgacgactggatttatagaatttcctgataaatcagtcttagaatgagagagcaagagataagtcaagttcgactcaaatctatttggccagagtagctggaaggatggaactgccattaattgacatggaagtgtggatggagaaggatttcacggaggaatgttaattattgattctgtttcaacaggttgattttgagatcctagtggagattttcattagtctagagttgagaggaatagtctgaggtagagttgccataggtgatattttaaaaaattagattggcaaagatcccaaaggtacttagcgtcatatcaagaaatgaggaattacaaagaatgtgcaatagggtactccatattagaaggtcaagaagcagagattattccaccataacagactgagaaagattagacattcatcgaagaataaaaaatatatggtgtcctggatgacaagttaaaaaattatttcagagttgaggacatgaaaaacaaggtcagaggctagagaagtaagaatgcaattattcgatcattaatagaagaaacaaaaggttaataaaataataggtaagtcagatactgttaataatacgaattaatataaaatataaaactaaatgctacaaaaagtacatcattttataataataaataacaacaaatataaggatagtggcggaaaacatgggatgaggaaatgcttgtttaaagaagtaatcttgagattaaagataaaagatatgtacaactcactgaaagtgaaactgtgaaggttttggagtgttacagccagatcagatgacatttgcaatggccttttttggaagaaaacatagtgtattcaaggaaaaggaaaaggctagtttagttttagcattaaaaaaatgaatgtaccaacttaaataaggaattatgtatgtttggaaagaaaagtcttgaaaatcatgggcaacataaaccaagatgagaattaaatgacattatgttagttaggatgttttgggcaacaaaaaagaaaatatcggcataaaaattacttacaaaataatagtttatccataagtctcaaaagagacatatggaaccccacaattctatatctcaaaagagacatatggaaccctacaattctatatctcaaaagagacatatggaaccccacaattctatatctcaaaagcgacatatggaaccccacaattctatatctcaaaagagacatatggaaccccacaattctatttctggacatctatctaaaaggactgaagggtgtgccttgaggagatatctgtacaaccatgtttatagcaacatggttattacaataacataaaggtggaagcaacccatgtgtccatcaatggatacatgaataaacaaaacataatatatataaacatggaatgtttgttattcagccttaaaaaggaaggaatttctgacacatgttaaaacacggatgaaccttgaggatattaaacttagtgaaaaagccagtcatagaaaacaaataccatattattccacttatgagagagagtagtcaaatttatggaaacaggaagtagaatggttgctcccaggggcttaagttagagagaaacagtgagttactacttaatgggttcagagcttcagtttcgcaagatgaaaattgttctagaggtagatgggtgtagtgtagtgtacatatgagtgtacttaatgcctccaaactctacatttaaaataggctggtaaatgttatgttacatgtatttcatcaaaattactactaataataatgaaaggggtcactggacccaatgaaaaagaagaaagaagaggaggaagaggtgaaggagggcagagagatgtaacaccagggatgattttagtaaattcatgatacctgggctccaggtaacttctgcatgactcttttagtcttcccttcgtggtcacaagatagctattgaaactgagcatcaagtttttccacaaaaatgtctaaggcaggaaagaagaatcagggacttttttctcatacaaccctttctttctaccaattaatagaatatgtttctcagaggccttcaaccaagatcactttagtgtaattggccagaaccataataaaattgccatacttgtctgcaagaaaaattgtgaaagaaggtttctaatgatttcagattcactttcgagggcaaaagtcagtggtgtgctgatagatatttaacaaatcactatctgggacgggagagaatgtgtgtacatatataagtgtattatacattttattgatataaaagatttgtgggacactataaataataatagtaatatataaagtattctttattgtcaattttgtatagccaaatgatctacacagtgtgcgtgcttccattgattttttttccatgcttttttatccatagccaaaatatagttgcaattcacaagtgtagttccaacaagaatggtgatagatattttcctcgtagttaatgagtgatacgcagtgaaccaatgaacacatatataaaaacttagtgtgagtaagctttttcccaaatcttctgaataccagaatatttcctcaatttttttgcactatttacaatgtaacagctattgatatgatatacttttaactttaatctctattactaatgttttctccaacacgcttaagtctaaacaagcgacaggagagtgccaagactggctgactagaagcagctgatgtgcaccactctcatgcagaggagaaagagtagcaagtaaaggctggcccttcagctggatatgcaggtagacatgctgggattcatcaaagaagcaatatgacctacacaggtcagagaggagcaacataggacagttgcccacccaggattggcatggagcaaggggaggctttccactataggaaattgtgagtaatagcccccgaaagcccactaccaattggagggccccccggcataggctgatcactttcattggtagtggctctgcatttctctgggagagagcccaattaaaaggacctctgcctcttaccgctgctaaggacctgctgaggaaggaacataaggcccgagcttaccccagggctgctatgtgcagccaaggaggaccaagccaagatctgcatccagcactcaagtgagatagaagcctacacttcctgagcactgagagggtatcatggctgcaattgtgaggaaatacaaagaagtcatgttgctgagcgtgagcctacaacatggccattacacctaagcaccatctactagatcacagcccaaacttcaacaccaaaaatacttttccaatatacccccaatccactgcaatccctgtcctgtgaaaccaaggacaagaattcagctacaaatggagacgctgcacaaagcctcgtccctcgggaaacatccagaaatgaagtcaactgacttcaacacaaattccaacacaattgaaggaacatcagcccacacagatgagaaagagccagagaaagaattctggcaactcatatagccagagtggcttatttccttcaaacaactgcactagttacccagcaaaagttctcaatcaggctgaaatggctgaaatgacagacatagaattcagaatatggataggaatgaagatcatcaagattcaagagaaaattaaaacccaacccaaggaatctaaggattacaataaaataacagggctgaaagacaaaatggctattttaagaaggaaacaaattcatctgatagagctgtaaaacacactataataatttcataatataatcacatattaaccgcaggaatcaactaagctaaggaaaaaaatttcagtgctcaaagactggttcttcagactaagtcagacaaaaataaagaaaaaagaataagaaggaatgaacaaaatgtccaagatatatgggattagatagagaccaaatctatgactcattggcatcactgcaggaaagggaaagaaaataagcaatttggaaaatatatttgaggatattgttcacaaaaatttccctaaccttgctaaaaaggccaacattcaaattcaagaaatgcagagaacccctgtaagatactatgcaagacgaccatccccaggacacataatcatcatattctccaaaggtgatatgaaagaaaaaatattaaaggcagctatagggaaggggcaggtaatatacaaaggtacctccataaagctaaaagcagaacattcagtagaaactctgtaagccagaagagattgcgggcctgtattcaggatccctaaagaaaagaaactccaatcaagaatttcatatccagccaaattaagcttcataagtgaaggagaaataagattcttttcaggaagcaaatgctaagaaaaatcataaccactcaacctgccttggaagaggtccttaagggagggctacatatggagaaaaaagactattatctgccaccataaaaacacacataagtacatagattattgataatataatgcaatgacactatcaagtctgcataatatccaggatcaaatccacaacatagcaatgttaaccttgattgtaaatggaataaatgccctgattaaaaggcacaggggagccagttggataaagcagcaagactcactgtgtgctgtcttcgagagatctatctcacatacattgacactcacaggctcaaagtaaaggaatggagaaaaccctaccaagcaaatagaaaacaaacaaaaaaatagtggctgccattctaatttcagacaaaacagactttacaccaacagtgatcaaaaaagaagaagaaggacattacataatggcaaagggttcaattcagcaagaagacataacacaacacaagagcagacagattcatagaataagttcttagagacctatgaagaaactcagataaccatacaatagtagtgggaaacttcaacactccactgacagtattagacaggtcattaaggcagaaaactaacaaagatattcaagatctgaactcagcatttgaccaaatggaccttgcacacatatacagaactctctacctaataacaacagaatatacattcctcttatctgcacttggcacatactctaaaatcaaccacacagtaagccatataacacttctcagcaaatcaaaaaagaaactgaaccaaccacactctcagatcacagcacaacaaaagtagaaatcaacaccaagaagattggtcaaaacaacacaattacatggaaattaaacaacctgctccttaatgacttctggtaaacaatgaaattaagacagaaatcaagaaattctttgaaactaataagaacaaggatagcacataccagaacctctgggacacagctaaaatggtgttaagaggagagtttatagtgctaaacacccatatcaaaaatggcagaaggatctcaaattaacagcctaacatcaacatcacaccttgaggaactagaaaaacaagagcaaactaaccccaaacctagcaaagtcaagaaataacgataatcagagccaaactgaatgaaactgagatgtgaaaaagcatacaaaagatcgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagctgggcgtagtggcgggcgcctgtagtccaagctactcgggaggctgaggcaggagaatggcgtgaacccgggaggcggagcttgcagtgagccgagatcccgccactgcactccagcctgggcgacagagcgagactccgtctcaaaaaaaaaaaaataaataaataaataaaagatcaacaaaatcagaggttgtttttttttttttaagaataaataacatagaccactagctggactaacaaataaaaaagagagaagattcaaataaataaaatcagaaatgacaaaggggaacataacctttgaccccacaagaataaaaaaaaccatcagagactactatgaacatatctatgcacacaaaatatatgacctgcaagaaatggataacttactagaaagatataacttcccaagactaaatgagtaataaattcaaaccctgaacagaccaataatgagttgaagtacggaatcagtaataaaaagcctaccaaccagaaaaagcccaggatcagacagattcacagctgaattctacaaaatgcataaataagagctattaccatttgtactgaaactattccaaaaagttgaggaagagggactcctccctaactcattctatgaggccagcatcattatgataccaaaactggaaagagacacacacacacaaaaagaaaacttcaggccaatatccttcatggacatagatgcaaaaatcttcaatgaaattctttccaaaaagtccttgtttttttgtttgtttgtttgtttgtttttagaataaataaatccaacagcacatcaaaaagccaatctactacaatcaagtaggctttatccctgggatgcaagattggtccaacatatgcaaatcaataaatgtgattgaccacataaacagaattgaaagcaaaaaccatatgatcatttcaatagacgcagaaacagctttcgatataacccaacatgccttcatgataaaaaatactcaacagaataggcatcaaaggaacatacctcaaaataataagaaccatatattacaaatccacagccaacatcatactgaataggcaaaagttcgaaccatttaccctaaaacctgcaaagggtgcccactcaccactcctattcaatatagtactggaagtcctagccagagtaatcaggcaaaataaagaaatgaaaggcatccaaataggaaaagaagaagtcaaactatctctcttcactgacaatatgatcatgtacctgaaaaaacataaagactgcataaagccttctagaactgaaaaacgactttagaaaatttcaggataaaaaaatcaatgtgcaaaagtcagtcacatttctatacactagtaatgtccaggatgaaaggcaaatcaagaacacaatcccatttacaatagccacaaaaaagagaaatatacaggaaaatagctgaccaaggaggagaaaaatctctgcaggtagaactacaaaacactgctaaaagaaatcagagatgacacaaaaaaatggaaaaatattccatgctcattgattggaagaatcaatatcattaaaatggccatactgcccaaagcactgtacagattcaatgttatgcttaccagtcaaggccattcttcacagatttagaaaaatctattctataattcacatggaaccaaaaaaatgagctggaataaccacagaaatcctaagcaaaaggaacaaagctggaggcaacacaatacctgaatttaaactatactacaaggctacagtaaccaaaacatcatggtactgatacaaaaatagacacatagaacaatgtaacagtatagagatccccaaaataaaaccacacatctacaacaatctgatctttgacaaagttgacaaaacaagcagtgaagaaaggacttcctatgaataaatggagttgggataactggctaaccatatatagaaaattgaaactggacctctttcttataacatatacaaaaaacaactgaagatggattaaagactttaatgtaaaacctaaaactataaaaacccttgaagaaaacctagaaataccattctagacttaggcctttgaaaagatattatgacaaagatgctaaaagcaattgcaacaaaaacaaaacttgaaaaatgggacctaattattaaagagcttctgcacagcaaaagaaactataaatagagtaaagagatagcccatagaatgggagaaaataaatgcaaactacatatccaacaaaagtctaatatccagaatctataaagaacttaaacaaattaacaagcaaaatacaaccccattaaaactaggcaaaggatatgaacatacactttccaaaaaagacatatatgcagccagcaggtatacgaaaaaaaatgttcagcattactaatccttagagaaatgcaaatcaaaaccacaattagataccatctcacaccggccagaatagctattattaaaaaatcaaaataactatagatgttggcaaggtaatggagaaaagggaatgcttatatacatgcttttgtttggaatgtagtttagttcagccactgttgaaagcagtttggcaatttctcaaagaacctaaaaccaattgaggcagaaatgtcattattggatatatacacccaaaggaatatatattattctaccataaagacagttgcacatgtatgtccatcacagcactatgcacaatagcaaaggcatgaaatcaacctaaatgctcaacaacagtaaaccagatgaagaaaatgtacatatatatacaccctggaatcctatgcttccataaaaaaggaatgcaggctgggcacggtggctcatgcctgtaattccagcactttgggatgcccaggcaggtagatcgcctgaggtcaggagttggagaccaacctggccaacatggtgaaaccttgtctctactaaaatacaaaaattagcctggcatgatgcatggtgaaaccctgtgtctactaaaatacaaaaattagccgggcatggtggtgcatgtctgtaatcccagctgctcaggaagctgaggcgtgagagtcgcttgagcctgggaggcagagatttcagtaagtcgagactgcaccactgcactccagcctaggtgacagagcaaggctccatctcaaaaaaaaaaaaaaaaaaaaaaaagaatgcgatcatgtcctttgcagcaatgtggatgaaggtgaagaaaattattcgaagcaaacttatgcagaaataaaaaaccaaatactgcattctcacttacaagtgggagctaaacattgggtacacatggacgcgaagggaacaatagacacttgggcttgcttgagggttgagggtgggaagagagtgagaatcaaaaaactacgtatcaggtattatgcttattatctaagtgatgaaataatctgtaaaccaaacccctgtgactcacaatttatctatagaaccaacctggacctacacccctgaaactaaaataaaagttaaaagaacaaaaagagcaaagaatttggagtcccaagacccctgggacttattagccgagtgagattgagaaggacattcacttgttttaagtctcaggttccttatctgaaaggatatcatttgaaaacagtacacatcttacagggctgtgatgaagactaaataaaactgttgacatactggaaagttttgaaaaatgtacctgacttcaaagactgaaatttcactgcagaaaaaaacttttaaaaaatcttcatataaaaaattactttaaaaaaataagcaacaaagcaataactcaagacttcatttatagcattggcctatttccacggagtaaatactcccaatatatccaatttcctggtacccacttgacaccattgaatgtaaatttgagattgtgcaatagcaaaacattctataggatttctaatattaagatataatcaatgcaaacaaactcaaaagcataggcaatagtaagaggtaataatatatttggaaaggatgaattttgagctttaattattttgcatttaatgtaattaaattgttcattaatatagtttgatgtttaatcatatctgtttataatatggcttgcaaaattcctgaaaatttaacaatcagccctcataggcctctttggatcaaatgaccagcaaggcataatactagcaagtaaggaggaatgagatggctttggctttacagattttaaacatttaaattcacttaggtatatagtagaagcatttttacttccaattgtgcttaatctaaggaaaatagcatctttgaatcttttcctttttctaatcaacttttgctcctaattttccattctagcttctaatatccctagattaagaacaaaaataacattgatttccaccacagataaaatgtccaataaaaggcaaagtaaaactggaatcaattgaatattctctgtttaacaccaaattgattttaaggctgccagataaggaagggagaaatagaatgtaaagctgtcctgagaagagatcactcagtctaagcccctcattttgaagatatgaaaatggagatacctcaagattggcctaaaatcaccgaacccactagcagcagagcaaagacaagaatgctgggctcctgagttctgaaagccatacctgttctattgctgtgcaccaaaccttaattcctgggccatctttattagaagagtgtttggcaagttctttgggtgtgaaaagagaaaacagttctcataaatcaggtttccatgcctggtctgttaaatccaccactggcacgatcacagggaagtgctgctccagctcattgtgctagaaataaactgaggtctcatagcagccattagagtctaattatatgtgacagccaacctgacaggttttgtttatttgtttgtctattctttcagtgcttatggcttgaaaaaaatgaataatgctgtcaaaactatcttacccttcaggagctctttctctgcttcattggaaagcataggaaagcatttacttctgacacgcctggtaaagctaataaggaaaaatgatttcactgagaagtctgtataattatgcatggctcatgtgacacctactgatggtcaactgtcactagtacactgtgatatacttgataagagaatgagaatcaggagcatcaaatacatagaaatcacataagaagtcttttcggaagaaatgcgagctatgaaatcatctgaggatgaggcaacagatatatctagaaaacatgagcaaaataaaacataaaattgtataaatttcataatggaactagtggacaattgacagattatatttaaccctgtcttaatttatttttcccagaccactcaccttttaagaatatcaacattatatttgtactgaaagtagatgtgataggtagatcttgattattttcgagtcccaagcagatctctatgtttttcttgaatgattccaattttaccaatgatctagctaaggacattgacatgttcctgaatgcctctaaacaaagtaaaaaaaaacaaacaaaaaaaaaaacaactttgaatggcagtattaagatccaattccttatcaacatgttgaaatgataatgtgaacttaataaaatatagtaagactcaacatattaaacttaagaagagttaaataagtaaaggaaaacaaacaacaacaacaaaaagctggagtggggaaaatagaatctaatagccatctgtatgagaaaagattttatttggctgcaaactcatgagttgatgttgtaacaagactgcaaacagcaagaatgtgaatatattgaatcttgccttcctctgggaagtgccaatgagagcttgtactagctccactccattccagactggaaagatcatgcctagtgtgccatcagcttgagaaatatgtgtttttatctcccatggctttgattaagttgggttacatctggctactactcagtctcagtttggacagtgtgggctccacagcatttgtccactcctcatttacttgcagaattctgttgtctaagttacactttttacactctgttctaatgtggctactggtgaggtgtaaacgttgttttgccactgtgaaaaatataaaaataggttttacagtgctccattgtatatacttttatatacatagtgatttctagaactaaagctttctacattattaagagttgattgtactgtgtttaattgtaggcaagacattaagtggtatgtttaaaagttgggtgtgcttacataagaatccccaagaagagaaagactctgtaaaccaatatctatgaggaatagttgaaaaaaataaagaagacttatttatgcacaagaaaaagagaaaaaattagtgggtaattcttaatggaataattacttagaagatgaattgtcattttttttggaattcagtttatttttgtgactgtcaggatgaaagttgcaaggtcacagattcaggtcagctttagagcaggttgaagtattagaaaatggaatatgatgctttataatcaattttccattcatggaggtgtccaaagggtactgaaatatacatgtattaacagttttataaatgggagtgattaattagatagtcttctaatcagtgagttacaatattcttttccactgcaagaatctatgagtcaatgttgtatcattgatgacatgatgacaaagaagctctatacaaccttcattttggttattttaatttgtaatctctcatttgaaacatagcactgattgaaaggtattttaaagtattatccctaccactcattaacacaaatcactcaacctagaagaacgtgtggtggctgtttatagacctacacctactttttgatattaatttttccttctagattttcatatatttaattagcttacaaacaactcacctattaaattataaaacttatgtatagatttgatatagcatagtttttacataagaatgtttaataatgaagagtggtgtttaatcaacatgttgaatgtgaagccaattcataatttgaaaggtcaacaataaaggggcatcatccatcatgatttaatcagtcgtatcttattaagagcagttgcaaaacaggtgagaacattcacaaaaggattagtttataatatttaggttaacatttaaaaaccatcactagccgtagtgttcatgatattaattatatagaagtatgccattttctaaaggagcaggaaaacttttaaaatattaacaacactgagattagtcttcagaaatttaaaataaaattcaagtgtctttagaatttaaatttctttatgaggatgtcaaaatgataggataaaaccccaatgaaagatatatattgcaatattcatatccaaatgaaacttctcagatcatgagtctattaccatactccattatcccgagatgaagcgattacatgttctgtttttatttttcaaatactgttgactgccaaaaagaaactagtgaagatattctttatgccaaatttccttgtcttctttcattttttcagtcaaccaccatttgctaagcagcactatgtaccaagtgtcagttactctgccactatacacatttctgtgattcaaattagctcaaataagatccacaagtaaaggaataatgtttgtattatacaaaatttcattggtttacctgtgattttcataagccaaagtagccagatgagtgtgaatagattacaaccttcagtgggaaaggaaaaagccatcatcttagctactgccctggcagtgggagtcctttcagaacattccaactaagtgcaagcagttggagcttccttcccagccaagttcaccatcagttttgttcagccagtggtaagttgcactatcttccaggtttacttcaccagcagccccactctctgagatctccattttcatcgatttggactcagtactggccaaatcttcttaactaatgttgtttgtgaattactaaaatcatctgtggcaaccttcagctacactaagctgcctgcctaggtggtctaagttagctctgcagaaacttattactgtgtttgcttgtgctttggttaaaacatttacataagattttctttatcattgcctactattatgcagaatatgaggtttcctaataacatatataattacagagaaatgtctctattgtgatagtcgcaggagattcagaagtgaattatacgcagctgatgccttcacactgccaaggtttagtaaaaatgacatgcaaactatgagttttactacaatgtgatgagtgtcattgctatgctaaaaaatacaagaattcagaggttagaaggcccaaataccatgagttttactacttccctaatagctcatttcacaataaagaatttctgatcatcagaagcttattatattgaactagaattttcacttctttatgcaatcaacaaggacttattgatcagtttctataagtcaggaatgtttctggacaactggagtttgcttgagaaggaaaattggacctgacttagtgttacagagtttatattttagattcaaagattgaaaatcaacaaacacacaagaaaataaatgaatctgtgaacaaataaaattgtttcagatagtaaggaaatctctgaaggtaaacagagtaataggacagaaagtgaccgtgtagattaagggtgtcaatactctataggctagtagaagttaagctcttctgtggagaagtatgggtttcagctaatggaagtcaaggagagatttacagcctgaagtcaccaattatgcagagccttcaggcagggacattatgtttggcaggagggcagacatgggaacactggctgcttgggaagataagaagaagccaggcaatatactagtccttaggaatttggatttgatttggcatgagatagaaagtcactgaattgtttttagcaggaaaaggacatgagatgatttattttgtgaaaatataagttgacggccagatgaagaaacaattgttaggttataggcatggaagcaggcagttaggtgttgggagacaatagccatgtgctaagtgaggcgttgcagtggtttgacagggaaaacaggggccatgagcaacagagatgaaatagataaactagagtatattatggtgacataatgtgtacattatatcatttggggatagatggaatgtgcttgtgattaatccacaaccatcaaagtccaccaagtaaacaagaacagttctctgcatctccactccattactgatgtggtttggctctgtgtctccacccaaatctcatctcaaattgtaatccccacgttcccaggttccaggatcacgggggcagttcctccatgctgttctcatgatagtgagggagttctcacgagatatgatggtttaaaatgggcagtttcttatgtgcacactttctgtctcttctgctaccttatgaagaccttccttgcttctccttctccttcctgcatgattgtaagtttcccaaggcctccccagccatgtggaactgtgagccaattaatcttctttcctgtgtaaatcagtctcaggtagtatctttatagatgtgtgagaatggattaatgcaattaccttttttcgttctttgccctcattcgctgaggttttcaaactacaattagatgaaaactttttgtgactgttacagaggttttcctgcctctatttagacattggaacaagattacctttaaaagggggtctagcatatgatatgtagatgggaatttttaaggaatatgattcatttagcagcatggactattagtaaaaaaaaaaaattatattaaatggcattctttccatatctatagggccaagtcgaaagctctccattatagctggagatgccctctttaagcttttacattctccttccgcccccaacatacacgctatacttatacacgtatacttttcaaccttcaacctccctttagaaaaataaaaattatcattaagtgctcagatcaaaaagtaataggcaatgaaaaaaatattgatttgtattaaatcaccggtgcaaatatggtgtgcgaggataagaatgtttggcaagagctacagtattataaaataaatgatatgctagtcatcgaaggcccttgtccatgtaagtgagcagaaatatatagcatttgcttattatctccagcccaagtagtaaattatcactgaaatggcaaagactgaagtggacataaatttggggttcgctgtgctgaggagtgtgggggcttggtatatttcaaaagccttaggaggctaccgatcatcatgatctgcagacagagctgcagataaagtataaggtgatttctagttggaaacttaaccaaggctctcatggcttacagttagaaaattattttcctctagtacagagtttacagattaccttttatttctttttagcttcaaacctattgttaaaatatcaaattatttgtattttcctactctctgtgaaagaatctttttaaaaaattaacctttctaccatttgattttgattacagaatgactgatttactcattaattacctattcattcctacactatagcagatgctattctaggtactagagagtgatgaacaaaagagatgtagactctgtatcagagaatttataatcatgtaaatgttataaagatagtgaaacaaaaaatgactcataataaaataaaataggagtgatgacagaggagaaaaatttaacttattttgaatgaaagtgtgtttgcataaggtaaggtacgtatgtatattggaattaactcagtccaggaagtggccgattttagagaacatagttgtcagtttaatctcctgatattgcagttagcgtattatctgattgtggctattagcttgcaaacagctgttgtttagccaaagcagaagccatatagggtttgcaaggttgaagacagacctgttaccacttctagtaagagactttcaaatatatggcctactgatggcttggtagtaatttcagcaaaaaagacaagtcctgttttcctcccttattattctcctatagattcagcactatctgttcgcagtctttgtatcaaggctgttctatttacattccatgcaaaagatgtttgttttcttttcatggtggtgatggctaatggctccctccattgtggcaataccttccagtgtcattccctatccttctgctcctttctctgcctcctactcccatgtagagtttctccaagagcagacttacttgattacctcagaaagccaactcctgtaatgtcacagaggcatagtactctatgaaactaagacgatctaagacacatgggagggaaatatgactggaaactatatttgctggttgctactaagagcctcactcagtttccagtgtctttctggtggttttacagcttttttttggtaacttacgattgtcttctctagtacccttcccaacaaaagaaatgtaggatattctaattattttgcactcattaaaatggacattcattttgctgaaatatagcttattctatatatgtttataatgaattatcttgtataatttttttatcttgacctatttttgtatgtgtaatgtcattcttttatgggcctgtgcattctctttagcattctaattcccattctagggaacaaattacagcacctttgtgttttaatcatcaattatcctactcaagtgttttaagcaccctgcaaacaatatctggtatgtgccttgcctagtttaattattgaagcacttttgaaagcaccaggatttcattagtgatcaatataaattgggccagtgttcaaccaatttgtgttcattattaaagccttcggttccaacaataacttggagacagagaactgatgaagctggttagacaattgcctaatgaggcaagcagactctgcctctgaccttaaccagcctctgggctctgaaaactttaaatggtcccagtgacagatatcacactagaaatcagccattgtccatctaatcactacctctagctgagctgagaggcataaaataacacaaatgaattgaatgaaagacagaatctatcatgctacaggtaattgtgtttatcaagcattaatatctgagactcaatcctagggctctaatccatctcataaaacaaagtccagagacaggagcaatcctcggcaaagaagccattcgtagaaagtaaaatttgtgggatccaaaaataattgacataaaattccagcaaaacagactgacattccaaaagcactttaaaattacaagggattgaggacacagatcttttagcagaaggtacagattaaccgggtcttcgacacatgcacaggatgtaggtgacgtgtacaactggagttaaatggcagttgagacaggtaggctttttctagttggagagctctcagggaaccggtgaccactttggtctggtacagatgagagatatagaaattatatcaggtgggaagtagacacctggccagggagaaatgcagggacataattaatcccatttctgctgagggtgacaacctgattagtgcccttaattaaggtcaggctttgagtatctttataaattcttgctatgggagctttgtgccaaatatatccatgtatatgtatagatagttacattatttttccctacatcaatttcatgatctctaaaatgaactgagagagatctgatttgaaatagtattcttacctgttctcaaaatctgaaagtccaggagtccatggggaaataagatagagtttttattacatattgaggtatcataactcttcctcaacatggaaacaaagagcttgcattatgtcaggtttgagcttgttagagacatcatttcagcaggctttttggattctgtgttggttgctactgaagtaaatttgcacagtactgttagcctttgggggtctttcttactcaaccactatagttgttgcagaattttgtgccttagttcagctaaaacctggttcttgtcacacgaccaggaaaatttggacacgttgaagggtgagtagagcaggattttattaggcaaaaagggaaaaaacctcacagattaaatcccaggccaccacacagaaactgaagagaccaggctcctcttgcctgcccatggctccaccctgttcccccagtgcacatgtgggcatgctccagcaaggccctgggcagcttccctcatctgtgccaaagcctctgatgtaaacacttatggagcaggtcggaggttctccagggttccctttttatctgcttaggcattcggctatctcgtagttaagattgagtagatctgggcaagaaaacaggggaagaaatggatataaatatgtgcctttcatcttcattaatttgaagcctcaagtttgtataagtatgtttccccaagggccttaacatcagatgttatgtaagtaggattttgattattcagaaaataaacttaccaagttaaacacagcgatattaccttgatttggaaaaaaatcatttagcaatggaattcaattttataccccggtacctaatacatgattccacagggaatcatgcttgattctgttagaaatactaatctggatgtaagcacttgccttcaaggagctttaaactagtggaatgtaaaaaaatgcactagaagataatgtagactgtgagggaaaaaaatgttatgtgatagagatgagtttcagttagcaagattgggcagattttaagaaagagggggtatttgactgaatcttgaagcaaggatagatagaacttcaactgacgagtaataaaggctcaaaggggaatagcatttgtttcattaatgtgctcctagagctcagcttgcataactcattttttataagactaagtttatgcttaaaaactcaccgatgtcatcaaaaatctaataggaatatgaacattttctgctagtggttttggtctctatgttagttctatacttttttttttttttgataagaagtatggatggtgggaaaccaactgctttgatggaaattcaagcaacagacagatcccctgtcagctccacacaaagatatcctgatgaagttctcctgacttctaggagggaatgtttcggaagtgcacatgagggagaggaatcctgctgtcagctgactttttcctttgcttactgtatttgttttgttttgttttgtttttaaaacaggcttggacatacattttcaattcgaaaactcccttctgagatccaaaagtaaacatgtttacagattatgcaaaagtttgagtttagtttcagaatttttctctcaaaggctctagcacaaaaaaaatgggggatgtccaaattctggaatttgaaacaaataacaggacagattgcaagctggcagctggcagggagaagtccattatttcccagctccattcctttgacttcagcctagggaaaggttaccctaaccttgcctcaccttattacccattctatttttaagcatttctcatttactgaaaaatatttaccacatacttctagtggatctaatcattagattcttaggtggacgcttctcaatcaatgaaggacagaacctatcgagcttcctgacctctttagttcctaaaacgcggcattctgttttctctttttactactaataaaggcagttaacattcactggtgggccacagtgaaaacttcagatagttttctgaaggtttactactttctatttagttttgttctttttttttccctaaaaattagtgggttccccagtttgtgtattgtaattccctttttttgagtcttgtttttcctcttcttctgtgatttctactcattcccgaaactctgcatagtaatcatgaccaaatgatttctgaattcatatatcaaatcccccaaaggcttaatatcatctcagaatgtcagccaagctcagatttccaaaagttttatattattacattggcttgaatcatagacttgtgtccttctgtagtcagcacccattccttcacctttaggcatagctccagttctgagagacctatccttgcctctactgacaacagcctggtagggatatcagtaaatgtagccagacatgtatattgccacatggctgctgcatggccctgattaggccatcttgatctgattgaaacaaagattagaaatagtagaagttgattcattccaaatacttgatgggacagcacatcaaatcccacagctcagacccctggagctgctctggtctgtgtgttttctaagcatacctttcaaaccctccctctgtttctacaaaaccctgtgtatttttcaaaggaatctctttttatgctaggaagaggtggtctctattgtctgcaaccacacacacacacacacacacacacacacacacacagatattctcaacaagtagtttctacaatgttgataggcacattgttagagatggagttaaaaaatcaattcctgagtcctaaatataggcaacttttatttcaatgaggacataatacatccataccagagatcattataataccatgtattggtaccaggacctggaggatatattgaggcatcttcctaaaacttcaacctaagttgctatctgagatttaaaaccaaaacttaagggacaagacataagccgcctcatataataaatacaggacaacttctttgccatcaggacataactgaaaactaaaacacatatttgtcaaaaggtgtgttggtaaatgttggaagaatagatttgtaaaagtgaagtttggaagttttcataaaagaattaattagtagagaggggagtaccttgaccaatgagcttcctatatcagaggaaggcagatgagacacaataatctgaagtctaatgcagtttgttcaaatcctggataacttgcttaacctgtctaggtgtcagtttccttagttataatttgaggataataacagtataaattattattagtttattgtgttgattatatgaaataatccatttcctatagtttttactgcacatgggttaatataaaatattatcaacttttttactattattattgagttggcaaagttattcctattatgggaaaagattatcagacattttagcccagtgccttacaaaatttggatcttatcattcttttagttctgatcctgggctcatgaagcaaccttctgttgctaactggcatcctacataggcctgccttgagggaagaattgctctgctaaggccaattagtttctaaggaaactctattttaatacataaaccaataatttgatttttttttaaactttatagatcagatttatttggagaaaacaaaacaccgacaacccaaaggatgggattttacgtcaagacatctcccaggtaataagtctacagattaaatcattttcatggaagatatttttgtacaaattttacatgtattcaggagccggacattaatcaatccctgtttctattttaaaagggaggacaaagtaggggagggggaaaacagttttggatataactatttggaaggagagtagacatgaagagggcaaaccctagcttttcattatctacaaccaatgttttttttcttttaaaaaaaaaataaaacaaaaacttttcaatcttcaacactctttaaaagcccacttcttagctactggccaatccacagcaattatttaattcacttggtacacacctttgtcctctgggtaaattatattcattatgcccactgctgcagcacgcataaaccaacacccctgcatggctgaacagggcctaatctaggactgatgggagaagggcttgcaaaccaagatcaaggtgtcgtttctctgctaatactgtctacaaagctgatccctacaaaaatgcacataaaagcaggcaagtttatctactgtgttgcaagggaaaccaggactttgttaaatagttctctccattaccatttgttctctcaagggaagcttaaaaaaaaaataaagaaaaacagcacattggtctgcccccctcatgaatccaacaagcattggtgtggcatttcagtggagaaggaaacttggggggaaaaagcccatcaaggttgtaagaagactcccaatttaactgtccctttccctatttatccaccatccaagaccatccattattctagagcactctgatctataaaaggggtcaaagcatcaggagcaggcaaggagtgagaaccaaaagacatcaagaaaccgatttgcttgagaaaagcagcgattcttcctttcatagctctccatggctgagagagaaaatgcccgagacatcatgtatgtgacttagagactgcttttcgggaggttaaaagtagcatgaagagcttaagatgacgataagagtctaaatttttagtttcaaggtttcagtagaatgtggatatattcaaactttcaaaaaggacagtgtttagaaagggtaaaactaggacacagaaaacattgggaattaccacgacctccaagtgcttccggctccaggaaataaccattcatgtgtttgctggaggtcacataattttcccctattacctggtgcagaatgactcatcacttcccaaaagcttcttttcagtccacaattttcccatttattttggtgcaatgcagtcccattctttatggcctaccgtctcactcccaactaccctcctgggagtaaaaaaaaaaaaggaattccccctaggctggcccccaaaactcagaattaaataagaggaggggctggcagcctcctggagactaaaacaacttgaggctaaatctacctttccaagggtggaaaatttattcagataatgtttgagaattcatatatgccaccataggataaaaactaaaaggtagaaatctcacacttttccttctacctccctcccatactgcccaaccaggttccaggcgttatatcactgtcattaccacttctgctaaatggagacctctagtttgcttttataaatcaaacttgtgattttggcaaatgaatgccagccttttcatccagctcctagaggtaggacatcctatggtagacacaaaccctggggccttgtggaagcgtttaaatggctgaagcatcaaggaagccttctgagaaatgtttaagagttaaccaggtcaaggagataatgaagttctcactgccaaggtagtatagggcaaacaaaaagcttaaggtgtcaagatatataaacagaatggggatgggggtggtgtcatgtgaggggactacaagtacttcagggttgctaaaataagagttaaaggcagatacttgtaggagactgggcaaaaagtctggctgggtcagtatttaattgtatgcccccccccaaaaaaaattaataagctgaaatcctaaatccaaggacctcagagtgtgaccttccttggagatagagtctttactgagataattaagttaatgtgaagtcattagaattggttcaaattcaatatgactgatgtccttataaaaaggggaaatttgggcacagacatgtatagaggcagggtgatttgaagacacacggggacagatgaccatctttcttccaggctaagcaaagggacctggaatagatcctttcctcatagtccccagaaggaatcaaccctttcaatacattgattttgggcttttcacttccataattgtgagttaacacatttctgttgtctaagccactaaatccatgaaactttgttatggcaacccaggggactaattcagccagattttaaacctctgtatgtatctgctaatgagcttataccttctttgcatgataggaaagcattgaagtgtgtgtgtgtttttttaatgtgtgatatgagaggacttggtgtttgtatgcattagtgtgtgtgtatgtttatagatcattatgatatccctgtggaagatggattcctggagactaaatattcaagtcaaggacatcagttagaaaattattatgttaatccaagtgagttattactatgtgcactaagggtaagaaaactttaatatcagaaggactcaggaattgtttacaaaggtagtggaatgacattcagatgggctagaattggagccacactctcgggatgtgtgttatcctctgccacctgctagctgcgtgaccttgagcaaggtacttaaccttcttgatcttgatctcatttctttacagtttgtctgtccactgaagccaacaaagtttccaaatcataaacctgattgtcatttcattttctcttcttaaaaataaaatagtcccatggcgcctgctcttaaggggctcacaagtgggacaagatttccttccttccttccttccttctttccttccttccttccttctttccttccttccttccttctttccttccttccttccttctttccttccttccttccttctttccttctttccttccttccttctttccttccttccttccttctttctttccttccttccttcctaccttccttccttccttccttctttccttccttccttccttctttccgtccttccttccttccttccttccttccttctttccttccttccttctttccttctttccttccttccttctttccttccttccttccttctttccttccttccttccttccttctttccttccttccttccttctttccttccttccttccttctttccttccttccttctttccttccttccttccgtccttccttccttctttccttccttccttccttctttccttccttccttccttccttccttccttccttccttccttccttctttccttccttccttccttctttccttccttccttccttctttcctttcttccttccttccttccttccttctttccttccttccttccttccttccttccttctttccttccttccttccttccttccttccttccttccttccttccttccttccttccttccttccttccttccttccttccttccttccttccttccttccttccttccttccttccttccttccttccttccttccttccttccttccttccttccttctttccttccttctttccttccttccttccttccttctttccttccttccttccttctttccttccttccttccttccttccttccttccttccttctttccttccttccttccttccttctttccttccttccttctttccttccttccttccttccttccttctttccttccttccttccttttcttccttctttacaccccatttttctttaattaaagtatctaaggctcaaaaccccagcccaattttactctcatccctgacatgagtttccaatcacgatagatactaatttaaaagcacctttcttgagtccttttcctttactttaccatccatctgtatgatcagtctgtctttagtcactcctggcttccaatgagtgatttcctctatacaataatgttcaacagcttttcagtatctgttgcattaaatgcagaatctcttttttagcattctagatcattcatcattctaaaacacctttcaactttatctcccattcttcccctttgtattccatctgcattgatcaaatgagattatctcatcactgcctgattctacgcagtcccctctcaattcatgcacttcttctccattctttcctatagaaattctacccattcaacagggtccttcctaaatgccatttccaaactaaaatgttctctgcattagggtactttctcagtggtgtgtagtaaacatttactcagacttgaatgagggaaatgaatttactggcttaaataattggagagtctgaaagttattttcagttttctctaagtggtgtgtgtcttagtttcctgttgcttataacagaatacctaaaagtgggtactttatacagaaaataaatttatttcttgaagttatgaaggacaagaagtctaaggtcaaggatcctcatccggtgaggaccttcttactggtggggactgtctgcagaatcccgagaaagcacaggacctcacatgagaaaggatggagcatgctagctcaggtctctcttcctcttcgtataaagctaccagttccactttcatgataactcattaactcattaatcagtgaatggattagtccattcatgaatgcagacccctcatgacctaattacctcttaaaggcctcacctctcaatactgcaatattgagaattaagtttcaacatgaattttggagaggaaaaatatgcaaaccatagcagtggggaaaatggctccctttccccatctctccatgcagcagctctaggctacaatttataagtgtagaagaggagtgaaactattatttttattgttcagaaaagaaaggaaggaaggaaggaaagaaggaaggaagggagggagggagggaggcagagggagggaaagaaataaattccaattggctctacttgtgacagatgatcacctgggccaattacttttccaagagatttggaaagtctgattggatagcttggataatgttgagagtggcatggcttttgattgacagcccagacaggaacagatgaagtgacaaagaggcatttataaaacaatatgtagaaaagataggagtggtttggaatctggtgctgcttagtcaatggtagaagtagagacagtggtctgaacactgccatagaaacatgtgctagaacgtttattggctaattatatttcttatcgctgtgtgcatgcccctgtatagtgtgactttaccatatctcagttaagaggcatttcactcccttgatcctgggctggatttgtgatttgctttgaaccatacaatctatcagaagagacaaggtatgcaatccagagctaggtccccagaggccttggagattttgtttttgatgccttaggacactgccctgacattaccatcccaatgagtaatgaagacagatagccactgtcccagcagttccagttgagcctagtccccaagcaacccaccttctgaatgcagcacaggtgagcccagcaaaagaatcactcagccaaaccacagaatcatgagaaatgatgactagttattattttaggacactaagtgtggggtggtttgtaacatagccctagaaaactgatgaagaacaggaccaggcttgcactcccaggagagcacgaagaaaagttctcaaaaccgatcagtattactagtgtgttttggaaataaacccaatgagaaaaaacataggctatttattgagagtttgttatagcaagaaagtcagccaccatcacttgtgtttgggcagagactcaaagtcaggcagaggagtagaaaagccttagagtggataaaaaaggaaggcttcagctgtgccttggtgacagggtattggcaggaggaagctggaggtgagctgactagatacagggtccccatgtgattgattggggggcatatttatctatctttgtttggctctaagttggaagtggggtaaaaattagagaagctgtcaattaaattgtggcctttttgagccagttgtggcaaggcttgttgtttggcttcctggactggttgctgaagaaagtggtccgacttgtggcctggttactgtaactagcaggttaggtgcctgtgctgttgttgcagactatgagtcagagttctatttttataggcactctaattattgtccatttgtctattccgtttcttaatatttcactttgttacaaacagaaaaaaaaaacctctctctgaattgttcggaacatgaaccccagaatgggtttaatcaagataaactaaactgtgagaagaagacctttataaaatgttcattaagatggaaagatatgggtcaggagagctgggagtttgagtcctcgagggcacaggagtcacagcatttcaggggcaaagtagcaaagaaaaatcctctaaatggaacattataaaaggtcagcagagcaagacaaaaatatatattgctgtccatgttataaaagctgtcaaaaatccaaggcagcgtcactaagaagcctctttctaaaggcagatgcctggagtgagaataaaacattaactcattaacctttttattataaacatgtttattaatttcttaagagagaagggagttctatgagggaattggacttatgacaaataagttgtgatgagttcaatagaattgaaaaaagtgaaacacttctaattcacttagcaagaccttattgtgcacaagcaatatgtaaatcattgtttatcagtgagagcaatgcaaaacgtatgtgacatggagcttccctttaaggaatggttagtctggcagcctcgtggacactaaagcatgcctataaattcctggatatgatgtaaaaagtgataagtgtggtaacaggcaataggccatgggaatatggaagaccagaatattctcctttctctttagaaacatgggcaatgatggcacggagtagaagctgttaagaagaagtttaaaggaggcgtaataatggagctcttaaaaaatcaagtggaggacaagttcaagggctaaaaagggactttgggatctggaaaacaaattattaaagctacaggataaaggttaattggttggagtgttgagttagctgaacaactgaaaaaaaagtgaagagtgctagaaaaaaatatcagtttcagtcagacagtggaagacattgaatgcctagataagaatgctgacatttattctacatgaaaatgctcacaaagctttcaggaagtagaatattattcagaacagtgctctgaaatgaacaatcaagcagtggcttttacaacagataggtctgaggtaggttgtaatggcaccagataataattcattggcaaatatctaatgggggcaacagaaacgaatgagaagagataatagatggcctcaaatttccaagtatctgaccagataggggctgagaactgaaaaaaatggaaaagagaagtataaaatcaaaataccaaagagttgttgctaacttcacaataaagagccaaaagttatcactccatgtaatttcaaaagcctgctctccccctgtgacatcctaaagggacacatggaaataagttttgaaatggcatgtggccatatgattcattgtcatacctggaaattaggactcagagttatgttttcttttctcctttttgctatttctttgaagagctttctacaacccaaatactctgccagttttccaatgtatttgtgaaatggtgatcatgattttggctaccctcatgtggatttagagaagaaaataaattgaattcatttctgcaatgcacgttgaggatttcagagattttcttttatttgaagaaaaatataagcttctaaaatactcataacagccaaggttgggcaactgaaattgccttttgctctgcggagactgcgtaatatgagctggaaggaaaaaaaaatgatcctgaaacctgaggtttcacatcaacaactgaaaaaaaaaaatgtagaacataaattgtagttttcttgcagaatatttataacagctcacttgtagtactccggtctctagctgaacagggccaatggagaaacatttctcgattcagcgttttgtttgatccttactacagagtgattgatcacagcaatttctttcacataaacaaaatcctctagacaagcttgttggagacactcagggctatgaatacactgcagaccaaaaactaatattttgcttgctgtgtttaaactcagtgccaatagggctcaaatcacttgtatcataaaagcaaaactcttttaagcatcctgatttaattaggttccagggaaagggcattgcctaaacatgtttctcctgtagagaggtatctgtcttttcattagagccccaacatacaagcaacaaaacgtatggtttaacacggtgagcatctttaatcattaggaaactatccagcaactagctcagctacctcattttggagagcagagagccgtatcgggaaggaagagaaatggaggacagcatttcccgtgatcctgaacatgttctcatattgatgatggtcgtttctgccgccggagtagccggaattgtaatttgagaggagtgtcattttctgcagatacaaaccttgtgtaatcctcccatttaaatgacatgatcctgcaggctgatgatttcatggcccacaatttgtcacctccccactgcttgagagcgaaacggtagctaaacgacaatcaatagactgattttgtcatgcctgactgttcaccttgtttgaactaatttttagtttgttaattgtgttttaatatgccaccaaagggggaggtgatcattatttttttttaaaaaaaggaaagagattgtcaaatgaggtgaggagagggtgatttaagtgggatacattacagaaaatctataaagtcacccctgctccctggagtaatttccatagaggaaataaactagttacatttaatgtttgtgtgcaaaactgattttttttacttcttgttaatatgctttattttttctatcaggattcaaataattgtaactatgtaaacacctatatatgttactatgaatagatttttgtagtttcgatatggaaatataatttttcagagatagtgagcattcagttagtcactgattcatgtgtggtagaagtcatgcctggtaagatgtcatcttttctgtttaagaatctgtaagtagactggaaaagaaaggtttcagagtttttttgaatatcatgctttttggacaaagacaaatcttaaatataaatagactttaataaagctttaggacccattaattaaatgtcactttcaagatgcagaagtgaggctgaatgcagtggctcacaccagtcatcccagcactttgggaggccaaggccagtggatcaattgaggtcaggagtttgagaccaacctgcagaacatagcaaaagcccttctctacaaaaaattattttttaaaaatttgccaggcatggtggtgcatgcctatagtcctaactacttgggaggctcagatgggagaattgcctgatcccaggaatttgaggctgcagtgagtttgatcatgccactgcatgccagcctgggtgacagagtgagacccctaatctctaaaaaataaaaaataaaatttaatttaatttaattaaatgatgtagcaataatacagattagggtgtgggtgcctggattacctctgagtgaaggcggcttctggaggttcttaatcccccagtgattacagtaatcggtagtgtccctggaagattaacatactatggtatatgtcctctttgaaactgtttctttcctcttttgttggtatctgaacattaatatctttaggatgatgaccgcattcatcatccaaactgagaggcttttgaaaatgaaggaaaagagttattagtatgtatcctgggaatattgacaaaaactggggcagtccccaccaaactgggatgtatggccatgctaaatatctgctctctggactttcaggtggtatgatatgaaaattcacccacatctttacataaatatgggaatcgtacaactggttaaatagagtgtttctatatatggtatggtatggtggcaggtgtgacagaaaaaactagaaagtgaagaaagaagcatgtgaacatctttgcataaagaaactgcctagactttattactcatgaatgtaacatattagtgatttccagaaactagatagaatgaatgatctctaatagagaaccctcctcccccaatggttttgtatactattttctcaggatacttaataatttctttctaaactgcaaatgagaaaatgaagcataaatatggtcttgactttggcacacccaattatttgaattgttggtatcattttaaaataaaattgttttatattcctcttcctaaatgattcaacctcaagaccaattcaagtgttattcaaataatttgaatatctttcacttcatcccttaagaagtacaacaaacctatggttgggttgatggagagagattgatgtcatgccccgacctaggaatcagaggtgctagctaggctctgctcattagctcagagactagaatgagctgacctgcctctctattctaccagttccacttctaagggagccatttgctgaatagctgtgaccccttatttacagaaaattgcatctgtaaaatgaacaaatgtaaaagcaaaatgagtctgaaccagcatctctgactttcttcatatcatcaattttatgtttaatttttatatatataatcaaagttattatttcttctattgaataagtttttactattaggagctttgaatttgttgtcacagttgaagctataaaaagttaatccaggaacatttttgtaatgttactttttccttaaaatatttgaaaccttatatatctgatatacccatctttcatttttttaaatttcctttccattttgagcagaatcagatataattccttccatcctctcttcttttatcccttacttcacacaaatatttatatagtgtttactatttttcaggcactattcttggcacttgggatatattagggaataaacactaattccactgtggaggagctaatgttctagtggaaggaggaagacaataaatagggtaaataaatattgcaggttagacaataagtgtggtgggaaaaaaataggacagattggaggattcaggagtactgggtcaagacgtgagagtatacatttcaattttaaataagataagccccactgagaaaataacattcaagctacatgatattgtatgagcaggagctttttattttgcaatcagctgtattgtttcacatggggaaaactagagatgaaactcaataatatgacatggttgagataataaaataacaaaaaatgtataatattgggtgctctggtaatgactttgcatgtgtcattttatttaatcttcatgacaatgttatacaattggcactgttatctgtctgtgaggaaagtgagaccaacaataaccgacttgccctgggtcacacagatagtaagcggtgattccagaatttgtatctaggtagtctgattctaactctactcccttaattactagccatgttctcttgagttctttcataccaaggaaaatgtcgctattattcctgacgtatcttcaataacctcaataattattttgcactgtgtagggcctttgaaaagatggaggacacacattaactttccaggaaagatggtggtgctcacatttgataaaatgagagtttaacatcaggaatgaagaaggcatgagacttcctcttctcactaaaaatgggttatgcgtgattaggtgtttctcacccactcttaagagaaaaagcatgcatgattaatatgaatgggggttcaagtgcatatatcaaagggagaaacatcctcttgcattttaaagattgcaaataaatatagtttaatctgctatacataattcatattagcaacaaccacctcaaaattaatgtcagcccatgttaagatttgtgaatgacatctctaaagctttgcttcaggctattctcacagagactggttaatgcctttatggctaatttcctgaggcttatttttttggtctttcctgatgaaatattaagctctttttaaaaagagatttatctgataaaaaagtaaacccttgttcaacccgttacatagatttttctttaagatagggtgaggctttgcataaaaattgaaaagattgcagagggttcagtaacactagaggatctatgagatgtttttttcttattgaacttgacctcttactgttcagcacactctaaataagggatgttaatttcactcccaaacatactttattgctttggatattgagaagactgttaatctgctacttaaaaaatctcagaaggcaggaagtaattgcagaatttaacactgaacaatattaaactctaatttgactactcattctgatattaggggttatttcaaaagtaaagactagaagttctaagagtaaagagataagagttgtgtgctgtatttattctttcctcttcttttgggaagatgccagcaccccttcagtaacaacgcaagagcgtcttttcagacttctctttgcttttggtaaaaacatttatgtgtgtatcgaaatttgaacattctccctgaaatggtactcaaggagatttctaatcattcaaataatctcctaatttctcttatttccacctcaacgttcccaggcctttcctagctctgttctttttattttgttttttttactgtattggaggaaaaaatgcctatcttcactgccaaggccaacacattcatctctgccagagcagcattcacttctagtttcctctgggacattactcccttgggtacctattttcttactggtgttttttcacctctctttctaatgattcaaatcagcttccaggtatgctcagcctccctaccctaatatcataatccttctaaagtattttttctccttagtccttttctgccctctcctctctcttctcctcttgtattttctcccctgtgttctatccctcctctttatttattttccctcacttgattgccaaacttctcaaaagtgcaaactgtgtctactttcttagcatcctggcatatgaaacaaccatggccttggaggtaagatgactgggatttctttcctgattctatcttctggtgtgtaactttgacaagggacctgaattctttggcttgcaaataccgtattatatccctctagtttccagtgatggttacacaaactaatagatgatagaatcacatatcatttctcttggaagatagcaaattttcaagaagtaataactaacatgtattcttcagggtacacccttctcctttcccctaagatgagctttttaaaaatatcatctggaaaggagaagaaatagtacaaaagaataagtaaacattaacaaaaaatactgagtgtacataatacataacgtaacaaagcattagatgcagggaacttgggtcacagaatagacattagaaattccatttcttttctcagagctatgatgctgtggcaatacatgtaggagaggcaaagtgatgagagagaaccagaagcagactaagatgaggaatgtggttcttctaggttgtcctattgtgatagatggtctcacaagatgtccacaattaagtttattcctcccatgttgctccatggaaagatgggttttcttcctctccccttgaatctagactgcatttgtgatttgctctgactaatagaatatggtagtagtgatagttccaggcctggactttaaagggatggtggcttcaggatcctcccttggcagtgagatgccatgttgtgaggaagtccaagccaaccacatgcaaaagccaactgggaaaggagagatgactggctatcccctagtggggccagccattatggctgaggtactgctcatgtgaataaagacacatcttgtactttccaggctcagaagaaagtggagcagaaggactatctggctgagtcagcactgattccccaatgattagatataataaagtgttattgattcaatccaggaagttttgaggtaaatttttgcacagcattagataacagacacaattactaatgaaaccagcccaattgtcccatataaatgatatttacaggtttttgaatcaacatagaaattgatcttcctcatcttaaaacttgaaacatatctgagttccttcctaagaaaccaactctggggcaagggaatgagactcagcagatcaccgcatccagacaatgaaatgccagacccctcatccatcatgattgcttccttacccctccctaattcctctccacacatagctacatcccttccccactatataaatccttcaactttagttgtttggggagattatttgaaactgatctgtccctgtggcttcagcagctgattaaagccttcctccctggcaacatttgttgtctcggtgattggctttctgtgcagctagcaatgagacttagactgacactaacactaatatacttcagcaagtcatctgcatttgctgatccattctaatttatcaaatgagacaactgaactagctcattgcaaacatgccccacccagcctgaattctggccatccatcagttttgcatgtgcaagtatttttactgataaaagttagaccctgagttcaaaaagtcttagaacttcactcttatttcctttatgacttaagtcctctctcatctgtctttttctactttaaatgaagttaatatcatggatcaactagattaaatgagatagtctatgtaatacataattctggaatgtgataagtacaccactttccatgaaagctcttattattaatgaaagaaagaggaggtcccacagcctgacccagagttgtgtactctgatccacaccatcagtggaaaagaaagtgccgtttgtgagttctaaagataaatgctgtagatgttttccaacatggtgacatctctgtgtttccctccttaaaaacctgataataatcttcatacttctttggaaaacttaatagaatgtaatgtactgaggcatcacatccttagtccctcttaaattttctttgttagataatcagggcagagtatcagaagtaattaaaattaaactctgcctgaaaatatgttaataaaaagtatgatatgagattataagtattgttaagcaaaagttttagaactatgtagaaaaaaaagtacagaagacagtgttaaaaaaaaagaaaggaaggaaagcatggctagataaaaaagctgaagaaaaagttaaaggacatatggctctgtagcccactacaagtttgcaaaattcatttctttttgtagacacagcttgatataagctgaatcctgacaaattattctttgtattcagagtcacttaatttaaaacaatgtaaattcaaaggaagaagataatgttcctaacctcactgtgaccccagtccaattttgctacaccacctcaagcgagtcaaattcacaatttacatgcaggaagttaaccacaaaattagagcaactctttataggccccaaggttaagcatcaaaggcagaaatccaattaaaatgttatttggattttccaatagcaaacaatctggaaaacttaccagattatgagaaggatatgtatatgaaagctagagattatgtcttgcataaatcaataaataaaatttaaaaatgtttattcatttcttcaacagagatttatatttttgcagattacatacaagattttttaaagaattgtggagaaaagataaaaaatgacttcagccctcaacttaagaagataataatttttaaaaggtagctaaaacattcaaatatctatgatggtaggtaggatattaaaattctagatgagtgatgcacataaaatgagacagctgtttaagggaggagaaactccttccaggtttagggatggtaaggattgcaaatacttgtatacaatatctaacaagtacattagactttgaagatgcacacatggcacaagcacattgttacacacaattcatattcatttatttcagtcactcagaagatatttgtgcatacctgcctagctttcacatgctgataagacagtctctttcccgagctgtataatatgtgagtgggaagaaaaggtgctttatttaaattaaaattaaactataaggctgatttgtaaaatataaaagcaaaaaacctcaaatgaagagggtagacagactgacgagttagcaaatagaatcatctatcaattaacagtggggacctggatgtcaagttgcccggtttgaatcctgaatataccacttcctagcaaagctgaatttagtcatctgtaaaattgtgataataaaattagtagctgcttcttgaggattgctatgaagattagataccgtagtcctcccttatccacggttttgctttccatattttcagttgcctgcagtctgaaaagagatgaaaaactacaacaagatattttgagaaagagaccacatttacataacttttattacagtatattattataattgttctactttattattagttgctgtgaatatcttttggggcctaatttataaattaaactttattatagatatgtgtatctaggaaagaaacagtagtatgtagggtttggtcctagccatggtttcaggtatttactaggggtcttgggaagtatctcctgcagataagagaggactactgtaatacagtgcctggaatatagtacgtgcctggaaaactgaataattgccgacagtattaagattgatgtgaaactacctagacctggaagggcttggtggaggttcaggaaagaagaaaatgtttgagctaagcttagaatagtctttggacttgctggtcacaaaagaagagctttgttaaaacaaggacactgttggaattagcaatcactaaagcttcaaaatcttttaacttagaaccattaggttctcactcatctttggaatacctctgagatttacctgcattggcattgtgttcatctttttcttgatggaatttaggctcagagaattttagaaactcgtgaaagtcagaaaggaaactaattttctaattttcaaatatgatgccttatacatcaactagagaaatatactctcaattttagtttgcgaggtagactcgagtctaagtgatcctttctttgtgtactacacataactagttatgtcactaaaagacaaaaataaggaaataaataaatatataaaatgaacggtaatgtctctaccttaattcccacatcagtaaaacaaagctaaaaattatctttgcctctatatttctaagtaatgtttgatataagtatgaaccatgacatcttaaataaaaacctgagagaataaatgatctaaggggtgcttccaaggaaaggtgttatataaatatgatatattttcattaatagctataaactgtgagtccctgagaggatgggaccttaagcacttctgttaaacctcaatgatcttgtgaagatgtgtctggtcatcacattttctataatacaaacagttaaaacaccaacatgattagaagttaaattaacgataattagaaaaggcgataccaggaattgatttagtaattcaccctctgagatatcacttgtattgtgttcagtttcttagcttacctattctattttcaagtaccttattatgagtttatttcacttccccccaaaataatagattttagctttgtacgtatttgaaaatttataatccatgttttgtgcatgtgtaactctcagctcaccaatatatttcattatctgaaacagcctaaatcattccatatatgtatgtattactttataaataatgcacatgtgagaaagtgaggagaggctgcagatgttcagtaaagtgcttggttagacgcaaacaatattatgactggaagaaactcaactaattatccagttcagggttggcaaatttttttctgtaaaggccacacagtaagtattttagactttatgggccatacggtctctgtcaccactacttgactctgccattgtaccataaaaatagccatagataatgcaaaatgagtaagcatgacatattccaacaaaacctcatttacaaaaacaggcggcctgccaaatttggccctagggctgaagtttgccattgtataaactaatgcgactcacctatttcacgtgtgaggagattaaggcatagaagatttaagtgccattattggctattattaattgaattttcatggggagaaacagctctgtctgctaacatttttattctgctttgtcaatgaatcaaccttccacaaggcttgctggaatgatctttatgaaatgcagagcaagacgtgtcttttctgtgtttaaattcctttaacagatccctgacttccatgtgagattcagtctccttgtctagcgtatttaggatctgtaatcatgagatttctgatcactgcatcgattccatagcctactccgttttgcaggaaggctctattaagcccccacagtatgataaactgcatgacacataggaagtggtcctattttatttactttatctcccatgtctaacataatgcttgatacacagtagatcctgaataaatagctggaaaatgaatggataaattaaaagctgagatcagaaaagagttttaaggcaaatttgacagaatacctccttgcttggccctgactaaagtttcctgggtctcaccacgtgttcatggaaaatgaaaggactaggatcagaaaccccctcccaggtgaccttcatcagagctcacttcatcagcctgtctccctagtaacccatttctatattaatgtctggttactcacagggccccatctgtaccgctccttaattgtgcaaaaatattccacgaactaagtaaggacattgctatcgtattatccagcatggttttcatcagctggtcacacttccttctgcttcttcaatgtctctaaggaatttgattctccaaatgttcaatttgttgtgaggtagcacaacctagagttacaacttgtattcctagggctattacagtgactcacagtaggagaggatattttgatacctggatcactgaacccacctgggatgctaatgtatatgtccgtgtaatgtgtggaattaccatcaccagaaggttgtcttccccaaggcagtatccccttcctccaggaaaatgcagaattgttatcactgtaactccataccagcagcatcctttcaaggaaggtctcacagtcttagccaaaaagagcacactgtgatgctgatgacactgtttttactaagctagacaaggtttctttttaaaaatattggccaccaaacaatgggattgtgctttcttctgcttttaaaagcatgattttttttaactatctccactcaagctattaaattaactgattaaacatatttattagccaaatacttcctaaatcatcagattgatctggagactattcagaagggaaaactttttctctacccttttacattcagtattggaggcctatgaattaaaaggacaaaagacagattagcaagataaaagataaagtatgttcatatacatacaggagagcctgcagaaaatgtagctccaagaagtggttggaatagcatctgaactagtgggatgcattaggatttcaagggacaataaatggtgagaaatgactgtgaaatatatgggggaaattaatggaaggtaagatttgagtgagaaagtcctgtttatgcaatttctcatcccagtacccacttctcctctaaggggacaggagtcactccacgtggtacaggaagacttccttaaagggggatttatgacagttgatccttttggaacacttggcttttaggcagacaacaggaatgcagagaaagctccttcctgcatgtttggattctcaaatgcctttagttcaagataatccttatgccacaatgacataacgtgaaccccttcaagaaaaatgacactccacaaagaagaaaatcaaggcaaagaattcaatcattctggaagacaaaccttttgactaaggtacccaaataatattgtagatgtgttcgaaagccctaagttaatgtgactaagtattcactttatttttcaatcaagcagagccatcttattgaaagttgaaaccaggaacactctaattgaatatctcctcccagaagattaagaatttcttattaatattttatctctaaatgaatcaattaacttctcagtacaaactgtgcctctttttaaaatatataatttggtaaatttattatccaatatagcagagctgaactttttgaaaaagaagggttctctgttagtgtgtggcagcatccataacataattagaagctcagaatattggggctaaaaggtgtcttggtaagctcagcaactgatccttggctttatagggagaaaaagaggcccagagtggttaactggtttacccaaggtcacatagtgagctcgtgctttaactaggacttgaatcttgggctcagtcccattgaaatacttgaaaagagtatctaatgacttgtaggttaatgaatagaagcacattcatcagattaatgcagcaaagccctggatattgagaaaacacaaaatgacttagagctaattaaatacagacacaaattagaaaatgaggcttaagacagaatattaataatttctggtagatatctcatctttctgctcttaaagcaccctatgctgtcttctctcacaacataatgtcaccttcttgatttcaattcattatgcatgggttcaattctgtgctaccctcccatttatatgttgaagtcctaacccccaggacctcggaatgtgaccatgtttggagatgaggtctttacagggatcattaatttaaagtgaggtcattagagtggaccctattcctatataattgatgaccttgagaaatttggatgcagagagatgcacagagggaaaacaatgtgatgagacatagagataaaatggccatctacaagtcaaagagagaggtctgacacatatccttctcttatgcccttagatggaaccaatcctacagataccttgaccttgaacttctagcctgcagaactgtaaatcaataaatcccagttgtttaagccacccagtttgtggtactttgttagtgcagttctagcaaatgaatgcacactatttactcaatttttccccaaggcaacccgcacttctaccctgcccagcaccaacagagatggtgcggacttctccttatcatctcagaaacttccagtgtctggcttttcctgggtactcagttagtgcctgtaactgaattgccttacactaaatagagtacttgtactactctaactcaactcttattcacaacagctccctactttgggtagagtagtttatattattcttatttaactgatgattttccaaagaagataatgacattcccatgtaaggttacaaagtattacaaaggaaagagatgacaatccactgaaatgctttccaaatataatccaaatataatagtccagtctttaaaatctgagttgctttttgttgaatctgaaactgcctttaatttaccacatgcagcttgaggggtctttccagtggaaactgttttccgtcagggaaaaaaataagtaaacaaataaaagccctcaaaactgatcactaaatcagctcagcttatcaaaacaaaacaaaagaaaatcccccaattaaaacaggatttaaaacaatgaattcaattttggaaaagaaattgccaagtttgatttgtactgattattacgtgtttcaacaaactatttaaagtagtggatctttctggggttttacagagctctgtgtccatagaaatcctgaaataaactcaaatttaccaattttgtattgttttccaagaggagtatccactaacactgattaataataacaaatggataattatgtcattttatatgttcttttgttacacataaaaatctagtatttcttaaatgctggctacatgctttatacatcagttagcactctggcagaaaataaaatggtttaatgaaaagagtttaactgaagaaaatttaatgaaggcacatttgtgcagagtgacaggcaaagtaagggaaaaatcagtggttggtgaggtacccaaggctcagcaaaagtgagaagctattacaaccttaggcctgaagatgtggggagttaccatcagagtccagaggaggattgtgggggatggggtacctgagagggagtgtagccatggaggaacacagccacttctagaagagtggtaaggcaaggcttctctctggtcaggaccccctatgacctggcaatcccacacagaagtcccagccctgggagcccagatgatacactctgtaaagctctgttggtctatttttgcattgctatgaaggaatatctgaggttaggtaatctgtaaagaaaagagatttagttgtctcatggttctgcaggctgtacagaaagtatggcaccagcgtctgcttctggtgagggctcaggaagcttacaatcatggtggaaggtgaaggaggatccagtgtatcacatggcaagagagggagcaagagagacaaggtggagtgccagactcttttaaacacccagaactcacatgaactaatagttagagcccactcattactgcaaggatggcaccaagccattcatatgagatccaccctcatgacccaaacacctcccaccagtccccacatccaacattggggattacattttactatgagatttggaggggatacacacccaaaccatatcaagagcttaatctccagagaccagttagacaatgaatgggaggggcagtttcaaatggagaacagagtattttatatgaaccatctaactgaataatcttcaaaccccatgacatattttacaaatttagaagcacaagatcagagaagttaaaaatgtgcccagtttttaatgagcaagtagaatgaggagtatattagtctgttctcatgctgctgataaagacatacccaagactgggcaatttacagaagaaaaagtttaatggacttacagttccacatggctgggggagcttcataatcatggtggaagtcaaggaggagcaagtcacatcttacacggagggcagcaggcaaagagagagcttgtgcagggaaacgcccccttataaaaccatcagatctcatgacatttattcactctcacgagaacaccacaggaaagacctgcacccgtgattcaattaccactcaccgggtccctcgcacaatacatgggaattcaagatgagatttgggtggggacacagagtcaaaccatatcaaggagcaaatgaaatccaactttgttttagatctaatgaagaagaacaaaagaaaaatattgttttgctttcatacaatacatttcttttaaatgaaggaaggggaagagggcattatgtgaaacttgagaaaattgtagatgagttttatgtcaaaggactttgtgtttacttcagaatgtggaatgacttgacttggtgtggaagaggagcagagtcagtgaattgacaggaggatggagaacgtgccagacgagaaagtaatggacatatgttgataaggatgatcaaagaccaaagaatgaggcctgcccaggtggtgcatgcctgtagttctacctactttggaggctgaggctagaagattgattgagcccaggggttgggtcccatctaggaaacatagcaagatcctgactcaaaaacaacaacagcaaaaagaccaaacctcataagaaacagaaaatattaagaaatgagtgggataggaggttaaacaagataactagctctcgtataacactatataatttactaaaattttagtatagctcatatgacttgatactcaacagatccttgagagatctattataactatttcccgcctcatgttgtagataaaaaaacaagttcacagaagttaagtaaatggtagatatggaatttgactgctagcctgaagattgtctaatgaaccaagaataattacttgtttgagaagtctggaagtagtctgtgatatgaaatgtcaccaaactatgatgcaactctgtgagtactaaagtagaaatttagttgtttttagtcatttatctaatcaaataactatttctaatcaaggtatgctagctaactatgtattccaaatccttttaaaattttttattagacaccttgtgccccaaataagaaagctactaaacatgagtatagcccagggctttgataattttcattagcaccttagtttaactaatgcattatctgttaaataagtctgattaacacttctctacataatcattttctaatgcgtgcaactgttgcctctagagattaattgccaagcttttatgttcaactaacagtagattgacatttagcatcttagatttatagatttcctggtatgttattggactgttttctttggatggattcctccaaccatttgaaattggatttctccaaggataggtcgatgtaagcagtggagctaatcacatcattttacttcagcctcttctcacagaacttggtttattatgatcttaaaacctcctgggatatttttctagctctggatgtatctgaatgtaccaggtaaaatcaggactactgtaattcatccatttgctgtactatcttctcgttccatatagatacctttatgttgacatgacagtattagaaaaagacagctaccagagccctgcccacccatctacaaggtcaagaactattcccaccaaactattgaggccttgtatatactaggtgcttaaatgacatttgataacctggtttattgactttgaagaatactaatttagttacttatttaatattccaatgcacaccttcttcaggtaaagtgcaatgttggctattgaggaaaagataagtttgtggcttcaactatgggaatagtgttttagttcaaatcctttagtttcaaaagagataaacctttcaaactcagttaaaataatgaatgaaattaagtggaatcaaaggcaaggagtacagagaggtcattgcttctctgaacctaaacattattgtcattgtttctctgcatagctctgtgtttctgtgtcaatggccatcactacatttgattctataatatttctactgcaatcaagtcactaacataggcaaaggttaacttgttccaggtcaaaattcctaggaaaaagaatctgattcatccaacctgtgttaaaaattaatacttgatacaatcaactgctgccaatggatctggctcccgtaataaatcctcggccactaaggacagctgggtagaaatgactattatccaggaaagaggaacacacctggccaacccctttctttctgtagtacatagggtatctactttgaccagtttctgagagtagtttgcttcaactctccctcttcctctatgactgatggcagacaatctaacatttaactctacctctgtattagtcagggttctctagaaggacataactaataggatatatatatatacacatacacactcgtatatacacacacacacagatacatatatatatatatatatatatatatatgtaaaaggagtttattaagtattaactcacatgatcacaaggccccacaataggccatccacaaattgaggagcaaggacagccagtctgagtcccaaaactgaagaacttgaagtctgctgttcaagggcaggaagcatctggcataggagaaagatgaaggctgggaggctaggccactctagtagtttcacatttttctgcatgctttatattctagtaaaactagcagctgattagattgtgccaatacagatcaagggtaggtctgcctttcccagcctactgactcaaatgttgatatcctttggcaacatcctcacagacacacccaggatcagtccttttcatccttcaatccaatcaagtttacactcagtattaaccatcacaagtctacccattgtcaacttgaacccacacacatctcctgagctcatacataaccttcaaataaagacaataataaggtcataattacacctaacataatacaactatcttttgtacaactggaaacacaccaatacccaacccaaatactattacagaaagttaacaatacttaaatgctgctatgaggtcaataaattttatgtcacatgataaaggaaaaaggaaataaaatgaagatattttcttagtacaagtatatatgtgcacaaacatgtttttaaaaaaaggaaggaggaaatactcaagggaattacagtccttgtttctgcagctggtcttgggatcatagctggtattgatgactaccttcttctactgcccattctatattccctttgccttcagcaagaacctcagcaggtcatggttttgttttgttttgttttctggtggagtgacccaaacctttattcctgaagggtgtgtgccatttgtagtcctgcctggattgggctgttgtagtttcccattgaccttaatcagagggcatggtaatactaagagacgccctaatggatctcctgtattccatgcatactctcccttacctctgttgtagagtggtagatgatttcatcttgatagtctggatcaattgccccagccaacactgtaactcccttcttagcctgttgacttaaaggtaggaggagaccaaagtgtccaggtggcaatcctaacttccagtttagtgggatctgggatcgttgttgtgtatcctggtggaagtgttcctccctctggaactaagacctctagcccagcagaaggtaatattgcaggaacaggaagcaaaaattttgctagtggatcacaggggtgatggtgagtggtgccacttccacttccaccccttgattccaagacccatgaatcctggctatgggagaaacagtaccatatattggacactgattcagagcatacacgggcttctggagaactttgcccctgccctgcaaagtattgtcacctagttggcattgtaattgtgacttcaaaaggccattccacacttctatcaatccagctgcttcaggatgatggggaacatggtaagaccagtgaatttcatggtcatgagcccactgccacacttttttagccataaagtgagtgccttggtcagaggcaatgctgtgtggaataccatgacggtggataaggcattctgtgagtccatgggtggtagtcttggcagaagcattacgtgcaggataagcaaacctatatccagagtaagtttctattccagtgccctttccatgatggaagaggtctaatataatcaacttgccaccaggtagctggctgattaccctgaggaatggtgccatatcaagggcacagtgttggtctctgctgctggcaaatttggcactcagcagtggccatagccaggtcagcctttgtgagtggaagtccatgttgctgagcccacgtgtaacctccatccttgccaccatggccgctttgtttatgggcccattggacaatgacaggggggtggctggggaaagaggctgaaccgtgtctgcagaacaggtcatcctatccacttgattatttaaatcctcttctgctgaggtcacccattggtgagcactcacatgagatacaaatatcttgtttttgaccactcagagaggtccatccacatacctcgtccccaaatttctttctcaccaattttccaatcatgcttcttccaagtccctgaccatccagccaaaccattggctacagcccattaatcagtatataattacacatctggccatttctccttccattcaaagtgcacaaccagttgcattgctcaaagttctgcccatagggaagattttcctttacccttcatcattcttcaggggtgtcctacaaagcggctttagtgctgcagctgtccacttttgggtggtgcctgcatattgtcagaaccatttgtgaaccaggccctagtcttctcttcctctgtcaactgatcatggggaactccccatgaggccatcagtgcatgctgggggagaaaagccagggtggctggagtggagacagtgagtatttgaaccacttccttatgtaacttacttgttccttcagggcctgcttgagcccaatcacatatagaccacttccgtttgatgatccagtgctgctgtgcgtgacccactttatggccagatgggtcagaaagcatccaattcatgataggcaattcaggttgcatggtgacttgatgatccatagttaaatgttcagtttcaaccaaagcccagtaacaggccaagagctgtctctcaaaaggagagtagttatttgcagaacatgccttgctctaaaattctagaggcctctgctgtaattcatgtatgggggcctgccaaagattccaaacagcatccctatctgtcactgacacctcaggcaccactggatctgctgggtcatatggcccaagtggcagagcagcttgcacagcagcctggacctgttgcagagccttctcctcttctggaccccactcaaaactggcagcctctcaggtcacttgataaatgggctggagtaacccacccagatgaggaatgtgctgcctccaagatccaaatagacctactaggtgttgtgcctctttcttggtcatgggaggggctaaacgcagcacttattcaccttagaaggaagatctcaacagaccccacaccactggacccctagaaattttactgaggtagaagtccttgaattttagtcatatttgtttcccatcctcaggcatgcaaatatctcaccaataagtccaatgtgtttactacttcttactcactagatcaaatcagcataatgttatcaatgtaatggaccattgtgatgttttacagaagcaaaaagcaatcaaggtctctctgaataagattattacagaaagccggagagttgatatacccctgaggtaggacaataaaagtatattgctggccttgccagctgaaggcaaatttcttctggggtttatggacaggaatgaagaaaaaggcatttactaagtcaatggctgcataccaggtaccaggatatgtgttaatttgctcaagcaatgaaaccatatctggtacagcagctgcaattggagtcaccacttggttaagcttatgataatccactgtcattctccaacatccatctttcttctgcacaggctaaatgggagcattgaatagggatgtggtgggaattacaacccctgcatctttcaagtcctgatggtggcactaatgtcagcaacccctccagggatgtgatattgtttttcatttactatttttctaggtataagcagttctaatggcttccacttggccttttccttcatagtaaccctcaccctaccagtcagggaacaaatgtgggggttctgccagctactaagtatgtctatgctagttatgtattctggctctggggaaatgaccacagggtgagtctggggactcattggacccactgtaagtcagacctgagctaaaacactgttaattacctgacctccttaagcccctactttaaccggaggaccacaatgacgttttgggtcccctggaatcaatgtcacctcagagccagtgtcccatagtcccccaaatgtctagttatttccctttccccaatgcacagttaccccggtagaaggccagaggtctccttggggaaggatgagagaaagattccttgcataaattgttggtaatgtagtggagtccttcctcaagggggaccagcctccccttcattcaagggattctaggtctgtaaactggcttgtctggaaattgaggagctatgattctgtttttataattgaaattagacttagaagttttctgcttgtataaattaagtacgaatgccgtaggctctctatcaatttaacttctaagaacaccatgattaattagccagtgccagagctctacatgagtcaaactgttctgattgccactttacctctgctgtccattacggtagctatgcctaccttgcttttgacagttgagtgctgccacttggcccatgccaccttgggatccaattattcccattgtatttaaatttcatagttgggtgactgtggttcccactgttagatctgacatactgagaagagcaattacagggctcttcaaagatgcaggttttgccctcacaaatctattttgcaaggcattggtcaagggtatatattctagacctaaatctccctaagcctttgcatcccttcctctacattaaatcaagggagatcaggcatttccagctcactcacaatgggccatatcaatctgattatctaatgtcaagagatccgggtcccatagtaaatccttggccactaaggacagctggtagagatgactcttatcaaggaaagaggaacatacctggccaaccccattgtttctatagcacatagggtatcaactttgaccaaattctgggagtagtttgcctcacttcttcctcttcttctatacctgatggcaaacaacttaacatttaactctaaccctaggctgttaaattttcatgctagccaaaatgcttatctgcctttaacagcagcttgaatacttccccctaccctttcaaagatttatctcaggaacagtgcagggggacaaggccaaatcctgttttgtttctaagtacaggaagcctgaactgtactattatttagataccaccacttctgaactaactgcaagcaggagagtcaactatatcatttcaatgtgtttttataacacagcggcagattttagaggtgaaacttggaagagattgatctttttctacaaggaggtagagaatatgatgagaaatttctctatttgcactgcaagatatctttagtgaatctcttctctattcctcagctacaaacattttaactttttctctacagcaggttcatcacagtaaagatagtaagccaagtcctcaccttttctctggaaaatataggaagaaacaaaatagaggtcagataaaccagaaattgcatttaggaaacatacaaattgaccttgtaatgagcatgctgtgtagtttttttcccactatgttttctttcttaaaatcaaatctaaataatacagccatcatgtctagttaatagttgtgccattggctgggtgcagtggctcacactggtaatcctagcactttgagagaccgaagtgtgcagatcgcctgaggtcaggagtttgagaccagcctggccaacatgttgaaaccccatctctactaaaaacacaaaaattagccaacagtggtggtgtacacctttaatcccagctacttgggaagccgagagaggagaattgcttgaatccaggaggcagaggttgcagcaagtcgagattgtgccagtgcagtgcagcctggacaacagagggagactccatctcaacaataacagcaataacaacaaaaacataattgtgcccttagggggactaaaacataaagttattgaggggaaaatgtcacatcacaagcttcccttgttttacaaggacttgaggttaagtaatttcttccttccttatggttgtaaaatattgacttcagaagttgtcaaattagcctggcatggtccttgttacaagtaaataggttccttctgtggaggcactagcaatcaactttcccaaggatgaggtgctgatatcccaaggcttgcctttctccctattgaatttatctatttgtgcacctgtacacttaggcagacaatgtaatacatctatttatcgctaccaccagcgtatctgtctaaagctataactgaaggcatgtgttctcataaaagaagagaggcacattagtctagtttgatgcagcagtcacaggctttatgtagtgacttatctggagataagagtcttgactgttgttagacaccaccgaaagtcattactttgtgactgcaaggaggatgacaactcaactgagtgaaacttccagcaggttgtgcattagaacttagaacaacaaaagtgagagaagtgggggtcctggatttctattgattacaaaataagctgtttatcatcataatataagctccttatgaccagtgactaggaatttatttaatattatgcacagaagttttttaaaaacagaacattgtatgtgataaatttttgccagcaaatagatgggtgcatgcatggatggatgaatggatgcacgaatgaatggatggatggatggatggatggatggatggatggatggatggatgaatggatggatgcacaaatggatgaacgaatgcatggatggatgaatggatgaatgaatggatggatggatggatggatggatggatggatggatggatgggttcatggatgcatgaatgaatggatagatgcatgaatgaatagatggatgcatggatggatggatgcacaaatggatgaatgaatgcatggatgggtggatgggtggatgaatggatggatggatggttggatggatggatggatggatggatggatgcatagatgcacaaatggatgaatgaatgaatgcatgaatggatggatggatgggtggatggatggatggatgcatggatgcacaaatggatgaatgaatgaatgcatgaatggatggatgagtggatggatggatgcatggatggatgaatgaatggatggatgagccagactacttactttcagagttttcacgaataatataggatgctaggttactaaagttattacaaatgtgtgatttttaaggaatctacaatcagaatgatgcctacttctctggctgcttcttgtaacctccacgccttgcccacagagttctagtcacaccatagttctttctgttcttcatgcctgtttagcaccagggccgttgcacaggctgttcctcaggcccaaaagcttttctttatgatctccacatatctctttctttcctgatattcaggattcacctcacgtgttctatcactaggagtgattcttttaaccactcagtctgaagtagtgaccagattgttctccatcatggttcaatttcaattctctcctcaacatttattgtgcctttatgtatttatttgatagttttattttttctttacatttgtggctttatttatctttcattctccaataacgtttgagcttcacgattatttcccagcttatttagcactatatcctctgcatacacatccagttatagactgaatgaatggaagggaggaaaaaatcaaacattctcccataggtttaattactaaaaattccctaaattatatgcacccataaaacatttaaaacagtgtaaatttatacaaattagatatatactttgaagtgatcaaatttcctactttaaaaaggtggttgtgttgacctgtttatctgtcagccttggaaatatatcaaaggttaaataaatataatcatgttatattcttaaatcttttcggaatgaagtgaggtataaacacatgtgtgcttttatatatataaacacacatgtatatatacatgcacatatttctataattcagggatttgttggttcagactaagaactcttagttcctagttctttgctctatgatgatttagaaacctggaattttttaaactgaaagggctaatgtcttttcgtgcagtggttttcactggaggcagtaagatcatctaccgttgcacttggcattttgtgacatgtgttagttattataataaatgggagcactaaaaggcatttggtggccaggggctaggtttgctatatatctcaatgcatggaaaagccttatacctgaagaaagctttcatatctcccacaactttcaaaaatctgttcacaatcacccgagccttatacataattctgctttacttttaaacacaaagtattttgcactcagacctgccaactaaactctagccccaggtactaagctttcaaataggaactgtggcttattacattttactccctttttcctgaaaattcattaaaattcagttacgaagtctgtctttaacaatatcaaatggagcctttaaacgatgaccacaatgtatagtcctttcaaggaggaatgtctttgcccatcacatatctttctgaatttctagaagtctgttaaataaaaaggaacaaatccagacttaggtaaggagatattttgttcggaaagacttttatagtgagaggaaaaggactattgcaatacagagaatactctgaccataagatctgcaaacatctcaaaggacaggcagaaagggctcctcttttacaggaaggagtaaacaaagctagaaggagctgtctgtgggagtgtgaagaccagatggtgtggtagaacaactgattggggaatgtttctcctaggtgtcagtggactcttgagaggggccttaaaggatgagctcttctatattctgatgcttggttaaagtcaagggagagtcaaactccaggtgtctgtggagtgggaaaaccctaacaaaattttggtccagacaagtcagcagatacttttcccagattgattaaattgtataaactcagtaaatcaaaggatgatttcattttccttccacaagatcacagtaaggtttgtttgccgtttggggaagtcgcattcctaatggtcgcagtgcttgtggtatatgagcagtcagtacaaccacttgtatcatctgcatttgtggttaccaaattcgtgataattctggaagaaccaatgcaaacaggtgacgactgtgttttatcttttagtgtactaaagcagttggagaatatttcatttttaattgacttccttttgtttctccgttatattaatttaaggccttatatcagttttccacttccctagattatgtgtagagctagacaacatggctgtaaatgtaatttcaggaaaataaaggtggcattatgaaatatttgttctcaaaaagggctgtaggtcctttaaaactgcaattcctattccactgccagattattatttatgtataatgactctgaaactaacagaagttgagaaatttgcccaaagccacagagaatattaatacaattacacacatacatactcttaaattgttaaaaaatgttgacatgacaagcatggggctaggaatgcagatgaataaaaatgcctttttctgtccagtaaaaaaataacttctacacagaaatgataaaaactcaattaagaagtgactggtttagcaagcaaaaagtcctagaaaatgttatttctgataagtacattaatacaaacttttcattgctggaaactttcttgctatatttaagacatgtgaaaaagcaaaaaacaaaaacgtctagaaatctatttcttaatctgcaaaatggggataaaaatatgtacctcatagcattgtgtgactcaaacaaggtaagtgatgtgatccatgatttccaaacattaatgttcttataaattacctggaaattttgttaaaatgtagaatctgatttttaagtttctgtgggaattagaattctgcattttgaacaaaatcttcagtagttaccaataatactggttagagataattttgaatgggaaagatggaaaccccttggcacattggaaggggccagttttggttggaggtccttggcttccactcttgtactagctctttttgaagaggcattggctgtttccccacagatctcacttgcttcttttatttttagatcactcccatttcactcatttataggttttaagaatgaggggagtgattagatgaagactgtttgagggactggtaattaatactcaaaaataaatttttgaatatgcttctttcttcttcctattaaaagcataatgttctggtactttgtccacgtttaaagcagcctttctggattaatatagctactaatagaaaggggagaaaagttgctatggttagaatacatgtgttcctctgaaattcctgtgttgaagcttaaccttcacagtgatggtattaagaggtggggcctttgagtggtaattaggtcatgttgtaattaggtcatgagggctctgccttattgtagagagaggagaaggactattgcaatacagtgaatactctgaccataacatctgcaagcatctcaaagggcaggcagaaagggctcctcttttataggaaggagtaaacaaagctagaaggagctggctgtgggagtctctctctctctctctctctctctctctctatctccagacagacagatagatagatagatagatagatagatagatagatagatagacagacagacagacagacagacagacagacggatagatagatatagagagagtctcacatctcactctgtcacccagcaggctgagatgcaatggtgcaatcgttgttcactgtaacctgaaattcgtgagctcaaatgatcctcccacctcagcctcctaagtagctattttttattttttttttttagggttggggtctccctgtgttacccaggctggtttcaatctcctggtctcaagtgattctccaaccttgcccttcaaaaatgctgggattacagtcatgaaccaccatcctgagtgtttaaatacgcttctaaaagaggcttcatagaactgcctgtcccttccatctcctctgccatgtttttacaagattcatcctcttttgcccatctgccttccaccatctgatgagatgcaaccaagtgccaccttggaagcagaaagtgagccttcatcaaatatggaaaatattggcatcttgatattagacttcccagggtctagaactggagacataattttctttgcttataaactaccctgtctaaagtattttgttacagcagcaggaatagaataagatataggtattattattatattcttctggagtgacattcttattactcatatataaatattcatatctacttatctaaaacaatcacatttcttattttacaaaatagttttacagttcctcaactgggatacaaaaagcccacttttttagtgagaaaaaatgataaaatgaaatacaaaacagttctactagcctcaatattctacagatgcttcttcaatggacctaagaatggtaaacagatttttttaaagacatccaaatctaagacaccttgtatttttcagttttaccaatagatgacactagtgatacacacgcacgcacgcacacacacacacacacacacacacacacgtatataataacattccaagaaaattcttcaagtctgcagtcttggggataaaagcccaaggtaaagaaaccggtaacaccgagttgttaacatactaacattgtttttatagagtttttttattattttcatagaatttgcaaaagcatcttcaaagacagtttttgtggcagatgactgagcatctaaattatttttatcaacacacaattataacactaatcctgaaataagaaaaaatcagagggacttcatgaaaggaatatgtgaatatatatttcatcttgtaaaaattggttgcttattccttcatctataaaaccatgtggtctgaatatattgtttctcaggccctggatggagtaccaagaatgcagcctagtaaggcaagacactgcctaaaaagatggtcaaattatctagaaaaattagtaatgtaatcacactgtccaaagtccccatgacatgggagtttcaagggttgtcatgccttccagatgtgagggaccatagtttgtaacctgcaaaacaatattattgtgagtggtgcttttctttaaatgacgtctctaaaagcgattcacattcttgataccactttggaattggagatatttcatttagagcccttgaaatctgagtactagtgtgcatattttattcctgccttttctcttgttactatatgcacctaaaccgagtatttttatcataggttttttggttgtttgcttgttgttttttttttttttttttttttttttggtagagattgggatttctccatgttgcctaagctggtctagaactcctggactcaagcaatccacccatcttggcttcacacagtgctgggattacaggtgtgaaccaccatgcccagccaatttttatcataattttaaattggcaactaaccagatgctttatgttacccccccatcatcccctacaaatgactccatgtcagacacagacattaatcggtttatggagttaaatttacaaaaaggaaataggaaaaagcgacaggtgcatggcattacgtgctgtgatgtgtattaaaagagagatctcacagattgaaaggagatgtaaataccagcaggacatatttttcaaaggacacattcagaagaatcccatataaggttgcctgtcaaaggaagccattccattttaactgaatatttaagaattttatagtgacataggtttcatttggttcatatgtgatatattttattagtaaaatatatagtgcatgattatcactacccagatatgaagcaaaagttgcataaatcattgtaatttttgatgaaacaaaagaatatttcgtaatgctaatcgttattttattttttcaaaaatttgtaaaagtgagaggctaatgggaagcctaaccattggcaatgaaataaattccattttgattttcttttttaataaatattgctgcacattcctttccaggatcaagttaaactccttgctaattctttcattgaacaaaataatcgtaaagaaaactcataacatattccgatttcagcatccgtgggtattagtagtcacatgatctacctttagagacagaaagttgaaatctgatttttttaaaaaaagtaagtgcagtggcttaagtgattctatgcttttagacagtattgtcttcaataattaatttgtatagataaatgtagcgtagcatctttacatattattaaaatattgttttgagattgtcatggcaatatacatgcacaaaatatgtagactggaacaacaacacaaggtactcagtaacatcattaaatgaaaaataaggtttttggttatgtacatcctggttctactctttttaaaaaaacttaaattaattcattaagaaatatttattacagagaaaatgatatatattcaaatatgtatttatatgtattcacatatataatacataagatatatataagctatgaaacacattaattaaaataaccatcactaccctacttaacaaaaaccatatattgcagtcttagataaagttgaaaaaaattattggtaaaagtttctaagtaaatctactaacataaataattaggccttttaatttttaattatcaaaaactatatttttctttattttatttaagggtaaagattctcacagcacacatgcacaaccatgatatatatcatctaagaacttatttctgtatatggttgggcagtaagcaattctatagatgtatacacctatataacctatattaaaatatggaacatttccaacttcataaaaagttccctagggttccatttcagtcaatatacaccaagatccaaacaaaactgatcaatattccaccaatgtagcttacttatgcctgttgagaactcaatataaataggattatacaatatagactcttgtgatattgtgatataataagtaagttatatttggtctctgctcttgcttcctgacacactgcttcgaaaacccttagagagtgtcttttgtatgccaatgagctgactgttggccagggttcctgagatagcttcaggatgggggctgttcaccagaaagacggaggcatgattagagagttgagactttcaggcctaccccgcaacctccgtgaaggagagagaggctgaagatcggttgagttcatcacctatggccagggatgtaatcaattatgtctacatgataaagtcttcataaatgtccaaaaagacaagagtgtggagagctttcaggttgctgaacatgcagaggctcctggggggtggtgcaccaggagagggtatggaatcttcagctcctttcctatacctcaccctatgtatctcttccatctggctgttcatttgtatcttttctaatacactttgtaaaaaatggataaatgtaagtgtttccctgagttctgtgagccatcctagcaaattcacagacaccaaggaaggagaaaattcactggacctgcgatctgtagacagtcagaagaatgggtgacagaccattacaatagtcccttgatgtcttccaagatgccttgtgcataccaaaatccacagatgataaagcccacaattggccctgcaaaattcccagaaacaaaacgtcagccccttgcatccctctaattctgtattttttgatcctcagttatttatccaagaatatggaacactcagattctgagggcagattgtacatgtgattggtgtctgaagagagggaatcttgtgggactaagcccttaacccatgggatctgactctgacttcataaagttacttcagttctgacatgatagtggtagaattgaaatgaattattggacacttagtgtccactagagagttagttgttagtggggagaaatccatacacattttggtgagcagaagtgaactattctgtgttgagctgtgagttgtgtgtattagagtcaaaaacagtttgatgtttcccatcttttccaatggttccttttctagctcagactctcctctgtgtccaacttcactcacattatataaagtctgtgaggttttttccttctgtatgtatagcaactgtttgttccttttcatagttgagtagtatgaatatgtaatttctggtgtggagctattatgaataaagctactgttgaacctctgtgtataagtctttaaatggacatgtgttttcatttgtcttgggtaaattcttaggtgtgaaatttctgaatcctataagtgatgcgtgtttaagaaactgccaaactgtttatcaaagaccttccaccattttatgaacccctcagcaatgtgtgagagctgcagttagtctgctccaggcagtcatcaactattaccagttgactccactcccacattctactgagtgtgaaatcatatcttattgtagttttaatttgaattttcttgatgattgctgatattgagtgtctttccatgtgtttgttttcatgtttatattagttacaaaaggccattaaataattcagatacaaataaatattttgtcagaaatgttacaaatatttctttttagtatgggggatgactttagaatttcttggtgtcctttgagattagaagactttcattctcttggaggccagttttttttttttttttttaatgtttcaagcttttgtgtgtactatctttgaaaactcataacaatattttcttatatttctgtctctggaatttttataattttaccttttatgcttatatctataattcatttcaaattacttttcacgcatgatgttagtaggggttgtagtgaattgaattgtggcctcaaaaagtcctatccccagtacctgtgaatgtgacattatttggaatagggtctttgtagatataattaaggatcctgtgattagatgatcttagatttagggtgggctctaaatccaatgactggggtcactataagaaaatagagatggtgatttgagacacggacacaggcgaaggtcatgtgaaggctgagacagaaattggaattatgccttttcaagccaaggaatgtcagggttcacaagcagataccagtagctgggaaagaagtatggcatggattctccttcagagcctccaaaagaacgaaatctaccaacaccttgatttcagattttaggcccctggaactgtgagaacataactttttgccattttagaccaccagtttgtggtaatctgttgcagctagcacgcggggcgggggtgggggtggggtgtcaaggtttttttattttcacagatggcataatacagttgttctagaacacatatcgaaaagattgccatttcattgttaattattttgatgcctttgtcaaaaatcaaagtgcaggtcattcctagacttgctgattctgttccattgatctattttttgcaccaatgctatgctgtactttacattttcctgtatgtcaattctctactgtcttgataacagtagctgtataacatcttttgagatcagataagatagatctttcaagtttgttcttccttttcagatatgattttgctattctcagtgttttgtatttctatatgaatttgggaattgaattgtcaatttctacatttttttgtagaaattggactaggattttgatttaaattggttcatgtttataggtcaattggtagaaaatagatattttaaaaacattgaatcttttgaatcatgaatatagtataaatgcccatgtttttgaggttctatttttgtaaaattttcaactgcgttttccagtttttctgtacagttattgcatagcttttgccaaactgatttatgattattttatattttatattatggtaagtggtattttaaaaatttatttttttcaattatgttagtgctagcatataaaaatacagttaatatttatatatttaccatgcatcctatgactcgccaagtttatttcttagttccagcaagaaatttttgtacctatgtcaagattttataatgtggaatatcacataatctcagactaaagagttttagcagttctttttttatctctattaatttatttgcctttttggcttattgcactgaatatgatctgtagtaccatatagtataaaattagtgagaacaaatattttttatctagttttctcatattaagaaaaaaagcactcagtcttcaatcatcatgtcatgtcagctgtaattctttgaaatatgtactttatcaggctgaagatgtttacttttcttcatagtttgctaggaattttcatcataaattggtgttgactttctaactgctttttctgcatctattaagataatcataaaatgtgtatcctttgtccctgagatttaatagattttattggttgattttttaaaaacatattgaaccaaatttgtattcctttaataagcaccccttcagtcaagacgcattttccctttgtattttattgaatttaatttcctaatatcgcattgaaaatgtttgtgttcatatgggatactgaatagtaatcatatttttttcttttattgatatgtcatactagtacatattttgatggtatgtgtggtagtacatgtaggcaatgtgtaataatcagcttttaatatcagggaacttccagcctcacagcatttgttggaaagagtttcctcttctgttttctaaaatagtttgtgtaagattggtataaattctttatttaatgtttaatggattcttcaatgaaagaacgagtctggtgtttttctcataagaagccattccttttcttttttgtacttactaagttactaaacttttttattttatctaacgtttccaatttttgggatatatttcctcatgattttattttatgttcatattgatatttgtaggttttatagaaatatgctcattttatttctgatattgtcaatttgtgttttctctctttttattactcctgtttggaataataagttatcaatattatagatcaatactattggtcttatatcaatattgatataaaattgattattgatcttttcaacaaactaacatttgccttattaattttttctatagtttatttttttgttttgctattgttatttttgtttatttctgtttgtttacttttgctaaaagtacttttcagcttctgtaggtaaatacttaaatcattaattttaaatatctttttctagtattgatactttaaaaatctatattttatatttaaactgtaccacttttggataatgtataattggatctgctttacttctatctagcctatcaatttctgtctattaattgggactgtttagtttatttacactgaatataatgattgatctcattggtttaagtggacgagcttactacttgttttccatttgaccctttggtgtcttcttctcttttgcatcttttttgctttcccttgggttattctttattttagcattctatttcacttccttattgacttcgcagctatatctctttatgtttttaattggctctctatggtaaacgatatgcagccttaacttgtcggaatctgttaccccttcactcttcacatgatctgagaagcctaaggaggtttggcccagcacagggatagcccagtcctaaaccagagtctcctaccgtgaacttaagaatccctgtccattttgctcagctctcttctctcctgggttctgtcctgcagattcaagccacttcagctgcctaaactctcgtgcctgccccatcaggtcagtggaacactccagctatgcttggattccagttctctcagatgtgatcataaaattatgctcaggtagcagtgggttttcagagtgctcaccttgtcaggttcccttctcagtcatcacagtttgtgctgcatgttgaccactgcctgaattcaactgcttcatgtattttgtcaagttacaaacttttatgtggtcaatgggctagtctggtaccagttattaagttatgaccagaagtagaagtcttattagaatgtactgttttgaaaaggaaaaataccgacatgtacagcaagagcaaacttggggttggagaaagattaccgtataattataaagatcaacaattgaaaggaatttgtgtggggaggcaccacaaaaagtaacatgatttataagcagacatgtttttgtgtctcatttttcatacgtatctgtaatgtaagatggagttaaaaatcacagtcttttgagttacacaaaaacggatttgaatcacttttgcctcatataagttagatgaatatttctctctcaaatatcaatttacccatctatgaagttgaaatatttatattacctatcacaaaccttgttttgatggtcattgaaagtaattaaagtaagttatgtaatgaatctgaatgtaatgaagttatggaatgaataaaattatgtaatgaatctcaataaatgtaagttattatctttatcatctgcagtagaattattattattactgccttatcattaaggcattcttaaatactttgttacaattagatggttaataatataaaagttagttttttacaaacttaaagtaaattcttactgaagaactaggtttatatgtgggggtgtgtgtgtgtgttaactcaaaatatgcaatacccacacactaaatatacacagtcctttgagtcaatacataaatttaggtacagcataggtccaactctactctatgttctttaacttgacatttaacttgacatatgctgagtatagctttgacccacaaacgtaacattatttagatgtattttaggataagaatgtaaatgtgagtcatcatttggttatgactttatttttagttaattcttaactaaaattttaacaagtttcagaaagacattgcagtctgagtttgacctacagatcaatccgataaagatcaaatttgagcaggactttttctttccccaatttgtctgtctctagaatggttatctatgtaatacaagagaattcttagctgcactcacccaataaaataaaaattctacattaccagcagataattaatttctgttttaagatttctgggtgaataattcattattatgttcagcaacccaaatagtgacaagttaaaactttactcagtaaggacaataaaggagatagtacccattcttgtctgtcacattggtctagttggaaatagaagagctgacatcagaggcctttatagtctcagatagtaggtattatacaaaattctgatcacttccatataagattgaaatggaaatagttggaaaacagctgttttatcttgtcagatcctttaatgggacttaaggttcacactagcagaacccaagaatatttgcaagaaattgctaagtaatgaaaatttatcctgcagttccaaccagaaatgaaagtatcatgtcagtgcaattcccatcagatggtctttagataaagaatctgggcttttaacttcatttaatgaaaaaaaccttggtaatcagtcttgtagtgtaatggaacttttatctcactgtgtaagtaaattatggatggagttatacacccaggaggtgacctacatagtatactcaaaaggcaaaattaagaatggtattcgaccttgaaccaaatttcacacctgtactgaaaaattaggggtaagcttggtaaagtgctgaatgcaaacatctcccagacaagccaaagtattttattccccaaacattcctcctggatgtggatccttactaaatctcaactttaggagttcttctcttggttgggcacagtggctcaggcctgtaatcccaacactttgggagaccaaggcaggaggatcgcttgagcccaggaattcaagatgagcctgcacaatgtgacgaaaccccatctctactaaaaaaaaaaaaaatacaaaaagttagctgagcatggtggtgcttacctgtggtcccagctacactcagtcccaggctgagttgggaggatcacctgagccataggaggcagaggctgcagtgagccaagatgaccctactactgcactccagcctgggcatcagagcaaaaccctgccaaaaaaaaaaaaaaaaaaaaaaaaagacaatttttctctctttgttttctttgttttttagagaataaatctgaaactgcttgaaatgtgttaatctgcacctttggttgagaccatgaccttcggcattagaaagacaatagttcaaacatcagcttagatattactatatttgtgactctggatgatttacatacaacttttgaacctcaattatcttatatgcaaaatgggactagaacttgcctggcagagttaatttggtaaatcagtaaaataatttaaaagaaatgatattactatgcttaacacattttaaatactcaaaagtagctataattattatggatgttatgtatttcaaatgtgtaaagttttaagcaaggtactaaacctatggcccccttttcctatagttaaagtgggggttatttaaaggaaaagaaatcattatattgaagatacctgcactggtatgtctgtcacagcattattcacaatagcaaagatatagaatcaacttaagtgtccatcaacatgattggataaagaaaatgtgatatatatctatatatataggcaatgtataatatagacatatatctcatatatatataccttcaaatatatacatctacatatgccatcaaatatatacatatatataccatcaaatatatacatatatatatatataccatcaaatatatacatatatatatatagacacacacaccatggacataaaaatgaatgaaatcatatcttctgcagcaacatggatggaactggaggccattatcttaagtaaaataacttagaaacaaagagttaaatactgcatgttcttacttgtaagtgggagctaaatactgtgtacacatggatatagagagtagaataatagacactggagactcaggaaagtgggaggaggggagggagtgaggaatgagacattacctatttgatacaatgtactctattcaggtaacggttacattaacagcccagatttcaccagtaggcaatgtactcatgtaacaaaactgtacttgcatccattaaatctataaaaataaataagtcataaagtgaggatattataactatattataaagttgttgtaaaaattaaacaagttattgcatgccacgtgagggaaacagtgcttgccattttgtaagtgttccataaatgttagcttttatttcaagtgagaatatcagatagtgtttaagaagaacaccagctggctgtggaaccttcctgccaggaatttaatactagctttctcagttacttaacctctctgtgcttcagtttcctcatctgtaaaatttgtgtttcaataatagcatttcccaaacaaactacttgggaggattaagtgggctaatacatataataaactcagaatagcacctggcacatgtaaatgcatgataaatggttttgtgcttttgtatgtgagtatatgctattttttccaaaaaacaaaatagagaaaattataaagactcatataacaagcatccatatgctcagtactaaaaagtaacaagtgctaacatgttgtatcattctaacaatataaaaatatttcaatagcctttttattctgaagtgaaatattgagagttttttcctttttttctgtaacgctgccacactgaattttaaaatgcaaagtactagatattagtaaagaccatgcgtcctcgaaatcagatttcttaagtttgaattagtaaagaccatgtgtccttgaaatcagatttcttaagtttgaattctagttccactacttagtacctatgaaatcctagctgtttcctaaacttcttttatcatgctttctcaccggtaaagtgctggtgatacgttctttgcaggtttgttacaaatgaaaataaaagtaggaaaaattctcagcacagagctttgccatgtagtaagtgctcatttcactggaaaataaattcctgaaatattttcataaagtcataggagtaaaatgggatttgaaaagccagctaatctactccctttttaatgcaatttttacatctttaaatttatgaagatctcactggtatatttaatctccttgaatagtgattttttttggactattggttttaacattttcataggatgtaaagttattttaattagttgcgatcagaattaaaagatactctatttcaatttaagctctacaagggcagggttttgcttatttcgttatgtatatatgtatacgcacacacacacacacacacacacacacacacacacacacacacaatctcaagtgccacatggtagatgctcaaatattttctgagtgttaaatgaataaatgaataagaataggattgattcaaatggttatttttaactacataaatttcaaatatttgtttgaataaatatataaatgttgtatttccttctgacctgaaccccatcatatagtctatatgatttacgcatatagactataatagctaacatttatttagcatttactacatgctaagtactatcctcagcactttgccagtattagctcatttactcctcatcccagtcctgtgaggaggccattattagcctattttaaaaatggaagctgagatacaaagaactaagtaattctctcaggactaaatagccaataaatgtgaaagcatttcacaaattcagctgcaaaccttggcagtaaagcatttgcttctggctagagtccatgtcagcccctgtttgtatttaacagacaaagaagaagatactttaacaatgaatcattcttgtgagaaaaaaaaaaaaatggtggtggtagattcagttctaaaatctcaccagatgacacaatcttctacctcgtgaaatactgcagaacttaaaaagagaaaagaaaagaagacctctttcctcctacagggtaagaggattggaaaatcacttgcacttttctctttatcacttctgttgacttggaatgcaaactttcaaaaagtaacatgtgtggtgtagtgtgatttttaactaaggttggatttcagtttcactaaagagccagaaatagatagaacagaccaactaagccctgctttgttttcctaaaaatctttccttaaatataaaactgtccctggacctgctaccatctttctatgctacaccagagttcatttcaccttactctgggccaccttttaaaatgtctattaacggtcttgttttattgacacatctctgctgtctacctcgctggttcaagaagttctcaagaatggattgttttctcaatcagttttatcctagtgcttagcacagcccagaacttcttgagcattccacaaatattagtttaaccagtgaaagaaggatgacaatggtttaagaaaaagggatactgtctatactcccaacaggcacactgtactgtgggctgacaatcagaggaaaatgtgttcttctttagctataggtttaagctcttaaatgaataacaaatcaagaccttcacccacactaaagaaggcaatttcattattattattaagatgcttaacacattgttgattgttgacacttgattgaggtattctttacttgagatggccattgaagcctctaaggttgaaaactgctaaactgtgaagggaaacacaaaagataaaggtctgcattttctttgatctagtcagggtgtctgattgcaatttactctctttaaaaattttattggattgaaccttaactgagaaaagagcgataggagagagactaatattttagacattttcatattaatttagagaagtaaggcaacaatagggctgcacccacagacctttattcagttttgaatctaaattacttggggataccaatccttcttcattgtgcagctacatgcacccacacaacatatacagaaatacatattcccccctttctctctctttattcccaattgtatgttcctttaatatgctgtacttagatttttattcatatgttgtttcttctttgccagaaaagaatgcagagcctcccaagggtaagaaatactttgtttgcgtatctgtcatatacattctcagcactttcacccacttgggtttcctgtcataagcttttctttagattgagcaactaaagctcagataaatcagaagaattgcctcaaagatgcacagatcatatgttttattgttggaccccatacgagggactatcatagggtttagtgctggaccccatacaagggactatcatagggtttgttatctgtgtgaaatgagagtacatatctgtgtgaatttgatcgggttacatgcatagaatcaagttgtgtttacctatatgcctattaaacccattccagtgtaggtttcaattgagtattgagtagtgaaatctaaagaagatgcatgtgttattttctggtggaataattttattttccctttgtagattggcaaaaaaaaatgatgagaacagcttaaattttgttttggggaaaatcttttaacaaaaagttgttgtcatgaattttgttgctttatgtatctatatatctatatctatatctatatctattacttcttcaaggtcctttagggactcaaccatttttcaataacagatttttagcagtaaagttgcatatattccctatatcatcccttccatgaaaggaagtggatcctaaacaacttgggttgtaggaatgataaatccctaatgtttatgtgactcagcaggtaggggataaaggcttaatttttgaaggtatattaaggtaagtaattagggaaccattatgtgctagaacagtatatctccaaagacaatctacttctacttagctttactgacctgcccagtaaattccacagaagctgatggcgtaatccaaatccagcctattccaagaaacacatttagatataattttagttagagtcattgttgagtttgaaagagatgaacacatttcccttcatcttgaaatgttcccttttggaaaatctaattctccccaagaaaatgattggatacctaaatcatctttgaaaagtaaaatctttccctagatcttatctcatcttttaaagctcatgtgtttgtctctgacaatgctataaatgcattttcaagagaggaatttgtcctactctttaaattacttttatgaatagtcaaagtgattttcctttagtgttcaaacttcctgcagatgattagtccacacttccagaaaccaaaatatataaagacttcttcctaaattagtcatataactttatattgggcaataagtgaatactgtgcaattttgctttgtcagtaatctgacaaatactgaaaaatactgatgtatatcaagattcaacttctgagtgcccagtggctttctaaactgatcagttaaaaagttttgtcagacgcctgtagtcccagccactctggaggctgaggcaggagaagggagtgaacccgggaggcggagcttgcaatgagctgagatggcgccactgcactccagcctgggccacagagggagactccgtctcaaaaataaaaaaattaaaaaaaatttttaaaaaagttttgtcatccaatgacaacaagtttaaaaatattttaagagaagtatgaataagtaaatactgtatcagattgattataaattatagaaaagttaaaataggtcagatttttcattcttcgttttcatagtttgagattcttagattattaaaatagaaaggaactggttttctaaaggaactggattcaaagtcacttctatcttatgaacccattgtatacatgacatctgatgaagaagaccaatatgaaaagcaggggagagtctctggttgaatcagaaagctcctggccaccacaaaacttgtaacttgctccttgtcctggtggctcaagaagtttgtgaggtatagtttgaaaactactgatctagtcaaacagtactttatagagggataaaaaaaaaattctggagatgtggcatgaactgaattatttacgatcacacatagaagtgaaggcaaaatttaaaatggaaatcagcacacctttaaaacagccttctccatggaaacatccctgagaaattttcacccttactgatcattttgtcttcccatcttctcagcaaacacatcatttattggctatgtccacagtaacaatgtaatttgtgaaatgtttcaggtcagtgaagtaatctgggagaattgaaaatgctttgagggtagaactacatagcacagctttttgagtcccatagagtgcttttggtctatataaacaaacaatggataaaaggaagataagaccaacaatacagtattatacagtattgctttggaggcaatatatagcacagaacacttttatacagaacgtgacaagtgtttcaaaggaaaggatttcatgcaaaagtaaacttgataaagtctgcactaaacaaagttaaacagtaatgattgcctcctctgagttttgaatatgctaatgtatattaagaatctgcaataatgggaatttttcgaattttccatagagccttaaaaatatgatagatattgcatgcctcaagttcatggtctgcagaatatatttagtaaaatttaagaaaggaacaagactagaagtcagaagtttgatgttttgaactcaaaccctgtgccacaaaaactttggaaagcaacttctctgatcatcagtctcttcatccataaaatagcattgcctatctgagagttaaatatcaaagaagattaatataaaaggctttgcaaaaagttaagctccactgaaacataaagcatgtttattgtgttgtaagtttacaaatataactttactgattgacttgaatagaggcacaaacagcatcccttcaacaacattttcagaataaaacaatgatatttctagacaatagtgtctcaaataaaaaaccaaagttttattcaaataacttgcaattatgatagatatttttcaattttatttagtagccaggaatttgaatgttaattactttatcgtgaacttatttcttccatgaagaagctaattgaaaaattaccaaattctgtatttttgtaaacataacaaaaagatacattgagtaaatattttaaatctactcaagttacttgaagatttttctttatgagaggttacaaaaattaaacaaattcacatttctaacaaagaacaacatattctctctacaaatatatacattgtataatgtaatactaagtctaaaaagatttgcaaggcatggtggctcacacctgtaatcccagcactttgggagggcaaggtaggaggattgcttgaggccaggagttcaagaccagcctgggaaacacaacgagaccctgtatctgccaaaaaaaaaaaaaaaattgaccagccataatggcaatggcctggggttccagctactcaggaggctgaggtgggaggattgcttgaaccccagagtttgaggctgcagtgagctatgatcacgccactgcactccagcgtggaaaaaacagtaagaccctgtctcaaaaaaaaaaaaaaaaaaaaaaaaaaaaccctaggaagataaatttaagctactggttatttttaaaataattagtcacaatatttttctaaggaaataaagctcttttgaaacaactaatattctgatttactctaatttgccttgcccatgtcatcaaaacacttttgttatagaaggactacaaaaggctctcataactaatagtcttattagaaatgttttaatgcatagaagtagtcatttaaaggaaaatgaagacttttatgccaaaagaatgttgaattgatataaatggaaaaagtagaacaaggtttccctgtatttacatttggataaaatcaaagaagaatataagttccatgagggcatgcattctatctacttagtttactactgaatctcagagcccagaaaaatatttgaaatatgcaaggtgctttacacaaatacttgttcataagatccaggattgacagtgccctggtgcctgacggtggcaaacaaatatcctttctggaaaaagataacattgtccaagttttcaaattatttctacaaaccctatttcaatatttcctacacataataaaatacatccaggcagataaataaattgcaacacaagcgacaggagacacagaagcacaggtactacagataactggaaataaaaaaataacagataaatttgcaaatttgtaatgaactctcaactcagaattatatagtcaattaaaatattgttcaataaccaggttaaataaataaaatgtaatatagcaggtctaaaaaataaccaaataaaatcctataatagataaaataatctaaaccatttaatagatgttatagtggaaaagctagatttactgaaacagtatttggttaaaacaagtaatatgctgagagatatgttagaagaaactatccagaattaagacagtcaaaaggacacaatatagaaatctgagtagaaaacaataagagaggatgagaaggtctaatagaagagtcatgaatggaaagaataagaagaattaggcaaagcaatattcaataaatgttatgatctgaatgtgtccctccaaaattcatgttacaacctaagacccaatgtggtaatattaagaggtggggtcctttggaaagtgattaagtcatggtggctctgctctcgtaaacggtattagtgccctggtcaaagggcttgaggatacagcgtctgtcccttccaccatgtgaggatgggatgctggggtaagtcaccatctatggagtagagagtgagatcttaccagataatgaatctgctggcgcttagttctcggtcttcccagtctccagaactgtgagaaataaatttctattatttataaattacctggtctagggtattttgttacagcagcatggacagactaagacaatgaggttgatccttgcccaaaagaagtagaatgcataaatccacaggatcaataggcctaacaaatatggagcagtataaatggaagttagcacctagtcatattgtagcaaaatgtcagaaaaacaaatagaaacgtaaaattataaatgcactaagaaaaaaaaaagaaaataacaggatgccttcaaaggagccccaattagaatggcaataaacttctttaaaataataataaaaaacagaaaacaggcccgacacgatggctcacacctgtaatcccatcattttgggaggccaaggtgggcaggccacttgaggtcaggagttcaagaccatcctggcctatgcagtgaagccctgtctttaccaaacatatacaacattagccaggtgtgatggcatacctttgtaattccagctactcaggaggctgagagaggagaatcacttgaaccctggaggcactggttacagtgagctgagattgtgccactgcattccagcctgggtgacaaaaaaaccaaagcaacaacaaccaaaaaaacagaaaacactggaataatatcaatgcactgcaaaaaaacagaattagataatattcaatgaaaatattattcagtaatattgtttaataattttattatttaataataataattgtttaataatcaacgtgaaataaagacatctttcaaaatcaaaaattgagagaatttaccagcaaaaccccctgagtcaggttacattttccaattattgttttttaaaagtgtgactggcactgcacctgctcagaaataggatctatgttgtctcccctggaatctgaatgggctctgtgactcctcttataaataagtatggaagaggtaatactttgagacttctacaataaggtcacaaagattattctcttctctctgtctctgtctctctttcttgctttcttgaattttgcctttggaactcatgcatgctgtgaggaactccaacccaggccacatgtgggagagcacacagagaaaataacaggaaaagaaactgaagttccccatcaatagacagcatcaattccagacaagtaagaaaacaagacttcaaagattccagtccacagccttttaactcttccaaccaaggctccaaacctgtggagtaaagattaattatccccctataccctatctacatttccaacacacataaactatgagagacaatataaacaacttagtgttgagacttgtaatgtaatcacagtacctgaaactaattttggtaccaagagtggggtcctatgtaacaaagactttaaaaagccacaatgacaatgaatgggacagatggaagttgaaagggctttgaacaggctgagagtggaagcctgatggagacgatcagtgagagattatttaaaaaaataataaaggaggaaaatttgacacttgaagaaagggaatccttgttaacatactggcaaaaagtttaccgacactacactcacagtaaagtagtaagtagaaaatgtacttagtgaaatggataatttatttaaggagatttctgggtagagtgtagaaatgcttcctggcttctttttgctgcttataataaaatgctagacaagagaaataaacaggaaggcctgttaagtagagaggatccaagacttgcattcaaaaataaaaccgtctctctttccaacatccaagattctcaaaaaagaaagtatttcagagcaaagcaatattctttataaagactgcaagtatatgaaatggtgcctatgagaattgtagagtgaaacataagttcctttatggatcttaaagacatgctatattttttagaatttcatttaaaaaataaatctcaaattcaaagttaataaaacataagggttgacttttactgttagaataatatttttccaatgcccccaaattggattgaccaataattttctattcatgcaatatagcatttagcttcttgcaatatgctggggtcttcattgaccacttaataaccaggaagccaaattaataatctacagcataaaatgaatataatttctcaaatcaagagtactgtatttcattaaatccggccattgatagatatatcttttatataaaactaaaaaaactgacaaataaactatgacacaatactcccttattttataaaatcttattactaaaatttgtatttatactcattacattcaattatttaaggttttttaggtttttttcttataaataatttccgtgtggtatgtaaaaagataaatacttttgaaatggttaaagtacttctaaaacatcttaaaattaacttctaattatcttgattccctttatatctcagagctgttgatgtcattgttttcccacaccatagtttcttttgtgccatccaagacattattggtgcagcatttctaaaagattcctccactgttgtctgtaggattttcttctaagctctgacatctcatccattctgcaaattttactgctttcctgattttaccagatgataacaatagaaggttttcaggaaatatctaaaacacatagttctcaagtgattcttaggcgatttagtattttaaatgtcaaaaggtcacaggtatccagtgatgccacaaataataatgacaaaatttatatgtgtgcaagccactacttcatggatgccttctggccaaaaataattttaagatgttctgattgtgagctatctctagattaagatgttaaattatgacaaaatatgcatgctagaatcaataaaggatgatattttgggtaaaactatatgtcacttaatagcatgtgttgtcctaggcctagagtactttatttttatttttttatttttattttattttattttattacattatattttatttttttttgagacggagtctcgccctgtcgcccaggctggagtgcagtggcgcgatctcggctccctgcgagctccgcctcccgggttcacatcattctcccgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagtctagagtactttaataagctcacttagattttttgtggatccaagagtgacatccagtaggatataaatgaattagattttccctttcccaaaggcaacctgaaagttatattagagaccctataaagtgaagaattggaccctgcctacctacagtggtttaatttaatcagaatcacaagcccaagctagttggttatttatttctgctgcctaagctctagataatataaatgaaattttatatggtgccagtgctcctctgatcaacatagctttgagtagcaatctgtttggtgtgagaaaattagtaaaattttgataaatatcagggctctgcaagttgaatctgatggtatcaagcaagtctaataataggatggggtattaccattcataggttttcaagactttcataagctcatttgtatttccacagttccaaatttcctggagaataaacacaagagttacaacttgatgacagatccctatgcattccaaatggccacaaacaagtactctattcatggaaattttgctaaccctggatatttacactggttttaaaccaagttcagtgttccaaataacaagtgctccagaattatgagagtcaaacattctgtttaaaaaatttgtttagctagtatttgggcataaaagtactttttttgctaagagatatagaatgtatttgtactgatagctcactatttatgaaatgtatcatttatatctgctatctgctatttaggcccatctatatgtatatgattatttgcaatctgcaaatagttataattaaatgtagccaagcaaaagcatgatacctgcaaatttctctccaaactgagtataattgctgctgatcaactagttatcaaatgtcttttttctgcttgctttatatcagtaattttaatatgaacgtattgatatttaaagcatcatcagagtagtatgtttctttctgttaaactttgctatgtgttttagtgtttggatagaatcagtgagtgaaattttgcaggcgtgtgtttaacatgagaggaggcaagataaagtatactgctttgaccaggtctgcaagtaatgtattaatagtatttacattcctgacctcaaaaatcagttcatgtaaatttctatcttgttcaacatattggcaaaggcaagactgccagaaagacaatttaaaatgccaatgtggtacaaagtaagagggatgtccaggagagtttggagtgagtgaggctttcaaatctgggcccgtggcggaaaatgggggaaaaaagtgcatgttctctggctttgttaccaaagtaggagggtagcattcagatgttgctctgtccaatagcagggtacagtggtaaacgctctgagcttaagatttagaggactcagagagagaggttaagaggctggcccaaggtaactaacataaaagaagcaggatttgcagtttattcttatgttttgttttgttttttactctataaaaacaaccactattataggtaatcttgtgtatcagaaatatatatatatatatatatatatataattaaatctccatagatagctcttctatggtcttgaattcacttgaatgtgcatgacatcatccataaaacttagtggtttaaactaataagcatttgtgattgctttgacatctatgtgtcagctgagtggttctgctgatctgagccaggtttggcccatcttggctgggcttcctcatgcatctgtgctcagctggcaggtgaacagggcagtgggtgtccctttatggacctcacccatgtctggcacttggctggcagtcacctggcacaacagtacacaataggccctgtgtctttcattgtccagcagagtatactgagctcgtttttatgtttatggcaagtattgagagtgagaggcaatgtgcaggcccttggaactggcatctttcacgtccatcacaatcttttagacaaagcaattcatgcaaccaatcccgattcagggggtagaaaaaacatactctcatcatgatgggaagagctataaagtcacattgcaaatggcttgaatacaaaaaggacatatttttaattattctatcaaagcttgaataagaatgctttagaaatctcagataaaatatttcaaaagaggtcacagtttagctgaaagtaagagttaaacaaatgttataaatgcaacaattaaaaaaggtgaatgttttggctcatgtggagataaaggagtagagtactaatagtgtaaataattgaagtttcatgaaagcaattttatgtagaagtacttactttaatttatatgacgtgttaatggttgaaaaagtgagatgaagaaattacacttatttagtgaactgattaattctaaaatattattgtaacatagtttatcttctgcttgcaaaatttctatatttggctactgagcctaaagtattccaatgtagattcatgtgaaaggttctacatatcagacaaacccaattaagaatgtgatagggatatagcatcacagagcagtttattacaaggttttttaaaagaaagtaattgttaatgtaactatttgttttatttttcttctaatatccaagtacataagaaaataacaaaaaagactgattgcatcaatacaaaaataaaaacagatggtcatgaacttttacttacaattattcaataaccttagaaaaatataaagatcattctcctgctttgaaagaatatgaaaggtcatctggttgatctttctgactttagatggaatattcttctcttaacacacagttctatatttagcaacaacatttttagaccagtgtacacaaaacaacaagagattagtcatttcaaaaaatgaggttaaaaaaaccttgattttatactgcaattagtatgtccctgcccccaccttgaacttattctgtacctccattctgcatctccattctttcgagtgcattgtagcctctgattatgttacccagggacaagacacttaacctcactggaatcgttttctactttgatgagcaggagacttatatactgttaaagttggatgctgtattacatgtgattacactaaaaaccagaacactgtaaatgttaagtgtggattttgcagacacattggtctttaaatcctttttctgtactttctagttaaatctcattggtcaatatttgagctttattagacttgatgtctacatatgaggcaagcagataatcacattaactcccttagttcccatgacaagtaactaagaaaatgcattaaatgagtcccttgcacatttccaatgtgtggcaagtgcttccatggtagtcataaaatgaataaaaaaatggttagacacatcagtttttcctaacttatttgatatagatgataagctaacgattattaacaaaagaagataaaagactgcggtaccaagctctgagctgaatagagcatcggtcactggattactccaatcaccttcaggttgcgtaagcttaggaccacaacagatgcacattggactcgatattattcaatcaccacaaacagaaacacccacaatctctttggaagaaaatttttgattaattcatttagtgttttatttaatattataattacttaattgttaatgactttcctgctctacctaaaaagtttccatttaaaggttttctttctcatttattaagaatattctaaaatctcttttttttcttatctctcaattttctccaaacaacaaaattgtccagtatatccatttttccatagctatctttagctattttaactctgaacacatcagttgaactgtggaataatttacatttgttcaacaataaacaaacatatagaaagctgatagatcaatgtttccctaggcttacagtgcaattatttaatctctacatggtataaagtcacccatatttatttttctcctgttcatatatttttatgtccaggacagtaatttccttacaggagagttcctaatgtttttgtttgtttgcttttatcaaagcaaaaataaaacatggagccctaaattgttttcaggagtcaacaggctttgttggggcgagtatgtatgcataccagaggaagtaatgaaatcatttactctattcactttcctcacaagaaacctgccaagaaaacgcgagtaaagacacagatcgatttttaaacctggaaaggacctaagaacttctctaggtcaatctttttattacatcattgaagaaactgaggcatagagtaagccactgtgcaaggacgcaaaactatggaaaaatctggataggaatataggcttttcttcttcctaattcagcatgctgttctctacatcatggtaagaggacggaagggagatctatagaaaactttggtccctatgtggttctgcaaccaagcatctggtgatagacctggggctgctatgggcaaaagccatccgtggaaaaaatgatagacacagagtggatgagagtgagaatacctggagcttgccaggcacctctgtagttgctcaaggactccatctgactatgacaacctacagaatgtaatggatgtaccacttcactcactctttccaaatcgcatgaaagttcatcttttgaccaaatctaacctgtcaccgtagagtgaataggattctgggaaatagagtaaagtttagctattctctcccagtaaaaccaccccagctggtaacctctgatccattctaaatgtaaaattcttcaggcatcactctgctaaatttattattttagaacagcaaagttctaaggtgaatagagtgaaatacaactttttgaaacctttttaaatttctacattgtaatattattgtgagccttgatgaacctcagtttctttcttcaatatctgtcatcaaccaaacctttaaaaaaacatgtaatactccttcctgtcaaaatgttcataaaacagctatttggatctctctttctctctctctctgtctctctctctccttgtgtgtctctctctctttctctcttgttccatctctccctctcttcatctctttccattactctctccatagctagctagctagttagctagttaggatagatagatgatagatagatagatagatagatagatagatagatagatagatagatagatagatagatagataattgagagaaagatagatggagaaatagttttaaacagcttcattacataaaagaatattaaagttctgaaactagatttttttttttttgtaaatttcaaaagaatgtagacttctctttttctttagtcaaatttttggtgctttcctggaagctaaaacagcactggtgctgaaagggtggccattgcgatcatactgtcttccccatacattttctcaagtgtgttgaaccttcccacagatgaaatgaactcttaaagggcaagcactgtttgtagtgctaccaagaggaaaggttccttctataaaacagtaccatttatcagacccactcaacactaagataaaggatagggatatggaagcaattgtcctggtcatctgaggaaataaccaatggatactttaggctaaagcatgtttggcctgaactacccaataatgacctcctagctccatgtggatatgtttgaatgtccacttaagtttatgtctctcttcactttttcctctgtttgtccaaatacaatatcaagatcatccccaggtgatttttttattatactctgcttgggtctttcagggagtacactcctaggtagaaccaagttgcctctgtccgggcaacggaagcctctgcttccaattatttctgccctgcaggcacttcttataaaggagctttctttgccaagttctagttattatttcctgaggcctttttttccctttccaagatacctcttgagagcaaacttctgatagaactgcaactttgtgacactagatagtacaagaatcattattttggctttttcactttctgactttttacacacctataattacatgctttgcagtctttccattcagataaaagcagtattctttaagacttttttttcctttcctttatttctgtggttatgattggaaagagaggcttccaggaacctccttgaaagtaccaacatatttcattcatttttaaagttctctttaatttattttttttctttcaactagttataatctgaatattattataaccataatatggtggcaaaactgtcaccctctttgcacgttcacagctgcacttaaagagacacttatgataccatggatagaatcacacgttgttcttactcgtgtgtctaaacaaagttagaaatattgctgaaaatcgtcaaagggacgtaggttctggatatgccaacattttgcatgattctgaaaatactttatagttgtgtctttcaggcgaatcaatcagaactttagtcgtaatcacaacataatcagcgaatccagtatttccctttgggtcatatagaaggaacatgtatctgatcagtataccaataaaaatcggattagttctgagattctccttatgattgagaatctacttcatctcaaaactgctttacaggtctgacctgctacagttcaggttaatagcacacatgtgtgacttaaaattacttaattgaagctacagatgtgtttaatttagattccatagtaacgtgtgtgtgcatgtgttggcatgcacacatttgtgcaatcaaaaagaccatctaattacaaaataaagtaaaaattgaggattttaattatgcataaatatattacagatagttgtacggcttcaagtcaattgaaaagaccattgggacgttaataattaaagtgtggatttagaagctttattcactgcttatgctacttaaatataattttcttttaactttaaataaagggaaaattgattctgattaaacaacaaaatggaaccattgatgttaactaatgccatctattgcaagccagatttttctagcgtaatctttttttttggaagacaatatgagatggagatcacagggaaaacttgacgaagcttgcaagataatattccaattagaaatacagaaacatcttgtttgaaaaaacattagcacacagaagccttcatattcttcaaacacacttatatacctttactcaattcagaaaaataaaactgtaagcttgagcaatatgtatagacatcacccttgtgttacatttttaaccttgcaaattctatttgcgttggaattcagttttccatttgtaaattggaatcactgagtcagttagcttacttgctatagatatccaaggataccaagctacaatatacatctgaagacttactaaaacacaagcaaccttagtgagcaggatatcagtgggatataatatagtgggttttggaaccacattcaccagcattcagagcctgtctctgttatgatttagctaagtcaccaattctgagtctcagtgcccatgtctataaaataaagataaccatatttaaggttttgtaacaattcagcgaggtcacctaggttacagactttttactgaaactggcatatagaagttaatgttatggttcatactatcatatatttcaaccttctgttaccaatgaggtaatatgtgacttatctcgaaccacgctattctagcatgtttgggaaagaaaacgggttttcttattctcttttcctgcagtgactaaaagaaaaaagtattgtaatttttgagaaacatctctgtgaaaaatatgtgatctagaagatgtctctgggtacatggatcaatgagccatgaaaaaaatgggaaaataaaattgtcaattttttgataattcaatctgtttgggtaggacctttcctgctaatagcttcccagtgggtaattctttatcggctttttgtcttatagttaaaatggcacaagtggtcccagtggctgttggcagaataatctgacattttatgttattggtttcaaattcccaccaaaaacacctccccatgaccagaagatttagtatagtccatagacagccaatttccaaatttttggctcaacgtagaagggttttgtcccattaaaaaatatcccccatctattccttgattgataggattcaactgctccacttattttgccatttgaccagacttaaatctaatagatacggatcataactaacagccagcctgccaacaaatgattcaagaatgctgtatggataatttttttctttagtaaaatcaaaatcaactaagccacctgctgaatgatattgctggaagcattataaacaccatgaccaagaaattcaactgcaacctcttctatgacaatcactaacaatgttcctcatagcttgaagctgaactgaacagaagcagaatgtataaaacaggcatgttttagtcattgatacctagatgggaggatctcactttcttgttctataaatacagcaatgctacttggctgtaggtaaataataaagtaaacaaaattatgttcttcatacccagagccttgagttcaagtgctggctatgctcctcattagccagttgtgggatcttaagtatgggaccacagtatgttgggattgcaaaatgagaaaagtcagaataaattacttttaagtttcttttattctaagttttaaagattgtccttttctacccccagtgcaggaacacagaagtctcaaatttccacttacaacattataataaacttacttattcctttattttctttgtttaatttggttattcaaaaaacttgcattggatatctgttatatgtcaggcacagggcaaaattctgaggatgaaacaacagtccacattattaggaaacaaatcatagcaatgagtcaagctgtgatcctctgtgatatttcttgcttcattcaggtcactgctttcacttatctaaagtggcaattatttggctacgcaattcatgctattgcaggttgcaggttgcccttggttccttatgaaatacaattcttgacagtagttatggcgaggagttggttctttttattatttcaaaaacatttacctttttttttttttttttgagacagagtctctcttttacccaggccggagtgcagtggcgtgatctcagctactgcaacctcaacctccccagttcaagccattctcttacctcagcctcacgagtagctgagactacaggcaaaacccaccacgcctggctaatttttgtgatttttgtagagacaggatttcgccatttggccaggcttgtctggagctcctgacatcaagtaatccacctgcctttgcctcccaaagtgctgagattacaggtgtgaaccactgcgcctgtccaggttttacttttattaaagaagcacaaactgaatcaaaaaagtaaagtttaaggtgaaattaaattaattctctgatgtttcaattatattataggctgataaaaatttcagaatgtggccaggtgcggtgacttacacctgtaatcccagcactttgggagtccaaggtgggcagatcacgaggtcaggagtttgagaccagcctgaccaacatggagaagccccatctctactaaaaatacaaaaattagccaggtatggtggtgcacacctgtaatcccagctactcaagaggatgagggagaatcgcttgaacccaggaggtggaggttgcggtgaaccgagatcgcaccactgcactccagcctggacgacagagggagactccgtctcaaataaataaataaaaaaaaaaataaataaaaataaaattcagaatgttaggtaaaaatgattttgatttaaaaaaggaaatatgttaacaattagttaataaattgtagtttatttggtagaagatatattaagacatgggatccaaaatgtaattagactatgattgaataaggtaatatttaacctccctttaaacttaaaatgacaagattcttcataactttgagttgcttctttaggtttcagagtttaaaattcaaacttccacttttggacccatatgggatctcaagtttgatacatgatacccagagccgattttctttcttctctttctttcttttcttttttctttctttctccttccttccttccttccttccttccttccttccttccttccttccttcctccctccctccctgcctccctccctctctctctttctttctctttctttctttctttcaaataggctggatggacaagagttatgaaaattctggattttttaaaatagtttgtttttgaaataaaaatgtcaaaagacaaaaaatatacagtcaagacctataggtattgtattattgtttgtttgttttttagtattcagttggaaggcaggaattcctgaagatatactaaacttccttctgaaatattcggaagaaaataaaaagatataactgtagaaaacataaactcaaacatgacattatctgaattctgcactattatattaattgcaaaatgttccctatactccatcatttctgtgcattgtcctcaatttatatacaaggaaactgagacttaaggaccagaaataatccaaaagaaatgaacgtcagtgtggcttagtgaagactcatattttttaaccttgagaagaatagaagctagaacaggaagaactcaaagaacagttgtggtcatcacaatcaaactcattgttcccagaaatatatttgacaaaacttgagagtagtatttattctggttttattatatcaaattgcttttttctcaaagactttataacatgatgtgtattggaattacaagtaagaatagttctgaatatatatttgtttattcacccatttttgcattcaacacctatttcttgaatacattcctgtctcaagaatctaaaaatttaagatacagagggaaaccagataacatagttgtttccctcaaagagtttacagggtggtggagaagacaaatgttagacatataagcccagtgaagtgtgatacacactataatcacataatatgtaagcatattacataatagaattaagtgattgtagaaagttcctaaaagaagtggtatttaagctaagttctgaaggacaaatatgcattaattagaaaccaaaaggtaatgattgagtgtgattgatgacattgaactcaatgaaatattaatgtgttcaagtgccaacagctacatttgctacagtataaagatatgattaacacttgacctactttatttactgaactcttgaacttcttaaagtcaatccaaagtggtcctttaacataattgttttcaaaccttacagggaattgttgccatttccagatgtcagtgattttcagaaagtgcttcatgttgaaatgaaaatctactcaattacatactaaatcacatttcacgagaaaacacattacataactaaatgaaaataattatgtacccttcaatgagactatgaattttcttaacaatattaagtttttaaaaaacattttgatgatacaaaaattacattcttaaatataagtaagtaaaggtagtcagaataccatggaaaatagtcttctctatttaaaattcttgtaatatgaattgaacacattagattttataatggactctagtaattaaaaaattgatctaactataaacatatcgatttcctaataaaaatataaacctaaagccccattatatcatataaatatgaaataacttctagtaatatggtagactgagttggtgtagaatgacttctcccctgacccacaactacccaataacagtagatagaaattctggataacatgtaacacaagcagattaatagtgtcatcatccatctgcaaagaggagggaatggagaaggtagggggaaagaaaccttcaagatgtcagctacaaaaatattttttccaagtggcaaaatgttaccaatgttctagcttctcacatagttgggggtaaggttgagggtggacgtggtggggaggaaaccattaaaaatgagcttatagctaaaatcacaaccaaagttgtgatctactctgaggcataattaacaggatcaagaagtaggagaatcaacatatagaaaaatacaaacatgatacttttttatatgtgtcagaagttactaaaaatcaagaaagttttatgactagtaattatttatttttaattttatttttattatactttaagttcagggatacatgtgcagaatgtgcaggtttgttacataggaatacatgtgccacggtggttggctgcacccaccaacccgtcatctaggttttaagcctcgcatgcattaggcgtttgtcccagtgctgttccaccccgtgccccacatctcccaacaggcccctttgtgtgatgttccccttcctgtgtccatgtgttctcattgttcaactcccacttacgtgtcagaacatgcggtgtttagttttctgttcctgtgttagttggctgagaatgatggtttccagcttcatccatgtccctgcaaaggacatgaactcattcttttttatggctgcaaagtattccatggtgtttatgtcccacattttctttatccgttctgtcattgatgggcatttggtttggttccaggtctttgctattgtaaatagtgttgcagtaaacatacatgtgcatgtgtctttatagtagaacgattaataatcctttgggtatacacccagtaatgggattgctgggtcaaacggtatttctggttctaggtccttgaggaatcatcacactgtcttccacaatggttgaactaatttacactcccaccaagagtgtaaaaacgttcctatttctccacatcctctccagcatgtgtttcctgactttttaatgaccaccgttctaacaggtgtgagatggtatctcattgtggttttgatttgcatttctctaatgaccagtgatgacgaactttttttcatatgtttgttggccgcataaatgtcttcttttgagaagtgtctgttcaaatccttggcccactttttgatggggttgtttgtttctttcttgtaaatgtgtttgagttccttgtagattctggatattagccctttgtcagatggatagattgcaaaatatttctcccattctgtaggttgcctgttcactctgatgacagcttcttttgctgtgcagaagctttttagtttgattagatcccatttgtcaatcttggcttttgttgccattgcttttggtgttttagttatgaagtctttgtccatgcctatgtcctgaatgatatcacctaggttttcttctagggttttcatggttttaggtcttacatttaagccttcaatccatcttgagttaatttttgtataagaggtaaggaagaggtccggtttcagttttctgtatatggctagccagattttacaacaccattgattaaatagggaatcctttccccattgcttgtttttgtcaggtttgtcaaagatcagatggttgtagatgtgtggtgttatttctgaggcctctgttctgttccattggtctatatatctgttttggtaccagtgccttgctgttttggttactgtagccttgtaggatagtttgaagtcaggtaacatgatgcctccagctttgttctttttgcttaggattgtcttggctatgtgggctcttttttgattccatgtgaaatttaaagtagtttttttttattctgtgaagaaagttaatagtagcttgatggggatagcattgaatctatacattactttgggcagtatggacattttcacaatagcaattctttctatccatgagcataagatgtttttccatttgtttgtatcctctcttatttccttgagcagtggtttatagttctccttgaagagatccttcacatctcttctaagttgtattcctaggtatttgtagcaattatgaatgggagttaattcatgatttggtctctgtttgtgtattattggtgtataggaatgcttgtgatgtttgcacattgattttgtctcctgagactttgctgaagttgcttatcagcttcaggagttttgggattgaggtgatgggtttttctaaatatatagtcatgtcatctgcaaacagagacaatttgacttcctctcttccaatttgaatgccctttatttctttctcttgcctggttgccctggcaagcacttccaatgctatgttgaataggagtggtgagagagggcattcttttcttgtgctggttttcaaagggaatgcttccagcttttgcccaatcagtatgaaattggctctttgtcataagtagctcttattattttgatataagttccatcaatacctagtttattgagtttttagttgttgagtttgatcaaaggccttttctgcatgtattgagataatcatgtagtttttattattggttctgtctatgtgatgggatatgtttattaatttgcatatgttgaaccaccctgcatcccagggatgaaggcagcttgatcgtggtggataagctttttgatgtgctgctggattctgtttgccagtattttattaagaattttcgcatggatattcatcagggatattggcctgaaattcttttttttgttacacctctgtcaggttctggtatcagcatgatgctggcctcataaaatgaggtagggaggaatccctttctttctactgttatagtttcagaaggaatggtaccagcacctccttgtacctgtggtaaaattcggctgtgaatccatctggtcctgggcttttttttggttggtaggttattaattactgcctcaatttcagaacttgttattggtatattcagggattcagcttcttccttgtttagtcttgagagggcgtatgtgtccaggaatttatccatttcttctagattttctagtttatttgcatagaggtgtttctattattctgtgatggtagtttgtatttctgtaggatcagtggtgatatcccctttatcatttttttattgtctatttgattcttctcttttttcttctttattagtctggctagcagtctattttgttaatcttttcaaaaaaccagctcctggattcatttattttttgaaggattttttgtgtctctatctccttcagctctgctctgatcttagttatttcttgtctactgctagcttttgaatttgtttgctcttgcttctctagttcttttaattgtgatgttagggtgtcgattttagatccttcccactttctgatgtgggcatttagtactctaaatttccctctaaacactgctttaactgtgccccagagattctggtaccttgtgtcttagttctcatcgatttcaaagaacttatttattctaaattaattttgttgtttacccggtagtcattcaggagcaggttgttcagttttcatgtagttgtgaggttttgagcgagtagatgcagtttcttcatagtgtcattggtctttatattttggtatgtctttgcagtggctgacaccagtttttcctttccatatttagtgctcccttcaggagctcttggaaggcaggcctggtggtgacaaaatcccgcagcatctgcttgtctgtaaaagattttatttctccttcacttaaaagcttagtttggctggatatgaaattcttggttgaaaattattttctttaagaatgttgaatattggcctcctctctcttgtggcttgtggggtttctgcagagatttgctgttagtctgatgggcttctttttataggtaacctgacctttttctctggctctccttaacattttttccttcatttcaaccttggtgaatctgacaattatgtgtcttgctgttgctcttctcaaggagtatcttagtggtgttctctgtatttcctgaatttgaatgttggcctatcttgctaggttggggaagttctcctcaataatatcctgaagtgtgttttccaacttggttccattctctccgtcactttcaggtgcaccagtgaatcgtaggtttggtcttttcacatagtcccacatttcttgaaggttttgttcattccttttcattcttttttctctaatcttgtcttcacgctttatttcattaagttggtcttcaatttctgatatcctttcttctgcttgatcagtttggctattgatcgtatgtatgcctcatgaaattcttgtgctgtgattttcagctccatcaggttatttgtatttttctctgaactggtttttctagttagcagttcctgtaatcttttttcaaggttcttagcttccttgcattgggttagaacatgctactttggaggagtttgttattacccaccttttgaagcctacttctgtcaattcgtccaactcattctccatccagttttgtgcccttgctggcgaggagttgtgatcctttggaggaaaaaaagacactctggcttttggaactttctgcatatttgtgctggtttttcctcattttcatggatttatctagctttgttctttgatgatgatgacctttgggtggggtttttgcatggatgtcctttttgttgatgttgatgttattgctttatgtatgttagttttccttccaacaggcccctcttctgcaggtcagctggagtttgctggaggtccaccccagaccctatttgcctgggtatcagcagcggaggctgcaaaatagcaaagattactgcctgcttcttctggaagcttcaccccagaggggcaccagcctgttggcagccagagctctcctgtatgatgtttctgttgaccccttctgggagttttctcccagtcaggaggcatgggggtcagggacccatttgaggagccagtctgtcccttagcagagctcgagtgctctgctgggagatttgctgctctcttcagagctggcaggcaggaatgcttaagtctgctaaagctgtgcccatagccgccccttcctccaggtgctctgtcccaggaagatgggggttttatctataagcccctgactggggatactgcctttctttcagagatgccctgctcagagaggaggaatctagggaggctgtcaagttccagtggctttgcagcactgtgctgggttccacccagtctgaacttcctggttgctttgtttacactgtgagggaaaaactgcctactcaagcctcagtaatggcagatacccctctccccaccaagcttgagcatcccaggtggacttcagactgctgtgctggcagcgagaatatcaagccagtggatcttagcttgtggggctccatgagtgtgggaccccctgcctgaccaagaccgcttggctccctagcttcagccccctttccaggggagtgaacggttggttttgtctcgctggggttccaggagccactcgggtatgaaaaaaacttttgcagctagcttagtgttgcacaaacagtgcccagttttgtgcttgaaacccaggactctggtagtgtaggcaccctagggaatcttctggtctgtgggttgcaaaaaccgtgggaaaagcatagtatctgggccagattgcaccattccttatggcacaatccctcacagcttcccttggataggagagggagttccttggccccttgcactttctggatgaggtgacacccccaccctgcttttactcaccatccatgggctacacccactgtctaaccagtcccagtgagatgaaccaggtacctcagttggaaatgcagtaatcacctgccttctgcattggtctcactgggagctgcagactgaagttgttcctatttgaccatcttgccagattctcccccatgactagcaattgtagtatcataaaatattagcttgaaatgagcaagttaatacacttggtatgctgcccttactttaagaaaatgataaagaagtaaattgacaaggtgattttgtttttcagttttgatcttacccagtgccacctctcaaaatatgtatacatgtacttattttattgttttgattgattgtgaagaatcagtttttaaccaaaataatatgattttattaaatgacactttctcacaaaagccatttgaagcaatgcagaatgggatttttctctgaacatgtcaagttctgggagaacatttttagtgtaataggagaaaactatattttatctattcaattctgtcatgcaaattggaaaagaacttctgaaggaattacataggacttcaaaatataatactttcagcaagttaattgcatgaattaataacaacattttcagacaatcaaatcagcccactccactatgatataagcacgaaaagcatggctccagttttgtcatttgtgtgaccaacatataacactgattaaagcttgtcttggacaaatgaatttcagttattcaaatgaacagatataacagcaatgtatattaatttgaaaatgtaatttcacaagaaaatataacgaatatttttcaaaaaactacaagtgagagcttttctatgagaaacccagttagctttattattagatagtagctgttggtaatcacactgtttacacagctgaggaaggccatggattcagtgctttgctattaataacattaatagttgcactaagccctcgtcaaatgtcagacctttctcaggcttccctgtgatgcaaaagtgaagatgtgataataaaaatgttaatgctggtgatcattgtgaataagtccatatatcttcagaatgatgattttgcgcatatatgctttggtttgaatttcctctgaagcagatcctgagacaagaagttaagagcaaataatttctctgacaggtgcaaatgacattggtaaaattataggaaagtgttacagggaagagaagcagcaaaaagtgtgataacaagccaggaaccgtatgaatatctgtagctctgttctacaggaagactcttaaccatgatgaaaagcacagacctcagaattacttcacaagcaggccaaggaagccagataattatacatacatttcctagaaccattgattgagaccttctctcagaggttattaataccctggcacttccatcctacaataaaacatggataaacagctttctatggctctgtaaaatgccttaggctcaaatatgtatttactggcaattggaacttggtggaaacacaccaaaatagtgagttctgaggaacatgggtggggcactgagaacatctgctgcaactgacaaatgatttagctaattaaacaatgcattttaatgagttatctatgattaattccaaataaaagtagcatcgtatgaaatcagctcacaattgtttacacattcttttgctgattagcaacatcttaatgatatagtgttgaaaagaatgcttttatatatattgaaattctgcatattagaattgataatagtaagccatcctgcactttttaatttatatacgactactcttgggctccaaggaaccaaaactccaactgaaggagcttaaaccataagaagattaactattttgtataagaagtcctaacacgtgatggataccgaaatggttggctcagcaactataacaatatgagctaagattcatgagattcattgcctctttagcaggtggactttggcccttaggacagacatacccatgattacaaggtaggttttggagacccaaaacttacgactgaagcaatgcacaatagaagaaaggtttatttctatctaggtatctctttaggaatgaagaagttttgttcaacatcaccaagcacaacatttgtttatattcattttacataatttacttttaatactgatataactaatatatgacacaatttgccattttgaagtgtacaattaaaaaattgttggtatattcacaagattgtgcaaccacctaattccagaacattttcatcatcccacaaaaaaacacaatacccattagcatttacttctaatctactcacccgtcctctgtaactactatctacattatgagtctatgggtttgtttattttgggaatttcatagaaatgaagtcatataatacgtggccttttgtttctgtcttctgtcacttagcgtaatgttttcaaggttcattcatgttgtagcatgcatcggtgtttcattcctttttacgacaaagtaatattttattgtagtagtaatagcagtagggagaagatgagaaggatgaattataatagtaatagtagtaagtagtagcaacagcagtagtaatagcattcaagaccacagttagtttattcattcatctgtttatgaacatttgggttgtttccatatttatctattataaattatgctactgaacatttttgtaaagtttgtatgtgaacatacgtttttagttctcttgcatatgcatatgcagaattcaaattctttattatatggtaactctgtgcttaagttttgaggaactgccaagctgttttccactgtggctgcaccatggtacattctcaccagcaataaatgagaattattccattttctccatatccttggcagaatttgttattgtctgtttttctttgaatatagctattccatatggatatgaaatggtgtgacattgtggttttgatttgcatttccctaattactagtgatgttgagcaacttttcctatatttattgaacatgtacatatgaattttagtgaaatttctattaattgcttccccatattttaattgggttatctttttattgttgatttgcaagtgctctttatatattctagatacaaaacatttatcagatatatgatttgcaattattttctcccattcaagcattctattttaactttcctaacagtattatttgaaacacaaaagctttagatattggtaaaatcctattaatgtacatttttcttttgttgttcatgctataggtgtcaaatctaagaaaccactgccaaactcagggtcatgaagatttaaccctgtggttttttttttccctaagagttcaatacctccaatgcctccattgtggtccattttgtgttcatttttgtgtatggtacaaggtaggggtttaatatcactcttggatgtaaatatccagtattccagcacaattctttgcaaggctatttttttccacaatgaatgttctagccagggatgtccatttggtttctgtgggccactttggaagaagtattgtcttggaccacacataaaatacactaatgcgagtccaggcgcggtggctcacgcctgttatcccagcactttgggaggccgaggcgggcggatcacgagctcaggagatcgagaccatcctggctaacacggtgaagccccgtctctactaaaaatacaaaaaattagccgggcgtggtggcggcgcctgtagtcccagctactcgggaggctgaggcgggagaatggcgggaacccggggggcggagcttgcggtgagcagagatggcgccaccgccctccagcctgggcgacagagccagactccgtctcaaaaaaatcaatcaataaataacaaatacactaatgctaacaatagctgatgagctagagaaaaaaaaatgcaaaaaacccacctcaccatgttttaagaaattatacgaatttgtgttgtgcgtattcaaagccgccctgggccacatgaagccagtgggccgtgggttggaccagcttggtctagacacccaagttgaaaatctattggccaaagaggtgtaagtttatttttggactctcgattctattccattgatccgtatgtctaccattttgccagtgctgaactttcttgactattacaggtttgtagtccattttacattcagaaggtgtaagccctccatttttttttctttcaaaattgttttggctatttggggaacttgcattatcttatgaattttacagccatcttgataatttctgcaaaaaaaaaaaaggcaggtaaaattttaacaggtattgttttgaatctgcagatctatttggatctattggagagtattgccttcttaacacgttaaatcttccattagataactacaagaggcttttccacttatttaagacttccttaactttggtcaacaatgttttgtactttcattgtaagacttggacttcttttgctaagttgatttctaactttttttatgctaccgtaaatataattattttaaatttcattttcagattgttcattgctatgatttaatgcaacagaattatgcatagtgatcttgtatccataaccttgctgaactctcatttattaactctaatagtttctttttggaggattgctttatcttaccatctgcaaatataagtaattttaacgttttctttccaatttggttgcctttcctctattttccttgcctaatagtcctgtctagaacctccagcacaatgatgtatagaagcagtgagagtggacttctttgtgttatttttgctttggggggttaattatctggttttttttacagtttaggatgatataagattgtggttttctataaataacttatcagattgaggaaatcaccttccattataagtttgttgagtgtttttaccatggaattattttttttttctgcaatcatctgctcatttggcttactggctaatctattacctcagcatagtgtattacattgattggtttttgtatgttgaatgaaccttgcattccaggataaattttgctctgtcattgtgcaaaatcatttacatatgctgctgctggattcagttgctgttattctgctgaggatttttgtgtccatatttgtaagagatattggaccgtagtgctcttgtaatgtttttgtctggtttaggtgtcagagtaattacggcctcagaaaatgagttataaattgtttctcctcttctaaactttcaaaagggtagtgaaggactggtcttaattctataaaagattgatagaattatccagtgaatatcccttagtcttgagctattctttgagaaaagtttcgattactaaaccaatttcttacttgtaggtttataaatattttctatttttctgcagtcggttttattagtttatgtctttccaggaatttctttttaatatcacttgttggcatacaagtttttatagtatttccttataatcactttttatataaggtcattattaatgttccctctttgattctgattttagtaatttgaattttctctctgttttcatggtctgtcatggtaaagtttatcagatttgctaatcttttcaaaaaatcaacttttgattttgttgattatctctattattttttctactgttcattttattcacctctggccttatctttattatttccttctatccaccagctttgggtttggttttctcttctttttctagttcctcaaggggtaaagttaagttatcgttttgtaatctttattctttatttttgaaggtgtttacaccttgtactctctgcctgccttgcttctcctacattacagcatgttatgttttcattttcattaatatccaagtattttctaattttccttatgattttttctttgacttattagttgtttaagaatgtgttgtttaatttacatgtagttttaaaacttccaactttccatctgttactgatttctatctttattgtagttggaaaagatactttgtaagctatcagtttttaaaaatttattgaggcttgtttgtgacctaacaaatctgttctggaaaatgttctacatgcacttcaaaagaatgtgtatcctgaagtttttaggtgaagtgtggtctatatgtctgtaaagtgtggttggtttatagtgtcattcaaatctatttttatattgaacttccatttagatatcctatgcattattaaacattgattattacgtcttcaattactactatagaactatttctacctttcattctgacaatgtttgcttcatagattttgatgcacttttgcttgatgcacatatttgtttttttttaattttattattattatactttaagttttagggtacatgcacacaatgtgcaggtttgttacatatgtatacatgtgccatgttggtgtgctgcacccattaactcgtcatttagcattaggtatttctcccaatgctatccctcccccctcccccgaccccacaacagtgcccggagtgtgatgttccccctcctgtgtccatgtgttctcatttttcaattcccatctatgagtggcacatatttgttaatatttttatttcttcttggtgatttgacccttttattaacagataatatccttccttgtcttttgtaacaattttgacttagagtctattttgtctgatattagcatagccacaatagctcttttttagtatatatatgcacacacacacacacacacatacatataaaatctttttctgtacttttacatacaacctagttatcactttggatctaaagcgagtctgttgtagacaaaatatatttggattttttcccattctgcaaatcattatctttagattgaggttttggtctatttacatttaaaaatgttactgatagagaggaagttatttttgatgttttgttatttgtttctttatgtcttaaataattttgtttttgttcttatcagtcttcatttcttttattattgcattctttgtgcttagtttatttttatatcctcctaatttccttttatgtatattattgtattggtcagggttctctagaagtacaaaactaagagtacatatattaggtatatatatgtgtatatatactatatataattatatatgtatctaatataatatatattttatatagagtgtatatatataattatatataatgtcctttcatctcaacatgaagattctcttttagcattggttatagggtaaattttgtggtaatgtacttcttcatgttattaaggtgaaatgtcacaatctctcccatatatatatatatatatttcccatatatatatatatatatatttcccatatatatatatatatatttcccatatatatatatatttcccatatatatatatatatttcccatatatatatatatatttcccatatatatatatatatatatatgagtttatatatgtatatgagtttattaagtattaactcacatgatcacaaggtcccacaataggctatctgcaagctgaagagcaaggagagccagccagcccaagtcccaaaactgaagaacttggagtctgatgttcaggggcaggaagcatccagcacagtctaaagatgtaggctgggaggctaggtcagtctagtcttttctgcctgctttatattctagccatgctggcagctgatgagatggtgaccacccagattaagggtaggtctgactttctcaacccactgactcaaatgttaatctcctttggcagcaccctcacagacacacccaggataaatactttgcacccttcaatccaatcaagttgacagtattaaccatcacaattattaacatatttttgtgtttatcattgagagtatacttaacattctaaatttataacaatctagtttaagttgatactaatataactttaatagcataaaaactatgcttttatagtttcattctctcttctttatgttgttgttgccatgttgtcacaaattacttatttatacattgtgtacccgaaaatacagctgtatatttttaaaagtttattttattttatagcttgtaagataagctttattagcagttgcaaactgataataccataatactgactttttaaattgcctatgtatttagtacaatcagagatctttaattatttatatggcttttagttagtctaatatcttttcatttcaacgtgaagattcccttttagcattggttttaaggtaaattttgtggtaattactttttcatgttattaaggtgagatatcacaatctctctcttatctttgaaggatgattttgtgggtatagaatttttggttgacagttgttgtttcctagcacttttaatgtaacatcccactgttttcttgcttatatggattctgataaataattagctgttaatcttattgaagaatccttgtatgcaatgaatgtatttttcttagtgcttttaatattttctctttttctttggatttcaaaatttcataatatgtcttcatatgagtctctgagtttatcctatatggaggtattgaggattttggatttatagaatcatgtctttcattaaatttaggaagttgttagctatttcttcaaatatagtttctgaccctttctttctatattccaccttccacctccacccacacctgggaaattctataataaatatattgattcacttgatggttttcacgggcccctccattctctgactctttcctttgtctgcctgaatctatggttgaatgcctctagtaaatttctcattttacttattgcacttttcagctccaaaatttctgctttgtttctttttataatttctcttcattgatattctcattttgttatacacaatttttctgatgtcctttaattctttatctatattttctaatattgtctatgttttcctttccttggccttgtgatttttctgttaaaacttggacattggaatattatgatgtggtggtcctggaaataaaatctccccctttatcaggggtttgcatttttcaatattattaaggctgttatcctccatttatttagtgacttctcgaaactttatgcaaagacggtttcttgttgagtgtgatccctacagtctgtggtttcttgtttgtatttacttagtgttttaaaagagattcatttaaattccagaagccaagaacaaatatacagaagaataaaaaaaaaaccctcctccagtctttgcatcttgggtctatgtaggacactttctcaatatttagccaggcttgcactgaagttttagcttaagatgaaaacttatgaccttctcagatttttctctgagcatgcatcttatcctaaacaaggtttctaatatagattttttaaattcccttcacacacaagtctttttggatgtcctaattttttgaagatactctcccagcttttgatcctgggtcttacacagtctattatatgttttgactgtaatcatttggcccagaaatcttggttggttagtttgctttgcagtgtttttgagcaatgcccgtcacttttccagcctatgtttagaggtaggtaaaacaaataatagtgtccttaatcaacctccccgctatcattcaggcaggttagaatagaaatacacaataatctgtacataaggtctttgctctttccagagcaagagatcaggattccaaactgggaacccaaggtttcctcttcgatttgtgctgtgccagagagtggtggcaaaaatacaagtaaaaatgtcataaagctttcctatcattttggagttacatttcttgattcattgtttgcctaactgctgtaaacctttgactctctcccagagttttgacaaacttggttctgacactttctgcttggtttccaatgttttagctggggtacagtagcttgaagccatcattttgctgatgccactgctttggctatgagtgcattgtcttggttcagagaaatcagaatgtatgtctcagagcttggaataaggccatccactccaaaaggacaatgttttaaagagaaatgtagctggaactccctgtgtcaccattacttagttttatgttcaggaaactttgtctagaaaaaaaaaaattagaccacctaggttaagatgtctcaattgtattttccaaaaaactttccctaagaaagctaaaactacatataaatactttttttttttcttcagggaattcttgaatataagggtatcttagataactatttgctcaccttaacaacctgcatgcttatcaaacaataaattacttatcaaggattacttaaagacctttgccttactatgtccatcaagcttaagttgttatcttaaatgttgtcctacctcaataatttattttccctgaaagaccttccttaacacgtgtaaattcagaccccaagttctgtaaatacccagcttattgcttctccttctgaaaaactggcaaaactctgtcaggctggtgtctcctttattgcatgttttttaaaaaatgttaattttgatttatgaacagattggtgatattttgaagaattctatattaagtgagcaacagtgtacattacaatgtctaatagttacagtagaagttattgaaacttcgaaacattaaaaagtgtgtttgagttctgtacctgcctgtagattttaacatctgcttaacttggagtattataataatctaatcctgaggacttcataatttctaatgtaatattacagtttacatatattgatggttttaaaataatttacaaaagttatgtttttttgataataattctgttccacaaaaaaatcgtgcgtatcatttttcccaacctttgaaaaccttgttgctagattatattatgaaaaactagcaaataagtaattgcgaccacttagcaagtgttaccatctgagttgccacaagtatcaagtaaacttcttcgagagtataatatagattgtaaagcagcacgtttgtatccacagatagaattatctgcccaccaaagatagtgaagtgattagtgtcacctcttgcatcgtgaatagttggatggatagagttggttgagattgctgaggtgcttattattaacggcttaactcttaagtattttctctctttaaaatttcccattaaactaccgcacccactggttaatttcagtattagttagctttaagtttcaagttaatagaggaaaaaattttatgcgctttctcctcctatactggaagaggaacatgaaaccgaaacgcaaattctgggtttaatgaatctaagataaatcagtatcttcaaatggcaatataaaaagatggagagctgaagacataataatagactaagcagaaaaccaacaattgtgaaattttcttccttggtgaagaaaatattaacaaagtatacactgacttactccgggaaggttaacgttttgaggcacaggttgataaaaatactgtaatttaagttggtgttggatatgatgaaaacagacactgtttaaaagtctgattatagaacaagaagaactcaagactgcaagttccattattcatgggcaggtggataaatcttccacatttcaagagatagaagatttaatctttgaaataattcaattagctactcccaacttcaggatccaaagaagtcagacactgctttctgaattatgagacttgagttctcattttcttcctaacttttagaaaaatgacagagagacttttccttcaaggaagaatataggtgtatccttctctggctaaacaggacaactccaggtaagagacacatagataattgacatttgggagcaacaaataaagttcaaacaaattgccaaagctggccagaatttgaggaaacactccaaggtgggaaatgaccaaataaacacactttttaaaaaagaaaagctttacaaaaaatctcaggatgaacaaggctttacaaagagtagaacacttcaaaactgtataatctgtaccccttgggaaaacccaaaataagagcagaggaagctatacaaaagctataaaaattgcaattagagatcaagataagaattttagaaactcgacaaatgagtagataaaattagaaacatctgtgaaattttgcaggatataaatcaggaattcttttgaaaattagggggataaaaatcaagaaaatagtagagaacatataagaaaattgagtgagttaggcagaacaatatccctctaggagatgtctcagaaagagacaacagaggaaatactggggaagaaattaagaaggaaataatacaagagaaaacaatctcagaactataagaaataagtctccacattagaagggctcaccaagtgtccaagaaaatgaatgtaaaaggattcactctgaggcatgtagtcatacattttcttcaaaatactgcttataaaacacatatcctgaaatcctccagatactgataataaaaaagtttcatacaaagaataggaaatcagcatgacatgaggctctttatctgccacaccaaatgaaagttagaagacaatggataaaatgccttcagaattcagacagaaatgattttcctctttaaaatgtatttactcaaataatatgactgaatctggatttcagtatgaaggtagagtaacaatgttttcagatattcactgtctcaaacattttccttccatgcaccctttaaataaaaattgaatataggatacaccccaaaaataatgagaaaagaaagaaaggggaaggataggattcaaagaacagaggatctgttgcaagaaagagatcaagagaattcccaagatgaggtcaaaggaaatattgtgaaaagagcctgacaacaggtttaaataaaagcaactggtatattttggagcagtatgaaagtaaccccagaaaggatatctacagaggaaaaaataaaattgacagattttctgacaggtctgtctatatgaacattttattgggaggacttttcggattttttggatagtataaaaatttggcaaaagatccaaagactattaaacaataaaaatgaataatgtttaactataaggaaaccaacaggggaagtgaaaaatatgaaagtataattgtagtaaactatgactcaatagtgaacaatatctattatgatgtcataataattaaaacactgattatggcattaagcaaagattgtgatataactacattttgaaatataaaggtcgggaaagtagacagtaagaaagcttaaatcctcacttgccaaagtagaaaatttaatgaataatgtcaatgtacatctatccaccaacataagcatgttatttggaactatagaagcaagatccaaaagtttctccttccatgattggcgtgatgggagcaggaaccctggtgtttattctatgcacttagcactattgaatgctcaaaatgttttccttgttttcctttgataaaatattaattaattaaaaattgtttggcaccagtacatgtgcttggccattgtgagaagtgctaagaaaaaactttgttctgaattaagaaattgggttaaaagcaagatgcccaaagagtttggctttaaatcttgagttctattccacatatctgtatctgcttgaacatttatttactctctttacttcatatgcaaatatcagataattttactacttaccttgtggacttgttgattcttctcacttctttgttaaggtagcaagataatgatgtaaaatgctgggcacaggaatagcaactgtttaatgaatgaatgactgatgatgatgaagactatagggaaaatggtgatgagacaatcataaatccaacaaaacattcattatttcccaagcatcctcaaaaattcccaaactatacagtaacctactttattctctattcttttataaaactgtatctgatagtatcatctttattgtcatcaaaatggctgataaagtgagaagcattttcataaagacatacaaatttggattatcctaatagtaattaataccaaagttatttggatgtgtattttttcatcatttttcttaattttgacaccattttttgttgacatttttaatccaagtcaatatttttcattcactttgactattcaacgtttttaatatgcatctctatttaaacttgaagaagtctccacacatgtaagatatacacaagtgggaaggtggggaaaagaaagatgcccccagtgggtggattgtttgataaggagtgggttagaagaaggcagataaattatctattactatgattttttaataaaacattaaagaagggtgtaaagattgaaagctaattgttttttgcctagtgagattctgtccttgccattttgactaatgtttcctcaaacattagtttcagaaatcataccatgatttgaggctattaattcccaggaaaagagcatatgacattttgctgctgaatcttgtttttaattactaattacttaaggagatatgagaagcatatagtggcttttaatttcttttccagtttacaatttaaaaaattagtttaaattatttacagagaagatagtgtcacattagtacactaaattgaaatagaattgtattccactgccttggcttcaaatgacttagtgtgcttgaaatgattacctgtatatggatggctaaatagagaaatattaggtgtttagtatgttgtgaacttcttcctggcctatttattgcctaagtggcacttaagaaaattagacaaaattttgcactaagcctgatgcataatcaatctattcaataattcccactatgccttgaccttcataaggtcactccactgttgacaagtcttgtctgtaacttaaaattacagacagctgggtaagcccatcgagtgtcatggacacatctatttgggcacttcttcaatactttgactttgaaaaactttcaattcaccaactggtatcagtggtctaaagagggtcacttcttgattatttgacagctcctggaaatctctgtgttttttttttgcttctctctaagaataattatagatataaaggcttggaattcattttaaacctgtgatagtgtgactacagttcaacataaagattgataatgtagtgtctgttatgactcatatcttagccagtttttgttccccaatgtcagttttcatgttatacacatttccttttagttgagtatgaaaagtagagctagcaacatatatttggagtttttgagtttgtaggcatcattacaattgtaataattttatactcactgagagggccacagttatgttttaggtatattgtaattgcctatgattcctagctttggttggcactgctatttggacattagttgttgatcatcaacctattcacaaattgttattcaacataatggaatattctgaacaagaaattttgcaatgattgtgaaaagttcatacattttggctgtgttgaccatgggcttcagacttgtttccaagaagcatcaaaataattaaaactaaatttcaggcacaataaatagccatgtcaacttccatatctacatgataaagtgagaacggtttgggagtatacagctgggtgcataaacttacaagggagtttctttgaagaaaacaatatttttctcttacaagaattaattcaaatgctgctggtttgtggtgctaaaaaaatgtttctagctacagtgttttaaattcccctgaagaaaacaaaatgttttatgaatattaggattcagttttagactttcttacatttggaaacagggctacttgttggaggggttctcattttacttcacagtgagtgagtggctccagctgacttcttgggtgctttgttgaattggtggaataggtaatagtggtgaatgactaaacatagcagacataaccattagtaactcatagtgacttggaagacacctcaagggaaacagcgttcagccctttcatcttttgtagctaggccttcggtctttcagttgcaagaaacttaaattcaactcaaactaactcaaagaaaagagaaattaattgacccatatagtcaaggagggatttaggagtatttaccgaatagaatttttaaaaaacaaacagcagatgaattaaatatttagaacccacagtttaaccgtgctgggattttctttgaccttctcttgcttctgtttcttgctgtgtgttggctcaatttccttctagtgatcataagctttaaaacaaccacattttagcaacttcagtgggaaagcacatgatatttgtaaatacttatggattaatatcaagcagagagttggatttatccatcctttgagccaaccactattgtctgggaaataggttataatatttgctaactcctattgctcatcgctatgaccagagggctagtgcaaactacaggtggaagaatataaaagacattcttttgtaaaaacaggaaaaaaataacactgcctagcacgtccactgcaccacttcttgtgcaaacacctgtataacatccttacaggtactcctcagcattaactgggtaaaatgtaggatatgatgaaaagtttattagacctggcatctatctcatctctgtttctagccagttttgtggtgatgaaaaagacattttgcagctctgaactttatttcttcatccataaatttgttgctctatcattttcaatctctgtgaataggaattactgactgacaatctcattctgttgttgtagaactcagatcaagctccattgagctaaatgttgtctttcttgcattataatacagaaattaagagtgaactcttatatcagataacccttagtttgaatcctagtatgtggtactcagcaattcactcaaactctctatgtctcagtttcttcattgaaaggatttaattagaagatgtatataaagtgttggcaaaatgcctagcacatataaacactggataaatattagtcattgctcttattagtattattgttttcattattatttttaacttacaacaactggagtttggcttgtcaagagtcgtgcagaattaaagagtctgtctttcatggggacaaatctttctttccctcctgcttcaccatagtttacaattctttagagaagaggcgctttggatacttccccacataatacagacgatatctttcatttctaattgcccaggatcaaagactagttccacattaactaaacggccttaccattttaatgtgttttgaatcatttacaatccagagatatggaaacatagcaaaattttagagtaatggtaaaaagcacctgggaacatggtgtaggatggtgtaggagcaggtaattgagcacagacagttcatttaaatgcctagatcatgtaaaattatttacttggaactggcccaagtaatttgcaataaatgaccttattttttgcatgttgaaaactgctttttttttttgcttgagacaaaatctccctctgtcgcccagggtggggtggagtggcacgatttcggctcactgcaacctccacctcctgagttcaaaggattctcctgcctcagcctcctgagtagctggaattacagacacctgccgccattcccacctttttttttttttgtttttttgtttttttgtttttttttttggtatttttactagagatgagatttcaccatgttggccaggctggtctcaaactcctgacctcaagtgatccacctgccttggcttcccaaagtgctgggactacagacgcgaggcaccacgcccagctaaaaactgcttttgatcattaattttttgacatgtgctattatctggaagaaagtaataacaggtgaaaaaataattgttactttaaatgatgtcttagggacagccaagacataccattagctagggcaaaaatttattcaaactacttcagaattatgtagacagtttttttgtttgtttgtttgtttgttttttaatgggatgggcatttttgatcaaatgtgcaaaatagcttagcgtcattttttatgatttttaattttctgtcttaaacttatatacttttttgaacagtggtattttaaattaatattaatgtggaaaattcagagcattcttgtttcatcatcttgacaaccaggttagactggtaaggtgggaattataatgattatcttcattttactaaaacaattttcccaaggttacacagctagtctatggccaacacagacttgcagacatacgtattataaccaaaagaaagtgttcttattaatggaaaatagggtaaggtatttgttctgtttttctaatgttgctttagattctttagacaaatcatctgtgctaaggttgcttataaaagcatctgaagatcaatggaattaagttgagacaattctgaaatgaaaattcaagtgatgaaattccccagagttcaattatttgagttaaaagtgtttgtaataacagatcttggtacatagttggcacatttctccgttgtgtttttcctctttctatcacctttcagtttctattacaacactcttagggagtttactaataaattaattattggaaagcatatattgcctgaaggtttatgtaccagtagccattagccacaatatgcctagaatagatatgtcatttcccggttgaaatatcgatccaggagaacaaatgaacaaattatcaatttggacatgccaagaaaaaaaaattgaatatgtagccatgtttatttgagacattttactccataaagcatgtttaataaaaagaatgagttcatgcaagaattgcaaacagccagtcagagccatgtgatggtactggaagttgttttacaaatgtatgttccagttcaggagcatcctctcttagtaaaaacttccttttaatagcagcatcttaggcacttgatccacagaaggaagtaattaaatttaatacatgcaacactcattttgaggacaccctcgatttaaagtagcggggggcataattaagtctaatagaaatcatggcttgagaatgaagatacactatcaagcaaacacagaccaagtctacacagaaccaattacctggttaattagggctacaagctgtgtttatttcatgttattcaaccaaagcaaagcttgagggttgatattgtttgtttatttatttagttggaattacatttataattggaattaaatgaatataaaccacaatattagatgagcttaatgctcatatatagccacccaaaaagaaaaacaaagaagtggaatcattaactaagtgtttttaactgaaagagtagatttggaagcatatatatacatagcctaaaccatcagaaaaaaaaaactatattcccctttccactctttatcataagtataacttcaattaaaggaaataactttgatttatagttagaccacaacatagtatctgttgtcctgtctgttatagatcaagtcagcttggtgtaatggaaacaactctggcttaggagttaagagttcgtggtttttatcatttcaattcatttatacttctgtttgtcagacatacgttgaccctacagtgtggtagtcagcagagggaaagatggggaaaataactaaaccaacaagatctaattcttaccattgaggagcttgtagaatactgttagaagtaaacatttgagaataattatggtaagatgtatttaatagtagaatggatgtttgtagaaagagttgtaagacataaaggaggaagaactgaaaaataaaacaggaatcagttactctgtattttcccggaccttaaagggtgataaccaaaggcccagggaagggcaatggaggtagagtcagcagcacatgcaaggacatgaacagaggcccaagacattcctttgagattccagattatatgggggatctgtagtaaaatgggcgtgggactaggaagctctgattgttcagagcagatgaaacctgaggtgaaaaaggaaaagggaggccagatgctgggtacatttatgggatatatgtaaggtttgactttaccttttggaaaacaatctttgaagccaagaagttctttatgttttgcctatattgttacctgaaccctgagaccttatacttccttttatccaaacagtgtctggtatactgtgtgttgaatgaatatgagtgaagaaataattggtaacaattagtattcaattttatatcataatttttaatttatgattttaaggatcatgcccttagtaaattagacacacagtggtcttcctggaatgcgtttatgcctagatacaacaccagaagcacaatgtaaattgacgataataaagaactgacacatgtgtcaagaaacagcaacgtaagcagttgtgcctcagagaaaggcatagagagttttagcaaaaagctgtgcattgggtaaaaatcatggaaaaaaagccaaagaaaagttaactcaggctctccaataatctgattgtgaggtttcactcacatcattcctctaagttttattaattaattatataagttttttgagcacttactgtgctcaaggacattagggcatgaagcaacaatggacactgttctcgtcctaatttggcttgcatttaatgggctaaagtcagcaaggactctttgagagcaagcaacagacaccaccgtgagttctcaccagccaaaacggacttaattagaagcacccagagtagcttacagatggaaagaaagatggaaatccaggccttggaaagaccagagatcaacaaaatagaaaattacgtagtaggaattaatagaatatggaatatatatacaatggaccatggggtgcagtgggggagcaattttgcaaaggagaatggaattatcactaacagaaaagatagggtatattgaataggcaaaatagaacgtttgtacaaaaaaaatctttttctttagataatttctgaggcgttttctggttgtaaaagttctggaagttggcaaaggatcatggtttggtgtttcctacttttttaaatcatatttttctttctttagaatgcaaccctgccttttgtgaatagaatttcataagtgaaggaagctggctttcatctcaaagtgaaactaaaaaaaaaaaaatagtaaaaagttttcctttcaaaagaagaggctgtgattgtctttaaagtagttctataaataagcattctgcagtctgtgacacactttagagaaagagcaaagttcagttctatagctcatttaaaaatatccttcttgagttgagatggtcccacagagatttattttcatggatttataagctctgagaaactgcagtttaaacataggctggctgaaaaatgcttaattactcagtttggtcactgaagcaacaacattagccctctagtcaaagaaaatgacagtgttatcaaaactaacctgcaaagctttattaaaactatctttggcgataatctcttttaagaatgcattgtttttaattagaccttggctttgaaagcaagaagggtcaatgaaaaaaaatttaatcatgtccaagctactgtgctacatctttacaaaattcaattatttctatccagtgtggcacaagaaacatttggcaactgattaaaacaattcttaaagcaaattacagcactgtcagaaaacaagaaatcagaatgtcaaaatacaaggacatttctatgcaaaatgtgttgcaagtgtctttgacagagtatttctgtctgcttgttttattactttcattaatttggtccacatcaagtaaaaagaaaaaaaaatacttccatgtgttagctatttgaaataaaaattctcaaatgaataatattcccaaagataaccaaagtagccatgtggggaaattttatgctttaattttatccaagcttactcagcactgtaaaaatctatgttgaggtttctagctgtagggatcccaaaataactgcttttttttttttttttggcagtaaatccacatctatgcaatttcagctactactaatatgtagatgccattagacgtagatgttatgtattatttcagggcagaataaaacataacaatatgtaatttataatatatttgatgtgcattttaaaaagtgaagttttttaaagtttagaatgaataacaagtttgtttttcttaattatgctttaagttctgggatacgtgtgcagaacatgtaggtttgttatataggtatacacgtgccatggtggtttgctgcacccatcaatccgtcatctacattaggtatttctcctaatgctatccctccccctgacaggccccagtgtgtgatgttcccctccccgtgtccatgtgttctcattgttcaactcccacttatgagtgagaacatgtggtgtttggttttctgttcctgtgttagtttgctgagaatgatggtttccagcttcatctatgtccctgtaaaggacatgaactcatcattttttatgtctgcatagtattccatggtgtatgtgtgccacattttctttatccagtctatcattgatgggcatttgggttggttccaagtctttgctattgtgaatagtgctgcaataaacatatgtgtgcatgtgtctttctagcagaatattttataatcctttgggtgtatacccagtaaagagattgctgggtcaaatggtatttctagttctaggtccttgaagacttgccacactgtcttccacaatggttgagctaatttacactcccaccacatcctctccaggatctgttttttcctgactttttagtagtcgccattctaactggtatttcattgtgattttgatttgcatttctccaatgaccagtgatgatgagctttttttcatatgtttgttggccacataaatgtattcttttgagaagtgtctgtttatatccttggcttgctttttgatgggattgtttgtttttttcttgtaagtttcttgtagatctggatattagccctttgtcagatggatggataggttgcaaaaattttctcccattctgtaggttgcctgttcactctgatgatagtttcttttgctgtgcagatgctctttagtttaattagatcccatttgccagttttggtttttgttgtcactgcctttggtgttttagtcatgaagtctttgcccatgcctatgtcctgaatggtattgcctaggttgtcctctagggtttttatggttttaggtctcatgtttaagtctttaatccatcttgagttaatttttgtgtaaggtgtaaggaagtggtccggtttcagttttctgcatatggctagccagttttcccaacaccatttattaaattgggaatcctttccctattgcttgtttttgtcagatttatcaaagattagatggttgtcaatgtgtggcattatttctgagacctctgttctgttccatttgtctatatatctgttttgctaacagtaccatgctgttttggttactgtagcattgtagcatcctttgaagtcaggtagcgtgatgcctccagcttcgttctttatgcgtaggattgtcttggctatgcgggctcttttttggctgcctgtgaaatttaaagtagttttttctaattctgtgaagaaagtcaatggtagcttgatggggatagcattgaatctataaattactttgagtagtatggacattttcacgatattgatttttcttatgaggatggaatgtttttccatttgtttgtgtcctatttcctcaagcagtggtttgtagttctccttgaagaggtccttcacatcacttgtgagttgtattcctagcattttattctctctgtagcaattgtgaatgggagttcactcatgatttgtccctctgtttgtctattattgtataagaatcacaagtataagaatgcttgtgatttttgcacattgatttttgtctcctgagactttgctgaagttgcttatcagcttcaggagattttgatctgagacaatggggttttctaaatatgcaaatatgtcatctgcaaacagagacaatttgacttcctcttttcctatttggataccctttgtttctttctcttgcctgattgccctggccagaacttccaatactgtgttgaataggagtgatgaaagaaggcatccttgtcttgtgccagttttcaaagggaatgcttccagcttttgcccattcagcataatattggctgtgggtttgtcataaataactcacattattttgagatacattccatcaacacttcatttattgagagtttttagcatgaagaggtgttgaattttatcgaaggccttttctgcatctgttgagataatcagatgatttttgtcatttttttttttacgtgatggattacatttgttgatttgtgtatgagaaccagccttacatcccagagatgaagcagacttgatcatggtggataagctttttgatgtgttgctggattcggttgccagtattttactgaggatttttgcatcgatgttcatcaaggatattcgtctgaaattttactttttgttgtgtctctgccaggttttggtatcagaaagatgctggcttcataaaatgagttagggaggagtccctctttttctgttgtttgaaatagtttcagaacgaatggtaccagctcctcctggtagaatttggctgttgatctgtctggtcctgggctttttttgattggtaggctattgattactgcctcaatttcagaatttgttattggtctattcagggatttgacttcgtcctggtttagtcttgggagggtgtatgtgtgcaggaagttatccatttcttctagattttctagtttatttgcatggaggtgtttatagtattctctgatggtagtttgtatttctgtgggatcggtggtgatatcccctttatcattttttattgtgtctattttattctgctctcttctcttctttgttagtctggctagtggtctattttgttaatgttttcaaaaaacagctcctggattcattgatttttgaagggtttttcatgtctctatctccttcagttctgctctgatcttagttatttcttgtcttctgtcagttttcgaatttgtttgctcttccttctctagttcttttaattgtgatgttagggtgtcaattttagatctttccctctttttcctgtgggcatttaatgctataaatttccctctaaacactgttttagctgtgtcctagagattctggtatattgtgtctttgttcccattggtttcagtgaacttctttatttctgacttaattttgttatttaccctgtagtcattcaggagcaggtagttcggatttgagtgagtttctgaatcctgagttctaatttgattgcactgtctgagaaactgtttgttatgatttccattcttttgcatttgctgaggaagtttttacttccaattatgtagtcaattttagaataagtgcaatgtgtgttgagaagaatgtatataatgctgatttggggtggagagttctgtagatatctattagatctgcttggctgagagctgagttcaagtcctaaatattcttgttaattttctgtctcattgatctgtctaatattaaaagtggggtgttaaagtctcccactattattgtgtgggagtcaaagtttctttgtaggtctctaagaacttgctttatgaatctgggtgctcctgtattgggtgcatatatatttaggacagttagctcttcttgctgcattgatccctttaccattatgtaatgcccttgtctcttttgatctttgttggttaaagtctgttttatcagagactacaattgcaaccccagctctttttcgctttccatttgcttggtaaatattcctccatccctttattttgagcgtatgtgtgtctttgcacatgagatgggtctcctgaatacagcacagagatgtgtcttgactctttatcaagtttacccgtctgtgtcttataataggggcatttagcccctttatatttaaggttagtattgttatgtgtgaatttgaccctgtcattttgatgctagctggttattttgccctttagttgatgcagtttcttcatggtgttgacggtctttacaatttgatatgtttttgcagtggctggtaccaattttcctttccatatttagcacttccttcaggagctcttgtaaggcaggcctggtggtgacaaaatacctcagcatttgcttgtctgtaaaagattttatttcttctttgcttatgaagcttagtttggatggatatgaaattctgggttggaaattcttttctttaagaatattgagtattggcacccactttcttctggcttgtagggtttctccagagagatcaactgttagtctgatggccttccctttatgggtaacccagcctttctctctgactacccttaacattttttccttcatttcaaccttggtgaatctgacgattatgtgtcttggggttgctcttctcgaggagtatctttgtggtgttctctgtatttcctgaatttgaatgttggcttgtcttgccaggttggggaagttctcctggacaatattttgaagagtgttttccaacttggttccattctcctgatcattttcaggtacaccaatcaaatgtaggtttgctctttttacatagtcccatatttcttggaggctttgttcattccttttcatcctttattctctaatattgtcttcacactgtatttaattaagttgattttcaatctctgatatccattcttctgcttgatcgattcagctattgatatttgtctatgcttcacaaagttctcgtgctgtgtttttcagctccatcaggtcatttatgttcttctctaaactggttattctagttagcaattcatctaaccctttttcaaggttcttagctttcttgcattgcattagaacatgctcctttatcttggaggagtttattacccaccttctgaagcctacttctgtcaattcatcaaactcattctccatacagtttttttccgtagctggcgagaagttgtgatcttttggaggagaagaggtgttctggtttttggaattttcagcctttttgcactagttttttctcatcttcatggatttatctacctttggtctttgatgttggtgacctttggatggggtttttgtgtggatgtcctttttgttgatgttgatgctattcctttctgtttgttagttttctttctaacattcaggcccctctgctgcagatctgctggtggtcctcttcttcagacttctgtgctggcagtgagaatttcaagccagtggatcttacctttctgggctccatgggggtgggatctgctgagctagacaacttggctccctggttcagccccctttccaggggagtgaacagttctgtctcgctggcattccaggtgccactggggtatgaaaaaaaggaaaactcctgcagctagctcggtgtctgcccaaatggcagcccagttttgtgcttgaaacccagggtcctgttgatgtaggcacccaagggaatttcttggtctgtgggttgtgaagaccatggggaaagcatagtatctgggccagaatgcacctttcttcacagcacagtccctcatggcttcccttggctaggggagggagttctccaacccttgtgtttcccaggtgaggtggcgccccaccctactttggctcacccgtgggctacacccactgtttaaccagtcccaatgagatgagtacctcagttggaaatgcagaaatcacccaccttctgcattggtctcactgggagctgcagaccggagctgttcctactcggccaccttgccagccaccctgaaaagtgaacttttaagttacataggtctgagccatgtgttctaaaatatattgttgttttgacttcaatttaagtgagatttgtgctttttaatagaaggttgcacatttttcttctcttttaaagcttaacagaaattcaaaggcacacattatagaaaagtgaagctctaggttgataataaaataagataaaccacaaaaaaatctgccttttattaacatagttcttgtcccatgtcaaaattcaagcactagagttttgtattcagccttattgagtcagttagctaactctatgctttgcttctatgtggctgcttgttttagtgaggcagagccttgactatagtagttatccaacacatttgttgaagtatattgagataaagagctataagaacatttgagcctatttgaattgcttggcaaagaactatatattcaatgttcacaaattttatggaattgggtcttcttaaatagagaaagaatttgaatcatggaggagtttctaattatgcctactatattggcaactataatgttgtataagtcagatctcttttaagtaataaaacctcagctgaaactggttcaagagatagacaatagatagatagacagatggacagatagagttttttagctcaggaaataatgtttcataagtagtttggatttgatttaggaattcaaataatgtaatctggatttattctctttcagacacatatgtgcatgggcacacccacacagacttacacacacttctgctttcttggttgttgacttcattctccagtagctcactccctctacgtagttgactccaaatttctaggcttacactctcatatcttagcaagtggtcctggtagaaaagtgatcatccctaattgaatagacataaaaatgtcccagacttgagaatcattccttaaagtcagctgctctctctgtgggcacagagatgaactggactggctctcatcataggtctgtgtttgtgtctggggtataggctccagggacatagatcagtcccgtgtctgggatataagttccagggatataggttggtccctcctgaaagtgaatgaaaatagagacagatggctcaccacatgaaatatcattgtgttaattccagatgaactgttaaaaactattaaaataagtaaatacagtcaatgttcacaactggtatgaaacatagtagtgaaaaaacataagggaaaattatatactgtaacatcacacttggcttatggtcttcattaatatctcttaacttcaacatgaacctcacacaatgatttagtgtcctcaactccaatgatctccattcattagaaaacagaagtcagtgtttgtggcttaaactacggtaggtactgaagacaagtcttggcatacatatgggatggaggtagcttagtgctgtaggtttgaaaccatgtggagctaaacagtctcaaaattccacacccacattgccaactctatctgcatataccttagtatgacaaattcaattattccaacagtaaactaattcagtatgtctcaagctgaactgattctttcctgccaaatcagttatcttctaactttctattaaactcctcatgattcttcattggaagcttccccataatgggttctacaacatattttgttttttaaaaattaatttaaattttgagtatataattaattcacttttaacagtaaaaggtttttctctcttctttatctgttagctccctgtatgatagtgtacacaaacactactataaatttcttataggttatctttttaaagatacatatgtatacacaaaaatgcatacttaggttagtctaaaataagttatgttccaggatctaccttatttttaaaaatacatattttttcaagagacagagactcactgtgttgcccaaatgaaatgcagtggctattcacaggcttgatcccactactgatcagcctgggtgtttggatctgctccacttctgacctaggctaattcacacccctaggcaagctggtggtcccccactccaagaggtcactatattgataccaaacttattgtggataacctaattagtatagcaaactgcagcccagagctctagggctcaaaaaatcctcccgccccagactcccaagtagcagggactctaagcacctgccacagtgcctggctgggctctactttttatccctttacaatatatcttatagcttgtttttatatcaatttaaaataaacaatctcattttaaaatggatgcctaatatgacctgatatccttgcatataatatatgtaccagtccttttttgatgagcataaatttccaactttttgctgttccaagcaatgctgcaataagtaacactgtacatatattacatatatattttattattgagttttaaaatctctttgtatataatggaaattaagctcttgtctataaattctaaagtttttttattcaagtatgtaatagccatgctcacagagaggaagaatcaacattgttaaaatggccatactgcccaaagcaatttatagattcaatgctattcctattaaattactgttgatattcttcatagaactagaaaacactattttaaaattcatgtggaacaacaacaacaaaatatccaaaaaaccaaggcaaccctaaacaaaaaacaaagctggaggcatcacagtacccgacttcaaactacagtaaccaaacagcatggtactggtacaaaaacaaacacatagaccaatggaacagaagagataacacagaaataaggccacacacctacagctatctgatcttcgacaaagctgtcaaaaacaagcaatggaagaaggattctcatttcaataaatggtgctgggataactgcctagccacatgcggaagatcgaaactgaccctttccttataccacatacaaaaattaactcaagatggattaaatacttaaatataaaacccaaaagtataaaaaccctggaatacaaccaaggcaataccattctggacataggaatgggcgaagatttcatgataaaaacaccaaaagcaattgcaacgaaagcaaaaattgacaaataggatctacttaaactaaggaacttctgcacagcaaaggaaactcttgacagagtgaacagataacttatatattgggagaaaatatttgcaaactgtgcatctgactaaagtttaatatccagcatcgataagaaacttaatgaaatttaccagaaaaaaataagcaaccccattgaaaagtgagcaaatgaaatgaagatgcttttcaaaacaagacatgtgtgtggccaaaaatcaaatgcaaaaaagctcaacatcactgatcattagagaaatgcaaatcgaaaccacagtaagataccatttcacaccagtaggaatggctattaataaaaagtcaaaaaagtaacagatgctggtaaggttgcagagaaaaaggaatgcttatacactgttggtgggattgtaaattagttcaaccattgtggaagacagtgtgatgattcctcaaaaacctaaaaacagaaataccattcaacctagcaatccccttactggatacatacccaaaagaatctaactcattctattgtaaagacacatgcacacttatgttcattgcagcactattcacaatagcaaagacatggaatcaacttaaatgcccatcaaggtacactggataaagaaaatgtggtatatatacaccatggaatactatgtagccataaaaaaaggacatcatgtcctttgcagaaatatggatggagctggaggcattacccttagcaaattaatacagaaaaagaaccaaatactgcatgttctcacttataagtgggagctaaatgatgagaacacgtggacacatggagtggaacaacacacactggcacctattggacattggagggtgggagaagggagagcatcaggaaaaataactaatgggcactaggcttaatacttgcatgatgaaataatctgtacaacaaacccccttgacacaagtttacctatataacaaacctaaacatgtacccctgaacttaaaataaaaattaaattaaaaaaataaaaactaaagtgtgtgggttctaaattcagaaaaatcatatttccgagttttggacctacatattgaagctgtgtgaaccaagactaacttccatgtaatgtgcaacttatgaaagtatctataggactctatttcctcatctatgtaatggggttagtaagactcagttgctatgagaaataaatgaggtgatgccttcaagccactgattattttcattgacataatatttgaatttgcatcattgggtagactgaacctcttttataacattggatatatactctgctttataagataacctcaccatgtaagataattgccatgcataatgttcaaaggatcaatatagaccactcacatggcttgaggatgaagacatgtcagcgtttgaaccaatttgttaagcaacaactactagaaaacagatgcctcaaaaaaatcccaattgaatattaagaattttgtcagtcttcaagaaaaaaaaaaggtactgtataccttcacagtcaaaatactggagatttaaggtgactggaatactgccaattcttttgtttgaaattgatttgccctttgaagtgttttggcagaattttggcctcattctcccttttcccaacaaatgcacctatccggctaccataaagaagttacagaaatgttttgctttatataatcaagggaactagctaaacttgaagaatctgcctgaaaacccataatccagggtgactatctctatgttttatcaaattggtttaaaaagtgcaggatctttacttctggtaacttcaggtgatgctctgtgcacatgctcactgccttatcttgagagaacaagaaccagggaataatgtttcctgatttcctgcttgaaatcccttaggtgaacattatctcccatctccctatttacttgtaaacaaagcataacaaaataaaatccagaagattgagagtgttggttctttcagaaacttcccttttggtgaaaatcattagtcagtgaaaaatagctcttcacctaggagacaaataaattagaaaaggccaatatgtttgtgagaatttcagggaaagtataaatggaagaaccagattcacaaggaaaaaatatttcttcaattcagagaggacactagaacaaaacaaaacaacttgatttaatacaatcagagggagaaaaacatttaaaatgtgttgtgtgtaggtatgtaatgccctaacggagacagatatttattacgtatcatttattcaaaattttagtgtgcctgtgtgttgttgtgtatttgttgtacaagtttctgagtaatacttccaccagtttcagttcagcaacctttggaatttgttgagaaaagccaggaactgtactgtagggtcagaatggctgacttctctccatgctttcactcgggtaacgaggcaagctgtcataactatggtttctggtgtacaggggaggttttgactccaatgtcataaatctcagcagtagaaataatcaaataggtaagttctttttgtagggcatgtcagtacatgtcctctgcccaatttctaaagtataatgtatctcttgggttttcaaagtcaggcacaaaatcctcagtttagaatgtacacagtgaccctcaccattactgaatgaattgcttcatgctgtactgtccagaaatatcagagagtaggtctctgtgtttaacaaacacagcactgactctgtttggttcttgcatttgactaggttagcagttgtcaactcggggtgaatttgcccccgcctccccaggggacatctggcaatgtctgatcatgtgtttaattatcacacctgtaacccagtgggtagaggccagggaccctcctccaccacccaaatgtcaatggtgccaaagttgagaaaccttgggttagtttttgggttgagcacaaattcagataaaaacataactcagctccttaaataaaaatttgataaaggaaatgtaacaatgaatatactgaaatttcattttgaagtccctgagattttgtcatataaaaacatgtgggcacagtttcttacccctttaattctaattctcttctgataagtggattttgccaagtgaaagaagactgaaacttatcttctctaggagaaaaaaataacttggttgtttgcattgcagtagctcaattatgaataatctataattttccaacccttgagaaatggcttttagctatttttcttttttttctctaagaaaatgtaagattaaaatggtttttacctatgcaggtataccttgccttaagcaagttctatatatacgaaaacacaaatttataaagaatattaatctgagccaagtgtttgctttagaaaaagaatttgttgctttaaaaaagacagtgtgggaagtttcctgcaaatttttaaatcatggcacatttacagatagtttgacccattttctgctttgggaaacacataaatattaattgaaaaattaaaaatataaaattagcgaatcaattagccatcttaaaaatatctgctaattttctaacagaaatcgcttcatttggctgagtaaatacaatagttgaagtgtaggctttacataagtattgtatctattaaacaggttccaataatgttcttttcttttctctacactgctatcattcttctgtgaagaatggtaccttaatcttatattgaggtaatcattcttatgtgaaaaactgccaaaattaagactttttgtttttcttatcagtctaagttttcaggggtgttaacacaactgaacaggcttacatctaatgcagtattgcatcatggatatgtcaaatacatattgaaaatcacaagaaaaaatagaataacagcattaaatataatccaacccaaatccctagcaactattttcaaaatttctgcaaaatgcacactttattcacttattcattcatcccttctagcaacaattatatatctagtacctgtgggattttagtacccaggagaggcactctagcacctgcatctttggttatggctattcagtttttaaaccacataggcaaggtccttccctaagtttacagtatagaggtaaagaggatgagtgaaactcagtctgctcagtggacagctgatgaagggcagggccatgaaactgtacagaagcagcaaaactagctttgtccagagagtcagggacaacctcttagagaaataacttaggaagaaaatcttttaggagatccaagaaaaagagatgacaaatgagaagataacctccttaagtgcccatggaaatttgaagttcacttcaaaccattcattacattgttatttaataaactcagatatagtggtgggagcatttatttgtaatagaatccaaaagctagactagaatatatagaagattttttttaataatcagtacctaaaagtgtatcagtgatataatctccagagtagattcaccctttttttttttttttttttttttttttttttttttttttttttttactgacaggagtctatctttgaccagggtatagattcaaagagtaaatccataatcgatgagctgcgtacccgtggagaattcatgagtctactctgagtctcagttttgtcattcttaaaataggcataatatctacctttagaattttgtcctgagaattcaaggtaactccataatttctagctcatggcaggtacacatcaagtggtagtttaatttttctcctaactaaaagaaattggtcatcaaatataaaaacatagttcccagacaaaaattactttttaaagataaatgataaatctacatatatataatacatatattatctgtgaaaagcattataaaataatttcttaatttcgtataagagaaataatttaaaaagaacatttgataagatggactggcaaacctgaaagagatttttattattggaatataaaaaaattatataaaattgttaaacatgacaaaaatggaagatgagtaataagcaaagactaaagtaatatgtacacaaaactgtatgatatggaagataatcaattcatatttaaactattacattttatagtaggctgaattatgagccccaaaaatatctctgtcctgattttcagaacctgtcaatatgtcaacttgtgcaataaaagggactttgcagatgtaattaagtaaaagatcttaagatgaggagattatcctaaactatctgggtgaacccaatgtaaccaagcgttaggatttttataagaaggtggtgggaagatgagacttagtaataggaggtgtcactttagaagcaagaggttagtgtgacgcaagaaagggcctgagagccagggaatggaggaagctggaaaaggcaagaacgtgaactctccctctgagcctccagtgcaatgtagcttggccaacacctagattttggacttctgactgccagatcggtagggtaataaatttttattagtttacccactacgtttgtggtaatttgttacagcagcaattaaaaaaaaactaatacaagtctaaacatgcccaggtgttcagaaaatcatgtgaaggaagacggctgacaatggctgacacaataaatgaattgaacagagaatgtcagaaaccaaaatgtattatagatgtatattttctgttgcaaaagtaagcaaaaacatatttatttatttatttatttatttatttttgagacggagtctcgctctgtcgcccaggctggagtgcggtggtgcgatctcggctcactgcaagctctgcctcctgggttcacgccattctcctgtctcagcctcccgagtagctggaactacaggtgcccgccaccgcacctggctaactttttgtatttttttagtagagacggggtttcactgtgttaaccaggatggtctcgatctcctgaccttgtgatccacccgcctcggcctcccaaagtgctgggattacaggcctgagccaccacgcccagccacaaaaactttttatatatttagaattacacagtttcgaaccatattaaatccattttatagcagtatgaaatgagacgaggataatgtgtattgaaataccctgcgacatttgtagaataatatggaagtagcctagagatacctcgttcctcagtgagatgcattgccatttttgtttattaacaaaatcctcctggtcaccatttcagctcacccagaagttaaactccttattctgtatgtttgttcatttgtaattaatgataagtgttttttagtgttagcgtcttcgtagttagcacgaaggagctttacagaagcctcaacttgtttctcgaattttagtaaagttgatttcaccatagagcaactcctctttgtgtatttacatatctctattactgtaattttaatttactgagcaagagtcaacatctatatcattatgtgtgattagacaaagaagatctattaacgttttcctaaacttatactgctttccccccatggttgaccctaccatatgaaaaagagactcgtggttgaaatggtacgttggatgaaaacaatgaatgacaataaagttggagagaggggagaaacagctgctggaaaatctctcttatccaatgtccagaatgctgattgttttggggaggaagtaaatttgtattggcttaggggaaatcagtttgtggacaatactggtttggggaaactttgttacatttctaatttcctgacctgggtcgttacaatcaaacaaaattttattcttttcacttgcactccagatggaagaaaatgtaaacagctgtccaagcggtgatggagccttttcttccacattcttgcatgtcattatgttagagatttactttttcagcaaattgaaacctctaaaccaagcaatcaaatttttccccctctccctctctttgtattccaactgtcatcaattgcttactttcagaaatagttttctaaagatgaagctctgttgaatatgcatggtcattatcatatttactctcatcagtaccatatagcattatgttgtttacaataattagctgctggaggcaatcctgtaaacacagccatgtgacagcccaaatggagagaatcaagtcattgttaagaaagagaataggtatgcgccggttggactcctatgctgtggttattggtggtgattgcaatgtatgggtccagtccaaaaagaaatctcttactcaatacttctctagttgctgggcacatatgaaagaaatgaagacatgagggaattcagatggttaaataaagctaacaagacagatttttctttttaaaattttgtttaagtctgtgggctaaccatattcacttaggaagcaatacatacagtaaaaatgcaaaattaatatatttaacttaaacaaatttagatttatgcatagggtatgcccctatttagggtacacccctattactcatattaagcagacagttgatgcaatcacacagaaaacaatcaatgcaagctatcaaaatctatgaaagtatgtataaagtttatttcagggtttcctgaccattagaaagaattaaaattcactgtttaagcgagcctcaagtagatagtgataaaattatcactattctcagggaagaaattgaagaaaattgagggcaataaagaaatattactaatatagaattagaggagcagatatatatgtgtgtgtgtatatatatatatatatatatatatatacacacacacacacacacaaagctttatgtgttacttaatgggagttttataagcttttcaaggattattttaattttatggaattgctgctttccttgaactgcctcgaaaaatgttactccacaatctattaactaattcaacacacatttattgagtacctcctagattgaaggcactactccatggagaaaacatgaataatcagacacttttgcttttaggagctgacagtctcaatggtactgatacatcaaagtaaaatgtgatgcaatttcatagcagaatcaacagtgtgctaaccaagcatgaagaagtatggaaagtgatgtgagaggaaaaactctttataatttgttcattaaaatatattgcagttttagagttccattgtgtttaccaaattatcaagagaatacagaaaattccaataaatagagaagaagtgggtaaaatgtaggtctttactagcttattttaagatagagtaaatgtatattagtgcatatacttttgtgttttgctttttcttttagtgagagagggcataattttcaaagctgtgttgtggctagatagggaatacacaatttagatagtgaaacaatcaagcccattctaagtgccaaaagtttaatcccttaatgagaatctaaaaaagttttttttttaagtgtctctgagaaatactaatggtaactttaaaaatgtatatatttatatgcttacttttattagcgattcttagtaagctcccccataccaataatctcatattactgagcaatcactccatgtagttagagcaaaagtcttctgctgttgtacggaaaaattgatctttaggctgtgtagtggatgttgttgttgattggcacagatcttttctgggtctgcacttgtccatcaactgctgtgagtattatctcaatggttgtcttttctcggccaagccagagcccctacggctaggaaggtatgctgctctctacctaccctcttccaaagcccagagccaagactgactgtttttcttgccataaaatggaatcaactttctggcactatccatactctggagcttcccactggacaggctgaagttaggttatagctacttagctttttccccctggcttatcctgctttttttactccccttatccagagagcacgtgtccagtacattactggaaaaaagaattctcatctcagactctcttctagggagcctgaactaagttaatatccctacattcccagtacctaacccagtgcctgacatatgtcaaattcagttagtgataattgaatgaatgctgaatgacgtttgcattcatggtattagccatttggcaatactcaggactctcagtttattgcaggatgtatgtcttgatagacctctctacactacaacattcaaaagggaaatcattttagtgaccacttacagattcatgaagtacaacattgaaaatccactgacatttttgttctttgctttttttttctggttcctctctacttaaggaagtcaattttagaggtgatccacttatctgatactagattcagccaagttgcagaagcaacaaccaacacaactaagaacaaataaaatgaaaataaaaataaaaaaatctggagtttaaaaaccaagcgtgttgtagtcaataaagtgttaaaattttttaaaagttttcaaaaatacatgctgtaaataaactgaggatagactagctgcacagcctcaataaaaatattgaagacattatgaaatggtacacttgcatgatgatttataatttacacatgggtattaatttgaaactaccccaaaaaatacagcctacttacatagcttcagaatttaacccttctcccatttttcccccaaaagtgtccaattatctcctgtcagacctgacagtgagttatcttgttaaagagcttgcaattccattatagacaagctccaaatattgatttgtgccttttatttccttggtctttgacatcattgtaggactaaaaatgttcaaatctgttgctgcatgacagaaagaaaatggtcaagagatctcagatacatcaaaaaatagtttactgaatttatacttcacaagacactgtttttgtagtgtaggcctacgtgggtccaaaggagaaccaagtacaaaagtgtgagcagggaacagctttggaacacactcagtaaaggtacctggaaggggcttgtcagggaagcctccatggagtggcctcagagaggcacactgacatcatggcagccaacagagaaggaaatattgtcttaaacagaattcacaatgcctattttgtaggcatgcaaattattaaatatttaatgtgagctcttggggtaaagcaaacaaatatataaacaaaaactctttgtctctttaccctttgaaatctatgtcaccataaatagctagaaaaatgctcattgaacaaataaatgaatgagtgaatgaatgaacgataaattcagaataattactttgtatttatttggcactagatgagggaataaaatatgttccttgaactccagttttcataatcagtttgttcacctgtaattgatgattttcacttgattttaggaatttttggtgtgataataggtggatttgaaaatgtcaggttttatcattaaataaatagtattctaatagagaaagtagaaattgaataattatctaataaattccaacagtgagaactactaagttggataaccaccctgaagtaatttgtatttttctttcagagtaaattcttttaacatatgtttaatttctttaaatgactccactcaacctaagataataagaatagcagtggctttttagagcattcagatttcaaatacattttctggtaataatgtttctaccaaataaaagaggattaactctgtagagtattttaaagttgtgttcttaccgtataatcacatagacatttatagttaatgctacatttcttccatttgcagatttaactaacactttcatgaacattgttccattttttttgttccagtagtttatctttacaataaacaggtaactataagcaaagtgctatcctgagttctgtgaatccttctagaaaattatggaatctgagacaatgtaatgggaacccccagatttatagcctgtgggtcaggacccaatgggaattggttactgacatattaagtgagagcagtcttgtgggactgagaccttaacctgtgggcctgtgctatctaaagacagtgtcagaatggaattgaattattggatattcaggtagtgtcagagagctggagaagacacagcatatttgatgtcaggaggaaaagatccttttatcaactgagtcaaattttgagctacactataaaagaaaaatgtcgaaattgaaaaaattttaaatacaattaaatgtgtacagatagacacaaaaacactgagtggaataacttggagataaatttgaaaaaatatcccttaattaagataaaaaacagtcaaggagagacagagagtaagaaaagatataacaaatttcattggatcaatccgatgaattaaacacaaatttattataatcttttagagacaaaaagcagactaagagtgggggaaggtgtcatcaaataaaaaaaattaccagcacttgaaagacacaaatgtgtgtaggaatacagagaatctaaactgataagtgagaggaatttttaaaaataacatacctaaacataccatcataagatctcaaaacaccaacagaatgtgctaaaacttccagaaaaaagaaatctacaaaatattgagaatcaggctggcatcacatatcacatcattaaaactagtctctaggaaataatgctttcaaagtttgtcaggaaattattttgactataaatcctatttcagtcaaataaccaatgccaaaataaatatttttcagacaagaagactcacgggatatttgcaggtatgtgccagaaaaacttagagtgaaaaccaagagaaaggaagatttgagatacaagaaacaatgacaataacttagaagtgcaatgaaaataagcctcaggatgatgcccaaaaagggaccaatttagaaaaggaaattctaagaatctaagttgaatgtcttcagaaaatgaaatggagtcaattagaagtaataatgaataataaattagaaaatgctaattaatatttgaaaaatattttccttctctggacaagaaaaatataaaataaatgagaaaattacaaaaatacaaggcatccaagtttcaaataaaaagtaaaataaaatgtactatgatcctaagcaactgatgagttcagaaaataaacaatttatctggacgtgactcaagaaatagtttttattaaatgtcttagaagtagtggacactgaaaccacaggaaagaaaagtgaatccaaaatagtttaaatgttgctaatggttttcagtatttcaaatcaattggtagaaaacccacagaagtcttaattatgtttactggaccaaaaacaatgttatcacaactgacaaatgtaaaggaaactagaggctggtggacaaagttgaaggaagagtaggaatactatttttttttgtttttttacatagtggagtgtgtagaaatagtttctaaatgtgatgaaatagtgagatgtttaggtgtagtatttgcagatttaaaggtaaccaacaggataaaaataataaagctcaagatatagggagaaaagttatctgataaatccttgtgttagtagaagccggaagatgctgtctaaagttacttaagcaaatagaactacaaataagtatttgtaaactaaacatagcattttgaatataaaatttgaaataactgaaaccccataaagttaaaagtacttgcatctgggaaggatagctcagcatgaggaggggcagaatgcaatcattggtaaaacacaaagcaaatctttgcttttcttccacattcaaaagtgccaaaatcacctattttaagagtaaaactaaataataaaaaatgcaacaattttatttccatttctttgtttctcataacatttgttaatagttcttgagaacctcttccaaccctttcagcctcctgtcttgtgtcagctgattctgtgcagtctttgaccagattcacacaactgccatctgacagcatttgcctccagtcctgcattgtgccctttgttttctgcctcagggcttctgtgtcctcacagctgtgaaatacccatgactacctgtttaacatacacatatacacacagcagatggcacatgtatacataggaaacaaacctgcatgttatgcacatgtaccctaaaactgaaagtataattttaaaaaataatttaaaaatttttttttaaaaaaaagaagtgtgaaggagttaatgaccttctgggacaaatctaacaaaaagggagtcagaagctgggggaaagatgcttctgagacttacttaagtttcaagtggtgcaatgggacagagcaacaagtcatcatagcaatagaatagacaatgacacatccttgtattgactcttctttcttgtctccgccatccctcacgcttcttgagttcatattctggatttaaccacccacatggaagccactatctctggttctgctttgaagaaaaccaaggctaagacccaaagaccataagcataattggcagtaaggcctgagtgacagcaaaatgcctttactgtaggaatcagtggcgactaatagattatgatattcctttggatgtaaaacattgccagtctactaaggggttactggacttgtgatattaaaaacaaaagtttaaaagagagctaaggagcagaaggctgatatcaaagatcacaatgaaaaatccacggtgtttttgagttgtaaatttccatatgtcacttctaacccagggctacttggctacctgattcgaggtggaccaggaagagcctgtaatgacactacaattgtacatagtaaaaatgcctctgattcttccttagagagaactgtggccatttaccaccatacttgtactctggaaggaggaatatccagaatttggagaatttttgagaattgtcggatataagtctgaactgacgcctgtcaagctatgatagtccactagttaatgtggactttggaatccagattgaaaaaaaaaaaaggctgacccaagtctgtgtgtgcactgtatatatggaccaattatttggttatttccccaattccttaatataaaattggatagatatgcctaattgtcagccagcaaaaccttcaaattggcttcctaccatacagagtaagagttgctatgatagaaaagccaactgaaagattcctaaatatcctttcctttccctacccccaggcaaaaatatgaaatctgaagaaataacacatcccctgaggaaatgtgcaaattagcaccaccagaaaagatttaaaaattgtaatgttagtactccattgtatctctgtttgattgagctgcaacaacaaaaacaataacaacaccaagtgggttgggcagttggtgaactacatataccattaagggtgtagccccaaatgtatctgctatgctacctgtgttctctttgctagaacatgtcaacacagcctttgaaacttagaatgtaactattggtctaatgattgtgttttttgcaactcacatcagaagaagagaacaaaagcagattgtctcttcatgtgaatgacagtagtacattttcagcgtcttgttacagggctgtttacattctcctaccttgttttcatattatagtccagggcaccttgattatctttgaattattcagaatattactctgttgcactatactgaagattatcctaattgacctggtcagcaagaaagacaagtaatttagatgtcctattaagataaacatgccatatggtgggacataaatccacaaaagccctggaactgttatattaaaaatacctttggatttccaaatatctatggcatcctaagacatcccttctaagattaagaaaaacaccttatttcatcttataattcttattattaagggcaagtcctattacttggtgggcttttggatttttgagccaatatctattgtacctataaatactgaccaactgaagagggaagaaaatacctcaagcctatgtaacaattcacttggtgtgaaatgtttctgtgagccaaaagtgggctgatgtctcattgtttttcatctcagaggtggttctaaacaaagtggcaaatagaaatctttctggaaggtggagctgtgagctgtgcattcgttgttctctttttaggcatggtaaagtgaccagagttacaaatacacatcaactcttgaccagtggtgaatggtttgtctggttagtaaagagtctggtaaggacaagaatggaagttaaaaacaaggaacaaatcttgatgatgatttgctcatttctttgtgtctcatgttagtgtccaccagagggcacccactgcaaagaggcggtcaaccacctagctgttgaccagtagagaacaacctgtttggtgaatgtcagttttctttctttggccacaggagtgctagtgcaatgagcccatgaattgagtgtccatggcctcaggaatagtagtgaagcatggattcaacagcatgggctccctcaaagcagagaagatgacgtactgccactgctgattgcctagtccactggcaacagagaccaatcatgactacttaatatgacatcattcctcaaggagtccagccacactcttgatgattataatagacattatccactctaaagggaacagtgatttattcttatcagtactgaaaactactcagggtatagattattttttttctctgccagcaacaccatctgagaacagaatgcctaatctatcattatggtgagatatatgtgtgtgtgtggtgtgtgtgtgtgtgtatatatgtatatatgtcatatatgtatatatgtcatgtatatgtatatatgtcatgtatacgtatatatgtcatgtatacgtatatatgtcatgtgtacgtatatatgtcatgtatacgtatatatgtcatatatgtgtatgtgtgtgtcatatatgtgtatatgtgtcatatatgtgtatatgtgtcatatatgtgtgtatatgtgtcatatatatgtataagtgtcatatatgtgtacatatgtcatatatgtatatatgtcatatgtgtatatgtgtcgtatatgtatatatgtcatatatatgtatatgtgtcgtatatgtatatatgtcatatgtatatgtgtcatatatgtatatatgtcatatatgtatatgtgtcgtatatgtatatgtcatatatgtgtatatatgtcatatgtgtcatatatgtatatatgtcatatgtgtcatatatgtgtgtatacgatatatatgtcatatatgtgtgtatgatatatatgtcatatatatcatatatatacatatatataaaaaactaagatcaagggacccattttgtagcaaaggatgaatgacgatggatgaatgacaatggaattttcaacggttttatcatgtaccctgtcactcagaggcagccagtcaaaaataatgatggaataaactgttcaagattcaactaagttgagagttccaggaacataccctgcagagttaatgctcagtcctctagaatatgaaatatgctctaagcctgcatttaatatatatggttctgtgcatagtgggtggaagacatggatccaggaaatgacaggtaatggtaacattagtctttccatttgcagaattttggcctcccatccccatgagtcctacctcttctctttaactatcttattccaatagacccaaagaaaaagaaaaaagttaatatatgagtagatataattaacccataatgccataagaagcctatttgctgctacacagtggcatctggaagaagtatgtttgcagtgctggcaattcagtggagtatctcctaagatttactgtacagtaataattgtgaaagggcaaatacagcaatatagtttcactagggcaaagtatgcaatattatcatctcttcaaggaaaaatgtctggattactcaaatagataagcaacctggaaaagtaaaattagtagtgaagcatgaagaaagtctagatttggaagtaaagaaatgaaatgatggatatgaattacggcttaagacaagttcagtaagcttgtgaatttttttctctaagtctgttacccttaagtcattgcagggaatttggctgacacaattcagaatctgactttgttactgattggacttaaagaaggtcatgagtagatctgagtggttcaaaggaggaactatattctatgccttgtttttctgcatcatttcaaatattctcatcctgaccaaacattcaagctaatgcttcattcagcctaacataaatattacctgacagtgatccatttctcacaattctcatttcccatccagcagtttctctgatactgagtactcacacaaagctgactcttactcatataggtatgtactctagatgtgtagaagagttaatatcccacaggacaaactttgaccaatatgtggggtggccacacagtctcactggctcaggattgatttcagctataccagttttttcagttactattattaatactttctcctttcactctggttattgtcctgttttacataatggggtatatggtcaccttgttactaaggtatcggagccaatagatagatgcttcttccatgcttaattcaggtggaaagccctgagaggcatttgatacactttaaagatgtctctatactattgaacacgtattcctatatggtgttgaaaaactcaatacatccttttattggcttttccttgctccatttttaactcacactgtgattactgttttctgagatcacgttttgaaatgagtggctaacgtgacaaaaggcaaaaactctttgactgaagctccgctcttgggagaacccagactaagtcagcttggtttcaataagtgataatattgtatcgactagttatggttccatagaaaatcatttcaaaattcagtggcttaagacaagaagaattgatttctctcccatgtatacaagatggatgagggtaaggtcatctaggctgtgcttagttgggcagctctgatgtttactgagatctttggatcaacaggaatagctctgttccaagtacttttcatcctccatggattgcagtttagccaaagtgagtttttctatggtaatagcagaggtaacaagaaggtaagaagaaacacaaacgacaattaaagcctaggcttatagccagcacgttgtgacttctagtcacatgttattggtcaaagcaagtcacatgtttaagccccaaatcaaggggcagagaagtatactccatctatgatcaggcaatggcaagagtgtatgtgcagggaaaggtgaggaattgagactaataaatcaatctaccatatgattataaaagaaatatcagtatatttcctgtgaaagaaaagcctatgacgtatttctggtaatgatgctagtaggccaataggtaaattctatttaatgggaactaatgactctcatgttttctatgtctaaacatcaaagaaacacaacacaacaatttttacacttcataaattacaaacaaacaaaaatggaggagacagaaaagttatttaagagactacactcttgatgcatagtaagattttagagggtatggcttctgacctcttcattatgcctgggaaataagatacagtaataattattacatgtggaacatctctcaatcttcagagttgaaaaaaattagagtagaagaggaatagcattaatgaaatacatttattttcactggggcccaagcaatgtattctataatttagaaagatcacaatgggctttatggtaaaaaatacctctaaaataataagccttgcagagcaattggcactcattaaaattcagtgttggaagcagcaggtggcaggcagtttcatggaacaattttgcagtgtccttccagggttgaagcaaaacaattcatgtcataagataccaggtcttacccagtccccattttaagttgccgtaagtaacagttcctctatttttatatgaatagattcaaggatcttaaattgaatgtattacaatagctttctaaaatatacattttcctaccatgtggtagaaggtgaatatatgcatttcacttactattttccctttgaaaaggaatacgtttcacggcaaaatgttgttacttgtttttccagagggaagtgaaatttgaatatctgtaaaattacacatatgtggtataagtgaaaaaaattgttttgggggcaaaagactaaggaaattgttatcaccctcccttcaatgcactttttcctgagggaaagtaaacgttgatatgtgcagtggatttctcttcatgacactctaatccctaccactccctcaccaaaaaggaaaagaaaaggcaagagaaaaaaaaatgatttccatttcctgggaccatttaatattttctattctttaccaaagcaccgtggaggtttgagacaaataattacattcagaccattttcatgaaaacaagcagttctttgaagaatgtcggacttaactatctaattaattgttaaatcttggcagttatagcctaaaacgttacatatttaagagaaactttttactataccttcaacactagaaataaccataaaattatagcacttattttcgccttctatttgatataccaatggacatagcaggggactcttgacaagaggtttagaatacaaatgctggggttaggtggacttggattcacatccccgtttatctttttaccgttgtgtgatcttggcaaaaacctcaattgctagtcaaaggtgataggaatatctgcctcatagggttgttaccaggactaagtgagattttggatttggtgtctagctcacaggaagcactcagaagattatagaagattattcatattttggtaatattagaagtgtctgtggtgaatagaagaaaagtatgttatagaaaatatttttttaaacaatggttatttagaaaagttgtacataccaatgggcataacaaacaaaccaaagcaataaataacaccgagacaatattactcatgttggtatatgacagatctttaaaataattgtgcatgttcaataaattattatgtgttaatctttgcttttaatttatttggagaaaaaactgtcattacaggtttcttcacaacaaggcaattatttaagagcaatagtcaataatattttcctgtaggaggcagaagtagatcagggttttgtggagcctgaagtttatagcattttgaatgcccacttcaagagttggcagtgaagagcaacccaagtatttcactggaaagtatcaggaaaagtacagacattggatttttccccctctttggtaaggagagaagaggaaatagcagctataggaagaggctccccttggggccttgagggattaaaaaaaaaaaaaaaaaaaaaaaggcagtgcttcctggttcactgaagtggattttactggcaaagaaactttgccacagcattccttcagagaaattctacttgtgagcttctgcctaatgtcggcgtccgccaagtgatgcaattccactggaatgtgtgcaactgaactgttgggatcaatgcctttgcaaacctcagaaggaaaacatatattcagtacaaatgttagctgctacactaaatacaaatgggacaagctaccctataaaaagacaacgccaattttttttcagtcaagctgaatgatgtttataagaaaggcatctaaaacagtgagaaaaagtgttaatattctagtatatacaggaaaacaaaaaccagaaagaaaggagaaatgctgaaaataattcatgtcaaggagatgtaaacatatttaaaaggattcttaagatgttatataatcataaaaacaaaatccactagagatatttatatatgtagtgtgtatatgtgtgtgtgtgtttgtgtgtgtgtgtgtagcctttatcgatgaaacagtttagcagcagaatatatagtacaaagcttcttgaaagataattgctccatttgaaaaatatttctgggaaatatttaagataccgctcacagaacttgacatgtcaagtagacaaaatgtgagaaagagtatagcgatttgaataataaaacaatattagtctagattcttgagtcaagctgcttaggttttattcttcccccactgtcacccagttggatgttcttgggcaatttagttaaactttttatgttccaattttcttgttggttagattttgcaaataatatcaaacccatcaggttgttataaggattgaataaattgctaatgccaatgtaatgctgaagacactacctgacacataatttgagttatagaagttgcctatcaatatgttcatcatcgtcttcatcattgtccagaaaaaatataaatgaataaaactaactcagatctataagaaactaaaatgtctaaacataaattgagattagagaggtgattgtttcactaaaatcaataataataataatgtacacaacaatattttggtagaatgatagacttattgattttattttttcaaagcctttaagagaatctacagtctgtcatcatttaattcattaaaaatcaactttattgaggtatactttacatgaaatgacatatacccatttgtctaggttgataagatttgtccaatacatatacccttgtaatcactgccacaatcaaaaacagaatgtttttattacccgaaacattccctgttgcccatttgcaatttatctctttctccttatccctaaacaaacattctgttttctgtcagtatagaattgcttttttttttttgatatctttctcttagcataatagctgtggaattaatccaagttgtgaatatcagtaatttctggctttttattgctaacttgtattacaattatgcattcaccacaatttgtttatccattaacctgttgatggacatcagtgttgtttccaacttttggctgttataaaaaaaatttgctataaaatttccttgcaaaaatttctgtggacatatgctttcatttcttttgggtgaatacataagagcggggtttctcagtaatattactttaagagtgccagcttgttttacgaagtaattgtagcactttatatttctaccagcaaggtatgagttccaattgtcccacatactcaaaatcttttggaattttcaatgtttttattttattttattttattattattatcattattattttgagatggtgctcactctgttgtccaggctggtgcacagtggcacaaacacggcttaccacagcctccatctcccgggctcaggtgatgctcccaccttaacctcctgactagctaggactacaggcacctgtcaccacgcctggctaattttttgtatttgttgtagagatggggtttcaccatgttgcccaggttggtctcaagctcctgggcttcagctgtctgcccaccgtgtcctcccaaaatgctagcattacagctgtgagccaccagtcccagactgaattttcagtggttttcatttgagcctgtttgattagtgtctagtagctgtgtcttgcggttttgattggcatttttaaaataatgatgttgagcatcattttaatgggcttaaatgtcatttggatatctttgctaaaaatgttcatttttttttcattttctaatgggttgcttatttttttgttattgaggtgtaaaaatttcttaatgatatatttcaaaaatcagtctttttaaatttaatgaagtccaatatttctatttattctttatgttctgtgtttttatgtgtgtgtatgcacatgagttttaagaaatctttgcttaatcctaggactcatacattttctttcagaagtttttttttttttcaacttttattttaagttcggggtacatgtgcaggatacgcaggttttacgtaggtaaacgagtgccatggtggtttactgcacagatcatcacatcacctgggtattaagcccaacattcattagctattcttcctgatactctccctcctcccacccgccacgatgggtaccaagatgtgtgttgttccccctccatgtgtccatgtgttctcatcatgcagctcccacttataagtgagaatatgtggtgtttggttttcttccagaaaatttaatgctgtacctttaagtgtgtgacctatttcacgttagctttttgtgtgtggtacgaggtaaggattaaggttaacttttttacaaatgaatattcatttgttcaagcaccatttcttgaattatgatgcctttatcattgaattacctgataactctgtctaaaatccattcacctaaaatcggcacatatccattagcacaatatccattgaattacctgatacctttgtctaaaatccactgtatatgtgctgatctgtttttgaacacttaattatgttttgttgacctatcctgccaacatcacaccgtctttatcgctctattactagtagtaaattgtaaaaatcacaggatatgtctgccaactttgtttatcattcgattttactttcttggttaattttattgctacataaattttagcctcatttgatgattgctacaagaaaatctcctgatattttcactgagattattttaaagctaaaaacctattgggagataattgacttcttaaaaatattgagtgtttttgacccatgaatgtggcatatttctttacttatttaggtcttaattaattttccttagtaattctgtgtagcctgtagtgtacagaccttgttttagatccttgatacccacacctcctcccccagtgtttaaaaattaataaaatgagaagatatcagcaaagggatctgagaaggagcaggtagtaaacgagaagaaaatttaagaaattaagcaaaagcaatgcttaaaggaggagtacttggtaaactgtattacttgtgagtgatacatcaagtaaaattaggactaagttgaccattgcattattctatgcgtaatttaatattgactatgaccagaaacacttatgtggaacagtggggacaaaagactaatcaaagcagattcaagataaaatgagaaaagatgaatggagacagtaagtacagagaattccttcaaggtgttttactataaacagaagcaaggaaatgcagtagtagacagaggaagacggtatgttaaaggggtgctgatttttaaaatgggccaactagcagcaaatctctttgttgtgatgctacagaaggtagggagagttgatgattccacagagagagacaagtgggtagaatggtcccttgagtagaagactatctaaagcacaggtggatggcttggtctaaggagggagcacggttcacctcaagtaacaagatgaagggagagtctgtggtcacaggggccaagtatgtgactagatgtagtgacaggagcttattgaagttttcttctggttcttattcctttttgggtaaaatagaaagcaaagcaatcagctgtccttgaatatgagtcagactgttggagatttgagtaaagggatattctttaagcttgaatgaatttctttccacaaaaaaaaaataaagcctactacataatgattatttttcttaaaactctgcagaaaaagtcatcttggcatttttacaaataaaatatatttttattcctacagagcaagaaatacttctattttttttaaaaaaaaaaaaaagaggcaataaaaacagatattctttctataaaattattagtctagtttgccttcttatgaattgggagaaacaatagggtagcccattttgagtttaccttgtgttaggaagcatcatctcctttctaaagcctcttataatgttggttagaccctgtgaagaaatccataggacatagtcataaaatgtagtcatagaaaccttcttgctcatcagatgaaagtaaactgaggccaagaaatatcttttgacttatttccatttgatttggggatttcattttctcagtatccacttactttaagatgctaagagtataatttctttgtatgccaacatgaaaataagtccaaactatcattcttttctcatgttatagttatgtttgtatgcactagagtctcagtgtgcatgtatgtgtaattcctattccttagttttcatccttcaagcagttagtcccttcaaaacccgatgacaagacccaaacatattaaaaagtttagttggagggcccagggtgaaacacaaaaacaattcttcttcttacagagctcttaggcaaacacatagacacttgttctctgcctctggaattacaaatatgttactcggaaagcagcaatactcttttggacttgtttgacttcactttctttacctgtctttaagaagcctcatacacacatttaaaaaatacaacttataaaggttttagtgatagtgcatacaatcatttgattttatttcccttttctcttcaccttcactaataggagttactggcatgcttcaaaaagcttacatttgaatactgtctaaatcagtgcagacccttgaccagcttaatctttgcttgcaaatgacaatgcagtgaaaccagaggaagaaaaaaattacttcctttcctgttggaaacctaataagtagttagtctgacccagttttcaataagagagattttctgatgacccgacaggagtgactatctccagtcaaagaaagaggagggtgaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtaagatctgtaagtacaaaattgtgctgtgtctgctgcaatgagaatattgctgggcaagctgcagcttttcttcctttcaatgtctttgtattagcataacaggtaaaagctggggttgggggagaagtcactgctttattgatgctgtgtttctatgatgctgatgtttaaaatgcatttattccttgtgtgggagaaatgtattgaatctgtattccgggaggttaggatcaaaccagggaaagaaagactacaggtatatttctcagtgtttcactagtctttgctgcagtaaaactaatgggcaagacgggatgacagtgctaattctgggactttcagatggctacacgccctttctgtaacggcagatgggaaaatgtgatcgctaaatgttttttgtcttttttttttttttaatcaaagggatgaggggtggggtttgcagttctcaccggatgatttaaaagaatggttataaagtttcctaggggagaatttggtaaggggagcaaagcaagactggaggtcatatgggctcaccaaattttgtctggcattttgctttatacccagcttctagataacagcctctggagtttcctttaccatttacaccagttaagttgtcagtattaaggttcttataatactttatgaaaactttcagaagttgatgacttgggaacaaaacttttaagagctctgagattagccacgtataacccattatgttaatgggatactgtaacattggggtttggggggaaaattggaattcatagtttttgcttctccaaatgaaaactacttatgtttaaataatcagcatcctgactatgtcctctgagaaacattcacagaatgactaaatagaagttatactgagaaaaaatagagtgaacagtagaatcacacagaatcaatttggaaaatgaggtattcataattttatctacagtggcaatgttttctgaagatgtctgtaaaagaagaagcatatgctgaatattgaattgcttgttttgagcaattttcatttatctgatgggtttatcatctttttatttttgttgttgaaggtttcaccaatttatgtgcattgtattttataaggaaagaaatgtttaagcagactctttttccctcctccttcacacacatgtgtaaacatacgcatgttcacaaaacaaacataaacatacaaaaatacttacacaatttgtgtaaaaaaaaagaaatacagaagcatttcatctttgatgtttcagtggggtttctttttctttttttaagcaataatcatggctgtgcagtccaaagatttcaaatatataaatgtggaaacttttatataaagctttatgtgaggttatataaatgcataacttatcacatcttagcaaaaaagtcaatcatttataaatgacttcattgcattacttcctttgaatatttgtagtgaaggaccagaatttttttttagaatttttatgtagctttccttaatgaaaacaaattcacttgtttacttagaaaaggatcacatattttctctgagtttagaaccccctctaaaaaaaatcaattatgttgtgaaaaggatgtgtggtatattaaattgattgcatacttctgggttttttttttagtaagtaaaaatgctcagtagtataatagtaaatttgtaccttttaaattcttttatgtgaggagaaggaatacaaaatatttgcttatttattcactgtttattttaataacatattaattggaatgcagaagtataagttctacctattaaaaatgactcaaactatacataaaagttcaaaagggaa

SEQ ID NO: 48 - DNA, 686470 bp, Homo sapiens
gaggctccattatattttccaggctacttagaataccatttagtaaattgctgcctcagagcactagatgatgattttatcatttaaatagttaatacacttaaattgcctgacaactaaaatgcctaattacacacacacacacacacacacacacacacacacagaactagcctaccataacctcagacactacatttcactgtaggtcagacctagggtccctaagccacagtagaatgataatagtttagtcttcaacactaaaaggcctccagataccatgttatcaaacttcttcattataaggaaaagaaaagcaagtcaacggacctatgtgattaccaggtttttgaatattttggagagatatagctatcaaaactataaaaatttaagcataatttgaggagtaattgttgttccttcttttcataaaataacatgcttccaaattatgttggaagatggaagactgataattcaagggctaggggaagctgtgtaaaattgatcattgttgtagaagataccagcatttcatacatttctctgtttttttaatctcatttagcttcccaaaacaaggtgtagttattgcacaggttatataactctcaagtcagaaaagatccaaatgtcttttaaaacaatctcttaaggggtgactacgtcaggctgtaattggctgattgagtttcggtttaatattacaccttgcccctagcatccactcctgctgtctctaggcactgtccttttctttcacagatttgacattttcttttgaccttaacttcttaatgttccttcattttataaatgcttcatttttcatgcttgcaaaaatggagtctcttatataaggacacctgtcatgctgtcagttcatagtaaaaccagcaccataacctagatatcactcttctcctctggttacagtcattttatataataagatttaaaacaataaagttagtgtcattaatgtgtctcaaaattcaagtttttcagcttcctctaaacatttcttttctttgaatctataagtcttatttctcttatcactaaaaatacatacatcaaaataaataaaagctttcttctccaattacctacctagctaattctctttctacttcatttatgtcctacattatttaaaaattaatcaatgttctcttccttttttgctcattcatttctgcctgaccagcctcctaaaaccagttccattgagtcactaataatcttttatttctcagacctaatggatgcttttctatccttgagttatgttgtctccttcatgaatgttcatgaaacattctcacttttagaaagagcatgttttcttcgtttctctcctacctctttgactaaacttctttagcttctgtctcccccacccctgccaagcataccctgtagttttgtatcctacaattctttatatgtttaaccttccttcttgcttctctgccacctatacacctatgactttggagtctatgtgcctacaccagtgcttctcaaactgagtaatttagcccccgaggatctatctggagacatctttagttgtcactgctggatgatggggtgggaatattaccgccatgtggtatgtagagtatggatgctctaaacatcctggagtgcacagggcagcctccaataacaaaggaataaccagctagaatgccaacaatgtcacgctagaaaaactcttctgtagaccgtactattcttcaattcccaacttatattcacttgcttagttgatgtctttacaacaaacagaaagatctttcactgaggctttgaatgaaacatttctatatataaatcaaacataatttgcaactaaacaatttattttcccacattgccttgtgttagataatgaacttttctttaactccttctaagtatgtgacacatcttctccactggaaagttcttatttaatattataactgtaatgtcctttgatttcttctttttgtgataccatgtataatcaatactgtatgaccttttatacactttggtcactttttttgatgaggcaagggatgtattcacatgcatgatatggtcgtcacccacatacttactatatgtgtaaatagagggaaaaccaccttgggaaaatgttctctacttcatcatgttacttttaatatgtcaattacggcctatcatattttccaataatcaagctaatttttgccgctttttcacaaaggaggactttgaaaagttgttaatgaagctcagaccaccaacttttgcttttgggtgttgtcttagtctttttgggactgctgacacagaatacccaaggcaaggtggtttataaaaaatacatatttctttatttttttaaaaaatatttcgacttttattttagattcaggaggtacatatgcaggtcagttccatgagtatattgcatgatgctgctgttagtatgattgatcctgtcactcaggtagtgatcatagtacccaatgggtagttttttaacccttgtcccactctgtcccttcccaatctagtactctccagtatatattgttcccatcttcatgttcatgtgtacccaatgtttagctcccacttataggtgagaacatgtggtatttggtttttggtttctacaaagaacagatatttgtttcttatagttctagatgctggggagtccaaaaatcaagtgacccacttctggtgaggaactttttgctacatcaccccatagtaggaaagcaaaggagtacatgctcaaaagatcaagagactgaactcacagcccccaactcttttataattggcattattaatccattcataaagatggagcccccttcacaatcacctcccattaggccccactaccccacactgttgcattagagattaagtttccaatatatgcttttagggaccacattcaaaccatagcattccaaccctggtccccgaaattcatgtcattctcacaagcaaaatgcattactttcatttcaatacccccaaagttttagtttgttccagcaccaactcataaggccaaagtcgagagtctcctctaaagagaatggtggtgagagtcaaggcatgattcattttgaggcaaatgccctccaactatcagcctgtgaaacgaaagcaagttatctacttccaaattacagtgatggaactggcatagagtagacattctcattccaaaatggacaaataggcaagaaaagaggggtaactagtcccaagtaagtccaaaacccaatagggggaaaacagtaaatcttaaagctggagaataacttttttaactccgtgtcttgccttctcagcacactgggacaaggattggacctccaaagcatcaggcagcccatccctatgactttagcaggcttactccacctagcagctctcatgggttggagtcttatacccgtggctttcccaggctggagcagcatattgatggttcagcagttctgaggtcttggaggctactccactctcatgactccactaggcattgccctagtggggactttctgcagtgggtttgcctctgcggcaagtctttgccatggtctccagtctgtctgtaacatgctttgaaatctaagtagacgttgccatggtcccagagctcctgcccgctgtgcacctgcagaattagtaccatgaggatgctgccaggatttacagcttgtacctttggtggctcaagcctcacttgggtccacttgagccaagactaggatggccaagaggcactgcattcagagagcagagtcctaaagcaaagggcagtgaatcctgaggtcctgtagccacctctctgaaaactttgctctgaaaacaaggcaagtcctatcttgccttgaaggtctgtgaaatgcctttaaggtcgttcttctattgtcttaatcaatagaacctggcttgcttctacccatattaatctcattagcaaagagtcacttggccacacacttaatattctctgctgaacacactttttaattctttacatggccaggctgagatttttctaaatctttctattctgtttcccttttaatgataaattccatcattacattattgtctccttctcttattttactgtaagcagctaatagaagccatgcagcatcttgagtactttgatgcttaaatattacttctgccagacctgctagctcatagctcttaaattctaccttcatgaagtcctaggacatggacaggattctgccaacttcttggtgactgaataacaaggatggcctctacttcagtttccaatactttgttatttccacctgagatgtcatcaaaatgatctttactttctgtatttctcccagtattctgatgatgaccacttaaataatctgtaagaagatttaggttctttttacaactcttcttttcttctgagccctcagaagatgcacccttaatgctccctgtatagtaagctaggcttttatagcctgctcttccaaattcttccagtctctactctttaccctgtttcaaagcccttctcacatcttctggtatttgttatagcaacagtcccacttcccagtaccatttatttatcttaatctgtttggggttgcatagcagaatacctgagatggagtaatttataaagaacagatcttaaggttctggaggctgggaagtccaatgtcaaagatcctgcatgtggtgacagtcttcttgctgcttcccatggtggaaggacaaaaatgcacatgcatgagaaagcaagtgataggacatgcaggctgaagtctttcataaacagtattattccatttataagtatggagctcttctgaccaaaacacctctcgttaggccccacttcccaatgttgttgcattggttattaaatttccaacatgctttttggggaacaccttcaactcatggcaggtatggatgtatgtgtgtataaatacataacaaacacaaatatatatatgtgtgtgtgtgtgtgtatgtacatatgcacatacacatttatataaatataaaaacatctatggtttcctggggatattatcttggaatcctgcattttttaataagtacaaagtgattaaatgtgagctcatattcgaaaaccacttcctttgccaaggcccaggccagtcacaaaagaggttattagcatttcattagttggattttctctgttgcgtctattaaagagcctccatttcccccattaatacagtgggtttgttgtcagagggtggcagcattataaataatgtgtgcacttttaggttaccagtttggagactaggcctatgttctgaatgttttcctgagaccatatggataatcttttggcatcatccagactcaaaccctctgactgcttctaataatgctggtgctttcagtggtcacaaaatagatcacagtctcaaggatcaatgtaagatttgaaggtaaggacatctttatgtgtagagggacattttctgatctggtaaataacttatcaagctgaggtgatttttttctcagttgtctcccttcccttatcaacacacatctctatttcaattttactgatttatgtactttactgctgtttaaatccttcattgtagtgcttggagcatctaggaacatatgtgcctcaaagcatcagtaaagtgtggtaggtgtctttgagggtgcctttaactgcaaggatggacatgcactggtttagctctgattctggtatcatctagtgatatctagtttgtgtctacgttcccccattttgtttttaaaaaagaaaagagttaaagaatcctgagcttactaaaattgtttggctcgcacagtggctcaagcctgtaatgccagtactttgggaggccgaggcagatgattgcttgagtccaggagttcaaaaccagcctgggcaacattacaaaaacctgtatctactaaaaatacaaaaattagccaggcgtggtggtgtgcacctgtgctcccagctactcaggaggctgaggtgggagaatcatctgagcctagggagggccaggatgcagtgagccaaaatagcgccactgcactttagtctgagcaatcagagtgagaccctgtctcgaaaaaagaaaaaagggttggggcggggggtgcggtttgatgtttattaagctttgaggaaggattcctactgtgagcatggaaaggcaggtggcgataagtgtgccaattttttcaccatttctgacctggaagttgtgaaatatttactttatgcaaactttactactgtatagaaaatgttacatgtccttaaagttgtgtagttaaaatactactaggtataaagggggtgagagaaataactgacatgaatactatgagcctattctaaatacactatttcattcagtcttcaaaaccaccctatgaaaaatgtattgttattcttatttagtgatgaggagacaaaagttcagagacagtgaatggttttcttaaaatagttcattgtaatagttggtgaaatgtttaaatccaggtctgcttgtttcaaagcctaaatgttttctcttaatatgttacagtctagaaacaatgattaagagaatttgagagtatgaagggaatactgtggtaacagcaaagctggaaagatagaaaggaccaagcaatagtagaccttgaatatcagaacaaggatttaatttttttaaatattatgcatttatgtatatgtatgtgttttcatatttgtaccctatcaatagtagaaaaatattgatgagaaaaggtcaacttattctaataaaaatatttgaaatgaaatatttcaaataatgaagaaatgtgtacacaaatatatgcatatatatgtacatatacatttatgtgtgtgtatataaaaattttgagtggggaaatgacagcacatgaagtttgtttcaagaagtttgtcctggccacacaacgtgagagatgttagtagatagatatttgcgagactagctaagggatgcttgagctagctcgaagaaataatgagagtctaaaccaaggtagtagccttgggaatggagagaaggaatggatgggagagattatgagccataatgctagttgacataatcagtttctctggacagtttccaaatgagacttaccttagtgaaaccacattcttacacactcataaattttctaagtaagataacaaaccaggttcctatgtaggtgctaaaaggctataattaaaatcaacccacttatttaaaaaaataaaggttaaggaggtgacttaattgggccacaggagagctatctatttatggtgagaacttcctactcaaaggatagcacatccaaaggcagtgctagtaaaacatttgagagtttggaaatacgaatctctgaactaggttattctaattccactaattggctgccaccacctgcattaattgacatactgacatcttttccctgctagtcccaaacatatgtggccacattgcccaaagtacacaaattacccactaaagtcagtgaaacttatggctcctgccgacatggtagctggattattattattatcgatccacttggctgcatcttgtcactatgtcacagctggcttgcagtactaggaaagaactattgcatatgcagaatcttgaaagccatgggaaaaaaaagtaagtggggaaaataacaatgttaatggcctcataacgtgctgtgcttcggtttaggacaaatgctggtgagaaagtccaatccatagtttggcggagagagtgttggctggcattaatgcaaaaattttatttaaattttaattatcggtggataagtgttttagattttgtgaacatccaatttgtaagttaattttggagtacctaacccagaaatcacataatctaaaatcattctaatgagtttggccgtgactcaattcacagttaaaggagagacgttactccaaatttagtctcatttttggatcatgaaaattcttagattgggtcatacacaccatggtgccgagtagtgcttaattaacttaataggccaagacttcattccacatgatcctgtgggatttgtgaaagcgttggtagccgagatagaagccaaatcaagaatgtaccaccaggtggcgcttaaggacttcctttcttcacatgtcactcagtcaatccaggatttattgatgtgagaaagtgtaacactagatacgcatttccagaagggtggcatgaaacttctttaaagatttcagaaataatatagtgtttctaatcataggattgggtctatctatttagtgagcgagaccactctctacacacacataaaggagacaaatgttatcaaacaacaatgataaaattacgttttgtgagacaactgtgttcattaacgcatttttttaaatctcaaaacatacaacattatttcatgttcaccatctcatttcttgcaagcggcctatcaagtaagtagtatttattattgtcattcttttcctagaagaggaaataaacaccctaagagattaatcaacatcacacaattggttaataacagagcttgtagtgtaatccaatgatctactccaaagcctgaaatcttaaccaatgtgtccatctgcctctgatatggcactggttaaagtgtagatgattgttctagttttcaacaactggtgtttaaaatttaggggaaattttaaagttttagttgacattaaagttgcattgaatttcctttctggtaaaagaaagaagcaaaaggtggtggtcaagtatattcagtaatagacacagaaagactataatagcaagtataatacacttgggccgcctttgtgaattaatttaaaaatgattgcatgcctggaattgcttaatatgaacttcccaatagaagaagctttgagttaccctttcttgttaataggattgtcactttttttctttccaactctgaacagcagataacactgtataatacttgtcccaacagaggctccaaatcagtagaggatggaaaaacactcttattcagagacccattttctttgttttataaaaacctgttgggaagaaggttaatcacaaacagagatgtaattcggcatagggaagacttccttccctattttgacaataaccttaatcttaattacttgattcactccaaggaagagtcagattaatgtacctgttagaacaccacctagtttctctaattaatgtaaattgtaaaatgttcaggaggtgttagaaatcagaatgtagtttgttcctataatttgaaaacatcctaatcaggatgtgttcttggaggaaagggctctttgtgtacctctaagaaaaacagtgaatttttcaagaaaaaaacaaaaaggcttgagctgaagtcacattggggatgttttgtctttctgagcacaggcatataaaataaaggaacccataactgcacaggggttggtctgcagatatgatgaactcctctaagtcatccagggcttataaaacaaaggaagtgcaattcaattctctgaaaatactaaactcaatgtttgatcgttagcacacagctgtcttcatcaccacccccactgccacaaccatcatcatcatccaaagtcattataattgtttaagatgctgcaaaagtagaaatgaaataaactctgtccttctcacctgagagttgaatatgtagatgtagaagataaaggaaagtatttattttaatgcacattttgaacacataagttttattatctttattatggtattgggtaaagtgatgtatgcagaaatattattagaggcaaaataaaccctttttctaataattttattcacttattgtcatagcccatttattgttactataaggaaatacctgaggcttggtagtttacaaagaaaatttggcttccaattctgcaggctgaacaagaagcatggcactagcattctgctcagcttctggtgagggtctcagtttgcttccactcatggcagaaagtgaaggggagttggcaggtgcagagattacatggccagagagggagcaagagagaggggagggaggtgccaggctctttttaacaaccagctctcatgggaactaacagagtaagagctcacccaccctataggaacagcattaatctcttcatgaggaactcatccatgatccagacacctcccattgggctccacctccaacattgggatcaaatttcaacatgagatttgatggagacaacccatcttcaaactataacgcttcttttaggtatattatttatatataattaatatgttatatataatcatatatacacatataaactatataattatacatatataatatatatatgtatatataaactgtatataatatatacataaatacacatatgagtatatatgtatatagtatatatgcatatatacacatataaaatatttatataatattcatataaatataaactatatatgctctatacgtgtgtgtatatatagtatgtgtaattttttacacacatatgcacatatacaaactatctgctatttactaaaacactttgcttggtagaaggaatatcaaagtcaacaagacatatgaactccaggaacattgcatctaataaagaagacaagaaatcagaaaaaactaccacctgtgaaacatgttatgctacagttaagtataggtagctgtaggagtatataagagagtcctccaacctatttttttgaagtgtttgtaagacatgatcccaggaaaaggtgacttataagtcaaagacagaataagcattaactgggcaaggggggaagttccaagcatttcagtctgcaaagacccagagataagagagtgatgagctcaccaggaatcctgagtagctttctaaggtttgagttaagacagtggaaagagactggggagagaggaggctggaaaggtaggcaggggctcatcataaagggccttcttttgctgtgaaaagtttaggctttatcctgcaaggtgtgaaggacacattaaaggatttaagcaaaacacctttgttctttgtgaagatcactcactccagatgttgtgtggaggaggaataggtgagtaagaggggaataaagggttcaaggtggtgatagctatttgaggcagagatatgaatatgctgactgagggaacaataatggaggtggacaaatttggatggcatcaaagtttagtacaggaatcatgttaactggattaatggctgaactcattgtgacactcaaaatatagaatagggttcttttgagacctaagtaagatgtgtaatttattcttaagataaactggtggtttggccctatattttgaagaaaaaacaatttgttgctgcaaaaagatggtgataagaaaactgggagttttagaaatgctggaggtcactgaaattgtaccgacagatttctaattctcttatctgggaatcatgtcttcagcaacttccaaaattgtgaactcacttgacctcggatagacaagcaaacattgattttgagttttcttaatggaggagctttgcatcatgtactttacttggggagattctcacctctatttgcttgctacgtctgttggcttctctcttagacgtggtcataacatcatcacttagctggttctccagcttgaaggggactagaagtactaaaaatgaagaggaaggtgggaagcaggccctctgacagcaggcacctgaagaaatgatggctgatatttattgtttgatgaagtctccatcatgtgctttctagatgcctggtaccaggtgtatcgcccatctgtggcatcaacacttggggattcagctggcaaagaaaaaaagggcattctttataatacgggtgcaagatctgaagagaacagacaaatttgaatcatgcaacattatcataatctcatattttactacccacatagtaaactggcaatgtgcttagtgacaaaagtgttaagaatagaatgaggtgtactagatgccacttcttagagagaaaggagtctcagatatttctaaagcatcacatcagaaatgactgatcattaaattggtcaaatatggattaaaaaaagctttgcagttcttaaagattttatttagttgaagaggagtagctttactgctttatggaaaaaccgtagtgttcgtttttcttcgttttcttcttcccctttgtttaatatctaaaagtttacctcaaccagacaaattctcaggtgtaatgagattcatttttgtggattctagagacgttgagaggtgctttattagctcagtttcttgaggattgcagggggtgtttgggcaccttttcttgactggttttatgaaagatgtgggggctgctttcccatggaaactccacctgcctgtagaagctctggcataaaatgatgggatttccagaaaagattccaattttaacttttcccactcaatggccaaactcctaaaaaaaaaaaaagggaggggggcatcaatttactgttccaatttggtcatgtttcattcacattttaccctgctgtaacttggcctcacagccatgccacccttggaacagttctcttcagattcaaactgattcctcttaggttactcccagcttatgtggcctcttggcagcattcacctccctttactataactttttcttgaaacaatggcagtgctctattttttccataatatttattatagctttaagggcatgtttgtgtggtaatttggtcagatctctctcctccattagacaagaagcctgctaagagaaggctcttggtctgttttacttaccattgtatgactggcaactgctggttgccacatagaaagagctcaataaagtgtattgatggcatgaataaatgaagggctcactttaggctagctttacaaacatgaaactgaagcaaagagaattttctaccttctaaaaattgaagccaatctccctatactagtttaatgatacaagtttgataactcagtagaaaatgtccagtaataactttaacttctcgtattcctgtcaagttctaccttaagacaagaagtaggcacaataatttcaatatctcaattataatgaatgataatagtaaaaatatttaatgatggatataacatgggcaatgagaagtttaaacaactattggctggaaacaatttatatggctctaaagctagtatacgctgaatattagcctgctgtggactgaattatgtccttcctaaattcatatgttaaagctctaatgcccaatgtcactgtatttggaattaaggtcgttaggcgtgaattaagattaattaggtcataaaggtgaaaccctaatcctataggattggtggcctcataagaagaaatagatctttctctatctctcttttcccatcccttcccctatgtgatcagaggaaagaccatgtgaggacaaagtgtcccacctgcaagctgacaagagagccctcaccagaaactgaaccctgatagatatgatattggacttttcagactttagaatggtgagaaaatgaatgtctgttgtttcagcctcctaatgtattatgtatttttatggcatcctcagaccagttcacagctctaattaatcatatcaggtacctatgtaacagacaaattggcattgagcttattattttttttaaaaaagccacaatgtttccagacagaaatcttctaccatttttataacatttatttaaaacttaaatatccattgacagaaatactcttctgatattgcatacccggtactcacaatagaaagaaattactttttctagtatgtgtatcctggaaaagcccatgtggttttctttcataaaataaagcataatttgttacaggaatttgcttttttttagaaatgctacagtacaccagttgtcacagtgtagtccttgaaggatagttctgcaggtgctccaaaaaggtagtcttgattaagtaagtgtgggaaatgatgctttattaaaacagtggtaaatgggtttattttattgctggaccttttagactctttcacaactagtgtgttgggtgaatttatcaataatgtttatgggactctcaagggtagatagatatataatgcaggattgtccaaagtcatttgacaaggagatccttgcttcacaacacaaattaaaaacccatggaactgatgtttttcaagatacgtatattccacagtaaatcgtagtgtaaaattaagaatcattttgcaaaggaaagaatcactgtatcaataggtttcagagcagaaaaaacaatctaggtatttccagctactaagtaaatcacaatgctcctcagtcccaaatatgacacctgtcaaagagatcaaaggacatggagtctgctgtgctcatggtcatatctgcagagaccaacacatcagcctccactgctggagaaagatggctcactctctctctctctgtatcttccacattttgtgcaaatgcatcccattggcagatagaaattgaatccagagccatggtagtctatgaaatataatacctagacttccagcctcagagttatagagttgtgaattgtacaattctggatttctatttattttgtcactgaaactcactgtaaatcatattctgagacttcttacatcctgtttccacactccttttccttattccctcagggaaaatagacaactaatctctttaacactttcttccctgcttgaagaaattgtaggcacacagtaggggctttgtaaatatttgttaagtgaataaataaataaaggacatataagttgttatgtgattcagccaagaggaaaatactgtgaaatcagaagatagttaataattgattggcattgatgtataggcttcagaaagtgtcacagtggtttcatgaattgactttattgatgacctatttcagttaccgtaagcatacctgtacaataaaattgaattaacgtgtatttactaccaggtactcaagaaaaacaataagcatattgaatatgagactaaaaaggataagacaaaaagagtaacaatcaatcatgaagcttctacaatttcttcctttcttttctcctaacaacagtggtcaatgactctcaggggacctgacatacttctactcagcatagatgggtcttacagatgatggagtctcaatgagtcctcctggaatgtggcttaaatatgcaggctttcatctatccctctatgagaagccagagggcttgaagtatcagataaattgtataaatgtaaggccaaccctatcagccatcaatctatgtcaaatttcaaaattatcatgtctttctaaacgtttcctatcaatgaagagttacatttcttctggctttgttagcccacattattacctcagcagtgtgtgtgtgtgtgtgtgtgtgtgtgtgtgtgtgtgtgtgttggagaggaagggcttatatctcaatatattattttattttaaaatacaggcaaagtaggggggagtctatatgactaactcaaatactgtcactcactggggtgaacattctaagaaatcaaagcattctcctgagtgtatcttcttaatcagcaaagtattatatttggattttttcaagaaaaacaaactccctacctaaactctgaatgttagtatggccttggtctctctgagagagagagagagagagagagagagagagagacagaccaagaaggagagagagagagaaagagaaagagagagggagagggtgattgatctctcatacatcagtcactgtgtcagagtatcaatgaatttcttagagtatccctctaaaaaaagggagaggagagttagaaaaagagaatgtacaggtaataaccaaatatttaatcatcttgtaattttctagatcctcttataggttctttgggaacatctgactagttctggtcaatgggttatgagcaaaattcacatcaacattcatggcctgggggtgaatgattttctctctcattttgccaacatcatttctttctctgattctatgaacttggaggccacacataccaccagtagaggctagaaaaatgacgtctgacccacatcagatttggtgaaggagaagacaagaataacaacaaaacacacacacatacacatacatatacacaaacaaacacatattgtgttacccctcaaacatttcaagatgtattttagaaaggagtatagattaccctcacaaatgaggggacagagggtgtcttcttaataaaaattccacagacaggctaaattccatttcaccttttttgaggcaaactcctagtaagataaacagaaatgggattaaaaatatccatgaatatatcctggaaattgtatacaatacttcatgcacatgtgcttttcatttccctggagagaggatagataacttacattggagcctctaaaaggtttagggtccagaaaacatcaaggaatacaatgtgaaaaatcgcccttatttagggaattttgagtatctgtggaatttgaaaatcatggaggcagttaccaaaaggcaagaagcttatttaaatctaagatagcctctttgggctattgcatgtctatggagcctgtgcatttggaatttgggctgcaagaagcaggcatgtggcaagtgatggacgcaccagtgatgaggatgaatcatttgaagccaagaggcctgttcaataatgtaacacaaagggattaaaagaaaagaggaaagaaagcactgagtagttagtctttgtgcttgcaagtcttttgtttccttgtaatctccttaaatgtgattgctgtgatggtgaaggctcttatatttaatagactcttgagttactttggagatgagacatattttccacttacataaaacacactttgtaccagaacacagatgctacaattgatacccccacgtcttaagagaaaatttgaaaaagagtccccaaagatttcagaactgcctttactataaatgaaagaatgattgcagttatactaaactccagtattaatgcagcagaaatagaagaaccaaagatggtgctatttattatttcccctcttggagagtatcagcaaaaaatgtttttttttttttaaatgcagttaaccctggcaaaggtaactgatgcaggtacacagatttgtagtcactcctcaaattgtcaatacattgtgctgtttgctcagcaggtgccctaaattgtgaattttgttaacgaagagttgtcaagaagtattggcttcatttagaaagcgatattcttctcagtagccttagtcttactttaggaaatccacaggggatacgtaacttaagggttcagattgggaggcgcctattattattccccaaatctttgcaggtgtccccaaaagcataaaagattaaattatacgtttttttatttgtcgactgtttcaaagtacaaacctataaaaggggaacactggtactcttttaaaggttatagggcatgaaaccacctttaacttacacgaaatgctttgaatttgtataatttgcttctcagatctcaaaacacttggtcgtatttcactgaatttgactcatccctttgggcaagaaaggttgaaaaaaagaaaatatcttgcactacttgctttctaaagccactccaggatgaaaaggagatactgaatgtctttgtggctgtataatttttagcaggggccattttctgtgcattcttattagaggaatatgtaggaatggtctgtttatacaaagacaggatggattatatgatatgattttgaaaatgaggaatatacctcttctaaaacacccatccagtctaaaacagtgtctgaaatctaagattcaaaaaaagccacttttttttttattttagggaattgtgagcttctatagagttgtcaaaacatggaggcagttaccagtgtattagcagcacattacccagatgctttctgaaccattaaatagggatcacaaaaagttattacttcactgaggacttttaaggattaaataagatgagacttgtaaagagtttaacatagggcatagggcagagtaatctcagtaaatgttaacaggcagtactagcagtggtggtagatgtcaaagtcactagttgcacccaataacatttttgcacctgttactgcatctatagatttataaaatctgaacgttagagacaatcaccaggtatgcagagtaattagttcatttcttcctcacttccttccttactctttccttctcattgtctcttccttacttcttctctccttgtttgttcatgttctttaattcatccaaccaacaacatgcagtgagcacctatttacaggcattttggataaagtaaagatcgaattaagcacaatcactgctcatgtgaaatttacacatgagagaatagaggcaaacagcaaaccacaacattcagaaataattattgctgaatgtgacatgcattatgagggagttagcataggaggcattaacgggctgaaacctagacatctaaccagaagaggggttggctcatgtatttgttcatttcacagattagtataaagctttaatctgattatttcctgagtttcttgctaagggatgggcaaacaatagtagtaaagacagacaggtatttttcctatttaagttctcattttagttttcaaattttgctctaagaaactctaaggtctcataaatgctctgaagtgccactggaagctctaacacctctctgaggaagaggatatgagctgagactataaaaccgcaaactcacttgaattggagtacagccaacctttactttgcacagatcatgttaacacaaatctgtgtgtgtgtgtgtgtgtgtgtgtgtgttggggggaacctagttcttactttacccaatccccacatgttctgatatgcaatagtttcagttagtagggtatcatgcaatgtgtggaatacccatatgtcttcttatatatgcttggcaaaaagtatgctgctagaaaaataatagcagccattgattaacttccattctggggcataattttcgagttcaagattgttacaagaatttatagctttaaaggactatcctatttcccctatacttcctgggctaaatatcccattctcttaaatttttcttataagaatcagacgaattgccctcactaccctggtcacttctttgcacatgttttttcagtgtttgccaatgttcttcttaatgcttgggacccaaaacaaaaccatgcccgttttgccattagaaattcatctgtatcacccttaagttggtttatcagagtgggagacaaatctatgtaattttttattgtaatcttagtactgcagtgtagtacctagtttctaattagtactcaatagttatttcattaatacatactccaaatgtggtgtaaccaaacacaacatagatatctgcttttataactatgacactatcacattaactttcatctagccacatgacacagttgattgattttatgtttcttatcaatttatcaaatcagcttcttctcatttgtgaaagtcctgagggaattgacacaagataggtaaagtttattgggaaggaattatgagaactaataggtgtgaattggaaaagtcagatctgagtaagattttaaagtgggaaggaagcagttatgaacatcatgacctctctcccataaatactttgtgcttggagaatgaaaagaataaggaaatcagaaatacaactttcacatatttctgaaaatgccaaggcatgatgcagatgtttaatgggtttatattttaaaggttttgcattatagtattgatttgaataatttgaaatttcatacaaaatttcattacctgttaacttgatgaaattcactgaagaaagaaagaaatgttacagaaatggactacaccataatgactttcatattcatgtgagattgttaatgtagaccaattgggacttcaaatggtgtggtagaaaatgctctttaatgccaaatctgggcaaagcaacttgtcacatatgggaccaagcttaaaacattcattctcaaattataaattatactcctgagaatttatactacaaaaataatgcgaggacatttaaaggcttaggtaaagatagtttatcataacattcttgcgattgttagaaaagagtcgatattcattaatatggggcaagtaaaacaaaatcatggttaaatctatgtgatggacaatcaattagacttccacaaagaggcagagcagtatgtatagtaagatacctttaaacttaaaaaatgcccggaagggtaaaattaaaactaataataatggttacctagaggaggaagagagaaaggaagaaactagaagaaacagccttgattatttattttcaaatttggaaacaagcaaaagtttttgtcttgttttgttttgttttaagatggagtcttgctctgtcacccaggctggagtgcagtggtgtgatctgggctcactgcaacctctgcctccccaggttcaaccgattctcctgcttcaccctcccaagtagctgggattccaggcgcgtgctaccgtaccgagttaatttttgtatttttagtagagacagagtttcaccttgttggccaggctgtctcgaactcctaacctcaagtgatccgcccgcctcagcctcccaaagtgctgggattacaggcatgagtcaccactgcacccaggcaaacaggcaaaagttttctattaatcacataatgtgtgggaaaaaatccttaaactccaaagaaaaatgaaacagaagaatctgtgtataagttagtagcttaatggtacaaagaattatttgaggatactttgaattttagtaatttgtgcagctttgtgaaatatatcttcatgacaatgagatatgcccacaatattaaaatttgtatgtttcaatatttttacaatatatgttgtttttgaattatcatccacatacttttgcataaagcaactgaatactttttatgtcattagagaagacagctaaaagaaatataaagtcaatgaagttaagcaaaaatcttataattcaacatttgaataaaaatgatcaaaatgaactcatgacgtttcttatcttaacacagtattttctacatctgtccactgaaaaagtgtagaaatgatgactatcccaatattactgaatagccccagcatacagattatggtctctaaatgccattgcccagttaaaaggaaatcagacaccttagacagatggttgatcccaggttttgggggaaataatatcctataaaaatgagcctggaatttctttcaaaaaccaaaagcagcaaagccgcctggacatggtggctaacacctgtaatcctaacactttgggaggccccagcgggtgggtcatccgaggtcaggagtttgagactagcctggccaatatagtaaaactccatctctattcaaaatacaaaatttagccaggtgtgatggcccacctgtaatcccagctacttaagaggctgatgcaggagaattgcttgaaccctggaggcagagtttgcaatgaaaaaaagcagcagagccactattactgtaatcagatcaaaggaaattatagtcatttttaagagcataatcccatcccagaaaatacagaaaatgtgaacattagaaatagtaataagattgaaatgtatcaaaatgtaaaatatgtaagtgcataatgatacaaaaaaagatggataaggaaaaataagcaagtttttctttatcttttctatgcaaacaatacctcaaggtagctaaagagtttctttatatagaagtatttcagataatcaatgaaaaataatgacaaaattagattattacaattttgtactcactaatacaaatatataattaataattgctaaaatccaagttttggaaagctaatggaaagctttaaaatggataggtcaggttgtcaacaccttttaaccttaggaatacacatgtgtgcatgcgcatgcacacacacacacacacacaccccacacacagaaatcagaaaagacctgcctactgatatgtacaataggaatcattaagcataacttacatctgtaaattacccatgccaaaatattgaacctcagcctgatcaaaccttaaaatgtgcttatcagtttgcaagacacacaaaggagagagcagcattaaaacaaacaaacaaacaaagaaacaaaaaatccccacattcaatcaatcaacaaaattcagaatgtgagaaattctttaggacaaatgactgatttatttaacaaattaatggcaagaaaaacaaacaagagtaaaagatgaaccaagagataaagagacttaagagatgtcaaacaaattatatgtagtggatatttttctttagtagacatttgaaaactcaaaatagtaaaacacttcttaaaaagaattagagaaaactgaacattgactacatgatataaaaaatcattttctggctgggtgcggtggctcacgcctgtaatcctagcactttgggaggccaaggcaggcggatcatgaagtcaagagattgagaccattctggccaacatggtgaaaccctgtctctattaaaagtaaaaaaattagctggacgtggtggcacttacctgtagtcccagctactcgggaggctgaggcagaattgcttgaacccgggaggcggaggttgcagtgatcggagattgcactactgcactccagcctggtgacagagcgagctccgtctcaaaaaaaaaaaaaaaaaatttctaatgcattaggtgcgattatggtattatagccagattataaaatagatcattatttttagatatgaactgaattgtttatgcatgcaattaaatcatatctcagatttgacttaaaatagctcagtttagtgggaaaataatgggtggtggtgtggatgaatcaagattggacatatgttggcaactgtccaaattgagtggagcgtataaggtgttttaatataatattctaattttatatatgcctgaaaatttccataataaaaagttaaaataatatttttaaatgatagaagagcaattagttctgggttatataatttatggattttttatttttatcattatactttactgtataattttcttagtgagggtatattactttcatcttaataaagaaaagatatataaattttaaatgaactcaagactgaatctgagctgatatatccaggagcaaatcccttgacatttgccaagaataactgtgttagttttctagggctgctgtaacaaagtgacacaaactaggtgtttcttataacaacagaaatgtattcttaatagttctagaagctgtgagatccagaatcaaggtggctgtagggccacatttcctttgaaacctgtagagaagaatcactccttgactcttgctaatttctggtgactgctgtcaatcattggtgttcttgatcttgcagttacatcactgcaatctctgcctctgtcatcatgcggtgttctccatgtgtttctttttgtgtctcatttcctcttataaggacaccagttatattggattagctcacactactccattgtgacagcatcttaattaatcatatctgcaaatatctcatttccaaataatttcacattctaccttactggggttaggacttcagcatatctttttaaggaaacacagatcaacccaaagcaatcactaaatccacccatgcatcctgaaataactgtgatgtactaggaaagtatcagacatacaactgaccaggatttaaattttaaataagcccttcattccttgtatgaactcaggtttaattctttgaatcatactcaccttggctgatcatcatcatcatcataatcatcatcatcatcaccttaattgtcttagatcagattatctataataaagcctaaggtagagtttgtgtgctaaatctttgttgagaggtaaaaccagacaccatgctgaggagaaacttgcttcatctgaattcaaaagtggaaaaaggaggcaaagtctttggtgggtagggtggagatggataatggcagataaaattgaagatgtttccaaatctagcccttagtattttaggagactgttttaatagatgtggcatatgagggcatgtcctgaaattttcactgggaaacagctgaggttcgggagcaggtagactcatcaaatctggagtagcacataaactgggttcaataaaaactcgttaacttatagatcagttgtgatgaatatatgagataatacatgaatggattctacacttctatgcactgcctggtttaagtcaggcactctgtaaatggttattgctgtttacttagacgggccacatcccaactttcagagagcttacgaagcaaaaaaatttcaaatttcttcaagagttcagcctaagctgggaaaagagggggcacaccatgtttaattgagaatattttattttaaagccattatgatttgaactcagtcactgaactacatataactaaaagacaactgatttcacaatttaataggagcatgaagagaagtgtgccttagattaaagtttgtgcctttgaagtatcataaacaagggttcactcattgatgaatgactcatttttatttatttatttattttttgcaatgaagcaaaactcttttcatttaccatctcttctcccgctcctccccctcatcctccttaattcttcttatagttaaaagcctgggctttggggaaaaggagatttaagaattcaaatcccagctttgaaactcaaaagctaaatgcaaattgtttaacttcttaagctttagcttcctcaattgtaactaacaagttacaaggattaagtgaaataacatatataaaatgcttagcatttgctatccattaacagtgtccactgttcatctccattttcaaaatctttcatgtctttctcgtctccagaagtgaccacagcagctgcataacggccacctttctcccctaccttgtaatctctctcttctctctccttgtatcgtaacaagagagagccctctcgaaggtaattctttccatttcattcccttccttaaattcactcagtgacttctcattaacagaagaccaacaccaagtttctaagttcgggccttacttcttttacttcattcctcattatctccataacagacacatggacactatctgccatagacacttggatctttctcctggacctcgacacctgcaatgtccttgacacctgcccttgatacctagctaatttctgcttgttattcaggccttagttgatgttgctcttccaagccttcaaaacgccctgtgccatggcatttatcacatcattttagtatcagtcctctgtctttcctctctactatattctctatggtatctttcatctctagtgttctagatacagagatataggagataaccaataaatactgtagaatgaatcagtaaattaataaatgaatgaatgaatgaataaatgaaggaacccacacaagctcttctttgcaaatatggtcaatagagtattgtctaatttgcaaaagccttggagtaacattaactgaaacttatagcaaataaacatcttgaaaaaataaggtaataaaatatcttaataagaattaggtttgacataacctaggctctgggttcaccctggaagaacactccagtggaagtacttagtgcccgaaagttggcaggacctcctctaacaggggtggctgcacagatgttctgggaagcagaacactgaagctccctgctttaggataaatggtgaaggactcaaccaaaaaatccactcctttcctacttacctctgaggccctggagaaggagcatccttagcagtgacaagggtatattgatgttctaatgttttccttaaaggcataaaacccaggatctaaatatttaccagcctatggaagagaaccatggaaaatgaccactattaaattttttactaatcttggaaactagtctttcagtatacaattttaattgattaagaaaaatagaaaactatgacttcactttcatggtcattaagtatcacacaccatccatagtgtttacacatttagttttgcataattattcatatcagaaagtttgaagaaattctgtcccctgtgtttgcttatgataacttcataccagcgcacagcaaattccatcatgttcctttaatttgattatctcagtttatcgccatcatatttctgaaatataagtgctgggattattgacttagttttcttacttgtcccctgccatttcctttgtcttttctaagttccctttgtttataattctcacataatgttaaggaggaataaaatcaaaggatggaaaggagctaaagttgatttttagcatagacaattgaaccaaaggtagtctgttattggggtaaacttctactttaaagtatcccaatcaacccactccctgaaattaaaaagtgtcttaagatatggtaactactctagtagatttttttcattggtatgaatttgttcatattaattttaccctttggcttaggacaagggcaagttaagggaaaatactcttccgtcttttcctttccatttgttcatcctgaaagactattttcagaaaggaagtttttattattataattcttcaactacagggtgaatgtaaaatacactctgtgagctagtttgagaagccatataccccacataacatactttctaaatgatgctgcactgttcttccccaaacactgagttctcctaagtcagaggctgattgtgaaagagaactccccttacctaaaatctacttctgaggcattaatctagggtttccaatttatgtcagctaattttatgtattagaaccatcatccaggtattctccagcctttccttgaagtgtcatttctgaataataatcttagaatccactttcttaagcatgtttctcctctccttgaatatctcatagcaatggcacctgagttcagtatgttgcatttattttaatgtttgtatttgaaaaactgtgaatgcacaattcctctttgaggataccacatttcttctatgtaaatcacaccttagaaaatattaaagattttaggtttttaacccattctaagtgttcctatcatttaagaatatttccacctcacaccttaacccagacttaattgtacagtgtacaattacactgtaagtggctaattaagaaaatgctcaatgtactgtagttgagagaacttcctattcagggaattcgttctactctttgttaggagttgcaaataaaacaattcaataacctgaatccgctccaaacaaaatactaaccaggtatcttcacagaggcataattccagctagaataaatgtgcatgaggattatttctccttcctcctactgcctcatcctattattatccagttccacatggcagagttaagaagcacagcatctgcatttctcagattgccagtcttcttatcctgtactggtaggatgacatctatttttgccagcggtgttgctgcaaccgttacagcgggtcttcctttctttataaaatgaatcaaattacaggtgcgcagcatggttgagttcagctgtatatctccaagttgcacgaaaactaaagctgtctttaacttaacatagtattggaagttctagccagggcaattagacaagaggaaaaaataaagggtattcaaacagaaaaagaggaagtcaaattgtccctgacatgattgtgtatttagaaaaccccatcgtctcagcccaaaaactcctgaaactgataagcaacatcagcaaagtctcaggatatgaaatcaatgtgcaaaaaccacaagcattcctatacacaaataatagacaagcagagagccaaatcatgaattaacttccattcacaattgctacaaagagaataaaatacctaggaatacaactcacaagggatgtgaaggacctcttcaaggagaactataaaccactgctcaaggtaataagagaggacacaaatggaaaaacattccatgctcatggataggaagaatcaatatcgtgaaaatggccatactgcccaaagtaatttatagattccatgctatccccatcaagctaccattgactttcttcacagaattagaaaaaactactttaaattttatatggagccaaaaaagagcccatatagccaagaaaatcctaagcaaaaagaacaaagctggaggcatcacgctacctgacttcaaactatactataagggtacagtaaccaaaacagcatggtactggtaacaaaacaaatgtgtagactaatggaacagaacagagtcctcagaaataatgccacacatctacaaccatctgatgtttggcaaatctgacaaaaacaagcaatggggaaaagattctctatttagtaaatggtgttgggaaaactgactagccatatgcagaaagctgaaactggaccccttccttacatcttatataaaaattaactcaagatggatgaaatacttacacctaagacctaaactataaaaatcctagaagaaaatgtacctgaatgtaccattcaggacataggcatgggcaaagacttcatgactaaaacaccaaaagcaatggcaacaaaagccaaaattgacaaattggatctaattaaattaaagagcttctgcacagcaaaagaaactatcatcagagtgaacagacaacctacagaatgggaggaaatttttgcactctatccatctgacaaagggctcgtatccaggattgaaaaagaacttaaacaaattgacaagaaaaaacaaacaaacaacttcatcaaagagtggccgaagtaatgaacagacatttctcaaaagaacacttttatgtagccaacaaacatatgaaaaaaagctgatcatcactggtcattagagaaatgcatcaaaaccacaatgagataccatctcatgccagttagaatggcgatcattaaaaagttaggaaacaggctgggcttggtggctcatgcctgtaatcccagcactttgggaggccgaggcaggcggatcatgaggtcaggagtttgataccagcttgaccaatatggtgaaaccctgtctctactaaaaatacaaaaattagccaggcatggtggcgcgcacctctagtcccagctactcaggaggctgaggcagaagaatcgcttgaacctggaaagcacaggttgcagtgagctgagatctcaccactgcactccagcctgggtgacagagcaagactccatcaaaaaaaaaaaaaaaaagaaaaaaaaagtcaggaaacaacagatgttggagaggatgtggagaaatcggaacacttttacagtgttggtgggagtgtaaattaatttaaccattgtggaagacagtgtggcaattcctcaaatatctagaactagaaataccatttgacccaacaatcccattacttatatatacccaaaggattataaatcattctgctataaagacacatgcacacgtatgtttattgcagcactgttcacaatgggaaagactgggatccagctcaaatgcccatcaatgatagactggataaagaaaacgtggcacatgtacaccatggaatactgtgcagccatagaaaaaggatgagttcatgtccttctcaggtacatggatgaagctggaaaccatcattctcagcaaactaacacaggaaccgaaaaccaaacatctcatattctcactcataagtgggagttgaactatgagaacacatggacacagggaggagaacatcacacaccagggcctgtcagtaggtgaggggctaggggagggatagcattaggagaaatacagatgatgggttgatggatgcaccaaaccactatggcatgtgtatacctatgtaacaaacctgcatattctgcccacgtatcccagaacttaaagtataataattaaaaaaactttaatttttaaactcctttgtcagcttacaatagcagccataaagaaactcagacaatgtgttccacttaccactctgcttcccttctaaatatcaagcagttggttgtaaactgagctgttagggcacttctgttgcaaagcacacttaaaaataaaaggaaaaatttggagaaaaattgttttaatataagaaaattttcaggcacctacaaagtcagggttgtggttagtgaagttgaggtaatttactgaaacttgtacaatgagtagactggaggattggaggaatctatggatttattttaagatatagagagcatttttttgttttgcagttattagattcattctgataaaataattttaccggaaaacaccaacaacttagttgcatgaaattttgtaatacatggggctatatgatccaaacttggctatctaaattatttttcccaggattttgagccttgaatgtagtcatgtaggatcgaaaaaatggttggagctgatttactgctgcagtgaagagacttcctgatttggattgaattgtgccccactcaaaaatatgttaaaatcctaaccatttatacctgtgaatgtgacctgatttggaaataagtaattgcaatcaagttaaaatgaggttatactgaattaggatgagccctaatccagtgtcactcgtgtccttttaatacgaagagtagaggcacagacccagacacagacagaagtccgtcatgcgaggttggaggcagagattgcatttatgctgccacaaaccaacagatgcctggtgctactagaatctagaagagggaggaaaagatcttctcctagaggttttggagaagttctgccaacaccttgatttgggactcctaggctttataactatgagaaaataaacatttgtggttttaagccactcagagtgtggtaatatgttatgttagctcaagaaaatttatacaccttccttttgcttcttctgctttcatctactgagatgctctatttctagttcctttccaatgctaattattttgtttttccttttttttgtttgagtcacactataatacttccaataaattccctttaaaattaagttgacccaaatagattgctgttgcttgcgtcattttgtcctagctgataagcaaatatttcttgctatcattcctgtgtcatttggtattggtagactagactcagtttgttagaaaaaatgaccaaaacttggaagtctggtgaagggagggttgcatatactcttagagccatattagatcacaaacattttttaataagcccacgaaaggagtgcttagttatctatagtataccattgtttgacttaatatttactataaagttccagcttgtgtgaacttacatgttaacttgtggatttttgtctagcagagatacaagtcattatttgcttgtagaaaaagtatcccaaaggttatgttagccatcttatgcctacatccttttttcactgtgtatataacccttattctaataattctcctttgaatcaccttttcattcctgttgaccacttcattaatgaggagagccagtgttataatatttgtataaaaatcatacttttaactatttgaatattattattgttattattgtttcttagggacagggtatcagtctgtcatccaggcctgaaagcagtgtcaccatcatagctcactgcagctttgaactcctggtcccaagtgatcctccgacctgggcctcccaaagctctgggattacaggcatgagccaccactctcggccaactatttgataattatactttgatatgtggcatgcgcagacaagattatttgagaacactgattgttccagattagctgaataactgtgagcacatccacaaggcagaatttaggatgttgacattaaattgaaaataaaagaggacttcagaatgctgagagaaaagtatgattttttcttcttaagattgaaaaaaataacatctattagtttaaataaaacctatccactcaacaaatattgatttagagactagtaattgtttcttaaatcgtaagacaacttttcactgaagatctggtcagagagttgggttaaatatcttcaaatcaaaactatttcatccagttcttcgggtgaaagcaaatcaggacacagaagcataggaatattacatatacattatattgatatataatatattatttattatataatatacataatatacaactgaattccaactgtaaattatagaaatttgataagaaaattagataatttcacatagtaagatcagactttagttttcattgcattattgaaacatgaatgaaatataacaaagaatgagtacaaccaaatctcttaacaaacttaatgtaggctcaagaaaacatttttgaaaaaagcccggtatctccccagtggaaagatagagttgtgtgtgtgtgtgtctatgtgtgtgtgtagtagtaaatttgggacaaaatgatgggtaggaaaggaaacacgaaggatactgccaccttctgagtgttttatggccacctctgcgaggagttcttaaaaaaaatcaagtatttaatacttactatatgaaaacatacattattgtcattaacacagataaagctaagagaggttaattttctttattagggttatgcaacagctgatgcagagccagaattcaaatttatttctaactccaatatttgtattttaggttttctattaaaggatattgcctctcaaaatgaaattgacattattggtggatattcagaattctggttgatttcacaagttgtaagttacaactatgacctttctgggatagcacatggtttgatgggaaaagtatagaacatttatttctagtaccgcattgccctgaaaacaccatgtgacctttggaatgtcactttttgctttttaggcctcagttaccaaatctataaaatgagtttatcagaccaaatgaatagactcataactgtggttcatagtattggttttgcggtaaagtagttcaaccgtatttcattcaaaagacatttattggagtgtataatgtaaataaatctgagatgcccttatttggaagatggcaattactttctgtacccctaagaaagaatgaaaatttattacttaaactctgacataatgccttattattggtgttttatttcataccttgtaaggaaaacttttaaagccttatttagaaatagatatttttactatatatcacctgttcctttacaaatagaaaagtaccagaaaaataaatttggttaaggttttcttaaaacatctttcccatttagagttcaatttttctggataacttttagactcaacttttacgtatttctccacacattagcatcttctaatgcttcacaactgttggtaataaagcattacttaaatgaatgttgtattatgtccttgaggttttcttagaagccagtgatatattgtactcaagttttgatgctgggagatatgtaagtatgcatacacacttatgtgtttataaatgtgagttgtgggtatatatgttctatatttccacattatgagcaactaagggagaacacttggatatcgttcacgttgatgtttcttccaacactcactacattattattcacataaaaagaactaggaaaattttgatggcagaaaatagagctaaaatatcttattcttattttacaagtttctaactatttggtttcatgtgtaaaaataagccacattaactagggtgaattttctatatctactgaaaatgtatttctaaatgtttaccatatattaacaataaaaacaattaggatagtaaatggcaaacagtatcagtgaaggaaaatttttccttagaaaagatcatttaaaactacattatttcatgaagttctgctgtgttatttgttgatatctgactaattaaatgcaaattatcaaggaaccatctgccaggctcattcccagcgatcaattgggtaaataaaggtaacaaaacggtgtgtttggttttgcatctaacacagtatttgttttattaccatcattttaaagctggatttttattgccattttatgtgccttgtaatttgtacattaaaaataagggtttcaaaaataatgatcattttgcatttaattcaacagaaatgaagtgcataaaagcttgttttgattgaatactgaatcagattccaaaattctaagtgtcccaacacaggccagtctccccaaacactcatgtaataattctgagttacattggaaataatttgcttaaccatgtcaagcacatgagcttgtgtgttctagaacaagttgtcccaaatggctatacttcagcgtatcaaaaaaatcatttctctcaacttactggtttataacatggaaagcagagtcagccttctacctggtgtacctgctattattaattactttgtccaattctaggaatttcgcaatgagtcctctgacgtgaatgctatttttgacacacacacacacacacacacacacagagagagagagagagagaaagagagagagagaaagagagagagagaatattttaaagggatggtataacataagaacccaatggagagcataatgtaacatgaggttataagagcagactctggagcgaatttctgagttcaaatcgtgtctcaaccatttactagctttttgaccttaggaaagttacttaacttctcttgtcctcagttttcttatctgtaaaatgggttaattaatagtacctaacgtataggagtgcttcaagagaaaactaatatttataaagcacttagaattctacctgctacatattaaataccatattatttgtgtaatttaaaatatataacatatatttattaattgagttatgttttcttactattgatttgtttctaatatgttttagatattaaccccttctcagatgtttagtttgcaaatcttttcttccattctattgtttgtctcttcattctgttgactctttcttttgccatgcagaagcttattagtttgatgtaatttcatttgtctgttttttttttttttggtgaagacctgtaggtcacaaatggccgaaaagtatataaaaaatgctcaacatcactaattatctgatactttaaagttaaaaccaaagtaaaatattccctcacacctgttagaatggctattataaaaagatgatatttaataagtattggtaaagatgtggagaaaatggacgaattgtacactgtttgtgggaatgtaaattaatacagctattatgaaaaacagtatggaaatgcctcagaaagtgaaaactggaacttccaagtgatctggtaatcctactactgggtatccaaagaaaatgaaatcagtatgtcaaataagatatctgctcccctacgttcattgcagcattattcacaatagacaagatatggaatcaatctaagtggccatcaatgtatacatgaataaagaaaatatggtgtatatacatgataaaatactatttagcctgaaaagttgtgaatcctatcatgtgtgacggcatgacataacatggaatacattatgttaactgaaataagtcaggcactgacaaacaaatacaacatgatcccacttaaatgtgaaatctaaaaaagttgaactcttagaaacaaaatataatggtggttaccagaagcttacgtggatggggttcaaggagatattggtcagaggacatgatattttagttagactggagaaataagttcaagagatatgctatacaatatcatgattacagttaataaccatgtattatatgcttgaaaattgccttgggtgtacattttcagtgttctccccacacacacaaaaaatatgtgaagtaatgcatatgttaattagcataatttagccattccacaatgtatacatatttcaaaacattatgttgtacaccataggcaatttttacctgtcattaatgataactcacacacacacacacacacacgtgctcacacacatgcatttctatgagaagtcccatcacttgctggaagattttgcagatccctgatgaatatgtgacagaatatctacctgttttattctctattttcttctcttacctcctataaataaacctttttgctatgactcaaaaactttattacaatgcataaatgtgtatataatgtccattagctgattaattcaatgaaacctaaatctagccatacacacattgaaagtcaaactcactgagaacaagtagaattgagtggatatcaccaagtttcagtaggaagccagtcttacctaaactgtctccctcagatattcctattgagaagtttctgaggaaggctacagtaatgaaagtattcacaaagtcctaaaatgttgccagtaatcagtcagcatagtgaccactgatccagctcaaactcagttatcttcactagctaaatcctgttacatggcttaacaaggagcactgactttgaatctgggtcataaagggaattcacagtgaacttttacaaatgttgcagactcagcaggatccaaataaagaaagtcatagattatgtctctccctttgaattggaaaattggtacaattttccgtattgcctaagtatcctgatacttgctttcttttacgaatagaattgatttccaatgcaatttcatccacctttgtttcttttatcatacgttaaacatggataagagtctcttaagagtgtacacatttttagaatggaaagacaattcagtacttaataggtgaggctactgggtgtcttctcattgacctcagagtgtctcattagttcccattagtctccagcctcattaaagtaatggatataatgcaaatagatttcacggaacagctctgcaaaagttcaattgtcccattttactattggtgtatttacatattaagttacacattaacctgtatagtagtgtgtgttttccacactgtataccttggagtattagttctgtgtaatatgaagaagtgttatgaggaaaaaatgcagtcacatttgtttgaaaaactgagttcaatcaagagatacaggtttttttttttctattgttattgttgtttttactgttggacttctcaaaaccatgttaatatgcatggtcagtcttcaatgaagagatgcagtaagccgtattcccaatgttttgaccactttttttttttttttaacttagacgatttctcagaactggtgttctcttgtacacagtttgggaatgactgcttggtacacttgttgttatttctgaaaattgatattaaaataataatttatgtactaccacttgaattcttttatcagttaatccttcttccttcttgcagatagtggagggctaagaaaagcaggaagtcatgaatgattgagaaacaaataaatgccacttatctcattcctcccctgggaaaaaagaacagctttgaaatttactgtatctgtcaccaatggagaaattgatagtattgagtatatttaaaagaaaagctattagcaagatcagttaggactgcctgagtgaatttccaactgttttccccatactaatgctaagccattgctagaattccttctatgtggcagtgaaaacgtaaaatgatgtcttcccattacaaatcaaatgaggacaagtgagtagttattgtaggaagccagcttcgggattaatatgagggaaagtttgcaaacatagaagaacggacattgttaaaagatgtaacagagtagattaaatgctatgactgtatgatccaaaaccaggcaaccatatccatggctataaaatattccaattggaagggaacttaggataatagtggatggatttcagcttttataccaagtccaatcaattgtagaagctttctgagtgctatgttgagggaaatccatatctcagtgggaatgaatagcatgatcaattagcaaaagatcctatttttaggaattggagatttggcagcatagggatcacctacttgccattcttgatttagttcaattgtgcattttgcaagtcggctgttgtgatgcacagaagctgtgtaacttactcaaagttatagcactagctaaggttagagccaaaatttgagccaggtgtttgcatcccgagtctttttcaaaaataggctttgctcccaggcgcggcagctcacgcctgtaatcccagcacttcgggaggccgcggtgggcagatcacaaggtcaagagatcgagaccatcctggccaacatggtgaaaccccgtctctactaacaatacaaaacttacctgggcgtggtggcacttgcctgtagtcccagctacttgggaggctgaggcaggagaatcgcttgaacctgggaggtggaggttgcagtgagccaagatggtgccactgcactccggcctggtgacatagggagcctccgtctcaaaaaaaaaaaaaaaaaaaaaaggctttgctcaatatttttctcaaaacagctatcattgccctctttgccatttaaaattttaaagaagacattcaatgatacaacactaacattcactcatcacattagggctgttgagaatgtcttcttggaaccaaagcagtcagtcacacaacacatatggagctgtaggctgaataaaactgcaagagtcattctgacttgcagagcaagccagggtggaaattggacatgttattatatttgataaagaaggcaatgttgaaagacagagaaatgtccttgtgtagcaaaaaaaaatttgaaatatcatatttttgcttttgccttagtgctgtctttaaaattttagactcttgactaaacaattaaaaatgaacttgataccccttatagcagctgtgcatacacaacaggagctactcagaaatatgccttagaaagctttctttgaagtgtttctttaccactttctttttctttgggttcaaattaaatagaatatcagccgtccacttatcttaatgacaattattgtgaattagacactgagtagaatacagtgacaaagaattgtaggcttttgccaaatggagtggaaaacagtaggaaaatatgatattctggccgggcgtggtggctcacacctgtaatcccagcactttgggaggccaacgtgggcggatcacgaggtcaggagatagagaccatcctggctaacagggtgaaaccccgtctccactaaaaaatacaaaaaattagccaggcacggtggcgggggcctgtagtcctagctaatcgggaggctgaggcaggagaatgtcgtgaacccgggaggcggagcttgcagtgagccaagatcacgccactgcactccagcctgggtgacagagcgagactctgtctcaaaaaaaaaaaaaaaaaaagaaaagaaaagaaaagaaaacatgatgttccaagagcgaggagacatcttatatatacaaatatagtgctcagtaaacattaatacaatgtgagttttctaattaataattatgccttttccagattgtccaagtcactagaagcctgaattttcacaatgactgctattgtcttttgtcatggaatcgaaaccttagttttaatctcattaactccctggcccagtcttctactaataggataaaataaagcatggttaaaagaaaaaaagcggacagaaatatctcacatatagaatacataaggccttatccataacattagagaaatttagagctacaatggactatttaaagactaatttaaacttttccaaataagtaaattgacaccgcagaagttatagggacttgtgctaagcgcttggttcagtgtgctgaagataaagctgaaacttagtgttctttccatttacccaataggatgacctaaaatgataaaatcataaaatggtgtaaacaaattccatcctcatagggcatctgcactggcaataatttggaagatcaaaatcacattttcttcttcattattctacaaggaatgtgaactgacaaaatgtgaaaactttttagaatataggctttctattacaattgctgaaatagttgaacattcaggttgttaatttttgaagacacagctatttccaaactgtttttatttttgttatgttttatcacttagttttttacacatcatgaagattaaggtctttgtaatttaaaaattatgcaacagctgctgaaaactgcctcttacactggaacatgaaatttatattaggaaaatacctattacttgctataaaatatgtatgaggctctgtagccaactttgtaaaatggaatttctcctcaaagcaaaatggaatggttactttgcttgggggatccactgttaaaggagtatggtattgatatgtgttaagtattgttctatgacatgaataaagaatacaaccatacattgtgatactcagtattgtggaattatttctacaccattttattatttagatacttatacactgacttttgcagctgggcttgtttttacggcataattgtttagatacagacgacaaaatgtatatttataattaatttggttctgtgtgcttctacaaataccacacccacaactactgtcaacaagaaaaaaattagaatatttagggtatttgatttttatgacacatgacaaaaagttggctgttgtcggtgatttaccttaaaaagttgtttcttagagcatttcacaaagatagaaaaaaaattgttttaattacactttgtcccagttcttaactgtataagatgcagagggtttttattactatatttgaaaccaagactcaggatggttaaagaacctgaccagcttctttccatttcttcacaaaacaagcaaatcaatctttctaaaatatgtatcttaaaatgtcatcgatacactgtaaaattttcatttcttattgccagctgaatggaggtcaagtaattaagctcactttcatatttaaagtcttcttcctcagagagacctcaaaaactttgcagctctttctaactctgtttctgtagatcgacctcacactccacacccccagctagacatttatttttgtcttatcttttcttctttgtttgcccaggaaagaataaccttgttcatcatcatcttttacagttattctcatcatttcaagggcatctcaaatgttttgattcttcaacagtctggttcattctcatcatatgtgactagatatgtttttggagtgtggtagtggtgggtagcatgctcctgataatctctcttcattcctgaattccagtacaaggtactggtcaacatatcagaggtggagtcccactgcctgggtctaaatcccaaatctgcgtttgattagctgtgtgatttagggtaagttattttacctctttgtgcctcagtttcctgaagttgataaaggggatactaacagtagctattttacatattttaaagatatgtaattgtagtgcgctgcccacagtcgatgatcagttaatgttagttattatggtggaagaataaaattaatacttattatataatcataatgatctagcatgcttcacctcctggctgcttttaagaaataagatacccttatatgtgtgtcgctaagcagaatttatacattcttttcattcctatagattgaaactactattttaaatttaaatttagtactttaaataagtaccatcacatgccttaagtcacaatacttaaaatcatagccaaattattgatctcatatacaaaagtgagaaagactttctcacttctgtctacatttaatctgcatcattttcctttcattatatgcttagaagactatgtcagtaatgcctcctgtttggagaatttccagcaatatattaaggagttcatgcaaaaatttacagaaatatttaccatttagtgatatactttcagttttaaaataaaacattgtgttgatggaaaggcttgacgacttcttagaaaacaggatgtgctatttatcaaattccatttaagtttagctatttggtaatggattatggattctgaatgatgcaaggagttatattcttcactggtagaaagtcattgggtcaatatatttaccgtaaagcaggtaatagatgtcctttattatctataactatgccagtttgtctctcgttctcatcaagtgtaagcagtatcattgggcaggattctgatatgactttatgatttaggaaatcagtaataacacaattaaaattacatcacacacaacacgaaaaaattatgcatcactttgtttataatgtttctaaaaaacttccgagtttgggttaattgaaaaaggtatttaataaaggggtgtcaaatttgcaaaatgttctcaccacttaattggtggaaggttcatataactactgattattaggtaaaatgtatagtaaatctaaaaacataaacacagcattatgcatttaattcaacttttattgttgtcagaatatgtgccagaaatattccaatccattaacaaggttccaaaatatctccagctggctgaatagtggggtcattcaaacccctaaaaagttactacatactcctgtctgttttggccttcttattatgttttttccttttattatactttgtgcagagcttaatttctgctctattggacttaaattgttgcactaactttaaatatgtgctaattttatcagaaactagatgtaaggtgattttagcagagaaacgtagcttgttaataaaattcgtaccaattctggagtacaagtttgatcctcttaaaataacaagcagtttgtgtggaatattgaagtatattttatcatcagcgaagttaataactctgcttagtttgatattttctgtgtatatatacatttttatagctttaccaaaacagagcttacactagaccgtggtttctttttcctccttccaattactatgtgttcttaaatgtgacaaaaatacctttgctttttgagttcagtaattaagaggtttaactacttcaagctgacctccctgcaacgagtgcaaattagtgagattaaaatgagattgcttctctgtgttctctcggtttacatgcaagttttaccacacctcattagttagatagttcattgcagcgaagtgctatcttgtacgttttcagagaaaacctggcttgatcaattagtcttggtaggtctttctgatctcttaaaaataattttgaaataaaactggcatgtgtgaaaattatccattgatattttattaaatttctactacatgtacgtactttaactcagtcattaactctttctttttaaatattatttaagaataaagaagaaacttgtttaaaatatggtgtcacagtcagagtacactgatttatgctacaatttccaagatctcagtggtttgaaactcttaaaatttttctttttctttctcaagcttcatgtacaacaaagggtggcaaggtagtctgttctcatggtagttactcaaggactcaagagaaaactctttatcttacataattgctacagttggaaaaaaagattcatggttaatcaatactggctttgataattccacctaaaaattgatacatgtaacttctgctcccattacagtggccaaagccatgcctaatttcaaaggggctagtcaaacatacttctactatgtgtttgaaaaacaaacaaacaaaaacctacgatttttctcattgatcaccaaataaacaatacgcctttctggccatcatatatttgatatactctctttttctcctaaataaatgtacacactcacacacacacgcgcgtgcgcacacacatacacactgacacaggcacacaccactgccaccgccaccaccaccaccaccaccatcaccctgaataacaacacttcctggtcaataaaggaaataactcaccaataatacccagccacaatattaagattaatgtcttatttatctcagagttttagctatgattatagcataaaagttagaaatcattccagaaaagggtgcagtaagaatatttccaaaggtttgggtgcattgtataattaatgcaaccctgtacaaactatgtttacagtaaattaaatctagaaataatatgaagaactatgtacaatggccaactaagatttattccagttaagcaaaactggaaaaatcaatcaatataatcttgaaaaatatgatcacttgaaaaatcaaccagtataatctctcatatctataggttgaagaataacttatacagaataaatcatttgacaaaatataattcatttataataaacactttcagtaaagtaggaataaatggaaatttcttctacttaataaagtgcagctacaaaaaaacctaaaactaacgttatagttaatcatgaaagagtaaatgctttcagctcaagattgggaacaaggaaaggattgctcactctccacattcttattgaatatagtaatagaaagtctacccactgtaataagaaaataaagaaaatgtgtacagattgcaaaggaagagataaacctttcgcgatttatagatgacatgactgtccaagtagatcctgaggaaactatataaaataaactcctaaaactattgtgtaaattcagcaaggttgcaagacacaaggttaacacataaaagttaattacatttctgcatgctaacaataagcatgtggagactgaaatgaaaaacacattaccatttataactgatacaaaaatgaaatgcttaaatatgagtctaacagaatacctaaaaaatttataaactaaaaattacaaaattataatgaagaaattaaagacacaacaaataaatggagagatataccatgttgatggattggatgactcaacatgcaaagatccccatcttgccaagttgattgaactatttggacacttgtctattttcttcctttttttctttttttgagacaggatcttgctctgtcacccaggctggagttcagtggcacagtcatagctcactgcagcctccatctcctgggatcatgcaattctctcgcctcagcctcccgagtagctagaataacaggagcatgccacgatgcccggctaagtactttatttttattttcttgtaaagatggagtcttactttgttgtccaggttggtctcaaaatcctgggctcaagtgatcctcctacctcggcctccaaagtgctggcattacaggtatgggccaccacgcccagcccatttgtctattttcagtaaagcctgtatgtatcagtgagatttggtataatttctattaaaatcctagcacggtttttttttggaagcaaagacaaacttacaatgaaatgtatgtggaagttacagggcataaaatatttaagccaatctccaaaaatttaagtggcatgaattactttatctgataataaacctggtatatagctataaaacatcaggtaatgtggtagtggccaaggcataatatagattaacatagatcaattaactgttaataattaattaataatatatattaattaataattaataatatagattatataatttgattaatataaattaatatatattaatagaacccataattagacccacttaatgatgtctttttttgacaaagatgccaaagcaattcaatggctaaaagatagccttcccaacacatagtgatagagaaattggatataggcaataaaaattgaaccttaacctcacctcatactttgtgcaaaaattaactcagttggattacagactcaaatataaaaggttaaattataaaacttaaaaaaaacacataagaaaaattttcagttctagacgtaggtaaaacgatcttagactgacatcaaaacatagcccatagaggaataattcataaattggaccacataaaaattaaaaacttgtgctctgtgaaagcacaggttttcatcctgttaaaaggatgaaaaaataagccaattagaaaaaggcaaaagatataaagaggcatttcacagaagataatgtacaggtaaatcatagatacaaacaattttcaacaccagtagtcattggatagaaacagactaaaaacacagtgaggtatcaatacacaccttctaaactgagtaatctttttaaaagtaacaaagccagatgaagatgaggatggagaaaagttggatcatctctacattgctttttggagtgtaaaatattacagcaactatgggaaaataattcagtagtttttaaatgaaatttatatgcaattataatgcagtctagcaaatacacgcttaggcatttatgctagagaaaggaaaatgtatattgacacaaaagtctatacacaaatgttaatatcagctatagtaataatagactcaaactggaaataatccagatgaccttcaattggtaaatgactaaacaaaccattgtttatccatactatggaagagtacttagtaataagaataagcacagatacaaggaacaacttgtgtgaatcaccaaggaattacgctgagtgagaaaaaacagggcaacccccaaagcttatgtaccatataaagctatttaaattatactttaagaaagataaaattttagatctggagaagagattagtaattgccaggtattaggagagaagaaatagccagagagagggtggtggagacggttacatagggcagtataaggtgtccttgtggtgatggaactgctctgtgttctgactgtgatagtagatacaagaacctacatacatgacaaaatttatgtaaaatatatacatacagacaaatacatatacacacaaagtagaaataaaactgaagagatataaataaaattgatggagtgcgtgaatgtcaaaatcctgtttgcaatattgtactatgaagtaacattagggggaaccgagtaacaggtatatgggatctctttgtaatatttcttatggttgcatgtgactctacaattatctcaaaataaaaacgctaattaaaattaattttattcatagatgatattatatatagaaaaccactagagactttatcaaaatacagttagaactaattatcaaattcagcaaaattgcaggatacaaaatgaacatgcaaaaatcagtagcattttgttgttgttgttgttgtttgttttgagatggagtctcactctgtcaccaggctggagtgcagtggcgctatcttggcttactgcaaccttcgccttccaggttcaagcaattttccaggttcaagtgaatcttctgcctcagcctcccgagtagctgggattagaggtgtgcaccaccacacccagctaatttttgtatttttagtagaaacaagatttcacgatgttggccaggagggtcttgatctttgacctcatgatccacctgcctcagcctctgaaagtgctgggattacaggcatgagacactgcacccagtctcagtagcatttttatacactatttatgaactgtctgaaaaaaaaaatcaagaaaatagtcttatttacaatagcattaaaaatgtatatttaggaatagatttaaccaaagaggtgaaagaacgttacactgaaaactatgaaacattgctgaaagacaataaaaaagacaaatttaatggaaatacatccgtattcagggataggaagattaatattgttactatgttcatactacccaatgtgacctacagattcaatgcaatctgtatcaaaattccaataactttttatagacattgaaaagatgacctaaaattcatatagaaccataaaagatctgggataaccaaagcaatctggagcaaagggagcaaagctggaagtattacactacctgatctcaaaatgtactacaaagccatagtaatcaaaacagcatggtactgacacaaaaagagaaagagagactggtgaaacaaaaaggagagactagaaataaatttgcacatttatagccaactgatctttgacaaagtcaacaggatcacacaccagggaaaggagtctcttcaatgagtggctttggaaacctgggtatccacatgcagaataataaaattggaatctatctcaccccatctacaaaaatcaaccaaaatgaatgaaagaattacattcaggaccttaaactacaaaactgcaagaagacaacagagaaaaaagcttcttgccattggtgctatggtttgtagatgatttgttcctccgcagcaaaactcatgttgaaatttgatccctaatgtggaagtgttgggagggaccctagcggaaggtgtttgggtcatatgggtggatccatccctatggatggcttggtgccgttctctcaatcctgagtgaggtcttacaagactggattggttttcaggaaatagatcagttcctatgagagttggttgttataaagcccggatgcccctagggtttttgcctcttcatatgtgtccacttcccctttgaatttctcccccgcgacatggcacagtacaaaaggtctcaccagaagctgaacagatgctggtatcatgcttcttgtatttccaagcctgctgtattgtaagctaaataaacatattttctttataaatttcccaatctcaggtattctgttatagtaacactaaatgaactaaggcaattagttcaggtaatcattttttggatatgattcaagaagcacaggcaacaaaagcaaaaagggacaaatgtgattatctcaaactaagaagatgatgcacagataaggaaacaatcaacagactgaagagacaagttacggaatgggagaaaacattttataaccatgtatctaataaggacttaatatccaaaatgtggcaggaatacaaacaactcaatagcaaggaaacaacccaattaaaacatgggcaaaggatgtaaaaagacatttctcaaaaaaaaagtactaatggtcaacagttatattaaacaatgctcaacataactattcatcagataaatgcaaataaaactcacaattagatatcacctcccacttgttgagatggctgttatcatgaagacaacagataagtaagtgttcgtgtggatgtagagacagggaacccttgtgtgctattgctgggaatgtaaattagttcaaccattatggaaaagagtatggaggttcctcagaaaactagaaatagaactaccatatgatccagcaatctcatttctgggaacatatccagaggaaatgaaatcagtatgttgaatagatagctgcaccacaatattcattacagcattattcacaaaacctaagatatagaatcaaactaagtattcatcaatgaaagaatggataaggaaaatgcggtatacacagtagaatacagttcagccttaagaaagaagaaaatcctggtgatttgtgacaacatggataaactgtgaaataagccaggcacagacaaacaaatacctcatcatctcatttgtaactagaatctaaaacagccaaactcagagaaatagagaacaaaatgctggtcaccaggggtttggggacagtaggggttgaggagatgttggtcaaaagcatacgaaattttactgagacaggaagagcaggttgaggagatctactgtgcaacatggtgactacagttaataaccacataatgtatacttgaacattagtaagatagtcgattttaagtgttcttatcacaagaaaaaagtatgtgagtttgagggaacaaatacgttaattagcttgacttagccaatccacagtgtatccatatagcaaaacattatgtcgcataccataagtatgtataccctttgtcaattaaaaaataaaatatttaaaaattaatttggcaatatatcacagaggttttttttttaataacaaacataacttgaatttccactttgggaaattgacttaaaaacaaattactgaatattgcctagttgtagggaagtcttattacacataaacacacaaaatgctgatgtagatctgtatcagtagacatttggaagtaacttccaagtaaactaattgataaatagcaagtctcaaacatatgcatagttagacctcatttatataaaacaaaaacaagttctgtggatctagtctgtgtctgtgagtgtgtagctagatggaaacactccaaattattattggttctttccagtaagtacaatatggggtactgtaaagaaacaggaagtttattttatattcaatgtaattatcattgagattcttataatatacatgtgtaactttggtaattaaaatattttccttaaaagaaggatatgtgtgctcataaggaataatgtttattatgtaactgaataagacagtacgtgtttgttcattaagtgtggtgtactatatattaactccttcaatatttagggaataccttttattcattcttgaacacttagtgcttagtacagatgaagggatcaataaatatacagattatgcttatatgaagaaaaggagactaagaaaattcaggagaatataaatttttttaaattatgtttatgggtgattttcttatttgttttaattttgactgcgcaagatgttaaaacttctatgatgaaaaaaacagtagtcaaactagctcgtggtgatcccagttaccaaagtatgcaagaaatatccagtcactttatcattagttttattttaaataaatcatcatacatatcctcatgtatatatcacacagtgaggattatcgtattcaaaggacacactggaaatctagtaatattaaacttggctttgcctggagtatagattggacagcagacaaaaatctacatgttaaatcatagtcctctaaatgacgtttctgttgttcgacatgtcatggcacttcgctttaacagtctctcatttaacttgcttcttcaacatatgtgctcatcttaatcattcactcatccttgaagtagccaaatttaaatgtcatgtgtttttattcacagagcatggaatcaatctcattatacccttgaatgcacagctttcactaggagaccctccttctaagccaaaaaatcaatttatgtttaactggaggaatgatatctttttctgattgttggcaaaatgagagagggagggagagggggaactactccatttattatatgttaaaatgtcacttcatggttacctcccatgtgcatggtagatctggcagctaattaacattgtcaaaccacgttaatctcacctacaaattcatttattattttggataatgtaactgaagttgtacaagagaagattcaggatcacattaaatgcattgaactattaatgtattagaacgtagtatgatcaagcagtagctcagtactcattacgatcctcagtaaattcttcatcatacaattgggaagagttgctttgtaattattaactcagaagacaatacttctataagatcatggactagtgtgataggaattattcagggaacattttgaacatgaagcttctcttcgtagcttcatagtaagtttatattcagtttgctgttctccattgttagtatgctaaggttcacaaaagaattatctctgagatgtctcttgcatgattgtactgtaggtcagagagaatttgagaaagtccagtgtttcagataacaatttaagatacaaacgtgttagtacagatctttatggcttaacaaatcacttttacatggttttagctgatcctagcaaaagtctcataagtaagcagatattactaactctaaaaggttaaataacttgatcaagagtacactgtgggtaaaggacaaagttgagatgataattctgcttattgatggaatgaatacatgcataataaatgaatggatggcaaaatagacaactccaggtattcttacagatagtacatcattgcagctactcacttataaggcatataccatatgcattaatattgcatgttcacccaaaactttcagttaatctttatgcattttggaggtaatgtcttaaaaaagtgatgtgaacaagccccaataaaattattgttttttgctaatgaataataggatgcatcagtttagacagaaaatagattctagtaatttacacagcttaaaactttcagatttgtctctagctgataaaaatcagcggcatctggtagtacaggaagggggcagtagaaattctatgctgtcagggctacaccatcagtgtgagtagtgattttaccagatgatatgaaacaatattcttgttatcattgtggagcctccaatacataaaaatacaaagaaaaggggaataacgattcttaaaatattttttaatcaagcagcacaaatttgaaatttgccatattcattcacttcctgaattgaatatcatccatatgaattatgtatcacattgatgtcatttttatgaactgctacattggtgactaattgaggtatattttagttttaaagaatatgttgctgtgcttaattatcctgataaacacattttataacttctagcacatatgctatttcattaaattaatggttttcagaatcattgatttaattgacagtttgcaattcatgaagaaattggatgaataagtgaatgtacattttatattttacaaattgcagaatacaagttcatgagtctttttcacttatgactttcattagttaatggtatttccatcagttttattggacacatgtcatgacagtaggaaacaataggattgtctgcatcaagaaagaacaagtagtaagtcatgaatcttttttttctctgttgtaagcaaagcttaagcacagatattgctaatcaaggtttggtcttgttcaagttccaagctatcatcaactcatcgtaactattgcaaaagtctcctagttggaatatctgcatccactttgcctagtctcaaattccatcttcagtctgtagccagaagaatatctttctaaaatcaattaaattggcatctattttattccttaaaactgctcaatggctccaaatttctcttaggatagtcacattagttagaaaaaagtagcttccataacaaaaaaaactacattttattggcataacacaaaagattctctttcattcacccaacggtacaaaatatatttctggtatgtgagatgcagcctaattatgacacaagaaccaatgttctgtcgcttaatgacacagagttctctgcattctgataaaagaagttaaaaagaatgaaggagtcacataaaatcttaaacatgttattccagatgtgcacatcatttattttactttcaatttttatggatacataatagttgcacatacacgtggaataaatgtaatattttgatataagcatacaatgtgtaatgatcaaatcagggtgattggtggatccaacacttcggacatttatcatttctttgtgctgtgaacattccaaatccactcttctggttattttggaatatacaatagattattgttaactatatcccctctattttgctactgaacacaagatcttattcgtactatccaactgtgtttttgtacccactagcccactcctctttaaacatgtcccactattctcagtttcgggtaacattctactccccacctccatgagatcaattattttagctctcacatatgagaacatgtgatatttgtctctgagcctggattatttctcttaacagaatgtccttcagttctatccatgttgttgcaaattacagcgtttcattcaggtggctgaataatattgcgttgtgcatatgtaccacattttctttatccattcatctgttgatagacactaaggatgatttcattatcttggctattgtgaatattgctgtaataaacatgggaatgcaaataacttttcaatatgctgatttcccttcttgtggatatatacccagcagtgggatttctggatcatatgatagttctgcttgtagttttgaggaacctccatactcttttctatagtggtttaatactctggattggccagaatcagcctgatagccatatatatctgcatttatgtctggagatattttccttcaaatggtagtcacttctcaggaaaattttccactgtaaatggtggcacacggtttttagtaaacagttaattgtctctgctgcaaacctacctcttaagatgtcaggtaagacctgcatttctggccatatcaagcacactgctcttcttcagctgatacaagtgttccttctatctcttgagtgccatatgtttccttctaaaatatagtttttcacatacttttatgttttgcctactattctattcttccttctggtctcagtaaattgtgatttccttataaaattcttacccagcttatgtgagtcagttttctgtgttacgtattctcatagtcacatcctacatgcacctgtattctgcagcacttgtttctgttgcaatttttacatttgtttattacatgaagccttcaatacagtattagctttatgatggtggatgtttgcttttgctcatcattttatttttagcctattatgaagtgcttagccacagtaggcactcagaagtactgcataaataaatgaatcaattgcctgatcttgcactcttcaaagccttttacattgctataattgtcttccaaatgcaaatgttcatcaaaggtgttttttctccattttgaaaaaaaatgaatgctttagtttgggctccctcagaagcaaactctaattttaatattcaagtgtaagtattttatttttgttcctaggcatgggaaacgagagaaatgggaaagtggtacaggaaggaataggcagccaacaatgtgataataaaccacatttgctgactgaataattccatagtgaagactgggaaacaatgtaaaacactacatcagaaatattccacttgatggaaaatggacttggagtaaaaatactccttgacatcatcattaagttacaactcatgtggaggactgctaattttccttagagatttagcaagcgaagtgaccttctggggaaatattctggaccaggagatgcagattttggtagctggaagactgttgttcatccaaaaagaatatgtataagggatgtgggtattcacagcatccaacacagttcacccgaggcttagtgccactgtcatcacacactgcaagcctttctctctctcacgtttgactcttcctcttttggctggtcttcactttgtgctctttcccagtcttcctgaaaggacactgacagatgagtattcttaaagcacatcatctctcctgttatgtgccttctccacagtcctcagtgagtattcttttactctaagattcagcctaatccttagcttacattcaataatgtgtaaaagttagtctattcatgctttttttcactcttgacattcactgtcaaattctctcctttggtatttacttgtgcttttctacataacttcctacaccccttctacctgggataatcttgtcttgttgaattcccatttattcatcaatgcagagtttaaatctaggcttttaaaattttactttaattgaaaaataataattgtacatattcatagggtacataatgatatttctgtatatatacaatatatagtgatctgattggaataattaccatatccatcatctcaaaagtttatcatttctttgtgtgggaacattcaatattctccctctagctatttaaagctatataatatattaatgttaactattgtcatcctacagtggtatagaacactagaacttattcctcctatctagctgcaattttgtatcctctaacacatttaaatctaagcttctttattggaatattgaatctcacagctgctcaaatgacttaccttaacaggtgaagtatttgccactcctgtatgttgttatgtgtgagtttggcaaaaatgtagtagagtaacccagatgagactgaatgagtagtgtcatgtatatagacctgcaaatgcctccttattctgtaatttgatgaactcatttctaatcggtcccaccactattgataattttgtaaaatgcctatgacatgcatggttttaactatgctttaggacctaatcaaaggtattttttattctataacaattgtcatacgtcaatgtctcatattccctactagattataaattctaagagggaagagatgtgctgtaattcaatctgtatatcagagtgtctgtattttccttgtgataagcactgaaattatctagaatgagtcaatagatttttcagcaaccttcaggaagtttcatgttcctttctttatcctaaccatcacctatcatgtactgattatgtcatgaccctagccccactgaccctaagcttaggcactgcggtgattcacaggcctactcttaaagtgaatagcttctttagaaaataaagtataaaaacctctttgattatcttatttctagaaatcatgttaggaggtttgatgttgatgaataaataatgtatgcttactttggactgattatgcaggtgaaccaaaaaggttatatttatgtgcgaggaattttgagggagttttgcagtcctcaagccatgctcattatctgataattgtccctgtttcaactgtgaatatcctgtggacatgtttgtattatgtgtttctatccattccagtgttcacttattgaataggggatatatatttgcaaaacagacaaaaatcatgtaatatttctgctgtcaatatactatgctgcatgcaaaaatgagtttcagttatactgagagacatacaatagaaaaaccgaatatatttttattgagtggaaactcacttcttaacacttcctcttttgatctttgaaatattctttattttttagttcatatacaaatttaaatttttcttctcatccttttgagtatgcactcacccacataccacctctccataattttatcctgcttcttagttcattagttaagattaactgtctcagtggtaaattacatataccactttaacaatgagaaaatatatcccaaaattttcttgtatagagtccacttatttctaattttattcacaaagcacgtgctttattcgtgagttctattaccaccattactaacatcctacacacaaggaaaaaaaaaggcgaaccaaagagcaaaaatattacttaatatgaacacgggctccttccagatctggttcaatagcagttcttctaggtaaggcatagcttagaatcttaaaagtcaaagtttggcccttggattatcagtattgacaccaattagaagcttgttaaaagcataacctctgacactatctcagacctattaaatgacagcctgcatttgaatacaatctttaagtgccgttttttgctgttgttcttgcaaattttgaacctgtgggacccagaaatcacaatagcaaagatggctagatatctaccaaaaagtgtcctctttttgtttaataatagaacttcctaattttagctggttaccaggttacccatcaaaaaatgcacaacctagttttgcttgcactttggcatagccaagggactaaattctgaccagaggcatgtgagtgtactgaagtctaggatttccaggtcacacctagaaagtaaatgtatttgaactttctaggtccttttcccacttgatgctgtctcgtagatggtaaaaatttgagcagcaaaattggacccagaaaagggaggcagatgttaaagatggacaaactattttgaactgttctgtgagaaagaagaaaactttcatcttgtttaagcagctaaaactttttcatgtcttttttattgcaattacatggctaatatatttataagttaactgtgtctccatcactctattttaaccatgtctacagtaacacaaaataaggcacagtgaattatatgtataacctcccctcattgatgttttcaacagctggatcattgcactacaatccagtgattaattcaagtcaatggccatttttgtctcttttgcaacttccaaattcatacggtttagtagcttttgaattaaaaatatgtcactctttctaatgggtaaaataataaaaatagtaccagaaaaagccacaaaaatgtcctaaagtgtgcaacataattaaacaattatttatctttctgattttgaatgttaattttggtcttatatcctaaatcccacataattgcatttttttctgattatacagttttatacttggcaaaacaaatgctgtttaacttagggagttatctttctacagcaggatcccctagagtttcagaatatattccttgcacactgctctgtgtagagaagacgttcgtttacagagcctgtctcaacttcctaacattggtctgagcacagttttgttttgttttttaacaactttttttagaacagttttaaatttacagaaaaattaagaagataggatatagagagttcctaaataactttcactaaattgtcactattaacatcttgcattagtgtggtgtatttgttaccattaataaaacagtattaatgcactattagtaactaaataccatagattttttcacatatccctattttttttacttgtttttctatgttggaggatcccatctagtttcatttagttgtcatgtcccctacacgcttctaggttgtgacaatttctcatacttttcctcgtttttgatgacattggcaattttttttttttttaagtattggttaggtattttgttggatgtccttctattgcaatttgtctgatgtttctctcatgattaaactggggtgaagctttcttgggagggaagatcacagatataaagtgtaatgttcatcccatcatattatgggtatatactattaacatgatttgtaacttcatattgaccttgcttgcctggctgagatagtgtttgtcagttttctctgctgcggaatcgttcttttttttttttttgctgtttccacaccggactctttgaagtgtagccacacgtacagcccacactgaaaaagtagggagttattacctcttctttgagggtggaatatctgcataagttgaggagtttttatgcacattttctttatttttaatattcgtcttaatgtttatctcgtaagacaatgctgtttctgaatatttggcaaacacattttagagaagccaaattatccatatcttcaggcaattaatatgtttaaaattatactgagaactgatctaaatttctgtgtgatttaattatgaaacccagttttgtgtctagtttactggttttgaaaaagtgtttcaacaaaataacaactaaaatttattggttgctcattgtgtgatacgaactgttctaagaggtttgtatgtattatttgatactaaactcagtgtattacaaggaaatgtgtcttattactaatctacaattacagcttcaattattaaataactttccccagtttccacaattattgagtgatggatcagggaatttagtccagttttattcaagtgaggccgtgatgatagttataaaactggtattttatgttcaataattgtattaaatctaaggctaaaacaatgtattcagtaaaacttagaacacagatcttctgaaagttttggttctgaagtgttcatttcaatttcttatataattatagttgcatgatcaaatgaaatcatccccaaataactcaatgttcaaatgctagactacccatataacataggatcatctgagaatttcaactgtcaaaaaggaaatatgtctagatttggacttaggaagttgcagataggtgagtcatattctctccaaaaaaccatctttttggtttgttgaaaaacttagggagatttttcaagaatccataactaaaggtgatagagggtaggtaagtgttattttttccttttgttgatagaataagaacagaattttatgcccaattaaaagatttcatgatatgagttgttagaatatacaagtgtttcctattttcactgcattaattttactaggatacaattgcataacaaaattcacaagcagctgagaaatgttatactaatatcaggcaggcatagcagcctgggagcattttgcacgtgtgatactttagtcatcaaatttgtactctgaattaagtgtacttataactggtacttggacaagacactggtcatttgtacaagtttccaaacatagtgacactgattagaaatgcccttgttccagagacagccaatagaaagatgtgtaagattttgttttaatgcaaatagtaataatgcatttgataggcattgtacatagaaaatgacttagggattattttgccatcatttcatttcttataagaatggtgaccccttggctaaatttcatgttaacaatgtttctcatttactttggtcttataatttcagctgctctaaaataaatcttagataaattcattgcctactttgacatacatattttaaggcttcaaattctggaaagatctaaatgcctttaaatatcttgtttttagctacgctatgatcacactattttatcattttaaaaggatcagtgttatctaactgaggtcaccggcagaatgaaaagtcaaggtattagcatttatattttcaactgaattgacagagatctcaacaatgagtcattgaggggttattaagttcaggagctaataatatttctctaatatgattgctaaaaagtcaatgggatttgtaatttataacacaatcttgataaaatacaaaatagaatagctgttcccttaagacatcaacagttagtgtatgaagcatgtcacttttgtgttccaaattttcactcatattaatttgctcttattgaaattttgaaactgacttagcttcagtttggtttcacagatatatgtattaggcactttatcctttagggggactcaagcctctgaagatgatgatgccattgcagccaaattttacattcaaattctagcccaagactactgaacttataaagttgaggacactattataaaatattaatgattcaattctacttcaaaatttcatcttaagtaaaacaaataaaaaataaaaattatatatagctatcttaaaacaagcataattcgatatcccatggatatctaatcaatgaaataccatgtgaccatgaagagttttctattaatcacatggaaagtgttcataatgtattttacttggaaacagagtttatcacacctttagatctgaaattcaaaaagaaatgtttgaaaaatataaatagtcataaaggcagacaagtaaatacatggagcagagggggaaaagagatgagaaatttttcaacagaacaattttatgggaatagtcataaaggcagacaagtaaatagctggagcagaggggaaaagagatgagaaacacaaaggataacaatgttattatcctcaatttatttatttgtgctttttacagtttttcaaacacttaacataaattgtattgatatatatataaagaacaaaacgatgctataattattaaaacaattaggaattttaagtcatcttatgtttgttccttttatttttatttatttattattattattattatactttacgttttagggtacatgtgcacaacgtgcaggtttgttacatatgtatacatgtgccatgttggtgtgctgcacccattaactcgtcatttagcattaggtatatctcctaatgctatcccttttgtttttaaagaacctgaaatccaaagggcaatgacttaccacaaggagtaaagtgtcagtgtgggtgcagaaaccaaaagccagggcttcatctcatggtctagtgttgacttcactcgacctcaatgccttcctccttccttcccctgccagtttggttccttattagtagttcttttctaggtatcttaagcttggaaccttcgtaagaaaagggacttgaaatgttcttacacagaaggtaagaagaactttacaaattctctgagagtttgaggagaaagaaaaaatgttaaggggctggccttattaaaggtgggttaactttgagctgtatatttgcacagtaatatatactgtgaatcttagaattaggagttgtaagaatggaaacttaactaaaggtttattttgtgtgacactctaagattgtagtgtcacgtttaattccattttgttcctaagttaaagtgaaagggcatttttaagagctttgctgatttatgaatagtcaagcacatcacatattaataggatgtgtaatatggaagttgctattcactgttaaatatggtggagaaattagtgaaggaatgggtagaaattttgataaataatccattccccccccccacttgctggctttcttgaattgatagccaggaaaggtagaaaaaaaagaggtatgtaaagtcagactgaactggttgcaaactggacttcatgacttgctacatgtgatcttgatcagattacctaaattctctgagtttaacataagtttgcatttaaggggatgagggcgggagagagagagagagagagagagagagagagggagaaatataccactagtcttttgtctgtggtaagtgttgcaaatattttctcccagttcattggctgtcttttgattttttgtatagtgggtttttttcctgcaaaattttaaaaaatgatatagtcaaattcattgacatttttcttttattgcctctgaatttgagtcatagttagaagaccttttcttacaccaaggttaaagatgaatttttcaagtacttgtttgattttattttttacaccagaattccattccttttgcagattattcttgcatatgatataagatatggatctaaatttaccttttccaaatggctactttgttgtcccagcagcagttattaagtctatttttaagtggtttgaaatgctgctgttgtcatatactaaattctcatatgtatttagttttaaatttggaccttctattctattccactgctttatctgtctattcaatatgatgctagtataacatcattttaaatataaaggctttgtagtatcttttaatgtttagtaaggtagtcttcctcttatttctttttttacaaaagtattttccttgctattcttgtatgcatgtgattccatgtgaactttagtcaatttacctaacttcataatttgttggtatttttattaggtttgaatgaattataagtcaacttatggagaatttatgtccttatagtgttgagtcattttatccaaaatacagggtattttcctaatttttaaagtcttctttagagtcctttgtgagtgttaaaattttcctttcacaaactttgtacatttttattaaatttatttctaagtatttagtgttcttattgcttattcttattatagtgttcttattcttattcttattcttattatacatggacttactcttaagttctctaaatgttcgttgttaaagagtatataaaggctactaatttgttaatgttaattcagcattcagctaattcactagaatatttgatttcttgagatggttttatcattgaccctctggaattttcaaggtttattatcttaacaactgcaaatagaagtagttttacttcttctttaccaatttttatgcttttcaagaatttatctcatctaattgggttggctctcatcgaagaactgtagaataatatgggatcgtattaatcataacatgtattcttgcttcgtctcaaatcttaatgaaaatgcctctagcgtttcttcatcaaatagtataccggctttaagtttaaggcaaatatatttcattatgttaagaaaggatccctaaattctttttctttgagtttttttaaaacaataaattagtgttttttgttgttgttgtcaaaggctttcttagcatctgtgaagataatataattatgcctttaaattgtcaacatggtatatatgaaatgaattgggtttataatagtaaaccaatcttgcattcctaaaataaatcctatttagttatcgtgtgttattttcttaatacagtgttggattaagtttgctattttttattttaaaattttacattattttcttcagtgatattgacctgtagttttctttcattatactgttttatcagatttaggtatcagtgttatagtttcttcatgaaaggaattaagatgttttccttccctttcaatgttctgaataatcatacagcattatgactatctgccatttaaatctttagaataattaccttgtgaaactatgtgggcttggtgctattttgtgtagtatttatctaattgtttcctatatttcttctatgaaattggttgatttaatctttctaacactaataagattaatttgagtaaacttcatttctctagaaaataattaattcatcaaattaaatcaaatttgaaatttgatttcaaatttatttgtgtcaaagtaaaggaggtttcctgtcattttaaaattctctgttgttttaatagtaacttgtttcttattatttataactttatatatttgtactttttccttttttatcaaatgaactgagttttaacatcgcatttaattttaattatctaatctaaatctaaaagctgatatttgattcaattgtcagaaatctcttaagtatattgggatcaacttggaaaagtaaattgactttaaacagtacactttatgaactttaaattacagatcagatatttttagtaaaattttatccaaactaagatgcaatatgagtataatcactgattcaaaaagcttcctttagtgagcatgaaatatctcactattttaattttaatattgattgtgtgttaaaataataataattgcattatattattgataatgtgtattcttgtcatgtttccattcttactggaaatgcctccagtgtttctccatcaaatagtatactggctctaagactaatttaaaggacaagatggccaactagacacagccaggaagcactgttcctacccccaaaagaccaaagtttcaagtaaaccaacataacttggacagatcttcaaagagaaaatgcccagtggatgaagatgtgatgcagatgtggaggctgaggaggtaggaagctgggaaccttgttcagggtaggccaatgcttgagccaatcctgacctcaagtggctcctgggaatgggtgaatgaagaactgcaggactgcctaccctagccatggaccgctgggatcctggctatgggggccccacatctgccatggacatttgagctggcagaaggatccttccagagagtagacagagatggagctccagccagcatggaagcatgggcctttgtgcacagtgaggctgtgtccaaacatggacatagccacctattccccagggctccccactcaccgtctgagaagctctagctccagttgaccaccaggctaggaggaagctgggctgatttctctgtgggactggtacgtgtctgttctttaggccctcttgcccaccagcccctccaagggccactgtccagctgctctccaagagagtatgcatggctcagcttccactgcccagcctggttgctttgctccacctgattatgttcccggtggcctgggagcactttggattcccattacacctggaacctgaatctaggggtccagaggatggagctgcaagccaatcctggtgccccagagctgcagtgtgcagttcagaagcgcagagctgaaatttgtggccagcactcaagtgggagaagagcccaccctcttagaggactaagaggggtgacttgtgtcagttcatgagctggaatagaagcagaacatgtcttcttcctcagggccaaccaggaaagagtgttacctatctccctgctacgttctttgcccagggagcctcacgtcccagaacagctaaagaaagtaatgcaggcacagtgccagtgatcagaaggggctccaccaaggcccaagttcagacttggtgaggaattacctctctccccactgcactgcagagtgtggctggaaacatgaggaaatatagaggagctgggtggctaagtaagagactatttactgtccattattcttaagcactatccactggatcacagcccaaacaataacaccaaaaatgttttgctgatataccctgctgtaaaaccaaggacaaaaattcagccacaaataaagacctgtacagagcctagaccatctgaaaacattcagaaacaaagccaattggctatactcaacttatactgtagttaaaggaacagcaaccctcccagatgagaaagaatgtggacaagaactctggcaatttagaaaggcagagtgtccccttaccccaaaatgagtccactagctccatagcaatggtgcttaaccagtgtgaaatgacataagtagaattctaaatctggatggcaagaaagttcaagaatcaggacaaagttgaactaaatctaaggaatctagtaaaacaacccaatagctgaaagatgaaataacatttcaagaaacaaccaaactgaacttctagagctaaaaagttcactacaagaattccattatacaatcagaagtactaataggaaaacagaccaagctgaggaaagaaaatcggagcttgaagaccagttattcaaatcaactcagtcagaaaaaaataaagaaaaaagaagtttttaaatgaacaaattctccaagaattatggtattacataaagagatcaaatctacaactcactggcattcctgagaggggagagagaataaaaaacttggaaaatatatttgagaatatagtccatgaaaatttccctattctctctagggaggttgacatgcaaattcaataaatacagacaagcccagctagatactatagaagatgaccatatccaacgcatatagtcatcaaattcaccaaggtcaacgcactcacacaaaaaaaggcagctagagataagggacaagctacatacagagggaacctcattaggctagcagcaaacctctcagcagaaactttataagccagaagagaccagggccctattttcagcatccttgaagaaaaggaattccaaccaagaatttcatatcacaccaaactaagcttcataagagaaggagaaataaaattcatcacagacaagccaatgctgagaggattcatttcatttagaccagctttacaaaaataccttaaaggagtggtaaagataaacacagaccaggtacagtagctcacacctgtaatcctagcactttgggaggccaaggtaagtggatcacttgaggtcaggagttcgagaccagcctggccaacatagcaaaaccctgtctgtgctaaaaatacaaaaattagcccggtgtgctggaatgcacctgtaatcccagctacttgggaggctgaggcaggagaattgcttcaacccaggaggtggagattgcagtgagctgagatcttgccgctgcactccagccttggtgacagagcgagtgtctgtctcaaaaaaaataaaaaataaaaaggatgaaataaaacaatgacacctgctaccacaaaaacatacttaaacaaacagcccacaggcactataaagcagctaaacagtcaagtacatacgacaactagctaacaacacaatgacaggatcgaaatcttacaccaacactaaccctgaatgtaaatggtctaaatgccccacttaaaagcttggagtggcaagctggataaaaggacaataccctatcatgtgctatcttcaagagacccatctcacatgtaaggacaaccacagactcaaagtaaaaggatggagtgagatctaccatagaaatagaaaactaaaagagcaggagatgctattcatgcatcagataaaagactttaaaccaatgaaaattaaaaagtacaaagaagagcattacataatgataaagggtaagatccaacaagaatacttaactaccctaaatatacacacccaaactttggaacacatagattcataaaacaagtttttcttgggctagaaaacacttagacaaccaaacaataaaagtgggggacttcaacaccccactgagagtattagatcactgaggcagaaaactaacaaagaaactctggactacatttgacacttaactaattggacctaatagacatgtaaagaacatctcacccaacaacacagaatttgcattcttctcatctgcatatagaacatattctaaaatgcaccaaatgcctggtcataaagcaagtctcaataaattcagaaaaattgaaataatacaaaccacacagtgcaataaaaatagagatcaatatcaagactatctctcaaaactatacaaataacatggaaattaaacaacttgttcctgagtaactcctgggcaaacatttaaattgagaccgaaattttaagacattatttgaaattaatgaaaatagggacaaaacttaccaaaatctctgggatgctgctaggaaagtttatagcaccaaacaccatcaagaaattagaaatatctcaaattaacaacctaactttgctgctaaaggaactcgtggaaaaaagaactaatcccaaagctagcagaagaaaagaagtaactaaaattagagaagaaatgaatgaaattgagatgcaaaaatttatacaaaaatccataaaaccaataactgtttttttcttccaatagtttttggggaacaggtggtttgtggttacatggatgacttgtttcatggtgatttctgagatgttcgttcccccgtaacagtagctgtgtacactgtacccaaggtgtaatcttttatccctcacccctctcatcctttcccctgagcccccaaagtctgttatattattattatgcatttacatcctcatagcttagctaccacttataggtgagaacataacgatatttggttttccattcctgagttacttcaacttgaatgatggtctccaactccatccaggttcccgcaaatgccattattttgctctttttatggctgagtagtatttcatggtatatatacaacacattttctttatccactcatcgttgatgggcatttaggctggttccatattttttgcaattgccaattgtacttctataaacatgatgtgtgtgaaagtgttttttcatgtaatgccttcttttgttttgggtggatactcagtagagagattgctcgatcaaatggtagttctacttttagttctttaaggaatctctataccgttttccacagtggttgtactagtttatattcctaccagaagtgtaaaagtgttcccttttcaccacatctacgctaacatctattattttttgatttttaaattgtggccattcttataggaataaggtggtatctaattgtggttttgatttgcatttccctgataattagtgatgttgagcattttttcatatgtttgttggcatttgtatatgctcttttgagaattgtctcttcatgttcttttcccagtttttgatgagattatttgtgtttatcttgctgatttgtttgagttccttgtagattctggctattagttctttgtcagacacatagtttgtgaagattttctcccattctgtgggttttctgtttattctgctgattatttcttttgctgtgcagaagctttttattttaattaggtcccatctatttatttttgcttttgttgcatttgcttttgggttcattgtcaataaatctttctttaagccaatgtctagaagttttttcgatgctatcttctggaatttttatagtttcaggacttagatttaagtctttgatccatcttgagttgaattttgtataagatggaggatgatgatccagtttcattattctacatgtggcttgccaattatcccagcaccatttgctgaatagggtgtcctttttccacttcatttttttttgtttgctttgttgaagatcagttggctctaagtatttggcttcatctctgggttctctactccattccgttggtctatgtgcctatattttataccagtaccatgttgttttggtaactatatccttgtagtatagtttgaaattgggtaatgtgatgcctcaagatttgttctttttgtttagtcttgttttggctatgtgggctctttttgcttccatataaattttaggattttttttttctagttctggaagaatgatgtgaagaatgatgatggcattttgatgggaattgcaatcaatctatagagtgcttttggcagtatggtcattttcacaatattgattctacccatcagtgagcatgggatgtgtttccatttgtttgtgtcatctatgatttcttcagcagtattttatagttttccttgtagaaacaaggagttttcacctccttggttaggtatattcctaagtattttattttattttttgcagtggttgtaaaaggcattgagttcttgatttgatcctcagcttggtcattgttggtatatagcaatgctactgatttgcatacattaattttgtatcctgaaactttactgaattcatttatcagatctaggtgcttttaggatgtctttagggtttcctaggtatagcattatataatcatcagacagcaacagtttaatttcttctttactgatttggatgccctttatttctcttatctgattgctctggctaagacttccagtgctatgctgaatagaagtggtgaaagtgggcattcttgtcttgttccagttctcaaggagaatactttcaacttttttccattcagtataattttagctgtgggtttgtcatagacggttttgattactttaaggtatgtcccttctgtgccaattttgctgagggtttcaaacgtaaagcgatgctgaatttcctcaaatgctttttctgtgtctagtgggatcaccatgattttggtttttaattctgtttatgtggtgtatcacatttattgacttgcatatgttaaaccatctctgcattgctggtatgacgcccacttgatcatggcgtattatctttttgatatgctgttggatttggtgagctagtattttattgagaatttttgcatctatgttcatcaggaatattgatccgtagttttctttttttgttatatcctttcctggttttggcattagggtgatactggcttcatagaatgatttagggaggataccgtctttctgtatcatttggaatagttgtaagtttggtacaaattcttctttaaatgtctgatagaattcagcagtgaatccatttggtcctggacttttatgttggcaatttttgtactactctttcaatgtaactacctgttattggcctgttcagtttctatttttttctgatttaatctagaagggttgtgtatttccaggtatttattcaactcctctagagtttctagtttgtgtaaaggtgttcatagtagccttgaatgatcttttgtatttctgtggtattggttgtaatatgtaccatttcatttctaattgcgcttatttggatcttctctcttgttttcttcattaatattcctaatggtctatcaattttatcttctcaaataaccagctttttgtttcatttatcttttgtattttttgtttcaatttcgtttagttctactcttatctttgttatgtattttttcccctgctaggtttaggtttggtttgtttttgtttctctcattccttgaggtgagaccttagattgtctgtttgtgctctctcagacttcttgatgtaaacatttactgctatgaactttcctcctagcattgcttttgctgtactccagaggttttgacaaattgtgtcactattattattcaattcaaaaaactttttaattactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagctttatggggatggcattgaatctgtaaattaccttgggcagagtggccattttcatgatattgattcttcctacccatgagtatggaatgttcttccatttgtttgtatcctcttttatttccttgagcagtggtttgtagttctccttgaagaggtccttcacatcccttgtaagttggattcctaggtattttattctctttgaagcaattgtgaattggagttcactcatgatttggctctctgtttgtctgttgttggtgtataagaatgcttgtgatgtttgtacattgattttgtatccacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatagccaaatgactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaattttttttaacttccatcttgatttcgttgttgacccacagattattcaaaagcaaattatttaattttcatgtattttatagttttgagggttccttttggatttaatttccaattttattccactgtgtctgagcaagtacttgatataatttcaattttcttaaatttattgagacttgctttgtggcctatcatatggtctatcaggagaaatttacatgtgatgatgaaaagaatgtatattctgcagttgtttggtagaatgttgtataaataccttttaagtccatttgttgtaaggtatagtttaagtccattgtttatttgttgagttcctgtcttgatgacttttctagtgctctcagtggagtattgaagtcccccactattattatgttgccatctatctcctttcttagatctggtagttattgttttgtagatttgggagctccagtgttaggtgcacatatatttcagattatgataatttccagttggactaatgcttttatcgttatattatatccctctttgtctttaattgttgttgccctgaagtctgttttgtctaatataaaaataactactcctgctcacttttggtttccgtttgcatggaatatctttttccatcccttgaccttaagtttatgtgagtccttatgtgttagatgagtctcttgatgacagcagatacttggttggtggatttgtgtccattctgtcattctgtatcttttaaacggagcatttaggccatttacattccatgttagcattgagatgtgaggtactgttctattcatcatgctagttgttgcctgaataccttgtttatttttaattgtgttattgttttataggccctgtgagatttatgctttacagaggttctattttgatgtattttgaggctgtgtcaagatttggaactccttttagcatttcttatagtgctgtcttggtagtggcgaattctctcagcatttgtttgtctgaaaaagactttatctctcctacatttatgaagctgtgctgctgtatacaaaattcgtggctgataattattttgtctgagaaggcaaaagatgggaccccagttccttctggcttgtagagattcttctgagaaatctgctgttaatctgataggtttttctttacaggttatttgatgctcctgtctcacagctcttaagagtccttcctttgccttgctgtagatgagctgatgactatgtgcataggtgatgatctttttgcaatgaatttcctgggtgttctttgagtttcttgtatttgggtgtctagatctccggcaagaccagggaagttttcctcaattactctctcaaataagttttccaaacttttaaatttctcttctttcccaggaacaccaattattcttatgtttggttgtttaacataatccctaatttcttgggggctttatttttttattttttatttctttatcactgttggattgggtttatttgaaagccttgttttgacctcggaagatcttcttctacttgttatattctatctttgaaactgtccagtgtattttgcatttctctaagtgtatctttcattttaaaaagttgtgattgtcttttctttaaaatatcaatttctatggaaactttttcattcgtatcctatattgttttttaagtttctttaagttggttttcaccttgctctggtaccttcttgagcaactaaatattcagccttcttaattctttatctggcaattcagagatttcctcttggtttggatccattgctggatagctagtgtgatcttttgggagtgttacagaaccttgttttgtcatgttacccaaattacttttgtggtttcttctcattagggtagactgtgtcagtgaaaagatctggaactcaagggcttctgttcagatttcttttttcatggggtgaccccttgatgtggtgctctcctcctttccctagggatagagctttctgagagccacactgcaatggttgttgttgcctttctgggtctagccacccagcagggctactgggctacagactggtgctggggaatgtctgcaaagattcctgtgatgtgattcatcttcaggtctccaagctactaccagcacctatactggtggaggtgggaagggagtgaagtggactttgtgggagtccttggttgtagttttgtttagcgcactgcttttcttggtcggtggttatgtgtagttgtcacatggacagacttatgacctctggttagccagggtgttgcaggaggtggaattggctgttctccttctttggagcaagcttgttctgttatgagttacaataatggcttgagttggttggcctccatccaggaggtattaatttcaagagagcaccagctctgttagcagaaggggagtatacaagtgtatattcctgtatattcctggccctatgttggccagggtaagtacttgggtttctcaggtgatagcaagggccatagagctccaaagaggtttttttgtttgtttgtttgtttgtttgtttgtcttcagctaccagggctggtaaagagaagatatcagttgggtacagggttaggctgctctgagctcagactctccttgggtggggcttgctgcagtcactgtggaggatgggagaatggttttctggccaatagaattgtgttccttggggggattatgcctgcctctgctgcatcatacaagtcgcctggaagtggcctcacccagctcccacgcagccagaaaggccagtctcagtactaccaatcaccaccaacagcgctgagtttatatccaagcagcctgagagcagggctgagatctcaccccaggctacaagcatccccactgagaaaacaagcaaggctctcaggcctcacctctccccacctgcctgtaccatcagctgtggcttctacactcatatctgcacttactgttcaccccacccccacccagagtctgctcagaaaaagttgtgctcggtcaaaattattaagaagttcagctcgaagttttcttcaacctgtgacaccttctaaattcttctggctgccttccccaaggacccctgtgaggtaaaaccaggaatggcttccctgggctcaaggtggggactggtagtacctacggggactggtagtacctacagggctcttcctgctgcttcttctgcttttatatttcactctgattcctaaatccatttcagctctaggtaaggttaaatccttctcctgtgacctggacctttaggttccccatttgggatgtgtttgggatcagactttttctcctttcactctggaaacacgttttttttcagctgtctttcaaagtttgcagcagcaagctacttctttcaaagggtctgtgacttttttgggttttcctgatatgttcctgcagtggttttggagcaaaagttcacaatgcgagtcctccacatgctgttctgtccatccaagtgggagctgcaccttagtcttatctcttatccaccattttctggaagcttggaatacaaattcattaacaagctattcaaaggccaagacaatgtgactctaatcttgttttcagtaactccttgcaacactattctttagctatatggagatatttattgagcctcacacaagctcctactttatgccttccacatgctgtttgcactgccttgaattctctgttgcttctaatttgaattgtatgcattttaggatttctcttagatgccacattttatgcagccttttctaactctaccatgtaaaattaattcctgtgcattattttatttgaatctttcttgtgatactcatcattttttatttttcggtttccctaaaagtatgctctttgagtgaaacattcatgtttgtctttcacatttctttctatttacattcataacccattttaagtgctttttatacaaaaattattcattaaatatttgttcactgtatgtaaaaggttgacatctcagggtgaagagaattattaaatatttttgaagttggtttatataatattagcttttacacactttctgtaagtttttcaaagtattttttgtctgtcatatttgcatttatttgtttaaattatatttgtactatataaatgtttaaaaaaatcccttttaataaaaacttaattttatcttaagtgtaagctagagttagcttagctacttattaattgtttctaagttcaaaattactgatttgtaaacatgtattagaagatcacagtgttaacagagtggaatgaattatccacatccctcaagtggtggctgcaacttagacccatggattctgtactagattttacataaatagaagtcataagacagcatgtagtgtaaaggatgtttgttactttttttcatcacttagcatctataccatatatctttttttggataattcaccactttaagagtaagtagatggcagagattgactctgtagaagttgaaattagcacataccaacgttttattcatcccttgaaactagggcaatgtcagtcaatgggatgcttccaactgatcttgaaattaggaggtgatggtgcaaagaatcaccaagctgaaggattgactgagtatctactgcagaggtagacagtggcagcctaaacatgtgactttcagaagcaacagggtaaatggatcactgcggtagctatagctttgaagtctgtggcatatgctcttcagaaactaaatgtagttatcctcactgatttagttttatgaaaagatttttattgtggtcttcttggctgcctattttttcttaatcctctccatctttgagttcagttctctggacttcctgatagtactctgatcaatcaaacatccattcaatggattctctttggctaattctgccatagtcaattactgcagcaactgacaactatgactgttaaaactatactcttttggcaccattgctggatgtatggtatgcttacttcttctctaattttttcccttccttttctagctagataaatatttgtttagccttttcatatattttctttgtatcataatttgaactctcttctgaattatcaccagaatctccttgtacctcttcaatagtggagggccaaaactcagcacttggtgaatcttggtggtttaaaaaatggtaaagacatagtccactctactatttagtagttgtgtgacttttagtaaattaatgaaccattatttttcattgtaattctgtaaaatgaagacaatgttactgattttatgggatttttataagaattaaataatgttagcaaagaccaaagacaatagcacagttctcacacatagtaggcattcagcacagtgaatagtagttatcattagtaattctgtaggctccatattgcctaaggacctaaagatatgatatgtattccctgtgtgtgagataacaatctctatagtcaatttcagtttgacttatataatatccttgattttattttctcaaaattatgcctgtttacttggtacttgcttttaaaatggtattcaccgaagctttaacatccagtgattaacagtgagagagagtaaggctctttttaaaccaccagagtgtgttagggtagtactgagtcaaagtctaagagttttatggttaaaaaaacaaataactttttactgctgctcatttaagtaggattttatgttgttcccaagatgggagtctacaggcaactaataagcgggaagaagtgactgtgaagacaaaccagctgcatcaaactgcaggcacctcaggaatcagcagatcatgcagggcacaaagaggtgaaaccagtcaagtgtacagtggagacgatttctcaattttttttccttggaatactagcatcactcaaaaatgtcaatagtgtttggtgaacaaaataagctttttaaattaaatgtacagaaatccctgcttatcagaatgacaccttgaattttcataatacatattagtatacccaagtaaagaagcctgtctaatttttctgagatctttatttctcccaatttgctggaacatgttttatttttaatttgttttctttgatttgcttttacaggaactttgtaataatctaaagaacgcagttgctataatttgataatgacaaatgaaattatgaaggtaattctgagcaattgcgaaaactcacaaacaacagtctaaatatttggagctttatactctaaatactggggagccactaaagatttttaaagtagaacaatgaagaattggtgcattacaaaaattagttgacaatcatatttagactttatttgaaagataaggaaaaatgatagaggcaagggaatcaattgaccagctattgtgatatctcaattttgaaaaataattaaaaattagaatgaagggatctatgtaaaaggaagccaccaagagaagtaattaattcataggacatgatgattaatggatgtggatgaggaggaaaaaggaggttgaaagaaagtagtaaaaactggcaagagagtccatgtctgaataagaagataaaatgtcacactgattaatactttaactgaccaaatcaagacagtgagattgtttgtggaagaatattgcaaataatttaggagctttaaaattgtggacttattctgatgcctccacctaaattgtctggtatcaaaacttgctgatggttgcatcatgttccagctttccatcttgcattttctaactcagtaaagagttaaaaggtgatttaaaaaaaaaaaaaaaaacttcctttggcatggattatgtcagctttcatctacatgctatgcaaaatcatgtcttggttagtatttttcttatcttttgatggttgacatgcaagagagaattaaacatcaagataattagtgaatcctggtgatatggttcagctgtgtccccatccaaatctcatcttgaattgtagtttccataatccctacatgttatgggagggacccaggaatcatgagggcagtttcccccatactggcctcatgttagtgagtaaatctcatgagatctgatggttttataaatgggagttcccctgtacaagctctcttgcctgccaccatgttaagatgtgcctttgctcctccttcgccttccaccatgattttgaggcctctccagccatgtgaaactgtgagtccattaaccctcttttgctttataaattacccagtctcagatatgtctgttagcagcatgagaacaaactaatgcacctgaatactttagtgttttttagtagaatatgacatattatgagtacacaatgtgaagaaatccggatattcgaaagacaaacatttctgaatgaaggggaaaagtaagctggggcaagacaacgtttctcatccctgattgaaatgttcctatttaccccctaacttataccttgggatgttatgttgcttgtaaagaattgtgcagagacagatggaaatattaaaatatttatcctaaataaatgtttgagttaaacggtaatatcctgtgctgctctagattcaattctatcaataagctattttgagattctgacctcagtttcttgtcttcttttaagttatctctgggccctaaagagacacagctatgaaactggagaatgactgcagaataaccaaaagaagttatccaacagaatttataagatataggatttcgtttcaagagagaaaacaggagtaaaaatataaattttgggattgtccacattagagagaaaaatcatatcttcatatgaagaaatatagaatttcttcaaaaaagaaaatataagggaaggagattggaatattaaagaaaatctcagagaacatccacaactgaattccaaaaacagaggaagaattatcatgaatggcaaaagatatataacaatatacgaatgaagagaatatatccactagagaattataagagaaaggaaatcaatttaggtgaagaaagtctaagaggaaggggataaaggtgactaaatttggtgataaaaaattgaggtaggcaaaataatggcctccaaagattcccacattctaattcttgaaattagtgtttatgttatgctaaatgacaagggagaattaaggttgcagatggacttaaggttgataatcaactcactttaaaaatagagagactgttctgaattatccaaatgggacaaatgtaatcgtaagggtcctttatatgtgaaagaatgtgaaagagggcagcagaagagtcatcagactggttcaaggtgagaaaggcttggttggctagctttgaagatggaaggtttcagaagccaaaagatgcaggctgactctagaggttggaaaagcaagggaatgaatttactagaaaggaacagagacctgctgacactttgattttagctcagtgagatccaatttggacttctgagaaaataagttttacagaactgtaagttacagaactgtaggaaaataagttggtgttgttttaatccactgagttgtaccaatttgttacagtagcaataggaaacaaacatagaagctcattgtttgcgtagatacgcagtgtcagtacaaaggacaaagacctattaacagagttacaaatgagcaatggaagtagcaggtgttgcccatattttcagcagattaggcagtggaataagagaataggataaaaatatctgagaaattgttaattggggaaaaattcaaatacatctaattaaatagaaatagcattgttcaagacagaagctctattatattagctccttctttgcaactaagcagaatatttcttgagaagattatatgagcataattgtcaaaccaagcaaatgaaaatctcccaaactaatggatgtaataagtgagatctagaaactcacagaaagctgtttcatttaccataaagaataatgaaaagtctttcatctctaaattgtatgaagtgagaaattctgccaattataaatgagatgaaaacgaatacttaagaaaaattctggcaacttcataaaaaatgccaattttacatattagaagaaaaaacatattatgctgttgacatgttaagtgcatcaatagagataatgaatatgaatatgctaaatcaaggcatataaaaaatagaagactaggatattctcaaaaaattcagtttatatagaaagccagcctggttttttacaaaggtttgtataaagaagtacagaaatatttaagggtagaagaaaaataagcagccatatgctactctaaatagtgctgagttatatgggccacttttatgcaaaatgaattctattgtaaaacacaaaaataatgaaaaaaaattgtctctatgttgatttgacagaacttacggttaaagctaatgatgcagttttagaataaattttcctaaatctaggtagagaaactcaattgtcaaatgaatgatctagacccgatgacctactgggttccttctaaagtaatggccccaggtatcctagtgcttgagaaatacgtaagcattgcttgaaaagagcatgctggggcccaaggtttggtaagcgctttatgaagttttgctgcttgccttctcagaccctttagcacataaatttctaagaaaatacttctaaatgaatcattttccctgataggtcttttgataacagaaaaggtttttgcccgtggatctcaaaatacttgtgtttaacacattaaactgttagccataaatcaatttagagtcctaaaacaataatgaaaaataagtcagaatcattttgacatactgctttctaaatatacatttttcacagaccctttgtgttataatcaactggtaacttcattcttctacttcctaagattgtacattcaccacttggatggtgtagttatgagcactcaattatttttttatctgaggaagtcttccttgagctgttagttcagatctctgggcactgacatctcctgttcatttcatattcttgattgtcacgttacttttttttttttgaggtggaatctggctctgttgcctaggctggagtgcagtggcgcaatctcagctcactgcaaactccacctcccaggttcaagcagttctcctgcctcagcgtccctagtagctgggattcagacgcacaccaccacgcctggctaatttttgtatttttagtagagatgaggcttcgccatgttggccaggctggtctcaaactcctgacatcaggtgatccacccgcgtcggcctcccgaagtgctgggattacaggcatgagccaccatgcctgacctgtcaagttactttctatacacttggtgacgctttggtcttttctgttaaatcactctcagattcccgaagtgtttttcttatttaggaatagcaatactgttaattagctaagcatccgtgatgccattcactttttatggcttatctcaaccctttcaacaactttgtgctagaggtcaatttaaccgttttgccacagagaaaacaaaaggctaagaaccccatagcttatacatggtagagtcaacattcgaacccacctttgcttttcttcaaagctggtcttaagggtaatgcccaattttcttgccctctctattccctatcgtaaattccaccctcaaaccacctacaatttcagacatatttccattgtttgaccctaggtggacaagagaagagagatattacttaagagactagaagtcaaggactagattttactaggtaatcaccaaacctcacaccagagctaagagtttctgaactcactcatgcccccgggtgctgcgtgactctgaaactcaatgtcaggccttatgaagtgatcatgagctccctttggaagcagccacctctaccatttcctctttcccatctgcttctccatgaggctcttcgcttccttgagaaacttggcttcacacctatgagtaattctctgtctcctttttaaccgtacaccttcaatcaacagcccttctgtttctcttgccacagatctccacagaggcctgaaaaagtgatttatctgagcaaaggaggtcttctttattcagtgccattgctcccagatgttttcttctgattctagaaggcagatttatgtcgttcctgttacctcagcccatgaagctcaggtaaccacaggcaccttctggccgtactgtattaaaattatattctcctgatttacatacattaggtttatgagctattggaagcacctaataactttgggcaagatgatcctgactttatttttttattttagattcagggggtacatgtgcaggttggttacctgggcatattgcatgatgctgaggtttggggtatgaatgaccaggcactgagtaaagtaccagtaggtagttttccaacctttcccttcctccctccctccactctctggtagtccccagactttttttatgtgacaatatcatttttatttttctaacaaatctttcttcctttttttcttttgaagataaacatggatttaataagaatcagataattccacttagaatcatctattgggggggctattttaaaatgctggtgtctgatttaattgctttggagaggacctgagtataaatattatttttaaaagcacccccggtgattccagtgtgcatctgggaatgagaacccttgttgtcggcagcacttctcaggttcatattcttaagtggggcaaccacacatgctagtttgccttaagtgagtcctggtgtaattattcacagtacttcctgctattctcagaatctccactttgggtgataaattatatggctaccctattcatgaaaatcatctgggaagctcattaaaaattcagattatctaatctcaggtcagaagattgagtttctgtaggtctggggtaaggtttgagtctgcattaaaaactagtaaaattgtcatgagttgattctaatgcaggtgatgtacacactccaactctttttaaaatagattatttcttttggaacagttttagtttcacagaaaagttgagggaaaatacagagatctcctatgggctccctgcccctgaatacccacaggctggctgactgtgagagtctcacaccagagtggcagatttattacaattgatgaagctacactgaggcatcattatcactcaaagtctatggtttacattagggttcagtcttggtgttgtgtgttctatgaattttggcaaatgtataatgacatgtatccaccatcgctgtatcggaaaaatgtttcagtgccctaaagatcctctgttctctgcctattcatttctttctctcccctaatgactggaaaccactgatctttttacagtcttcatagttttgccttttccagaatatcatatagttggaatcatacagtatgtagccttttcagattggcttctttcactgagtaatacacatttaagtgtcctccacgtcctttcacggattcttagctaatttttttctgaatgttcatgtagtttatcctttcactgaatgaagaacaactttatttcttccaagttttggcaattatgaataaagctgctataaacatatatgtggagtttatctagtggacatagttttttaacaaagttgggtaaatcccaaagcgcacaattactatattctatggtaagaacatatttagttttgtaaggagctgccaaactctctttcaaagtggctgaaccgttttccattcccaccattgacaaatgagaattcctattgctctacctcctcaccagctttcgatgttgtcactgttttgtacatttgccattttaatagatccctaatggtatctcctttttgttttaatttgtaatttcctaatgacatatgatgttaagcatcttcccatacgcttatttgctatctgtatatcttttttagtgatagttttaaagtaaggtgttttgtctattttttaatcaggttgttcattttctcattgttgagttttaagatatctttgtatactttgaataacagtcctgtatcaggtatgtcttttgcaaatattttcacttagtctgtggtttgtcttctcactctctcgacactgtctttttcagagtagaagtttttaattttatgaagtccagcatatcaactctttgtttcatggactgtgcctttagtgttacatctaaaaagtcattgcaacacccacggtaatttatatttttctcttgtattatcttataggagttttatggctttgcattttacatttggctcgatggtccattttaagttagtttccgtgaagggtgtaaggtctatgtccagattcatttttttgtacttgtaggtccggttgttccagggccatttgtttaaaagactatgtttctctattgtaatgcttttgctactttcaaagatcaattgaatttatttgtgcaggttgtttctcagctttctattctgttccattgatctatttgtctattatctttaaagtaaggtagtgttaggcctccaactttgttcttctccttcagtattgtcagctattctgagtcttttgcctctccatgtaaactttagaaattctctgatatccacaaaatatattgccacactgtccttttaaaacactgtttagggtctgaactttaaaaacatcggaacctataatagtgtgtgttagatattgtcaagttttccgtattctaaagaaagatactcaaaggtgaataatggatctgtaatttaaataataataaataatagttaatgaactctcacaacgttctattttctcctatttgtcctatttgatccttaaacaacatagtgaagtggttatgaattctgttgtatgaattaagaaactgagaatttgaataattttttctaaatgtgtacagttagaaagtggtagaattttgattcaaatttaggttaatgagccataatgctttattatgattgtgtaatgtcatttcccaaacactgttcactgatttaaatctcacaaaatccttctgatacagactgtaaaaggcctgctaatttagacaggtgaaacgactttaccatttatgatgttatactggtagtgtaatgaaggcagaatatgaatatagatcttttaattccctaaccaatatatgttcttctcttttacttaatgtagattaaatgacgatctgcttgttttcatttaaattttaaagacctgtgaaaaccactatacttttgtaaagaaggaaaaacaaacgttcacattttgaggtagatagaaatgtcttattacatgctttggcaactctttctgaaggttaaaacatattagaaagccccatctcttccatttctaacagtaaagccaccctgactagctccccaccttctttgtaacttatctcgtatttatcatattcaaatctgcaatcttgatgctattttcgtgatcgtaattcatgctcaacaatctgcttccattctcaactcagtgagctggcaatcaatttcttagtgctatttgagaagaaagcaaaatctaaaaatgaagctattactatattacaagtaagtactaaatctgttaggtaggggctgacagatcacattagaatgtgtgccctgaggcactgtgaggcatgagaagggacttgtgatgcatgacactattattgacctttgagttacacaatttatcagaaaggaaaaaatagtttcctttgtgtcggtaaaaaccagtaagtgagccctttagtctagatttccaggagaagcaaattggtcattgtaaaagttcactaattcggctgtttattctcccaaacagaaatgggattgttaccacctgaccagcatgcatttagcagagcagtccttagctaaatattacatcagaaaccagggtaagaagcaggctatattgtgagaactattagaagtggttggcctatcctttaattggtgtttcacactgctctgcttccctacttaccattatacatactcacacgattacaaacttaacattacaacataataaacatcacggtgctctgtcattaatagagcacttcctccaatttatgcatgatacttagctctaaacttgatttatctgatttaatccttcaaatagtctacgacctaagttttttttttttgtttgtttgtttttgagacagagactcactccgtcatctaggctggagtgcaacaatgcgatctcggctcactgcaacctccacttctttgggttcaagcaattcttgtgcctcagcctcctggatagctgggattacaggtgtgcaccaccacgcctggctaatgttttcatatttttagtagaaatggggtttcatcatgttggccaggctggcacaatcctagtagtattatgctcattgtgctgttatggaacttgaggctttgatgattaagatgagttgcccaagtttgcacagctagtaagtgccagaactgaaactcaaatctaaggggaaatgggctttatcactgtattcttaagcatttctctgcattgcagtgtatgtaaaatgaatggatagtacttgaaattagtcccggacaattaagtctatatgtgatgtattcaaaatcagttgaaagttctaggatctaatcactgccatagtgcactccaggtcatgcaacaaagcgttaccccttttttgttgttgttcatcattcttatctaaagaggattatattctgaggtctttattgcattcacagcattcctgagagccacatgctatgagaaccctctttttttctcattttaaaaaagttaactttattgggatatatatataatttacatagaataaattttaccttcttatttgttcagttttatgaattcttataaactcatgtaaacaacatgagaatcaagacaatttccataacccaaatggttcatcattaactgtaaataaactttttatttagaacagatttagagttagaaaaaagttagtagtacagcgagttctcatgtaccctccacccacccagtatattccctgttgttagcatcttgcattagtacggcattgtgatctttttctgtgccagcatttcatccaagataccatgtttacgtatagtcatcgtgtctcctcgggctcctctagtctgtgacagtttcatagactttccttggtattgataaccctgatgactttgaggactattggtcaactattttgtagaataactctcatttaggatttatctgatattttcttatgattagactggggtcatgtgtttttaggagagagactacagagataaagtgccgttctcatcacatcatatcgagaccatatgctatcaacatgacaaatcactgttgttgttgacttttattacttaactgacttagtgtttgtcagatttgtccactgtgaagttattctttcctgccttgtctgtaaaatactttttaggaggaagtcactatgtgaagcttagagtggggagttatgccctgccttgtttagtggggaacacctacacaaattatttggagtaaacagaggatttgtctatttccttcatttgtttatttatgcattaatttaatcattaatttatatcactatggactcagatattttatactttgggttataatctaatagcacattttaagtttcgttgctcatattgtgctagctacagccattagaagctctttcagttgactactgtgtccttttgacatatccccattgttgttttctgttggttagtttatttttgctttatttctagcacttgttctctgggaatacaaactatcccaggataatcttatgtattccctgtccaagctcccaaatcaaccatttctccaaggggttctagttccttttagtcgagaagccaagatctgggtgctagaggtgctcactgctaccagggtgttgttccttctatgtcccctcagatgatggagaaagagatgtatatgtgtatactagctcacgtgtgtacacatatcaaaaataattccctgtgtatcatgctaaacgtgaattgtactgataccttctactgtaattcattataacatggcttattctaagttgttctccctttcatgtttctaattcccatcccaacaatgagcgaaacctatcccttgctagctgccattgatttacttacttgctcagttcttgtatacatgtatatgggttcctgaattgtttacttgtatccccatgggaaacaactttcccaactagagtgcgtacgcgcagttcattttgcctttggttttatagcctctgtgtatttacaaaattaattagggccatatatgctgaccttttatgagaaaatattcaaatcagcataaaaaataaagttttatttagtgtatagctacattgtgaacagttttaaaattctagagttacttacaatcatggatgtgtattcatgtaataatagttttaagtctatggtgttcattggatagtctaatattatagcagttatttttcaattaatttttaaagcttttatgtttttggttttctggtctttccatttcatgcatcattaaaaggagaattctgtaaaacaaaacattttatataaagatgaaatatggaaaatatttcctataagctgtctgtattattatgtattttaatggacttaaaaatgtataaaaatatgtttaaatatttgtaactacactccatatatcaattaagaaattggctgcaaatatgtgactttaaggtacgtcttttagaataaataattgtctacattcttggtaataaaatagtattattctgaaaatactaagcaaatgtggctttttatcacctgaaatagaaaaccttgacaatttcaatgctttctcctgctagatgaatcttatgagatcctataactcacccaaactttaaaaagcaatctcatctcaaactattctttccaaagttctcttttggaagttcaagggtatgttttaaaaaataattaagtaaccatgtaaattgagaacaaaatagatgagctgctgtgttttctgtataagtcatgctggatgcaaggttaggattttaagttccataaaatcaattatatacacaagctgaaatagtatctgagactaaggtaaatagaatgagcagggcatcaaggatacagcagtcaaaaacagcaaacctttcactgaatatcagatataaaacatttaggaacctgccttgaagaaatcttcttttgattaaaatttaatgatttatatttataaaatgagtagctctgaggttttatatattcataacgtcaagagtttctcagatacttcaagtacattcaagcttttgtaatgaagattcattttaaattaatgatttattactttcagcaacattttaaagtagtttgtagtatgatgttgggctccaaagaaaaacaattgcctgaagaactgtatcaggtaaaccttctctgtaacagacttcaaaagaaaatggctgagacaaactgggatgctggaaaactgcaggtgtacttttcaggatataagcattaatacgtgtgtaatactgtaatttctttaaaagtgtaatttggggcatggttaaaccacagaggtgtctatgaatttgattttgactcccaactgcagtggcagtagtgtgtgcctttctcttccagagcaataagcattttgctgaggaacttaaaatttgcatctaggaaattgaatctcctaggctagtctttgatcacacaaatctaaactaaagacggacacagtacaaaacaaaaacaaaaacagaacaagtggttcagcctcaatcttcatttttttctgtgtatgattacgagcgaagtagaggtacatcacaacaccacaatcatttattgaatagtgtacattaccccaacatccttattcataatgactttaagatttaataaagggaattagaggaatatacaaacgtatatgacagttaggtacttcacctctaaaaaaaaacaataaaaagtgtgtattcaagggagggagaaaagacatttctttaaggggactgggaacactttgggcatttgttgaatgcccataatattactttaaaaatgcccctcctattcaacatagtattgggagttctggccggggcaatcagacaagagaaagaaataaaggaagagaggaagtcaaattgtctctgtttgcagatgacatgattgtatatttagaaaactccaacatctcagtccaaaatctccttaagctgataagcaacttcagcaaagtctcaggacacaaaatcaatgtgcaaaaatcacaagcttttctatacacaaataacagacaaacagagagccaaaccatgagtgaattcccattcacaattgctactaagagaataaaatacctaggaatacaacttacaaggaatgtgaaggacctcttcaaggaaaactgcaaaccactgctctaggaaatagagaggacacaaacaaataacaaaaaattccatgctcatagataggaagaatcaatattgtgaaaatgatcatactgctcaaagtaatttatagattcaatgctatccccatcaagctaccagtgactttcttcacagaattagaaaaaaccgctttaaatttcatatggaaccaaagagcctgcatagccaagacaatcctaagcaaaaagaataaagctggaggcattaagatccctgatttcaaactatactacaaggctatggtaaccaaaacagcatggtactggtaccaaaacagatacatagaccaatggaacagaacagaggccacagatacaataccactcatctacaaccatctgatctttgacaaacccgacacaaacaagcaatgggaaaaggattccctatttaactttgttgttgggaaaactggttagccatatgcagaaaactgaaactggaccccttccttacactttatacaaaaattaactcaagatggattaaatacttaaacataacacgtaaaaccataaaaatcctagaagaaaacctaggcaataccattcaggacataggtgtggggaaatacttcatgtctaaaacaccaaaagcaatggcaacaaaagccaaaataggcaaatgggatctaattaaactaaagagcttctgcacagcaaaagaaactatcttcagactaaataggcaacctacagaatgggagaaaatttttgcaatctgtccatctgacaaagcgctaatatccagaatctacaaagaacttaaacaaatttacaagaaaacaacaaacaatcccatcaaaaagtggacagaggatatgaacagacacgccataaaaaaggatgagttcatgtcctttgaagggacatggatgaagctggaagccatcatgctcagcaaactaacacaagaacagaaaaaccaaacaccacgttctcactcgtaagtgggagctgaacaatgagaacacatggacacagggcggggaacatcacacgccggcgcctgtcggggtgttttgggggctaggggagggacagcattacaagaaatacctaatgtaggtgatgggttgatgggtgcagcaaaccagcatggcatgtgcataactatgtaacaaactgcacgttctgcacatgtaccacagaacttaaagtataataaacaagaaaaaagaaaaaaatacaattaatttcaggatatgattttaatgaatagcaactagtaacagaggttttaaacatgacaaagggagaattttcctggggaaacatttcatacccaaactctatcttcccctttaaacatgtcaaaggggaagatacagaatgtataaaagaaaagtgccagatattttcacagagcagcactaaatctataattgtaagaaatataaggaaaataataggtgataaagctaaaaataaacattaagaacatactactgaaggccatacatgccagggtgaataatgtgtatttaatatggaaggaacaaaaacattggatttttgtagtctagaaaattaatatagaaatattgtgtataaaatgataaagggaaaagcaagatgtatggatatcaagattgactataataagagaaaaaacaggaattaaactagtttgttaaaattataatgaagggaatggtaagctaaatattttgttactgtgagcaatataatttggaaacataaatatagaaatacaaaatcaaagatgatacagaaattctgattgctaatgcatgggagaacgagcacacccttaacataaaaaagaagataagttggcttctagaaatatgactagggatgggtgcaggagggcatgttctatttttgaacattagaggtcctcaccccaccccccaatattttactatttttattaatcctatagtgcacatattggacataaatcatgttcctcacttatgatgatatctctgggataggttcctagagataaaatcatgctttcaaagactttctttccctacgcattgtcatattctttaccaaaatagttgtatcatcttcagcaatatatgagggagtattgctaactatattctcattaaacttgataattaacatgtctcttgagttttaccagttttagtaaaaatgaaattttgttaatttcatttgaatttctttgtttacaagtggaatcaaatgttaaaataggttatttagattttatattttcctttctggaaattgtttatccaggtattttaccatatatattcacctgccatttgtttctataggccttattgagtttttctttctaactaattgaaaagaatatatctgtttgttgacttttaaatgaatatttgctgcaagttttcattaatttttatttgcttttttcttttcttttcttttttttttttttttttttttttgagacagagtcttgctgtgtcgccaccctggagtgcagtggcgcgaccttggctcactgcagcctctgcctcctgggttcaagcgattttcctgcctcagcctcccgagtagctgggactacagtcacgcaccaccacgtccagctaatttttatatttttagtagagatccgatttccccatgttggtcaggctggtctcgatctcttgacctcatgatccgccctccttggcctcccaaattgctaaaaattacaggtgtgagccaccgcatccggcctttatttgctttataattgtgttcatagttttaatgtatacatatatatatatatgtagttttgaagtgtccaagggaatctgaaggaaaatgcatttttttaaactggctgacatacaggaaggaagacatccttcaaagaaactgcttcaaagcaattacacagggaggaggttttataaaatttgggaggatgagccactctgaggaaaagcagaagaaatcctgagaatgaaaaacagcaaattttatgcattctggcatgcacattttcagcaaataggatgtttttggtgtgaggaagaccaaaagaatctcataacttcctttaggaaggttatgatcactcacttctcagggataaatgacattttccagctggggtcaatcaggagtggggaaaatgtcatgggaatagagggatctaaaatcattcagaaaaaaaatcttacagaagtcaagtcaaaccaaactatcttttcctttatcgtttccagtattctctatctgggaaatctcccggctcaagttaatatctgtatatacattttttctttttttacgactcacatgtggcacattttttagaataggatgcatggagttggtcataagtgacttttcaaataggtgaccaacagatttgtggtaggtagaataataagtacactatcttcccaaaattttcttcttcatcttcagaacctataaatatgtgattttcatatcaaaaagaacctgcaaaatgttgactcaggatacagaccttgagagagatcatctgaatgggaccagtctaatcatatgagttcttaaaagcaaagaaaatgtcccagctggatcaagagaagagaaacaagaagaacttgacctactgttgctggttttgaagatggaagaaggaaccatgttccaagcaatgtgctagatgttgggaacagccctcagctgacagccagccaaataattgggacctctgtcctattgtaagatactgaattctgccaataattcaaataagctaggaaatttattttcccctagactttccaaaaaggagcagagccttgcagacaccttgattttagccctgtgagaactgtgttagaggtctaacctacagaactgtgagagaataaatttgttttgttttaaggggttaactttttggtaatttattccagcagcaatggaaatccaatacggcatacaacattattttttgaataatcttttcatttttaatgggtttaatgtctaccatttattaaagtcttttatctattatggctgtcctggagaatcaaggaacctgggggttagaagagatatgagtgacctggaaagtagatagaaaactgaattagattgtttcaagaagtacagggaattaatgagcagggtgttatagtgagcacctgtagtcctggctactcagtgggctgagccaggaggataacttgagcccaggattttgaggctgtagtgagctatgatcatataatttagtcagtattgaggaagtagaggttacactctaaattatacagtgaaatgaaaggtgatgacatgtaagttgagaaggagtctgagttctggaaggagtaagtttgggggcatggaaaaatcagagcaatcaccaaaacaggaaagatataagattcagaaagaagataaaataattgatagtgaggaaaaaattatatagtatttacttttcttttgagactttatcttctgtttcccttctgttctttctgccttccttctcatcctactttccactgtagaattttgtcttgaattttgatccatggcaatctataaaagaaaacactaataacgttcttaaattcagagagaatttttcctatctctgagagcagttgtaaagcgtgaatttgtctccaaagtggtttgcattctttctataaggatgctaaatgtaaacaaagtactgctattagaatgatatatgtgaggctccccatgcaccttggcagaaaaatgttatataaatggaaagtgtcgcatatattttaaaagaatgcatgagtttattcctcaaggggagttgctaatttatgtactgtgcttgttctaaaggtacgtgcatgattcataagttagtttataagtaattttgtactggagaaagagagctaagaggatacttaactgtttccaagtatctgaaagacttattttatgataatcaactattcaccattttattgtagagaagaaggaaatcaatttaaatttcacctgtaaaagtttgtgcaaaatataaatcttatgtaagcatcctgatttgttgtggactttaagaatacaaaataaatactctttttattttgttttctaattcttatgcccctaaattctctgttcttcatatccacactcctgaattttaccaaatagttttaaaaacattaaccattcccctgctgtaaatttttcctcttgttagtctttttttaaatctaaaaaaaaagacaattagttttattttataagccatctatacctctatcatggctacctaatatctggggttaaatatgtaccatgttcagacagtacgggcataaatacacacagtgtccaacggaacaaaatagagaactcaaaaataaattcacgcatttacagtcaattcatttttgacaagggtaccaagaacatgcactggagaaagcatagtctctttgataaatggtgctgggaagcctggatatccgcacgcagaataataaaattagacccttatgtctcacagtatacaaaaactaaatcaaaatggattagatttaatctaagacatcaaactataaaactactaggaaaaagactggggaaacattccaggacgttggtctaggcaaagatttcttgaggaagatctcaaaaacggagggaaccaaagcaaaaactgacaggtggaatcacatcaagttaaaaagcttctgtacagaaaaagaaatcatcaagaaagtgagagacaacccacagaataggaaaaaatatttgcaaactacccatctgacaagcgattaataaacagaatatatagggagtttaaacaactcaatatgaaaaaataataataatccaatttaaaagggacaaaagatctaaatagacatttagatcaaaagaagacatacaaatggccaagagacatataagaaatggtcaacatcactaatcataagggaaatgcaaattgaagctacagtgatatattgtctcacagcagttacgatggcttttatccaaaagacaggcaattgtgaatgctggcgaggatgtgaagaaaggggaaccctcatacactgttggtgagaatgtaaattagtatagccatatggagagtagtgtggaggttcctcgaaaaactaaaaatgaagttaccacatgatcctgcaatctcactgctaggtatatatccaaaataatggaaatcaatttatggaagggatttctgcacacttgtgtttattgcaacactattcacaatagctaagatatagaatccacctaagtatccatcaacagatgaatggataaagaaaatgtggttcatatatacaatagagtatattcagccattataaaaaaatgaaatcctgtcatttgcaacaacatgttaagcgaaataagccaggcacagaaagataaatatcacatgttttcatgtgggagcaaaaaaaaaaactgatctcatggaggtagggagtagaatgatggttaccagaagtttggaagggtcgggcagagagggtgataaagagacagttaatgtgtacaaaaagacaattagatatttgggataaaatttagtatttggtagcataatagaggataattatcaagaatttgttgtatatttcaaaataactaagagtggaattaggatgtctctaacacaaaaaaagataaatgcttgaggtgatgaataccccaactacctcgatttgatcatcactcattgtatgcttgttcatacatgttatactttgatacatagaactagtatgatacgtacaactagtatgtatcaaactcatgtatacatactcattgtatgcatcaaaatataacatgtaccctataaatatttccaactattgtatatccataataattaaaaataaaagttaaagaaaatatatatgtaccatgctcatgaaagtttgaataaatcacaaagttacttgaaagtaacaccttatatgtgtgtatatctctgtaatattttaagtaacagacttttaaaatattatttgtagagctaattctaatgggcatgagatgagttgtttttattttttgctttttgttttgttttggttcaaaactatcaacttttccttaaaaaggcaaaaggtttagactttttaaagaaacttgtataatacctagattatttttgagagtctcattcttgtcatactttcatgattctcattcctgcttttttcttctgacacaattaaaaaatactaagaaaagtattctctccaagaaggaaggccattattttttattccaaagtaatgatctccttcatgccctcttcactctgcccttgcagtcattagtttaatacgcaaatagaagtgagctgcctaggcatattgcaagagttaatgaccaactaattgttaccaacaccacaatcccctcccatgaaaatacagatactgtgaattgatgactagaatctccatatgtttaatgggaaaataacaggaggctccgttgtactagtgacaaaacatgagggaaaaaataattttcatcacgtgcccctgatttaaaattgcttcaggccatccttgtttcacagctaggagtataataaattaagaaaaagtagtatagggctgagatgaaaccctgtgggatatgtgagtgaactaacaggtagagaaattgaagggaaaaagaaaaaaacgtggatagccttgggtggataatacaagaagcaagaaaatagtgtcaagatgcagcagtaataagctaataacttacagatgtaatatacgttgctacaggtctctcaacttcatgtgtttcatactttaagagtttctgtgaccaagtagaggcttgataaagctgaactttatctattaataaaaaatacatgccactcattagggggcagttcatagtgcagcagaaggcatggtggggactaagaatgagaaagggaagcaagagacaagcaacatttactgagagccaagcattaggcatgtgatactcatttataatctactgttttgcctataaggtaaaatgtatgatttttcattacaggtaaggaaacgagtttggatatatatatatttttccctaaactttgttgacacatttgttcattcatccatttaacaaacgcttatatttaggtaagacttcttgaaaaaaaaatcaaattctgaaataagacaaaaatgtaaatgatttttttcaatatcaggtatggatataagctcatccaaatattaggtaatgtatagtaaatcatttttttcattaaatataggcccatacgtagtgaattgacatattaaattgtaaatgttgctgggcatggtggctcatgtctgtaatttcagcactttggttggctgagggaggtggatcacctgaggtcaggagtttgagaccagcctggccaacatagtgaaaccccatctgtacaaaaaataaaaaaattagccaggcatggtggcacatgcctttaatcccagctactctggaggctgaggtaggagaatctcttgaacccaggaggcagaggttgcagtgagccgagactgtgcctctgcactccagcctggacaacagagtgagattctgtctcaaaaaaaaaaaaaaaatgtaaatgtttgtttggtaaacgtatgcataactgactagtggtaagcatagaagataacggtttattcccctgttggatgttaatcaggtccatatttaacccatcattcttatcctaacatacctttattaaatagtctagaaaaacccatctcttcaaatattttcagaaccagttttaacatcttcttttcttattagtcatgaattgaataatatttttgagacattttatatttgcaagagaagtaaaaatgagtacaaagacaaataagccacaataagacaaatagccacaataagacaataagccacaataagacaaacacctttcccctgtgttcttgatagggaaaactgatacttatgcaactactaaccgcaaataaagagtagagttaagaggaaggtagaagcagtggagacaaaattgttataatacaaatttgacttgagatgaatcttgacagacgaaaaggttttcactaggcaaatagcaatttggaagggctttctcaaaagagacaaaaagtattataggtgacagagggagcacttaaactagatctgcttggctcctagacacatatttttttccatcatgctttgttctttttcatcctttgtggaagactttaatttctagtaatcatctttagcctctctggtcatgacatcccttatctaataaacaaagtcattatgctgaagatatataacatatttatgataactaaagtttcttcttattatgatatccattaattacacagtaataataattagcttttggttattaccttaagaacattaaaaaataatgcaaatacattcctaatgcacattttcttgtatttatgtatagatacacaatagaaaacccatttcttgtgacttgtaagtttgaatcagtttcttccccccctcaaaaaaaattcagtatgtataatagatgatgttcagttttaaatcattgtgccttttgaatttagttcaggtctaaaactagtagaaatagatacttatgttaataaaaaaattgttgttaaagggtggcatatcttctgcgtctctttacgcacccatcaaacctattctttttttaatctcttaaatttaaatctgtatattgggagactgatttatttttgtgaaggaacaaaagacagaggatggcagcaccatactgattttgccttgtttatgaaatgtcaccatgttacatgttgttcaccatcttatctagctatgaggtggttaggaagaatgatgtattaggttcatattaaattaacaacatgtcaagtttcttacttctatactcttggagcaacacttactttttcctcttgacacatatcaaaaatcttaattttccattcattatatggctatttggttaagagctgcctccctcaggaagactattgagtttcttcaggatagaagaatgactgaatgaccggcatgattatgcatacaaagagtgtttgaataaataaacaaattaataaatggatgactaataaatatattaaaatatcaagacatatgtgtatatataatttaaaatcaaaaaacaaaatatttgtaagtaattcagtctcttgtgttatctctctcactctatgtcccatggcattacatgacatgttttattttatattataaggtaaatgttctggagacttttagaagcccatcattttttttctatgcattctgttatttcagacaaaatgttaagtgttgacatttctcttacaagagatagttattaaaatctaaattctaaacactcctgttaaacttttaacatcaacctaattgcactgtcaatggtatatgtcttcctttaatcttactgagtctgttctttgcgcctggataccaattatcaatttgttttggccttcacgcatgctcttcctttctgaatgaatcaagactcacaacttcctaatattcaaaatacattgaggattttccaaatactttacttaattgttcactcattctatctttcatttgttcaacaccattataaaacacccaaaaagttgtttgtgatgttgtcctgaacattgtcaaggttctacagataaattagatacaatccttggtttatgaaacttataaactcgtagttacaataaagtaatcaaatatataataaaattaaaatggagtttctaaattatcaaattagtaggatatacttgcatgttttaattataataccattttcttctacaaatattgtactatatgtacatttcatatagctaatatgtaagtgtgaatgaaatgatacacttctaactttaaatttcctggggagatttgaatacacaatcaaagctctccaaaagcatcaaaatgagatgataatttttgtattgcttttaatgtaccttttatctttagtgtattaaatattttttgtgtctgtcaatgcacatctgtaacatcattttcaatggatggtcacatcatagacgttttaaagcaacccttgtctgttggaaattaatttccttttcaatttctcattattacaaaaaaaatactgtgattgacaatctagacaatgaagatattttaaaacatctaatctaaagtaatttatccaacaaatattggttgttcgcctactatgtgtacattctcctataaagctttgaagagttaaatctctttatactctctcttccttcaccctttccctctctgtctatccttatcccctgctctgtctatctctatctgtatttgtctgtctgtctatgtcagtgtctgtaatattgtggtgtagggacttgtaacatatatggaataagacaaatatttaggaaatggtggttgaatatgtctacatatcagtattttccctattttctttccttgcttccttccctccttccttattccttctttcttttgtatttttctttgcctttcttctatatttttcttaagtattttcattagtgttgttgctttaaatgtatattacacttataataaaattagttttcaaaattaggaaaagctcagatcttctgatgctttttaaatagaggaggagacagaacgtgcacataacacatttgtttactatgaatttgtaacatccatattccctacttttttagtggcttacaaattatactatttttaattaaaatttttaattaaaatgatagaatacctcccaagaacaatgttagactgaattctgacttcatgattatgttttgagatttttgatcattagataattttacaatttaaaatctagttaactaaattctcaggctgggcgtggtggctcaggcctgcaatctcagcactttgggaagccgaggtggtcagatcacttgaggtcaagagttcgagaacagcctggccaacatggtgaaacctcgcctctactgaaaatacaaaaattagtcgagcgtggtggtgggcgcctgtaatcccagctacttgggaggctgaggcaggagaatcacttgaactcaggaggtgcaggttgcaatgagccgagatcgtgccactgcactccatccatcctggatgacaaagtatccttcctgcctccctccctcccttccttccttcttttcttccttccttccttccgttcttccttccttccgtccctctttccttattccttctttccttattttctttgcctttcttctatatttttcttttgtattttcgtttttgttgttgctttaaatgtatattacacttataataaaattagttttcaaaattaggaaaagctcagatcttctgatgctttttggacaaaattggagacagaattgcacgtaacacatttgtttactttgaatttgttacatccaaattctgctaaaagactggagatattgtgtctatacatttggaagccaaatatgagatagcagagagtggtgaaatcacccttgaaatgagaattataaaactggaaacaagacctagttgtatctttactggctaggggatcttgggctgcttcagttagtgaaaagaacaccagtttggcatcacaatgcctgacttaacctgctggccccaatatatattcgttgtgtgacactagacaccatttaagtttgcttatcttcaatttcctcagtataaaagaagaaaaaatgattattatgttcataccgttaagttaaagttatataatatgtgtcacactgcaaataaagtatattaattatgtgcataaacccacttattactcactaaacaataaaaaaactaccaaaaaactaacgtttttattgcataaatataaatataaccttaagatttactgtgatcttgtacaagtgtatataaaatcaaacactagacatctcttttagagagttttatttttcagtgtctgtgcttatcttaaatgagtactatttagattataatttaagcagtatggatgtcagtggttgaagttcatttcattttatacattacataatgtgtcattaataggaagcacttattcttaactatgatttttcttgtctcttacgagaactcagaatttgaaaacctgtgaaagtaatctaaatattcttcccattgcaggaggcttttgtgcattactgctgggtgatggtctttcattgattctatgaacttgccaagcataggaattctgtttactgtttttctgcccaatatggtagtaaatcactccaagagttggtaaaatgactgcatattgggaagttctgtaccatcagttttttcagcaatcatctgagggatcaaaacagatctgattcaccagagactaccttaaaaaaccagaatggcagttgatttaaaattgaagatatatgtggcctaagatgcagaactatttgtcttcacagggcataaaccttctagtgggaaaatccattccatttatcaaattataggccagaagtttattttgcgagcaaagggatttgagggttttaaggggtatttctatgttctctagcaaagagagctcctttactctgaggatatttcttcctaaagaagtaggactcagtttctaagatctgtgcagtctttcccactatataatctgatacaaaaacgttactaatgtttgaatgtttcttaattgttgctacaagtttgctttttacatgaccatatttattagcctgttcacaggctgctaataaagacatatccgagactgggtaatttataaaggaaagaggttcaatggactcacagttccacatggctgggggaggcctcacaatcatggcagaagaggaaggaagaacaaaaggacatcttacaagagagtgtgtgcaggagatctgccctttataaaaccatcagatctcatgagacttattcactatcacaagaacagcatgggaaagacctgccccccatgattcaattacctcccaccgggtactcccactacacttgggaattatgggatctaccattcaagatgagatttgggtggggacacagccaaccatatcactacatgaatacactgaaacccacccaatccacccaatttatttccactacactacatcaaaagagatagtgtacaaaaggatgctggtttttgtggcctgccaaatttgaggcaaaatcatgacagtggttcatctgaccaccgtcttcttttcttggtaatgtactgaaacttcttaattctcaaaactaagagtaatttctgtaaatgagaaactgaaaatattacttgaaagagtttcaaggaagttggattctattcccagtttcatcgctgaggagcatatcactttagctttttgagtcctagttttcacttctgtaaaatgagaagacagagtgggttgaattctaaaatcagttgtagggctaagatgatgacttaccatgctacagtttggggtagtttcttattgatatgaataatattttgtgcattatttacattaaaaatttttattgttttcagaaccaaatgacctttttctctaaaaaaatacatatttttagatatttcttgctttatgggtcacaaaatgtagccacaataatcagaaaaggaccaatattgttgacaaagtgaacaactaagaaatgtaatacttgagccccagagctggcttttaacttaaatagtaaatttctaaattttgattactataaataatattatcactataattatcttccacaacagggaagaccacagtggctctgaagaactaaataaaacctagatatcacacatatttgagagaacaaaaattcacaataggaagctgtacaatatttgggaattcttttcacagtttaaactttctctgtcttcaaatatccctattacagcaaaatcccacctactcacaattgtacgtattcaaaatgggacctcagaacacaagcaggtggaaatcacaggtcatggccacagttgaaatgatatgtctttgctaatttaaaaacacactcttgtgatgagcagttttgcatatttaatataaatattacatcaaaaatagattgtgcttgctctgcaatgttgcccttataagccctggagggatgtgatcattttctgctgactctgctatatatgacggtttgtaaattaatactaaccttctcaatggtaaatgttggcccagccctacagtaattatgtaacgcagaaaacttgagcaatcagacatgtttcaatggtaaatattttgtctctccccacccccggtattatgtattaacgaatacattattacctgctcaagcattttctcttttctgtctcaatcagtattatggtccgtgatataattaaatgtttcattttgaacaaaaacatttattttattgctcaccaaggctgttcaattttagcctttggccatatgactttaatcagaagtatttgtgatttagagcactatagcatgtttatttttgcaatttattttaacagcccatgggaaaatgacagtaaatagcttgtaatttttgtaagtaataaaaaaatagctgtgacctatgattgaaggaaaaaaaaattcagggactttcctgtagaaatagactgtcatcgtttgaaaactcaacattttctaaattactatttatttttaatgatcaaaggcttcttacacattgtctcttccagtgattctcaaagtgttatacttagactactgcatgataataaattggaaaatgtctttaaaaaatagatttctttgccagacgcagtggctcacacctgtaattcaagcactttgagaggacgaggcaggagaatcacttgcgctcaggaattcgagaccagcctgggcaacaatatgagaccctgtctctgcaaaaaatacaaaaattagccaagcgtgctggcacatgcctatagtcctagctacttgagaggctgagacaggaggattgcttgagcccaggagacagaggttgcagagagctatgattgcaccactgcaccccagcctgagcaaaagagcaagaccctgtctccaataatagtagtagtaataataataatgatggatttgttggcactacccagaattattgaataagaaaattttgtgagcagaatctcaggctctgcattttgtataagcttaccagctaattcttttgaatatttaagtttgcattatcctattttaaaattctattttttcatataaactgcaatcatgagaaaatataggactttttccccaatctcacaagttaactgcagaatttgaatgagaattcagatctctttattcctaagacaatttctagagacaatacatactggatttcaatttatttttcatcctacacagttggtataaaattaattttataaataagaaccttttatattactaggataaaagtagcattctaacaatttttcatctttaggttggtgtctcacctacttatgtaaactttttctagcttaatcagtctaatatatcattctttttttttctgagacaaagttctaaactcatgacatccgatcacgtgttcccgtctcaaaattacttgttttgctctcatttgtgtatttcccatttgtattaatcaagatatactaggttatgctgcattaacaaatgaacatgccaaagtcacagtggcatagtgcagtcagtgaaagtttatttttcagccatactacatatccagcatggctcagcagggatctctgctccattctgatgctattagtgctattaagcaaatattactggtccggccccctctgacacatggtaaaattacacatgcatgctttttttgcaattacattgggcaattaattagttcttccagatatcctgtaagcagaagttgcaggcattgcactgcaacatttaattgctggtgtgagaacctccagacatcatctctctggcattacaattggtaacattgaaaatggtaactattccttcagtgtgcatctttgaggtaccataaggagcagagatttgcctcagattcacaagagatatattgtacaagagaaaaataaagttgtgttgttttgtcttctgagattgttagaattgtttgttaccttcgcataacattgactatctggactcagatatcctcagaaatatatatacagagagatccagcatggaagaggctgtgcttccttgtatctgcaatattttaaacatgtggcgtttttgtccccatgacatagaaaatgtctgaaaaagtttacacagctttttcattcctcaagctaacaataataggatatttttcctcacagcccgttatccagaactaatcacatgactccaacatactaaaagaagggtaataaatgcaatttttaattttgggagaggaaaagaagaacttgatattaataaaaactagtaatggggtagacttcattgaataaactttatatttttgttcatagaaaattttccctcatatataatttggaagtcaagaacaaatttgttgacttgggataatatcaagaagtcataatggaatatgcagatatatgtgcctgtaataaaataaagtcctaaaaagaaaaaataataaatagatttttaaagcatggtaaatatatttgcatattatgacagaggtcaacacccttactctattaaaaatatttacaaatcaatgtttaaataatggaaacgtaatcatataaaaccaggaaaaaaagtgaatagtcactcaaatcgtaatatgaatacccaaatctagtaaacctctgaaaaaaatgttcactgttattcttctcaaaaaatgaaaatttaaaaatcaagtatatattctgcctaccaattgtcaaaaacattttgaaatatattaatagcaagaggcagacttgaagggagcaaacttccctagaacatctataagtagttaggggatcaattttaaaacgtttatgaaaattaaaaatagaaaatatatcccagggaaacattcaaaaagtatacaaagatatatatttgagaatattcactgtagcagcattttcaaaactaaaaatttagaaatgtttgtaaataggagatagttcagtaaatcatggtacagaaagacagtggaattctgttacagatagaaagcaaaataaacacaggactttcagttaggagcatgttgggtatatgtgagaaaaaaatgtcagtgaggtcatgacatacttggctagagagagaaaaatgagaggttcggtgatgaaggttaaatcatagatggtttgtaggccaacataagaacttagagcttcactcaaatttgagcctttttgatgaatttgaccaaaagagtaaaattacttggatgaccacttgtaaggatctctctacctattttgtggtgaattgattaaaatgaaaataatataagcagggagaccaggtagatgactatttcctgaagcaaaataagagatgttggtaacttgggataggataatagtaatgaaaaatatggaataattttaaggttaaaaaattaagatttgctgatggactagatacagtgagtgagagaaggaaaggtattaaaaagtaatccaagtctaccttgatcaagtgaaaggctgcattgaaaagacagaaagaagtaggtttatgagaaaatcaaaaatttacttcggagcatattaaagttgagttgcctattttgcatcaaatggagatgtaaatgaagcagttgggtatacaaacgtgagtgaagagatacattttagaagcatcagtgcataaattttattaaaggctttttaaagtaatgaccttgaaagatcatctatagtgagtaagtagacagagacagaaggcatctatggatcaagtcctggagtaatccaataggtagagcttgcaagatgaggcagagctagctagtaatagagaaaagaagtaatttttgagattcaaaaaaaaaaaaaaaaatgaaagagtggcatccagaagccaagtgaaggtatttaaagggggattttaatcaactctatcaaatacaatttatagtcaaataagatggctgaaaattgacaacatgagttggcagtatgactattattggtagcatttgtatgaacgtctcatgatggaaaatgaaagtctaattgaaatgactttgagacaatggaagaaaaggacacaaaaagagtgagacgattttctgtatgcaagcagaggctgaatagtagacagcagggtatatgagatgaaggtaggtttttatatgatagatattatagcttgcttatatgctgatgacaaaaatccagtaaagtaggaaaattaaggttacataaaatagaaaaaatagtaaccaggagagggtgagacaagggctcttgtttgtttatttcaactgaggagtcaaatttctttcatttttaagaataagtacagcattgtacttcaagagcaaaaaataaagagcaaggtaccatggtgaagaaaggtggggcaggagggggaaagaaggtgaaagataatttataccattttttgctaataatttttatattatctaatttagtctttatttttactttttgaacagaattttttaaaaacagttttagagtgacagaaaaattgggcagaaagtacagagaatttttgtatgcttcccgctcccacacacatagcatcttcctctatcaatattttgcaccagagtgacacattttttacaattaaaaacctacattaacacgtcaatgttactcaaagtctatagcttacattagggtacactcttggtgtcatacattctatgggttttgacaaatgtataatggcatgtatctataaataaatttttattatcaaagtatcataaataataactatgataaaaatattttatcataaagtatcataaataataattttattaccctaaaaatcctctgtgctctagtcatccctccatccccacccaatgcctgaaaaccattgattgtcttattgtcctgcaattttttctataattttattgtggtataataaacaacataaaattcgctttcttaacaattttaagtttacagttcggtggtattaaatatactcataatgttgtgcaacattcaccaccgttcatctctataattcttttcctcttttaaaacttaaattctgttatacacactaaacaataattttctatgcactcatcctgaagcccctcaccaacactattctaatttctgtctctatgattttgactgctatcagtatacttcttataagcaaaacctatagtatcattctttatatgactggattatttcacatagcaaaatgcccttaagatgtatccaagttttagcatgtatcagaattttctccttttttaaatgctaaataacattccattatacccatacatcacattttctttgggtttaggtatatctctcatagacagaccatgtgtttttaactattctgtcaatctctgtttttacattccatttacatttaaagtaattactgaaacgaggaggggcttctgtgtttttgctctttgttttctatatacgttatagctgttttgttcctcatttccagaattattgtcttacattgtgtttagctgatttcttacagcgaaatatttaaaatcctttcttatttccttttatgtatattatatccctattttccttgtggttaccatgggaattacatttaacggcctaaagttataacactctcattttgtttatgccgacttaagtaacataggaaaccctttaccacttaatggccctgttgccactccttttggttgttgatgtgacaaaattacatctttatacatccggtgccccaaaacataaactgataattcttttaaatacattggtctcttaaaatatgtggaaaacaaaatgttgtgttacaaaccaaagttacaattattctagcttttagattaataactgtttatttttaaatgtagtagtctcttaaatcatgtagaaaacaaaaagtaaagttacaacttactgttgtaagtaaagttacaaattattgttgttacaataatactagcttttgtaattgcccatgtatttacctttatagaggtatttatctcttcacatgactttgaattactgtctactctcctttcatttcaccctatggaacccacttaagcatatcttgcaaagtaggtctagtggaaacaaattccctcagattttatctgggaatctcagtttcaccctcacttttgaaggatggttttgtcagatttagaattcttcgctaacaatttgaaaatattttttcagcacattaagtatcttggtccactaacttctgccctacaaagtttctgatgagaaataagtggataatgttactgaggattccttgtgtataagtcacttctctgttgctacttgaaagattttctccttgtttttggcttttaaaagtttgattttaatgtgtctatgtgtgggtctctttatttttattctctttgaagtttgagattcttggatacttacattcatatgagaagttttcagcaattatttcttcaaataatttctctttctgtctctcttgctcgctcactcactctctctgtcttctgggacttctacaatgcatatgttaatttatttgttggtttcccagatatcatttaggttctgttcatatttattcaatatttttgttcctgtttttcagaatcaatatttattgttgtatcttcaagtttgctgattttttcttttgcttacacaaatttgcctttgaatccctctgtaaattttccatttcaaatactgtacttttcagctccagaactttaggttcagaatttctttttttctatctctttattgataattacattttgctgttaggtagttttcttgactttatctatatcttcctttagttctatatcttccttaacatctttaagatggacattttgaagttttgtctatggatctgccatcaagtctttttgggtatagtgtcggttgatttttttttcctttgaaaggccatgctttcttgtttctttgtgtgttttgtgttgttgtaaaaaatggatacttgaatctaataatgtggtaaccctggtaatctgacccttcccccttcctcagagtttgtcagtttttgatattctttttatttatcgttttgctttttgtattgttgtaggctatctctcattctgggatcagcctgaggtaaaataataaattcttgtcaagtcttttctgaatctatgccttttccttaacatgcacagtcactttttaatgttccccaatatatacaattgcttttaaatatatcagtgtttaatgcctggctctcaaaagagaaaaaagaaaaaaaaattaaaaaattagttggagaagcactggaaagtcacttcagccagaggtaaaggggctttcaacaatggcgagacgtgaaaaatcaatggcagctcgtggcttgtctgcacctctctgataagaagcagctgtcagaagaacaaccccaaatatctggaggacagagtcctttgtgctcaccctggctccttacagttctgtccagtctgcttcaggaacatatgcatagctgtctaccacagcgatgtatgcggagaatgggtagcaggtgctgtactgagtgctaaacttgatggaagttaactgcaattttccatcccagcattcccctggaagttgcaaactttcaatagactccagggttccaaagagttacatcagacagattctgccagtgctattgttatctaggtggggagacagattcctggtgcttcctacgccaccactttttcagaatcctctggaatgaactcctttgcagaagcaaagaagttggtctttgttgagactacagacaaataatccataatagtagtactggttatagagtgtatgggttacagttactgacaaattttgagaagttgttattgatgctaatggagtactcttctacctgattctatttcctcagtaaaatgagaagcagttttttagctgaggatgagaagagggtttgaaacagaaagaaaaacagagattgaaaaaggagttgaggatttatgcaaatgagaaattatattgttgaaccttggaacagcaaaagtcactaggatcaatagataataggtcctgtgaggttgaaagatcactgaagctggatagataagaaacgaagactgaaaaatggaatacttgaaattaagattatgaagcagatgcagttattgacagtaaaacatctaggttatggtcatgagagtgggtgactaagacagcatgggaggcaaaattatgaaaggacagaaggaccaggaaatgagacaacaggattctaaaatggctgcacatatttttaaaatcaccaagaattataacagaagttggggttgagagagtaacagtaggcccatgtgctataaccctcaacaatgtggaagagaaaacccaagggggtgccactgagtaaaacaaggaagggaggcagttgtagaatgtgatgacatgagctacaaaagggcatttgtagggagctgcaagaaatcatggcctgaaaggagcattgaaaagcaaagagactatattccacgttcaggaccagggaatgggagaaaaaaattcacaacttagagagggtcacaggcaaagccacgtcttcggggaagagctattattcaatcacagctaagtcgttagagggatgttcagaaaaacaaacaaacaaaaaacagaaaatatgagctaacttattggaactatgaattctacagggcagagcaagaacagaacagctttaggagtcaaggagagtgggaggtggggtcagactgaggttgtcagtgccatatggggaaaagggccctgcaacaactaacataaacagagatgtgggacatgattacatgagctctgatagtctgtgagacagagtgtggtagactggcaaatgtgtgttggaggggagggatggtggtgttactaggagcacacaatgatctggactgtcctcttttcactcttctctaggtttgtgaggaagctttggaaagggacagaatcagaactgtgggcatatccataccagaatattagcagtaaatatcccggcatggtggcattatgcatgacactgattttctcattttttatttagtatttttaagtacaattgtcctgctgtgtcagtagtgggttcttcatccatggattcaaccaaccgtgaatagaaaacattcggaaaaataatgccactgtactgaacacgtaccacacttttaaaattcctgtaattttctaaccaatacagtgtaacaactatttacataaaatctacattgtatcaggcgttataagtaatctagagaagacttaaagtatatggaagattgtttgtagtttatatgcaaatactacgctcttttatgtaagggacttgaacatccatggactctggtatctgtgggggtcctggaatcaatccctcacagatatctgtatttattttaagtgaatgtgtattatggaatataaatataaatatatgtatatgcacacacacacatatatatacacaatatatacacacatatatatacacaatataagtgtatatatatgtgtgtgtgttgtcatttttcaacttaagtttaaaaaattgcctagaagggataaaacaaaaatagagctccagatatctaatgttcttttcagaaagaaatctttatatctctgttttacttcagctgtattttttaaactacttggctaaagtaaacccacgttcatagagaaaatcactattattttgcataaagttgtgaagtctaaggctgaatagagtctaacaatcatatttattgatgtgtctgttgttaaacactgagcagatgtctccattagagcctctataatgatgtctagatcattttagggagatttttactaatttcaagctacatagtgattccttccacatcaaatttttacttcttagatatttcttgtatttcttatcccctaatatggagactattaggctctcattatttctttcccactcctcagggttatcaggaggattataagcatgagctctggaattagacttctagtgtttgaatcccattgatgtctaaaagatatggcctttgccctcataatttgcaatgtaatcattgaagagaggcaggtacatcagtttctacaacacaatgtagacagaagtaagtatcataaaaataatattggctgaattggtagaaaatatcatggagggaatggcttttgagtggggattgaataaacagagtgttttaggaataaaaatggtgttaggaagaaaagttcaagcaaagaataattttagtgaaggtataaaaatgatgaactgctctcatcttcaggggagggtctagaaggatgggagtaaatattgagtaggggaaaattgagagatgtggttaaaaataccttgtttggacatgaatactagcctaataattctgatttgctttactatccatttgactttatggatcattaaaaaattttagtataaatgctgatcgctggtatatatctctctaagcttgtttctgcacatgagagcaatcaggaaaacattttcaatcaatcacttattttactagctggtgccaggcaaatggctttcctgattttttttcaatctttaaaattgacttaacgactatttttttaagttaattgggtggttcagggtaagtttaaatgcaaacaaaacacttagcataggagagcgagtgcgtaaattcacagtgggagcaaacatcagggcaacaaaaaaattagagccatttttgagtcattgaccacccacatttgagagttttttcctggatgaacattccttctgcctttggaaataaattaatgttttagagcaggggttagcacactttttccatagagaaccagatagtaaatattttgggccttgctggataaatagtctctgtcacaggacttgtctctacttttatagggtgaaaacacctgtagacaatgtgtaaatgagtgggcatggttgtcttccatctaaacattatttacatagtgggtagtagatcatatctgagccacagtcatagctggctgaccctgtcttagaaaattattgggaacaggtgtgtaaaaagttgaagtaaacaaatgcaatattaagatactatcacataatgatgaatgttcaccaaatgttttctttgaatatcaatgcaaacctggcctgactttgatagtgatacttccaactaagggcggaatccatagtcagcaaaaattattattttttgtatgtcttttgctgttacagagcagaggaaacaattaattcaacttagattaaagaaaggcatagtttaataataaatagacctcacagaaacacaagcccagaaactaacatagagctgggtatcatgagatataaaaatgggagtaaaaatttaggacagtaccaggtacttatttcagcccatgggcaatcttatttttcttttagaaaaaaatcttttaaggctgggtagttggcttatgtctataatcccaaggcgggaggattgcttgaacccagtggttatcagcctgggcaacatggtgagaccttgtctccacaaaaatataaaaaattagctgcgtgtggtggtgcatgcctgcagttccagctactgggaagactgaggtgggaggattgcttgagcttgggagtcaaggctgcaatgagccatgatcgcaccactgcactccagcctaggcaacagagtgagaccctgtctcaaaacaaaacaaaacaaaaagaaaaaccctgtaagattaatgttgatattatccccatcttacaaataagaaaactgagtcacagaccactgctaaagaagtttctcttggccacagcttagaaaatattagagccagattttttatccagccagttcacctcaggagccagtaatcttagacgttgaccaactggtttaagtcaatttgctctttgaagtttgagctaaactgtgaaaacaactaggatttatctaatcatagtagctaacatctgtgaatcaatatatgccagggctttatacaaatcagctcctttaatcttcacaaccctacttaatggacgaaaaaaagagacactgtcaccgaaagtgatataaatgcaattggtagagccaggactctatcctggtgagtctgcccttagagagtataaacttaatctttagggcaagcaaaataatgttaaaaaacataatatatgatgtgcagagaccaggctgctgaaatcagcaagagactgatttgctaggcaaggtggttcccagattatggaaccagtgaaggaggataattttttaatataggaagcaactgagaaccactgtagagttgtcagtcaggaaggtttgcttgatagcagtaaacactggagactgtaagggagtttgaaaaatgagggatccaaaagcaatcatgagttttgtgttatcctgcagaagagtgagagtagtaagaaactgagaagagagaattacttggagacatatttcaaaggaaaatattatttgacactgacaggtcacagaagataaagcaaaaaatagtcaagattaattcacatgcttagcctgggataccctgacaaatgatgttatcacagacaaactgaataagtttagttaaagaagccagtttgaattaaaagtaagtttggttaaattcactcgtaaatttaaagagatatgccattttggcaattacaaatctagagatggagtacagttcatagagcataaagagtgagaaaagccattcagtttagaggtgagaacaccatcagttacgtatgtctacaagagtaaattcaacagagtggtgtgaattgaaggtcatttggtggggatgaaataggttaacaatttgaaaccataacataatgagtttgcatggagtaataatgctcatgttagatttcaaggaattaataaaaacggcaaatggaaatacagttagcaggaacctagatcatgtagcacacatttcagaacctgtccataacagaaggaaactgcagtggtgactctaggacaaataggtagttttcctttcttttttaaagttggtgaagacctagtttttccttattgtatatttagttttcctcctatagctccaaggtaaaatatataagtgctatttgtttcctagcaatatttttcccagaagcagaatgataagttgtagaagagatatattttaattatttattgaaaatgtaaactgcttcaagcaatataacaccataaataaaaatggctaattttgaaagcatgagagtgtacacaagtctgataatttcaattctccatcaactcaaagaggcatcatgggagcattttatataatcttcactctccttgtcacaaattcaccctgagggaaactaatcttgatggagaagtctgactgtcttgggtagggaaaaatgcatatgtgagtattctcatgatgaaatttaaactatgattttggtgaaatatttgaaatgtaactaaaaatatagctttctccaaattgctacaatatagtttttaattatgttatctttctccttttttaaatctgtggatctattttcaagctattccaatagctaacattttcatttttaccccctactcataaggtaccactgtttgccgattatcatgtaagatttaattttattgatcattgcttataatgtgtgcctagagacagagaacaagcttccctatccaatttctattttcccttcaggttaataggtttccctttcccaatcattgagtattgcacataagaacaaggagaaaaatgtttgttgaggtatatttagaaaagaaaaagaaggaaaatcctcatttagtagtgatcttgtgtttttctctagttcattagaaaatcagccaatgtatgaagactaagctttaattaatgaagttgtcctatattataagagggttccaggatgtatcttacatgcaaatgttttcatctttttaaggtaattctattaatatacctgctgtgccctaagggtcctagtctgagtacatttatccctttagcaagatttgggggtggaggccatttgtattctcttctattcatgttggactttagttggtgattagacacagtagacaatgtcatgtagggttagatattcatgtatggcttagatgcaggtagattttacctccacaatcatatgaacattgagtgtgtctcattggatttctgtaagaatgacatgaagtgaagaatttaaacttcttgacaaattacatgacacagaaaccactccataagtgttagataatcttttgtacgtgaatgggaaataataatatatattcatattttcatgttttggcctaaaggaaatctagatattaaatactagatcctggtgggaagattatttttttttcagggtggaaactgagcagatggaggacaaggatggggaagatttttctatacttttgttatgtttttggactttaatccgtatgactgtattatatatttgaaaaggcaaatataaaagtcatctgagctttttgtcatcataatggtatcctttctgacaatcgttgcttttaatcctaaaatgtctcatcaagtgcctttgtctcacaatttatctgtagaacatatatgcttgtgtgtggaatgagggctactcagactgtgaactcagaacaggcaaaatgtaaatgctcatttaattgctgttttgtagatctaaccaatttctatgactgtgtgaaagtggttaatgaggtttttctttctctttatcagatgatagtccaccttctaagataaaccttctctgtgttgaagtcaggcttagataaggaataagttattaataatcatgaaatctaataattaatagctttattagaagactagggagaactgatttactactaatagtaattattcttaattacagctaacctttgttggagtgtacagtgcaaagcactttaaatgtattatttgatttccctagcaaccctatgtggtacatggtagacggtagatgctagattaataaaatgacaaataaccacttggaaaatttgtctaaaatcatgtggctggtaaatggtctcagagccaagcctttttaatgccaaaactttttaatccctatgctctagaccatcacactgctgtatgtaagcagctttcaattatgtagtttaagaaatttttatttagcaactatttctggagtaattagtgattgttccattttgtagggaactggggttgccaagtcgacagatattgggctcataattcatatcatgcattgacagcatgtatgcaattaaccatctcaagtggtagcactgtcacgacaaactgcctgttcagtctcatgcatttctgtagtattgtaatccaaagatagtggggtctcatagaataaaatcaaatatattatccatgatctgaactatcagatattatccatatctgaacaatccatgaaaacatttattgttttcctcaatatcactcaaaatagattttagccctcttataaagagtttaaacagcaatgataacagtaacaaaaatggctttttattttctggctaaattatactttacctatattcatggttgtttacaattaaaaatgatcattctcaatagaatgcatacacatggtcaaaagctgtatccacatattaccaaaagaaactggtgattttattttttaaaaaagtaacattcaaagtcgttttgttacaggaagaaaaaaatgtctatgaaagctggatattttacttttcatttatttttgttgtatcatgtgaagagagctggagattctctgtttcataattttaatatatggattaaattggattattcagaaaaattctacttatgacacttctctgtactgttttattacttgcagctacgtaactctaatcctaatagaacccctgttattcatgacgctatgtaagctttgttgcattattcatgtttactttatttaaatttgtgtctgtgaactgtttgatttgtgaggctctcaggaaactgtcatcaacagaaatgacaagaccaagcttgtaaattacattttttatatgtgctaaagtctagacttctatgttttgctaaagaaatcaccctattaaaaataataacatgtatccttaaagcagagtgtctatgatttataggagcaataggcttgctcggaagtggggtgcctgcagtatctttaccctgtttacttgttccaggtgcctattgacttctcacattgttgccactataacgcggatacaagctgaaactcacaattgttatgttttgaaacttgctaaggtaatgtttttctcttgccctaaatatttgaagatatatttgaatagatcagtgtcttttcacccatttttaaagcacacattgtcttgtgcttctctttttaataggatggagatgagtgagacttgttttcccatttttgacatgcttgagcaagaaaacaaagctttccaccatcccccaaatggaaaaactgcactatgctagatgggttttgaaaaataaaaacacaaatcaaaaccttctaacagcacatctgttcttctttacaggaattagacgatataagctgcagctcagaatcagaggtaagcattacatttaatctgtcatgcctgcaggtttttatgaagttcaaacattttaaaaggttcagcttgataaaactccctcattatgtttcttgaggttagtcctgtcatctttgtccagtgtctcactaacaacatttccagttcagtaagagcagacattgctcattgcattttatttgatctcaggctatttaatactataagatgttgtgtgcacaccattcctttgggattttaaaccattaggttaaaggtacatccaattatgtgatatctttaagcaacttgaaggtgcagttttatatatagaaatttaccactgaacgatactgaaatgaagttaaggttgtgaaacacactgacaaaagatagggaatccaaagttaggaatgacattttgtccttcccttgtgctatactgaaaatgaaggaagttgagttgagtacaagataaactcaaggacactgaggattttactttttaaaatgtccttatagatgcatcatacacaaggtaacaataatagctgtacttatggaatagccgggagtttaaaacaccctttcactgatacgattgtactggaaccttaaaacagtcctattcacataagaaatcggtgattttagtctgttttccccaatgagaacacagagaatctacaagtaattataattttttttttacaattgcaaaagcagtaagaaatgtagcagcatgtcagagcctgttcttcagacatcaaggttggtactgtctgtactacacagtctcactgctgcctataagtatatatgcgtgcacctatcaacacacttatgtacaaacacacataccagtggatagtgagaggaagaacaaaagaaccagagaccaagtaatatgtatttgctggataaattaagctgttctctctttcatgcaattcaattcaaactgctttaaacattaaaagaaatgtattggctgatgaaaacataaaagtccagagtcactgttcttgtgagtttcctagatttgtcctcaagtgtgccagatttactgtgggcatgccttgtgcttgcaaaaggtcaatggcagtttcgggaaatctgtgacccagagttcacagcataaatcctgagtttccaataggttgaaatagccatgaaaccatcctgtagccaagcgtaaagcacatagacttggattagcttcagtggtcatcatggtaagggggaatggaatatcctgtttgcattgaacagatatacttccccattatagagaaattgtctatctcatatgactacaaggatgttctgcaatggggaatagtatattaattctatgcacacaacctcaatatgtactataactctgttttagtatgtaactactctgtgctaggtatgtagaattctcattatttgactttaggtataaagggatacataagtgtactcctaaatatgtgtaagatcatacttatgttctgataaataaatccatcaattcatttttatttcattcagtttaatttttatttgtacacattttcatgtatggggtacctgtgaatttttatttgtacacattgtcgtgtggggttcatgtgaattttcttacatgtgtatagtgtgtagtaaacaagtcagaatatttagggcgtccatcgtctgaatacattttgttaactataatctaccctgctatcaaacattgaatcaatcccatctaactgcatgtttataccctttaactcatttctctttatactcccccttcccccaactcactcctcccaatctctattatctttctttccactctctacctccatgtgatcaaatattttcactccagcatataagtgagaacatacaatatttgcctttttgtgcctggcttagttcactaaagataatgacctccagttccatcaatgttatgtcaaatggcatgttttctttctttttatggacaaatagtattccattgtgtatataccacattttctttaaacattcattcactgatggacacttatctttgttatctacctttgttattataaatagtgccataataaacatgcaaatacaggtattcctgtggtatactgatttcctttgggtagatatcagtaataggattgctggatcaaatgatagttccatttttagtgttttgaggtatttccatcctgttttgtatagtggtttactagtttacatacctaccaactgtgtatgggtgctcccttttctctgcatccttgccaacattcattattttttgtctttataataatggccactttgattggggtaagatgatacctccttgtggttttgatttgaatttatctgattagtgacactgagaatttttcatataactcttggccatgggcatgtcttcttttgagaaatatgtattcatgtcctttgcacactttttttcttttttcttttttgagacagaatttctttcttgttgcccaggctggagtgcaatggcgcgatcttggctcactgcatcctctgcctcccaggttcaagcgtttctcctgtctcagtctcctgagtagctgagattacaggcacatgccgccacacccagctaatttttgtatttttagtagagatgggtttcatctttttttttctgtcgagttgcttgatttccctgtatattctggatattggtctgctgtcatgtgtttagtttgcaaagattttctcccattcaataggtttcttcacactgttcattatttcttttgttgtgcagaagctctttagtttaagtctcatttgtccatttttgtttttgttgtctctgctttggaaatcttagtcataaattctttgcctagaccaatgcccaagagagatttccctaggttttcttccagtatttttatagttttgggtcttacatttaagtttttaatccatttttgttgatttttgtatatggttagagatagggatctagtttctttcttctgcatgtggctatccagttctcccagcaccatttattcaagaaggtgtccttcccccaatataaattcttgtcagctttgttcaagatcagttggctgtaaatatgtgactgtgtttctgggttctctattttgttccagtgggatatatgtctatttttaaaccaataccatgtgttttggttagtatagctttgtaatatattttaaagtcaggtaatgtgatgccttcagcattgttccttttgttcaggattacttggttatgcaggcttttatttcactctatatgaattttagaactttgtacaaaaattctgtgaagaatgatggtattttgatagggattgcataatctgtggtttttttgggaaatatggtcattttcgtgatattcttctgatctttgaggatgggattttttcatttttgttctcttctatttatttaatcaatgttttgtaattttccttgtagagatcttaaatttagtcctaggggctttaatttttatagctattataaaagtcattggcttcctgatttctttttcagatagatgactattggtatatagaaatgctactttttttttttttttttttttttttttgagaagaactctcgctctgtcacctaggctggagtgcagtggcgcgatctcggctcactgcaagctccacctcctgggttcccgccattctcctgcctcagcctcccgagtagctgggactacaggtgcccgccaccacgcccggctaattttttgtatttttagtagagacagggtttcaccatgtttgcaaggatggtctagatctcctgacctcaggatccacccgcctcggcctcccaaagtgctgggattacaggtgtgagccaccacgtccggccgaaatgctactgatttctgtatattgattttgtattctgcaaacttactgaatccatttatcaaatctaagagctttttggtagagttgttaggttgttctcaataaaagatcatattattagcaaagaggaacaatttgaattcttcttttccaatttggattccttttacttatttttcttgcctgattggctaggacttctaatactacgttgaataggcatggtgaaagtgggcacccttatcttgttccatttgttagaggaaaggctttcaacgtttcccattcagtttgatgttagctgtgggtttgtcatatatggcctttattattgtgaggtgtttttttctatgtttagtttttgagagtttttatcctgaaggattgttgaattttatcaaatgcttgctctttgtctattgagattatcatatttttttcttcattctgttgatgtgatgtattacatttattgatttgcatatgttgaaccatccttgcatccctgggataaatctcactcaattgtgttatcttatctttttaatatgttgttggattttgtttgcttatattttgttgaggaatttttgtgcatgttcatcagtaatattagtctatagttttcttttgttgttgctgtgtctttgtctggttttaatatcagggtgatgctgctctcatagaatgagttagagggattccctcctcttcaagggggaattttttggaatagtttcaggaagattggtattaattctttgtaaatttggtggaatttggcagtgaaaccatctggtgctgggattttctttgttagaagattgtttattcctaattcaaccctgctacttgttattggtctgttcaggttttctgtttcttctcgattctatcttggtaggttgtgtatttccaatactttatctatttcctctcggttttccagtttgccaaagtatagttgttcataatagtctctgatgatctctttatttctgtagcatcagctgtaatgtctcctttatcatttctgattttgtttatttgagccctctctcagctttattagtttagctagcagtttatctattttgtctatcttttcaaagaatccacttatcattttgttgattcttttaaaaatatttatttcttataaataagttttattttctattcagtgggtacatgtacaggtttgttacataggtatattgcatgatgctgaagtttggggtacgattgatcccataactcaggtagtgagcatactactcaacaatgtgtttttcagccttctctctcccccttcatccctccctctagtagtctccagtatctatttttgtcatctttgtgccctgagtatccagtgtttagctcccacttatagtgagagcatgcagcatttggttttctgtttccatgttaactcacttaggataatggcctccagctgcatctgtgatactgcaaatgacatgattttattctttgtgatggctgtgtagtgtttcatggtgtatatgcataccatttcatttatccagttcaccattgatgggcacctaagttgagtccatgtctttgctattgtgattagtgttgcaataaacatgtgaatgcatgtgtcttattagtaaaatgattcattttcttttggaaatatacccagtaatagaatgggtggccaaatggtaattctgttttaagttctttgataaatctccaaactgctttccataatagctgacctaattgacattcccaccaaaaatgtctaagcattcccttttttctgcagccttgccagcacctgttgttttctgacctttaaataatagccattctgactggtgtgagatgttatcttattgtggttttaatttgcatttttcttatgattagtgttactgaacatattttcatatgtttgtttgcttcttatatgtcttcttttgaggagtgtgttttcatgtctttagtgctatgtgcctacttcaaaatgttagatctcaaaataacatatctgaatgtctaaatttcttgccaaacttgggctattttcatctattattttgttaaattgattttataattcttttattttctcttcattctgagaggtaccaataattcaaatatttggtcactttatgtcataccaaatcacaaaggatttcctcattcttttttattctttctgccttatttttttgtctagctggattatttcagaagaactgtcttcaagttctgaaattctttctgctcttaatctagtctactgttgaagtttttgattttttatatatattttttattttttttattttttatttattaatttttttttttgagatggagtctcactctgacacccaggctggagttcagtggcccaatctcagctcactgcaacctccatctcccgggttctagcaattctcctgcctcagcctcctgagtagctgggattacaagcacgcgccaccacacccagctaattttcgtatttttagtagggatggggtttcgccatattgcccaggctggtctcgaactcctgacctcaagtgatccatctgcctcggcctcccaaagtgctgggattacaggtgtgagcccctgcacccaacctatattttgtatttctttcaatgaattcttcaattccatatttttatttggttcttttcaaaaatatctatctctttagtgaatttctcattaatattatgaacggattttctgatttcttcacataatttttcagatttttttttctcactgagcttatttaaaatcagcattgtgattttttaatttggagtttgaaaaatttatttttgattaaagtgtattgctaaagaattattgtttatttagaattgtcatatttccttgctttttcatgtttcctatttgcttatgttgatatctgcacatcagatgtatcagtcacctttttctatttttgaatttactttgtagaggagtactttttttctgtattcatggtacggtgagtaggacaccttggctttgattctggctatgtgcaatactgtagtctctgtatgatttctttggcagtaaacagtgttacttctacctgtgatttcctcttaagttgtgattattagtggaggctgtggtgaagttgtgctagggactgggatgttaggtaggtcagtcttcaggcctcagtggtaacaaaggtgggttgagcatgccccaatgccattagcattgtaccccaaggcagtttacactagcccccatgttggcgattactggagagccaaatttcgagcctatgtgtggcttgcttgaatgctggtagtggcaggcagtggtggatcaggtaggtgggtgggttctcaggccactgggcagccagtgtgccatgggcagtggctcattcacagctcacaatctattctaagtagtgacactgtgagtttccctaacacctcactccaagcactgctaagccccaggacactgtgcagtcatccaagtgctaggtaagaaaatggtgccttgctctagccacttagatgtcagaaagggtgtaggacccagcatgagcgccctccctgggttagcttcattctacgatcccctgacagcttcttgtgttagtttcagggcttagagggctagagggactttcccatggctaagattggatgattccactgtgggaatataagctgctagaagcctctcacttacccattctagcatggagaactcactcctggctcccacccaattcctgcccctagacaaccccagccaagcaggctgcctttcttctttctctttccttgcttttcatattttctctcacttttttaagagaaaagagagagttttctctcttgaataatgtgttttaattgtgcttatccgtatactatttcagttcttctaagtagaagtgagcctaaaatgcttctagtcagccatcttgaagcctttcctcaaggcagtttttaaaaattcagtttatttctacttttcagtttccattatccttactctaacaaagccaaattttaatgcattggatagatatcttttattgatgtgtgtttcatagatttgttttattgttttgtgtgcaaaatagtggttgcctaagtcgtattgtgttatctaaagaaacaaatatgttttcttggtattcctatattggcacggaaacatctagtttatttcttcctattgttgtgtggttctacagggtgagaatatactgcaatttacttaatcactttcttattaatggataacaatttggcttccagcttcccacccaccacaaatatcattgcaatatatttctgccaacatcttcttaaaaagttgtatgagtatatatttggcttatacacctgaaaccagaatgagaatgagtttgaatgtgttatttacatacttgtttagatactgatgaatggctctccaaaatgtctctacactcccctctagaaatacatgaggcttgtttatcttcatcatctaccaaactcagcattattcagtggcttccaaaaactctaaatgctgaaaatacttaccaatttgtatgttttataaaggggtttaatacaagtaagtacttggtttaaaaaaatcagtggatgggatgcaaaagcaagtctagactgggcctctaagaattatgtcagaaaaaaataatcaaatatcttctaaagagagtttcaaccttgagaccaccatggaacttttgagcttaacaacatatgatgcagctgctaagttaaggaaactacaactagaaaggagctctcactatcactacagatacaaatacgtcttggtatctcctaagtgacactcagaatgctggagaatcaatcatcactgcaggagtagctcagatctctggactgatttctgctagcagaaaatagcaaaaaaggcaagaagaaggtctttgtcattttctatttaccaattttatgagcattcacctaacatacaatttgtttctagaatcttagctgcaaaggagtatggggaaaataggggttttctggcctctataatgcaaaaaagcacattaaaaccatgtatgaaaaggattttgaaagagccaattcatagcatccaccatgccaactttctaatggttggcagtctaatgtgtgaaaatgactttgtgccttctgtctattctttttagaactgggatttccatttctataaaatacatattttttaaactttctggttgtaatcttgattatttttgttggtttgattacagattctagataatagacaccttgccattttgtacaatagaaatattcctcataacattttatgcctgttgacataattttttaatttacagaaatacttatttagtgtgataaaatgtgttattgttccacagatatcctgtaatttgagttttgtttaacaaggcctttcttattcctaggccgtaaggatgaattgtcttttaataaatttataaatgtaataatgttttaaaaaattaatgcccttaatttatctaaaaaccattgtgtgtattttgataggtagagatatccttatccttgttttccccttttaagtaagctggtttttcagcaccatttacctaacaattattcattctccgttaaattgttttacacctttattgaatctcacgttcctgaatgtgtgcatgtgtgtgtatacatgagtgcacatgtgtttggggtgtttattttgatcctttaatgtatcttttgcattacatcaatgtcatccttttttttattattatactttaagttttagggtacatgtgcacaatgtgcaggttagttacatgtgtatacatgtgccatgatggtgtgctgcacccattaactcgtcatttagcattaggtatatctcctaaagctatccctcccccctccccccaccccacaacagtccccagagtgtggtgttccccttcctgtgtccttgtgttctcattgttcagttcccacctatgagtgagaatatgcggtgtttggttttttgttcttaaaatagtttactgagaatgatgatttccaatttcatccatgtccctacaaaggacatgaactcttcattttttatggctgcatagtattccatggtgtatatgtgccacattttcttaatccagtctatcgttgttggacatttgggttggttccaagtctttgctattgtgaataacgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgacggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttctgttgccattgcttttggtgttttagacatgaagtccttgcccatgcctatgtcctgaattaccatgcctagtttttcttctagggtttttatggttttaggtctaacgtttaagtctttaatccaacttgaattaatttttgtataaggtgtaaggaagggatccagtttcagctttctacatgtggctagccagttttcccagcaccatttattaaatagggaatcctttccccattgcttgtttttctcaggtttgtcaaagatcagatagttgtagatatgcggcattatttctgagtgctctgttctgtttcattggcctatatctctgttttggtaccagtaccatgctgttttggttactgtagccttgtagtatagtttgaagtcaggtagcatgatgcctccagctttgttcttttggcttaggattgacttggctatgtgggctctttttggttccatatgaactttaaagtagttttttccaattctgtgaagaaagtcattggtagcttgatggggatggcattgaatctataaattaccttgggcaatatggccattgtcacgatattgattcttcctacccatgagcatggaatgttcttccatttgtttgtatcctcttttatttcattgagcagtggtttgtagttctccttgaagaggtccttcacatcccttgtaagttggattcctaggtactttattctctttgaagcaattgtgaatgggagttcactcatgattaatgataaaggggatatcaccaccaatcccacagaaatacgaactaccatcagagaatactacaaacacctctatgcaaatgaactagaacatctagaagaaatggataaattccttgacacatacaccatcccaagactaaatcaggaagaagttgaatctctgaatagaccgataacaggctctgaaattgtggcaataatcaatagcttaccaaccaaaaagagtccaggaccagatggattcacagccaaattctaccaaaggtacaaagaggagctggtaccattccttctgaaacattccaatcaatagaaaaagagggaatactccctaactcattttatgaggccagcatcatcctgataccaaagccgggcagagacacaaccaaaaaagagaattttagaccaatatccttatgaacattgatgcaaaaatcctcaatgaaatactggcaaagcgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacgcttcatgctaaaaactctcagtaaattaggtattgatgggacctatctcaaaataataagagctatctatgacaaacccacagccaatatcatactgaatgggcaaaaactggaagcattccgtttgaaaactggcacaagacagggatgccctctctcaccactcctattcaacatagtgttggaagttctggccagggcaattaggcaggagatggaaataaagggtattcaattaggaaaagaggaagccaaattgtccctgtttgcagatgacatgattgtatatctagaaaaccccattgtctcagcccaaaatctccttaagctgataagcaagttcaggaaagtctcaggatacaaaatcagtgtacaaaaatcacaagcattcttgtacaccaataacagacaaacagagagtcatccttttttttattcctttgggttcacagaatactctaggctatatctcctccttttgtatttctttttcaaatttgagaacaatcattgatctgtattttccatataatttttcagttatttttattgatatcttcataacactaatcagagattttggctgagattgcattacatttataggggattatgtaaataattggcatatttacatgtcatttcattaaatatctctatattaaacaacaaagtctctgtcctccattagttaaaaatattatccgtgatattcttaactattagattggttgattcctaaatagtaggttgaaccatatgaatatatcatttttattatttataaaagggttggttattgttaaattcacatggttaaacttagtactttgtagttttattgttataatcaattatatatttcacttttatatttatttttggtgctgagaacaactattaatttgtataaattaatgatggtttatgcagccatgtctaatactttgttggttgtattgctatctttttctgaaataggtattatatcatctgccaataataacagtattatcactttccttccaatacttaacacctcattcctctttcttttcctacagaattgatcaggttatagggtatttagcatgcatgccaataaagaatattgttatagccagcattcttttttctcattagtaaaggaaatgatcacaattgttttctacttaccatacatttctgttatataagcttcactacattcagaaatttttttttagattttataggttgctgacagattattatgtttttgtcccaaatgtttaaagaaagatttatttgaatattgaatattgaaattattttttacaggaatctattactataatgaattatactaatggattctctaatgtttatcatctgtggatacaagtcatccaggtacagcttatatttcaagcaagccttccttgcagctaattagagttatatgactaaatatgggaaatagaatgatagtaaagttattgtgagtgacttacaggttatctccaactcaacacacaacagtggccctggacattgaccatttctcccttcttgactagacatgacaataactggagtgactttagaagccataaattaagtgttgacatgtcataccatcctgaaccaatcagaatctcccatgagataaaaataaacttctatctatgtaagtccctgaaattttgttgttgttgttacctcagttaaacctttatcctatctaatgatgtctttgaagtttggtgataaaccctaattcatcagaatgcattataacttttctaaatgtactattagattagtttgaataatgctttgttgtagattttagcatttctattaataagcaaaatgtggctaaaattttactttcttatataattagtatagtcaatattttacataatcttatatagaacataattttaaaataaaaattatattagacttttaaattaatcttgacagctttttctctttatttaatttccaaaaaagaaatgtgtaaaatgcatgttctctaggctgaattatatctgccaaaaaaatgtttaattcttaaccaccgggttctataaatgtgacctattttgaaaataaggtctttgcagatgtaatcaagttaatataacgtccctagggtatgtccacatccaatgtgactagtgtccttttaagaggatgagaatggactcaaaaacacaccgatgaaaatgctgcatgaagacagatatacaaaggaagacagccatgtgataaccaagaagagattaaatttatgcagctacaagccaaggaatatcgaaggttgcaacaaccatcagaagccaagaaagatcattgccttgctgacatcttgattttggacttctagcctccagaactatgagagaatacatttctgttgttttaagccattcagtatgtggtagttaattatgtgagccctgggaaactaatacagattttggcactgggaggtaggatactgctgtaacaaatatctaaaaatgtgcaagtggctttggaattgtgtagtaaatagagtctggaagtgtttttgaagcatattctagaaaagtttagattgtcttgaagaggctgttggtagaaatctggacattaaaggtgttctggtggggtctcagatggaaatgaagatcatgttttggacaccggagaaaaggcaaccctatttataaaataattgagagtttgatgatttggaaaattctcagctattcatatttcaaagaatgggaaagcatgttctggagagaaaacaccataggtgtgtctgaataaatttttgctacagagattaagcgtgtgactcatggatccaatcaactatctcagtagaaacggtcaccttggatgaaagatgatagaaatgaacaaagggcaggaaggctgttggactttttggttccacaaacagaaaatgggcagctagagctgcttggctagcaacctctgttagccttcaagaaaaaaataagaaaatttttaagggtggctcagatgccagtgggattttcaatgtctgggagggtgggatggttaccactgtggatcaagagggcagggccactgctattgaataccagaaggggatagggagccatctcagtgggttcaatggaaagagtcacggagaattattctcagaacttagactttaatggaattttctctgataggttacagacttgcttgggatatgtgaccctttcttttttttcttttttgaatttctcccttttggaatgggaatatctattctatgcctattccaccagtgcattttgtaaaaaaggtaatttgttttctctatttcagaggtccacagataaagaggaattttgccccaaaatgaacattacccagcatctcatccatatctgattctgaagttttagaagatgagatttgggagttgttgagttacttttatttagaagacattttggtgttagaggtcacattaggatgggttaagattttgggggatgttgggatggggtgaatgtattttgtatgtgaaaagatgtgggttggggatctagcaggcatattaatatgggttgaattgtgtgcccccccacagggatacgttgatatcctaacctcaagtacctatgaatatgaccttatttggaaataaagacattacagatatagttaatatgaggtcatcagggtggacctaatctaccctgattgatgttattttaagaggcgaacagacaaatgcatatcgaggagaatgctgtgtgaggacatgaacgcacgaaaggaagatgaccatgtcacaacaggaagagtttggaattcagaagatgcaatacaagaaatatccagcaaccaccagaaggagaggcagcgtggtcttgccaagatctttcttttagacttctagctctagatctttgaaagactaaatttctcttgttttgagccacccagtaggtggtcatttattatggtatccctagtaaaaaaaaaatattctggatagtttggtaattctcatttataaaactatttatcggtgaaaccccatctctactaaaaacacaaaaaattagctgggcgtgatggcgggcgcctgtagtcccagctacttgggaggctggggcaggagaatggcatgaacccaggaggcggagcttgcagtgagctgagatagccccactgcactccagcctgggcgacagagtgagactccgcctcaaaaaaaaaaaaaaaaaaactattaatacaatgataattattactattaatttctattggtgggaggctgcttctgagatggaaaacatgtctttagctacaatttaaatttacttaattctaattagtctgttaaaatattctatttattacatatttgtaatgaatttgtcatgtcatctattttctttatatatttattagcatagtattagcatgataatggccttttttttgttcaacagtccttcctttagtttatccctctttctcctctcacaattccttagaggcagcaaggaaaaactgaggggacccttttaatactttggctacaaaattttttagctggattacccaggcctttaagcacatttttctattaatacctgtcttttatcacagcatcctacatttgagtgccacaatctgaatttggtcatctattgctgcataaataattaatcccaagcttaggctcaaacagcaaacacttattatgtcacgaaattgctagggccagacaccttactttcttgccatatggccttctccataggctgcctgagtaccctcacatagtggcagctagcttcactcaggaagagcaatccaagaagagtgagagcccagcctaatcttcaaagagttatgccatcaactcttctgtattctatggtgacgcagacctattctggtacaatgtgagagactttacaagggtctgaacacaaggaggtgggggtaatcgggagcaacttggaggttagcttccacagttattaaggcataatctccaccatacaacatgaggagtgggctttgccaagagtatcaacatacattctgctggatcttcatctaatggtcagttgaaatggacatattggaatttattataaaataataattttaaatgatttttaaatgatttgctacacagatcagttacctgtaatgaaaaactaacagacaagtgatttttaaaaattggatcagtatgaggttcacctataatatgttcacactatcctggcccctgagagtaatattataataaaactcatttttataagtgacatcatcctagtcttggtatcaaatgaggcataaatggattgaagtgctcatttggcctaataatgtagcgaggttatttcaattagaatcacccagctactagtaatctgactatgttattggagcaattcctttaaactactgaccaagtcttgcctggctcagcaggccacatctaatgtgattacctcctaacgtgttatgacatttaggaattctatacaacaatcttaacaggacatagaaataccacttctataaaatgaactgacatgaagttaattctttaacgcatttcattaagagaaaagtgtttactttcatctctgcaaacaattccctcattaatctgggaaatatcacctgagaatgctattgaagtcgataaaatcaaataaaataatgacaggtaccgacaggaatgcaacaaattctactccaaaatatactcccctattagagctgttgtaaaccatgcttggattcggctaccttggcagaagatttaaaaagaaaagacacattcacagctgtgtaattagaggagaataagaccagcaattagttgtagagtaggtgttacttctatgttagcatctattttcagttttttatgttttgctttatttcctgtttcttgctgtctataagaatttccagacaaactttgagagtctgggccatgtttaacaaaatcacagaatactgagattaggaggaagtttaacctaatgttgccaattcctgtttagacttgtttcccttcgaagcaactaatttttacctctggaatttgattttgaccctaaacttaatggaactttagtgatagaactcattgccttctgaaggagtaccttctacaaaaagttcatttgttcaattgcaaagttctttgtcatatcaagcttgtttatccacttgaagttttcatatgttgacataaactctacctttggcaatatctagcacaagtctcatttctcttcagcaaaaaagacccttaaaaatatttatgataaacccttttgtatttttgttgctaaaagtggaatcacctcataaagctgaatgatagcattactgagtctcctgagatgggcttgtcatcacatttttctttctgtgtgcctttacgacatcaagaaggtgcatgattgctgtgtatttccagctcatgagagatttggtcttgctactcattgacatggaaggttagcctcagtcaaaagagttcaatagtcttccccaggagtatacttcttgactcacagtgacacaacaggataggtgaatgaaataatcttgagagtctgtatgctagtataaaactagtgagggcagacattaaagactcataaaattaaaaatcaagagaaaggtcaaatcagatgtgaaaagtattgtttcttaaggaacttacacatccaggatgatgtcaaagcgagagacagagaataaagaggggggacctttaagtcaggaatatagcatggtatgtgatttgaagcatttactgaatgccaacgctatgagtgttcgagtagtactctggaatgttgagggaggggatcatttttaatactggaatgagaacctgggaagtagggtaccaaaacatgttgaattgattcaagattcaattaacagggatttattgatgttctatattgaggcaggcaatgtttcgggtacagaatccacagttttaggcagtgagacactcacaaacttacaatgctattaaagttgtgtggcaatacactgaacataaataagacatgatatgctgattttgaagttgtgaaagagtttgtatctggattattgattttatagtatattttgccaatagaagttataaaagtattatggtatgatttttattgtgtacattttttgtggcttaataccaatgagaagttgtatttgccagatgttatatggtttaaatacgactaaaaatcttaagttatagtttacttgctctggttggttctctttcagtttgtttgctctccctgaaattttagatatcagtgtaaggaaaaatgagtgagactgccatagaaattcagagctttttacatagtccaactcagtatagtcagggtaatggtgtcaatgagctttgtaaacaaaaattgctgtgggaaaatttctcagggactgtaatagtgagatgaagcccctaggttcatactgtggaaccaaaggcaagacactgagattaaagcattttgtaagcattaagtactaatcataagtagaaaatgatcataagtttttaaaagaaaaaaatagcatatacatagaaaaggattttttaatcaactgggcttttagatgttactagtaattgctaaataatattccagaatcgtctttataaaatcatatagtactagagttttagtttcagaaaggtgggatagacatattttccctatttcctcctgctaagtacagctaaaagccctgaatattatatataaaataaacataagaagattgaaatgtgaaaggaggaaggcaactggctaaaggccttaggacccaaacactaacataataggatgctctctgggttttctttttttactcagatcacaaacttaaagaagccagaaacccagaaataccaataggtgtagacaaacaaaacacaacaaaaaactctaaacaaaactctaatctctctagccaaaagatgaagaaaaaatatagtgagacagatagctgttagataatagctgctttactccagccaaacaccactaaaaagatcatagtcccatacccatcagcagaagccaagtggggagctagattttcctgcttacaagggtataataagatactccaataccctatcatgatggtgtcagagaaggcagagtaggaacataggtctctcactcctttcagacaataagctcccttcttccactgcaggatcaatagagacaacatatggagcctggacttccactccaatcatgcattaatgatattctcctccctgtttcaactgggtgctatcagagcagactcagtagaaagtcaggacttttaccaccaaacacacattttagaacaagaatctaagacatattttagaacttgaaaatattacaactgagacaaacaaaacctaaaactcaactctctgtgggcgagcttaagagcagaatgaagaggactaggggaaaaaaaaattagagaccttgaaggtctctgataggatcttcagagacaaaagaaattacacttctaaacaacagaaagactgcaaaaataaagcaaaaaataagaataacaaaacccaaatcctcaagaacatccgggagtataacaagggatctaacatttatgtcactggagtctcagaaaaagaggagaatgaagctataagaatattcaaagtaatgttggctaaaaagttggaaatttgaataaaaggctaaacccttcagatttaagaaactgggcaaacttcaaataggataaatccatagaaatctgcaccaagatgccttggagttaaacttctgaaaactatatcatgaaaaacaattttaaaggagataactaacactttccctacacagggaagataattttaatgacagaggttttctcatcagatccatagagactaaaaggaaatgacacaatagtttttaagtactgaaagaaaagaactgtcaacccagaattctacaaccagaaaaaaatctctcaagaaagatgaatcaagatagtctctgatcaaggaaagctaacagaatttctccccagtagatttatccaaaaagtcttaagaaagttctcaaaaagaaaaagaaatgttaaaaaaaatcttgggacattaggacagaagaacaacaaagaacaaaaacaatctgggtaaatacagaaaaattccccactcctcttgaattttgtaaatcatgtttgatgtttgaagataaaattttaacagtgtgtgctatagttctgcaaaataaaaacaaacaaaaaaagccactaccaaccaaaaccaaaacaaactaaccacaacgctgcagctgggtgtcagtaaaagtaacgttctgttgcaaccagatattaaatgtttgatctccatggtcgctttccatggatttggacaagaaaatgaaacattcttcaaaaaacattcatgttgtatacttaaaatgtaaatttttctacttaaaggtaccaacatctttggtatgggagaggacagaaaagcagaaatggagtattttattctctgaaggaggtaaattaaataagaacaaaccataaataagttgagaagtataaattaaatactaaatgatgtaattcatactcaagtgttagagaagaatagattaagacacaaacacgaaggatttgggctggactttgaaggatggaaaagacttagataaaattaaagacaatgcacagtgggagaaaggacacagaaataagcatgggcatggaagcaaccaggctgagatccttgatgtcggagtgttgtattagttttctacagctgccctaggaataaccacaaactgtataacttgaaaggacagaaatttattttctcatagttgtagagacaagatgtctgattctgaaattcgggtgttgactgacagaaccatgctcctcctgaagttctaggagatggtccttccttgtctctcccaagcttcttggcattccctggtttatggcagcataaactccagtctctgcttccatcttcacatgtctttttccctctgtgggtctctgtgtccaaatgtcctcttcttttttttttttttttttaacagatttattttatttttttttattttattattattatactttaagttttagggtacatgtgcacaacgtgcaggttttttacatatgtatacatgtgccatgttggtgtgctgcacccattaactcatcattaacattaggtatatctcctaatgctatccttccccccactcccccacaacagtccctggagtgtgatgttccccttcctgtgtccatgtgttctcattgttcagttcccacctatgagtgagaacatgcggtgtttggttttttgtccttgcgatagtttgctgagaatgatggtttccagtttcatccatgtccctaaaaaggacataaactcttcatttttatggctgcatagtattccatggtgtatatgtgccacattttcttaatccagtctatcgttgttggacatttgggttggttccaggtctttgatattgtgaatagtgccgcagtaaacatacgtgtgcatgtgtcttcacagcagcatgatttgtaatcctttgggtatatacccagtaaggggatggctgggtcaaatggtatttctagttctagatccctgaggaatcgccacactgacttccacaatggttgaactagtttacagtcccaccaacagtgtaaaagtgttcctatttctccacatcctctccagcacctattgtttcctgactttttaatgattgccattctaacaggtgtgagatgctatctcattgtggtttcgatttgcatttctctgatggccagtggtgatgagcattttttcatgtgttttttggctgcataaatgtcttcttttgagaagtgtctgttcatatccttcgtccactttttgatggagttgtttgtttttttcttgtcaattattttgagttcattgtagattctggatattagccctttgtcagatgagtaggttgcgaaaattttctcccattttgtaggttgcctgttcactctgatggtagtttcttttgctgtgcagaagctctttagtttaattagatcccatataaagagaacattagtcattggattaggggccgctctaatccagtgtgacatcatcttaatggctgtatttacagagatgctgtttccaaattagtcacagtcacaggtaccgagtgttagattttcaacatatttttcaagcactagtcatatttctcaacttgaagatgtgaaaagtagtactttaggtgggtttgaattttgtggagccttagaaactatataatatttgcatttgataaagagccatgaaactgattcaaaaccaacccaatactgtataaactctttctcactttaaatatagacacatacaaatagaggagcatttctggtagatttatagatagtaaatttgtaatagtaaatttgtaatcaaacattgataatgaaatatcacatcaaactaggaaccaggagtcttcatttctaattctgtcaccatctctactatgccccatgaccttaagatacaccttagcatgaatatgggattatttttaccatctatgatatagataaatttctcagcttcataataataaacatttttattgcatgctatatgtcaagcactaatacatatgctgaactatttacctgaattgtctcatttaatagttaaaatattcctatgagttaaatcatattatccttactttttaggtgataactaaagcccaaacagagttttgaaaactgcctcagtcaaagggtggtattaagattccaacctatatttatcttagtcaacagctaggttcatagccagtattcaatcaagggttcacaaattgtgagcccattgatgatatatggcccaaagatatatgttcttagatatacattctgttttaaaagaatgagccaacatctaaaacatcaaatgattttacattaaaataatttttataatattttgaaaaacttagtaggtcttgaacttctctgcccaaacttagctggaccttaagaacatttgcccatgcatttgcccatttagatattcatgcattctccacttaaatgtaatccccagctctccctatcacctccaaacacacagtgtgtcaattatgatttgtcattgagcttgcactattgttttcttcttacatctatagtggaacttctttttacccatatttcaaataaaagaagtggaatacttctttttacccatatttcaaataaaagtgagaaaattaacaataggctgaaatatgttatttttctcatgcctctcctagattcttcttttatgtgaacttgctggctcctataggcatgtaagtttgtaactcctgccatattgcctctggatcagtgatctcaaccttggctgtacacatgaatcacatagagagatttaaaaattcccaatgttcagtctgcactctagacctattaaatcagaatttctgtgcatggagcccaggtatcaatatttacagcatcccactgtgcagtcaatgttgagaaccactgctctagatattctttaagatatcttctgttttctaaattctaaatttacaattcaaaagccagttctaaagattggaatggttcgatatgttgtgtgtaagctgtatattggggatgtgggattgatgtagggacactgactgtggatctttgcttgccgagctaagcaaattagaccaaccctttagatgtgcagcccattctagcacacaacattgacatccagaggaaaagtgtcataagttagtcttagttatggggccaacagtttacgtgacctaagaaagtcatttactcagtctcggttttattttcttttttcaactatgactcaacagcgctcatatacaatgctgtatgcaggtcctatatttgcagtaaagacagtatcagaaaatcaaaataaagtacattcaagatatatacttactataagaacataaaataaattttttcaaacctactgatttccaacagaaattcagaaacatagggggacaactgtactgcagaaagacatgtattcagaaaggtaatcagaatgtgaaatgtttactgcaatgcttaggtaaggaacttttgcccctggctaccctccaaggtctagatgacacatgtctctggtgaatcatgaggttgctaattgtaagctttatggattcaacaaccagcactgagaagacctgcaatgatcagcagccaaagccaatggcacagcttggagcccggcgctttctgttctttgtgttcatactagttcattctctagagaaggtcagagtattccatacaaaactatgctcagttttcaagtgtgaagcttccatgacaggaaacacatcaaggcttttgacagctgataactttgtacctcctctctgaggggctcctgttcagaacaaaaatgtaatatagctccgggtgttatcagagctgttataaaatgcacttgggcattctgaggattcatgcttaatgcctttctataatttgtgcagaatgtgtgcagagtccttacagcatgctaataacattttgttatgacacagtgcagcaccacagagccaacttacataaggatagaacaatgatgtagaaggcaaagataaagattagaatttcaagttaaaaagcaaggttttatagaggccattgataggttggaggtaaagcaactgacaacaacttaaaatagttaaagacatttaggcatatcttagaatgagactcgactgacattttgaaggcaagcttataggaaaattaatcacatgaggagtgttcattgactttctatagaaaaagtattgagataaatttgcaggtattcaataaagtagagtgcctatcaaaataggcagcctgcgttaggacgtcaccattttccatacatgtgtgtgtttttcttcctaaaaatattgtctatatatgccagaaacaattgtggctgaaataaatttcttgtatcaacaggatctcagcttataactttacatctgagaatgaagccaaacagaagtacttgcttttgtttgtggcattgctcccgatttatttgaatttagtcctgtcactggagttcaataaagtcaggcagtgaatccatatggatttgggtaatagattgatgttctgataatgagaatcaatccagaattaaaattaattttaggtgaagagtaaatacactgcttttagatactcatgaaactctgcttccttcttgtaagtaatgatgagaatgacatggatatgtgaagaatagaatgcagaataaaaacagaataaatcttcatgtgtttcataaacaaaatccagggctggtggtaagtatatcaaagcatttgtgttttatctttgaaggaaatatgaaatgttacaagtttttcattaatttatgtagacactaagtaggacctgagagagaaataataattatacaaaatagtgttttattggataaatgcttttttgttaaactattgtacttgagtgagaaattatggtgtgtattttctttatattcactattgtgcattttgagatgccattatgccaacagattataggcaaacctgatgattatgctctgaactgcatccattatatttattaaaccaccttttctactaccttttatgaatgtttaactatagaaacttcaacgttttaaaaatgatttatataatcaaatcattcatgtataattaattctactaattttcatgagtgtttcaggtcattttggcataattagccattgttgagggttttctcccccatcaattaaactaattgctttccacataggtatagattgaatattgatccccatttttttcagctcacttgcataagcaaattatgcctaattgccagcttactacatcattacacacttatcatcaattatacaaaaatatactctgctagacaaatgatttctttgtggcattttgaagggctttttaattgtgatgcttagaacagtattgtcattttaaaaaatattaaacaccatgtttaaaccaataacgcaataaagcgtgttattggttaacaaacataccagctcctggctagaccatcatttaccttggaatataaagagtgtcttaaaacaatttgaaggaaactcattgttattaaatatagtaaatccaccaatgcaaatattagaataagttctttctaaattttttagcttaatctttatctttcccattccacatatttatttcttctctacctgacgaaaagtctttgagaagatctgaagaggtggtgaatttcaaagaatcactatacagaacacaccaacatttttaaaagtcaggagataaaagcaaccccattcatcatgcattctgtgcagagcattaatgtcttttagtgattttactgggcatttgtcttcactagtttctcagttagattctttaaaaagtacagaaagatatgaaaataatataatcccaagattctccttacagatttctacaccctatgacataattttcacacattagctctccatagagaatggagataaaccaaaagccaatattaaaatgtattttaaaataagtgggaggactgtcctgatatgacagtcttattttaatccttggctattccactaataaaatcatataatatgagccacttttacattggtgctcacctcatggaagccagacttttctcaacaggatgccacatttagcaaagtaggcctccacaggctgtatctaacacccacaaacaaaagctgaggatgcgaaaaggttctaaatgattctatcgcttgaaactgcctgataatgagtcttgaattacctgtggggatcttgatgatcaattctttatttacactttaggactaaccttactcttttcttattcaagaaagttggggaagacggaaagaagaagagtatagtaaatattcccttactcattgatatctttttaaaaccaaaatgggacaattttagaagaccatttcgttttaatcaatttaatgtaatttaaccattttctaaaattggatgatgattttgtgccacaaatcctaggctcagcttatggaatcacaggacatcagagttagaaaaccaatgggagatttacatagctttaatcactgacatccagtatctatttgaattcctctagtggcaggtgacttgtttttacctagaaagcagcacataatatttcaagggagcttcagtcatcacaaggttcttagacccattcatcccatctctgcactctttcaaatcttggaaagaacttatatttttctcctcacaggttatagtttgtgttgataactctcataaatgcctactcttttccattgttgaccaaacatccttagatctacattctccttgtatagtttcagacctttcaaaatctttgtctacggatatatttcatgcatatctcttttttgatggcatttaaggtctgtgaacaggaaggtagcatttatagaaatcatgaaaacaatacaaaattataaaacaaatgccaggcgcagtagctcacgcctgtaatcccagcactttgggaggccgagatggatggatcacctgaggtctggagtccacaaccagcctgaccaacatggagaaaccccgtctctactaataatacaaaattagccgggcatggtggtgcatgcctgtaatcccagctacttgggaggctgaggcaggagaattgcttgaacccgggaggcagaggttgtggtgagccgaaatcgcgccattgcactccagcctgggcaacaagagcaaaactccatctcaaaagaaaaacaaaaacagaaacaaaaaacagacaaaaatctattattttcccctttacatagcttttaaaagatacaaatacaaaaattcaccttacataaaatatacatgtattaagaatgctagtagagaataatacataaagttgtaaaatgtgtgctattttcatttcttaaaactggaattatactgagttgttattatatttgacaaaaataagatagaatatttaaaaatcttttacaaaagatggcatcaccaaactgttgattcatgataacttttaatatctgaaataaattttgttcagtctaaacactgctaacaagaaaatatcatgtaagtttaaataccatttgatattctttgggtctttcagtttattttatttttacaaagttttatgaatggatttatttaagtaatattataatgtaaataacaagtcaaaatcaggggtttgaaagaatcgtttctcttaaaatgggtctgaaccttattcgagtttgggaaacactgggctataaaataaaattaaactttggattggtatgccaggccttccatgatctggccctcatggtaccattgcttcatgtcctgtcagtctcttagtcaaacctgaggtcccaccaacactgtaatttccatgtccttattctagctgttccctctacccaggacaaccttataaacctactcagaaaaaataacacatcacagaccatagataggtcttgggattttaatcctcccagaatgacaattagaaattacctactcaactgaacaaaatggtacaatctgtctaccatctcatcatgagatatgtatgaagcagtcttccacattattgtgagggatagactgagcacctgtcaggccaccacaaggaagtcaatacgttccctctaagccagagaagccaggaccaatagcccagacaaaacggaaacttcaaaaaacaggcccccatcaggcttaaaatggtcactcccagtcattccccacaactgtcttaagcattttgcttgataaatacagacttttgaccagaagagataaacaactttgatgttaaggttgttatcatttgtgataacatttcgattgattttaaactttcaatggtacttcaatgatgtcaataatacaaacctgatttaaagctgggaatctaaaatgaagtcaagtatttgctgaaacatttctttattatgttcaaaatggtaactttcatatgaaaaaaagattgacaacctgtgtcacacctttactaagacttcacaaactcttttgtggccagtgttacttctgctttcataatggccgcttaaagacatcttgtattgtttatactgacaacacatctgtatttcttattgttgactcaaaatcctctctcattaacttgaattaaaatagaaaatagcactggtcaggcctaaaactactcagcaaacatgcactttaacagtaaatttacaactctttacaacagaaaccgcgcactcttctttaattgctacagagaggtcagtctttcaaaccaaataagagtaagagatgctgcttttatcatagccttatgcaattgtaaaatagagagcaaactaaggtctgccgttctttctccacctgcttacttttggttatatctcatgacagattttgaagccgatttcaaagggcaacatctgttgtttgaactatgcatggaaagtttacataaagctaaatttatagatagctaaggctatgaaaagtattagaagaggatgctgaagatacaaaagtaaaataaatggtgaatttggatgaatcgtagtgaattaattctctaattgcattacttattctgttaataggaagacatttgagcaacttatatatggaggggttcagggcatgatgccccagaatgtggctccttggcctttgataaaacagcagaatgaggaaggtcagtctctgaccttctcccatccttctcccctgaagtaggtcacaagaccctcattagagaggtattctggcagaaagaaacatccttatctctgaaaagacagagaagaatctgaacaaatggccttaacaagtttattaccattacatcctagaccctttgttcatcacactttcccacaactgtccactttgggtcaaacctaagcataaagacgaacaggtttcctgtttctttaggtcttcatttctgaaggctctcatgtcatgtaaagcttatatcaaatatatttttatgttttcctcttgttaatctgtcttttgttacaggtgcctcagccatgaacctagtattggatgtggaaaataaatcttcacccatttataatattcatgactccaaaacatgtcctcttttaatatcccaagctgggttttattccaggcctccctaggggtgtcatgggagaataaatggcaaatttagaattctttatacattatattagccacagatatatatatacatatatatatatatatatatatatatacacatatatatatatatatatatacacatacatatatatatatatatatatatacacatacatatatatatatatacacatacatatataccttttatttttttgagatggagtttcgctcttgttgcccaggctagagtgcgatggcgtgatctcggctcactgcaacctccgcctcctcggttcgagtgattctcctgcttcagcctccagtgtagctgggattacaggcatgtgccaccacgcctggctaattttttatttttagtagagacgggatttctccatgttggtcaggctggtctcgatctcccaacctcaggtgatctgcccgcctctgcctaccaacgtgctggggttacaggcgtgagccagcgtgccaggcctatatatatcttttgttaagaaattagaatttactctttaagatagagttaggcctagtggggtattttgaaaatgtttctgaaaattcgcctataaataaccctgataattttacactgtctttaaatttactggagttctaccaaatgcctaaagcaaataagtgtggatgttaaacattaaaggcaatacttctattccaacattgcaaataactgactgctctgaaccttacttatgaatggcgatacttatatgacatattaaagtttagagtgcaagatgtgttttcctgcctgggacattatatttgataattataaactgatattttaaaatgcatgcatgtctttattatttttaaaaaggtgggtttcaatatgaaaacacctttgtcatgttttccttcttgtgtgtttcatggattagaaagcaatttaagatttaaaaaaatgtttactgaccaacaagtgttttgtttagaaactgtgaaaaatagaattgctgagctaaagcaggcgataaaacagattgagtttgtaatacattacttacaatgtgtgcttaagacatccacaagtaaaatgtgtcttattataaaataaatatacatatatatacacacacacatagtgttttcaaagcacagtgaattaataccaacctcaaatttcattctcgctgcacaaaactaactttaaattacacagtagttttctcagaaaccaatgtcagatattaaagggtctcatccatctataaaatgtaatagttgaaagcatccatctgatagtctgggcaagaaagtgctaggtgaggaggaatgggataaggagaagtgacaggacagtcagaccttggtaaaaatcacttcattggtttaattgaacaatttctctaccatagagtaataaagaaaatatcacacccagtaacaatagatagtttccaagttaaaagaaaaatctgttgcacctcgttggcgtgttctcataacaagtagaacataaagttattagcatgcaccatattccattttaatttctgatctatttatctttctctttcattaaattattagctcctttaagacatatcagtatatctctaaaatctaacaaagaacacagtgcccaacacgtcgtagagaatcaaagagaattttttgttttctgttaacctttatgtttaatcattatgtctacgattcttatttgcataattatacctttaaaatacctaattggtgtgaaatgttttggatgtaccaatcattgttttttgtttgtttgttttttcttgagacagagtcttgctctgtcacccaggctggagtgtagtggcgggatctcagctcactgcaacctctgctttcaaggttcaagcgattctcctgcctcagcctcccaagtagctggaactataggcacccaacaccacacctggctaatttttgtatttttttagtagagatgaggtttcaccatgttggcctggctagtctcaaactcctgacctcaagtgatccacctgcctcggcctcccaaagtgctggaattacaggtgtgagccaccatgtccagccccaatcactcttttaaagcttttctgcattaactcattcatgttacaacaactctgtgatgtaggcactttgatgtacctgatttatccacagttgacagatgaataagcagggtatagatcagaaagtttaattttccaatgtctaactgtgaataagtggcacagccaggatttgaatctaggccatctaagtcatgagccatagcacatacccattacataaaatatctacattattaaaactaaacaatgctttggagtcaaagaatatttctatagttggggcaacaattttttaaattagtcatcatgattataatataaatattattatttaactgtaaatttaactagaggtggcaaaagtggatggctgagagtcgaggcaggtaaaaacttaacctgggtaatagtgaaggtgagcagtctgtcttcagactataaatcattaagtcataggcaacctgagctatcaggagaaagctcagaatatgacaggaagagaagggagctgaaatggaagatgtgaaaggtgttgtagagttcaaacttgcctgagctgatcatataacctgtttcaatgaacatctttatttctgccctcattttgttatttacctagatggttgttcagtttccatgtagttgtgtggttttgagtgagtttcttaatcctgagttctaatgtgattgcactgtggtctgagagactgtttgttattatttccattcttttgcatttgctgaggagtgttttacttccaattatgtggtcaattttagagtaagtgtgatgtggtgctgaaaacaatgtatgttgtgttgatttggggtggagagttctgtagatgtctattaggtccacttggtccagagctcagttcaagtcctggatatccttgttaattttctgtctcattgatctgtctaatattgacagtggggtattaaagtctcccactattttgtgtgggaatctaagtctctttgtaggtctttaagaccttgctttatgaatctgtgtgctcctgtattgggtgcaatcatatttagaatagttagctcttcttgttgcattgatctctttaccattatgtaatgcacttctttttctcttttgatctttgttggtttaaagcctgttttatcagagactaggattgcaagccctgcttttgtttttgctttccatttgcatggtaaatattcctcagtccctttattttgagcctatgtgtgtctttgcatgtgagatgggtctcctgaatgcagcacactgatgggtcttgactctttatccagtttgccagtctgtatcttttaattggagtatttagcccatttacatttaaggttaatattgtcatgtgtgaatttgctcctgtcattatgatatagcttgttagtttgcccattagttgatgcaggttcttcatagcatctatggtctttacaatttggtatgtttttgcagtggctggtaccggttgttcctttccatgtttggtgcttctttcacaagctcttgtaaggcaggcctggtggtgacaaaatctctcagcatatgcttctttgtaaatgattttatttctcctttgcttatgaagtttattttgactggatatgaaattctgggttgaaaattctctctccatatatatatagagagagagagagagtgtgtgtgtgcacatatttgttctctttctctggagaactctaacacatggctgttacaaatcataatatgtacatatttctattgattatctattaaggagtaaaatttctgggtcataaagtgtgcataggtctgacattagcagacaatggtaaacaatttctgaactaggtcaatttacactgtctccaatataagactaccatttgctctagagtctcaccaaaacttgatggcatcagtagtttttaatgtaaaccttgccattgttttgaagttattttaattaacttatcttggtctcaaatatatatttgttgttacctagaatgtaatctgctgatcatcagctaattatgagaatgagacaaggtttctgcttccatagctcagtggataaactgtcttcatggtaaaactgatcagcaaaaatatttctcaccatgctgaaatatgctgtgcttgttcatcacaatctgcctttctggtcttgtggtcaaaaagtatcatgctaatcctaaatgcaatctgttccttgctccatcaagttgatattagataaaaactgaccccaacttgatacctttgctagctccaaattggtgtgctaatgggtgatttggagatttacagtcttttaaaacatgatttttgtatatccccccaaatataaaagctcctcaagctgcttgctacaaacacctcctctcttcactgttgcctgcatgagagtcttctcttttccttctgcagctactgattcactgcaaaatcaactcagactaagtgcagattttaaatagcatggcgaattgaatgatcccagttttaaatatgtcaggaaggtaatgtggagttttctagtacagccattagttttcctcctcctgtgttgcagctgcaaacacattggcattctccaagactgcctcaatatactgtgtgtgctccacccacgattacaaaataattggagtgttaagagaaacatggcgtgaggtgttgggagttggaaggctggccttcaggagcaactctatcttctcccttccaggcacttgatttggtttttccttagttcagattcgattctgaatctgaaaatgttgcctaagccctaattcagaaatcctttgcaagagagctgaaaaatttgctccaaaaaagaaaaaggggagagttctagacagaagtaatcagctacctgtaatcataactttagcatgcttttaccaaaagatgattagaaggatatatctgcttcatcagtgatttttaagaaaaatttcattttcttattgatagaaagacacgtggataagtatactgataaatggctgagactatccagcacactaacaaggtagcttcacacatttctaggtgtgaaaaaagtgctgggaatgttaagtggatgtgactacaacatcccctaaatgagaccagctttctttcagctcttttactttcaactaaaagtgaaaaatgtttatcagctgaggtcaggcactggaaatgagtagtgaatgtaaaatacaagctgtacagaattgttccacatctaaacctgtgggtggatatttgtgcaataaccccaagggtctactttattttaacttttcagcataactgaatggcatagcaagtcacttatctgttcaaaattcatgagagagacagaaaattgataaactcttgcaaaaatttcccagccttctttctaagaagaaccacaatggaaatttgctggcaaaactaaaaaattattgtaacaatattagcaaggggcatgctttagccttcagtgtttaaaaaaaaattcccttcctcatgtacacaacttggtatactcttagcaaagtttgttatactcttagccttttggaaaaggagaaagcttttggtatgcccaatatgaaacaaatttttataatctttttgtaataatttaaagtaagtctatgtcatttcagaatgagcacagtggaaatgaacaatttttacaagtagtgaaatagtcaatacacaaagtattatttattgttgttaatatgtttcaaataatgttaacagttcctagcacatagtaggaacatagaaaatatttgtttctttcaatatcagtcattttttattggcgaccagctaaaatacgctctagctgatttaagtggaaaagggattcattaaatagatattagatgcttctcagggtgatggggaagcctgaataatgtggctcaagaaataggcagtaaacaagtgtctcatattttcagctccctagtcatttatgtatcagtcatttattgcttgtttctttcctaaataaatgatatattctcttttcctgtgtttgaggatcactttgaagatcctcaagatcctcaaacataggaaaagagaatatatcgtttatttaggaaagaaacaagcaaacaaatgatgatgaaaatggtgtccaatgaaaatactaaaacgtatgattacatggtttatataatttgggtatcaattagtttggttaatataaatagacaatgtggaacttttaaacagaaggttaaagccttctctttatcttcacctgtggaaccctcagaacttcagattagtgttaaatccattctgttgtaatgagcacctttctaagaactggaagcaaatctaaaaggaagtcattgaaatcagagggaaaataaaatattctataactgataaaggggaagtgttattaaccagtttaatggatatatttttaatacatagtagaaatgtctttgtttgtagaaatgctctaacaaggactcacttcatttcaactgcatcacagcttacctgtaatgttttgggaacttaaaacctacaattcttcatttaacatacggagtcaacctttatttttaatgccaattcttgatacttaaaataaagtttcaaataaagtgacaataaatgtatcaaaaggtcttcctaggatagatagcttgatatttttcattgccaaaatctcataaacaccaagttgcatacatgaattatattcacacagcatacggaagtttttttttctaaattctctcatttgagtatttttttctcaactactgggccatgactcatgagcatgtggagcagatgtacttggttttatttatctatttatttatttgcatctggtttgcataggacagaataaacacaaaataaggacctaaaattgcttacttgggtgattgaatgcatttatcaggttggtctattactatcttaagagctacacgatacaggccaggcgcagtggctcatgcctgtaatcccagcactttgggaggctgaggtggggtggatcaagaggtcaggagatcagaccatcctggctaacacggtgaaaccccgtctctactaaaaatacaaaaaattagccgggcgtggtggtgggcgcctgtagtcccagctagtggggaggctgaggcaggagaatggcatgaacctgggagatggagcttgcattgagacgagattgcaccactgcactccagcctgggcgacagagcaagactctgtctcaaaaaaaaaaaaaaaaatggagagagagagagctacacaatacaaaatgccaagttatatttcataaaaatttcaatgaaatagtaattatttttctatcattaatttttatcacgatattacaagtgataagaaagaaatcagaaacattttctgccaaagtaaaatgaggtgtatcattcatataataacatgaatattaagcagttttcatatgctagcctatttaatcctcacaataattcagtgtgggaaatagagttcaaggtacccttgaacaacaagggggttgggttgctgacccctcatgcagtcaaaaattcacatgtaacatttgacttcccaaaaacttaacttctaatagcctagtgttgactagagccttatgggtgacataaacatattttgtatgttatatgtattatacaatgtattcttacaataaagtaatctagagaaaagaaaatgttgttaagaatatcataaggaagagaaaatgtatttactgttcattaagtggaagtcaatcatcatagaggcctttatccttgttctcttcaggttgagtaggaggaggaggaggagagttggtcttattgtctctgggacggccaacgtggaagaggcaaataaggtgaaaggagaggcaggagaggcaagcacacttcctgtaacttttactgaaaataatgtatgtataagtggaccctcccggttcaagagtccaccgtattatacttaatttgtttttagagatgaagaaacagagcaattagaaatttgcccaaggtcacatacttgtaagaggtgtatatatatatatatgtatatgtatacacgtatatatatatgtatatatatacacgtatatatatatacgtgtatatatatacacacactatatacatataatatacatatgaaaatatatggcatatattatatagaaaatatatattaatatagatcgctacagaaaaagatttaaggagtttgaagcaatataatcagtgaattttaatagaaaagactcacgaaatgcaacactctaccctactttgttaaggtcaacagatgctcagattgcctttataatgcaataatatgtttaatatttttttcttatttttttagacagagtcttgctgtgtcacccaggctggagtgcagtggcatgatcttgactcactgcaacctctgcctcccaggttcaagccttctgagtagctggaattacaggcatgcaccaccacatccagctaatttttgtatttttagtagagatggggtttcgccatatgggccaggctggtcttgaactcctggcctcaagtgatccacctgcctaggtctcccaaagtgctgaaattacaggcatgagccatcgtgcttggccttgataatgtttaactcatcccactttcatacctcaaacaaccagtaaattagtatactgttccatttgtctgtatagcacctggtattcaagccattttcctaccagagaaaatattctccagagagaatattttttctttgctgaaataaaagttgatgggcagggtcttgcttttctttttttagatctgtatgaattaattttgctttgggctgaatgtttatgtccccttaaaattcatatgttgaacacctaatcaccaaggtgattgggccttgggaagtaattcaattatgagaaggaagccctagtaaatgagattggtgaacttagaaagggcaccccatagagtgcctttcttcttctaccatgagaggatacagtggagaaggcaacgtctatgaaccagaaagtaggccctcaccagacactgaacctgctagtgctttgatcttggatttcccaaccttcagaactgtgagaagtaaatttctattatttgtaagctaaccaggctatggtgtttatattacagtagcctgaacaggctaagacagatgtactctcagtccctggggaagtacaagttgtcctctttccccatttctttcctgtgtatgcactagccttagctctgctcttctttacataataatattacaaaataatttcatttacagaataatatcatttttgttgtcaatatcaattattttttatacaaggaattaaaaaccttgggtaacatttttctagagtcttactttctcttggttatgactttttcacccatttacacgtgtgacacatatatcacatgtgtaaatacgatgcatttgcacactgttgcaaatagccaaaatattccataataagataatttgcctgggcttagtggctcatgcctgtaatcctagatttttgggaggctgaagaaggtgggaggactgcttgaacacaggagttcaagaccagcctcggcaatacggtgagaccctgtctctacaaaaaataaaaaataaaatagcctggtgtggtaatacatacctatcatcctagctactcaggagactgaggcagaaggatggcttgagcctgggaggttgaggctgcagtgagtcacgttcatgccactgcgctccagcctgggtgacagagtgagactctgtctggggcggaggagggtggaggaaagaaagaaagtgagaagaaaagctttatatagcagagttgtctccatgttttctgaacactgtgcatcccagtctaaatcagtaatcatattgtaaagttcctcaggacctgactctgtttcttaagcagaaaataaatgtattgacatataaagggtagctcagaaaattaaagaaatatttgaagaacagttgtggggctggacaaatataagagcacttcaggcatctagggaatagaacattattattaaattatgtaacacactctctatgggataaatcagctaaaatgatcttcagtatttaattactccactccaggttagatcctataggaagtgcaactggacaaacatgaatcacttgcccacctactttctaggaaagcacagaatctcatgatggataattttgctaaatggtccatctatcaaagtgaaattgggagcttttaccagaatacaggaaaagtagattggcaaaagcaacagatttctattacaactgttaacaattttaaaatagtttcgttacaaagctgttgaatccacaacacagctgcaatcttagatcaatattttcagtgtcactcccccacctttaaaaaatctgaatatgacatcaattcatactttagacagttaattagattaagaccactactttattgtggcagaaaaataaagtttaatctgagattttagacgtcttcaaaattagaacagggaggtttggttgatctttgaagaattcattcctaaggtaagtgaaaaataacatctcaatacaaataaatgtatccatgaatgaaaggttagcatgtactcagtatctcaaccctttgttggaatgtgaggaaggctacatccttacagatctgacgttctgagactctcagggcacaggaactgataatactaaggcatatcaggccttcttgctcagtgcatctggggaggctattgtagttctaaggttataaacatgcaaacatatactgtcttcttcaaagctgcctcccccttgtctctcttattggcagcagaaagtagagcagagctacaaatcatgcacagcaatctggagatacggcagggcagcctcgtgtcggagtcgtaaatctgacaccctggccaatcagtgccggcctcattttattcacggcatgttcatcgtgcaggcaataggagcgggaggctgctttctgtccttggcttctaaccacatggttgcatcctggtgtgtttttctatttgtgtatatttgagagaacaataagttatgtttatgctttcctttcaagaaggagagtctatatttttcatccttggacttaatcagagcctaatttttgtaaaaaattcatttacttgaagtacaaagctattgtgtgttgcacttggggtttctttttgtgttgttttgataaagaaggattccaaggccaaagtttcccagtgtcattttaagtaagacctgcaaaatattcagggtcttaggtgaaaaaaaaaataccgagtagaaaaagtactcttccttaccatatgaccactttcagccttgctaggtggaaggaagtggctctgtcaagtccatattccagcagggctcaaaatttacatccctttgcatatttccattaaaaataatataagcttccaattcaaatgtataattttgcataatcattgcttcccatcttctctttgggtcggctaaaataaaagggaggagaaagcatagtttacagaaagtaagctttaaatggttgagccatttaaaatcaccatttttgttagtaaaatatagttcaacactgagtattttgtatgtttcaaagtaatataaaattattctatactaacaatgaaaattagagaataattatgactgaatgggaactaaaaactagatgggaataggtaaatggataaacaagtgtgaagaaagctacacatctcaaggttggtcttggtggtcatgactgtaatcccagcactttgggaggctgaggcgggtggatcacttgaggccaggagttggagaccagcctggccaacatagttaaaccccatgtctactaaaaatacaaaaaaattagctgggttcgggagtgcacaactgtattcccagctattcaggaggctgaggcataagaattgcttgaacctaggaggcagaggttgcagtgagctgagatcacaccactgcactccagcctggatatcagagtgagaacctgtctccaaaaaaagaaagaaagttacatatcccagaatatgggagcttggaaggattttggaatgagtttgtttaatgggtctctgaaggctatggagtcaaagacagtaagccaattagagggcactgggcaaacaggccccaaatagtaatcatatagaactaagccaagtagcaatcctatacccactcttagactataggcatttgttatcctcaagggaaactccaaattgggttcttctgcaaagcaataaacagtttgaggaaagttaagttccgagtgtgggtgttggttctaacagtaagatcatggtctgctacaatttggatgtttttatcccctccaaatctcatggtgaaatttaatcttcaatacagcagtgttgggaggtgagacctaatgggtaatgtctaggtcatagggctccgtgttaatgaatggattattatttttatttttataatggcaataccactaaaaaataactttcaggagtggattctttctcttccactttctgccacatgaggatacaatgttaatctctgtttgttcttgcaccttcttccacgtgaggatgcagcaaaaagccctcattggacaccagatgcaggtgccttgatcttggacttgccagcctccagagctgtgagaaacaaatttatgttctttataaattacccactctgttatttttgttacagcagtacaaaatgcactaggatatagtcattctgccatttggtggaaagtgtaatagctggttagctaacaggtccaggtcagacctcataaaacaccatgtacacagcctggtcaaatgtccaacttagtaaagaaaatcaaatagaaactgtactactgattaaagcaacaaagaaagtacctaacattcttatttcttacagttaagctgtgcttatgaaaagatctagcagtatcaagaaactcagatataagtctactctaaaagaaaacaaataactctgcacacaagtgagaacttagtaaaatccagtctataattaaaaatttgagaaagtattgcattcctaaaatagaaaaagtttggtatgtaaaaaaaaaatcagatagcaacaaaactgtcccagtttaaaatactaagggataaatttttaaagaatggggaaaagataaaaatacaaataaaaatataagatgtaaaggactgacaaaggaggtccctgagtaataagaatcatatatcaaaaaaaagccaactgtcaaataaattatgaaagaaaatttcctagagctgaaaacaggtattaaaatttagattcaaagggctttaaaggcccagaaacatacattttttaaaaagtcaatcatccttaatcatatctttatgaagttttagaactgcaactttttgaaggaaaattattctcaacttagaattctataatagtcagactacaaatcaaatgtaaatcttaaaaaatgtgcaatacgtagaataacattgggcctttgttttaacaaaaccattctttaaaagttacttcagagcttggcttggtagcacactcctgtaatcccagctactcaggaggctgaggcaggaagattgcttgagcccaggagttccaggtggcagtgagctatgatcacatctgtgaatggtcacagcactccagcctgggagataaagcaagactacatctctaaaaataaataaagaaagaaagaaattacatcaggatacgctctggaaaaatcaaagagtatttcaagaaaaggggaacacacaaggtcaggaaacagtggatccaaccatcagagttatgatgagaagcactgaaatggcagctgaacttgtgacctaaatcacaaccatgtggattaaaacaagaggaagcgattcttcatgaaagaggtttacagaaaacgtgaaactacagaatggctagtaagatcaaacatttaggaaaacacaaatacataaggcaaatcatgactaaaaaaaagaggaaagaaagaaaaaaacagttataaattcttggaaaaatgtaacatttcacaaaaagtcatggtccaattttgaagcaatgtaacctgcatgatggtttcaggcaattatgaaagatgatttattttaatgtgatgctaagaaaattctcctgtgtgtgacacaagagtgcagaaattggatcagagacaattaaatgcaatctacctataatactttcttggacaacaaaaaatacttatataattttaaaaagtaaaacagactttagcattaacccaaggacagtgtgtgttaagtctgcttgcagttggaatataaagtaacagttaatatgcaatacctcaacaatataaaagttgaagtgtgactgacataagatagtgtatttacatggaagagagaggagaaggaaagatcatgccaagagaaaatactgtgttaatagtcataatgtaaataattaaaattgcagttgaagtattttaatgttaaaattttaaccaaattataattcattacaatatatttatatgtattattatatataatataatgtataatgtctatttttatatatatagtagtattggagaagaaaatttttaaaagtagtatgagcaaatcaaatccttattgtgcacactgggaagaaagtagaaattttgtacaattgacagatcaagaaatagttgtataattatattacttaagatttttagggtttttcattctaaacagtggaacacaagttgaagaagagggaggcaataaactgtagctttttaatagtgagtttttctgtacagttttgattagttatcagggccatctattactccagtaaatattgaaatagaaaaaaaaggatggaattatatgaaaaaataataatggcctttattgctttatggtgagattacagattttttaatctactttttgcattgaaaacacttgcaataatgtatatatatatttttttgatgataagaaattcagaagtatccacaaataatttttttaaataatatttcattgtctacaatgtgttgtgtaatttgacagaaatttttatgctttttatctattctgtgaaatgatttatccatttgcgttcccacatgaataaactgaggctcactgaaactttttaactaacacaggttcacataaaaatatgccattgcttcaagcctaacttttggcttctcaaaatagctcaccacactctatctccaaaagcttatgacatgtgtagggatgtgactagtaatcttacaaaatagggacctgaaagatttactgcaatttacctgaatgaaaactgatttaacactcactacccacattaagatgattttttaaaaatagctgttaccataattaacccagatttataaatcatctctaaaaaaatctggccccattgatccaattggtttctgcacactcaattactaaagctgaacattctaaatagacttgcctgcccctttgtggttctgttgtgttgaccctacccttgttaaaagtatgtattctttattagactgctcatctttaaatgcctctcttcagcatttgttagttgtgtgacactgatattcccattttgagaccttcattcttcaactataaaataaaaatttaaaaagtactgcagttgaaaatgtcagttgtcttccaaacatctattcatccctttttcattgccaacagaaccccaatttgaggtctggaaatatgatcagctaaatgtatactacatctttctggctgccttaaagctaagggttgccatgtaacagttccaaccaacaaggtgtaagtggaagttggctgtgggtttttgagaaagcttactctttcttgatatgaacaacaaaaaaagaagatatggtttagactgtcctacctatctctgttttacttgcttcaaataaggacgcagtgcaaaaagccaggtctgcaatattgtgagcatgtggaggtaggtgtagtggaaaggacaagagaattgcaaaagttctaactttgatataaacaagatgtcagctgcttaacctttaaattttgtgtgacataagaaaaaataatgggtctaagccagtagaagtggccttctgccatttgtggcctaattaattgctttctctctctctcttttttttttttttgacaggattttgctctattgcctaagctggagtgcaatgacatatgattgcttactgcagcctccaactcctgagcttaagcaatcctaccacctaaccctcctaagtagctgggactacaggtacttttcaccatgtctggccaatttttaattttttttattttgtttttgtacagacaatgtctggctctgttgcccaggctgatcttgaactcctggcctcaagccatcatcctcctttggcctcccaggtgctgggtttacagggtgactcactccacccagatgtggccaaatgaatttctaatggattctaatgtctttttcacaggattaaatcaaacaatacatataaataattaagattagggccaagtacatagtgcataataattattggctacaatggggttaaaggaggaaattttaacatggcatagaaatttgcaccttgaaattcagcctttttatctcattgctcaggaaacaaatgttcagagcatgaaatcacttgatcaagataattcatgtgatctttatttctcttcataagttactattatgaaatgtgctatttattaatcatctgctatgtaacaggtgttccacaaaagtccgggtatagagtaatgccctcacaaaacttccttatagtgtcacacattctgggtctaaaacttgaattaaacccatttaagatttaattacatcaaatattaaaaagtgttgatactcaggtttagcttgaatcttagcagacaggatatggtctaattaaaccactaactacatctgctatttatatccattaactttaattttatagtgtagttcatagaaccaaagaaatggctgagatgccaggcttggttagggtagaaacaacggctaatccaatcatccaggtcgtaggagtcagcctaacctcagcattgacactagactatatcaactccaactcttgttttttctgttcttgaattcttccacttgactcagaaactagaaggggctggggaacgggatggattgttctaatttgaatgacatattcactccttggctaagagaggtacatcaccttgactgacagtccaccatattgctcacaatgggagtgaagttactccccaggaggagattagtgtgccacctccaaaagaaagtggaatgcagaacaattacctatgcaattactgaaaccagagctctagcaaaaagtataaaataaaaatgagagactatggaacttagataacaccctggttctgaatgggaggggggtggtagagctcaaaaagaaaatattagaaccctagccaagtcccagaattaccttagtcagtccctgtgtatcagcctgtggtattttgtgacaggaaaggaaaaacagtaaccctgccttcttactctttttggtataccttaccaattctcttttatattccaagaagttcttgcctgaaatatgtaacagttaagtgttgtttttctccttgcttatattgactttgtgaaaagagcttatgaaatgtagtgttgctcagtcttagaaaactaggccaggtatccaattagcatatctctcttgctcacaggactatcaggatgattaaggagtgttccttctagcagagaaaaaggtcttctgagctgggagtcagtttgacagactagtctttcattgacccccttcagctctcctttattttacccttgatttttaaggagggtgcttttactgttctttatatcactcttgctgtcattgttactgcagttgagaatgctttgattccccctctgtgtttaaattctttatcttcttctatttcacacattcaatgttgtagccaattgccaattctgtttgggcaattcaatgatgcataacacttttaagcagagtataactgaaagggcaaacttttgtaaaagattattattaaagataaacactttggatggatggatggatggttggatggatggatagatggatgccacaggttctgtatactgtgcagaaccccttatgctcatttctcatttctgagtgtcttttctcctgtttcagtgtgtcattgatctcaatcagctgtacctcaaagtcatatttggcacactctcctagggcaactgggacacttcccatagtcatgggcaaccagaagtgcttgggagtttacatcagtctctcaccttgaggacttcaatcagtggctgtatgttgtggaagtataaagtcccaggatctgatgagatcagaatgaagctacatttaatagggcttggcctgaaatcatacccttgcttggcttcttccccttcagtgtcatgtgcaaaatcccaagaaaagaactagttaatttgtctaagaacctcagaaaacactggcacagatagtgaagaagaggaaaagtagtataagatgaagttggaaagagacttaagagtcagatcatgccaagacttataaggagtctgagtattattcaaagcatcgcagttcacatctactagccttttctccttcataggaaaaactgcaatcaagaatggtagccacaatgggtagttgccatggtagtgaggacaagtagccaatatttacggtattgtcattgctggtaaaggaagcatagggtatacaactaattttctaatgcaattgttgcaattgttagccaggttgtaccaaaggaatcttcctattcttcatcacaaaataattatccttaaaaagagcttggaatcaagaatccagagatatagtgctaatattcaagagttttcacattatgctaaatttagccaaatgttgcaaaatcatggttaagttgacataggcccctgtctaagctgcaactcttggttgaacacatcaataatggtgtttaagcatcccaaattcgactgatggcagagaagccaaattgatcattttgatgtaaaatgaccttcatttgcttctgttatggttctgttctctagggaagaacaaataatttctaacctatgcttagctaggatgtgacactttattatcaatttattgataaggattatggtgtactatagattattatttatttatcttatgttagtttatcaccacttataatctgctaacttttctaaaaagtatcaatagaattagttttattttttcattgcattaagaagcacatttttaaataatctgaaattgtttttacataaacataatttatctaagatttagattttaataacactacattttgttagtgcagacttggcctccatgcttactaaaacataggtagtttaattagctgatcacaatatggaatatgactattagacgagaatatgttttaaaatttgttttaatatcctgtaagagaaggcaaatcaacaagcatgtggagagaaactcttttcttgatctacttacttttaaatatattttggcacataggaccattattcacaggatccaatttatttcaacttacaacttattagtaataataatatatgtagctttatatctttatgtgaaaatcccaactatgacttaagtgtgagtgtcatatcctgcaatttcacagatacttagaagtgatagatgaaaatcatatatattcttcttgtttactgaagatatttaacaccagaaaaagattaaggaaaaagaaacactctccatatgtattcatacatttttaatgagaaaaaaagaaataagctctgtcaaagtgctatttgtagctatttccaaatttaattttatgttttaaaaagtttttgaagtcccacctaagataacatctgtgaggccagaaataaataaaatccaagtgtatttaaaagaaactaaggattaaaaggtgagcagaacctgaagtggataaaaatttgtcttttcaatttacttggtgttcattttgggaaattagcctcgtgacccccagcctaaatgacatcatccagtgaggttgctaaatcagtgtgataagacccctggaattgaggaagtttcaagaaaggatgctgaaaatctaccatacattgagttactgtagattaatggttcatggcattatcttatttactcctaagaacaactgtatacattagatattattatcttcattttatagaagagacaccaagtgttggagaggctaatgacttaacatagctattaatcagcagaggtacatttaaaatctgaatccaaatccagaaatcacaaagctagcatatcccctctagtaccagcctggtaattgtgatttatgtgcttaataagaaatcagatctgttttcatgaacactatgtttaataaatcatcttattgaatcagaggtcctaactgtctagcctgaactaaccaactgggttctagtaatcaagcaattaaagacaacagtttggaattgtaggtgacataaggcaggtaaataagaaggaatcattcctggttttgcatagccacatacagagcacagtgcctagagcagagcattgcagatccattgaatctgcttttaagatccatctagtgtgcctagaaaagaaacaggaaagaaatcacaaactgttaacagatagaataatttactaaaaatgtcatactgcctgtcactggtttattataagtagcataattcaaatgaaacctacatgggctccaaaatgttacacctagaatacagcaagatttgaccatgactaccctaaatgatatatgatcagtccattttcctttgctataaaggaatgcatgagactaggtaatttataaagaaaagaggtttatttggctgacagttctacaggcagtgcaagcatagcaccagcctctgctcagcttctggtgaagcctcaggaagcttttattcatgacagaaggtaaacagggagcagacatgtcacatggggagaaagagaggaagagagaaggcaggccaggctctttaaacaaccagctctcacgtgaacccgagctcactcattactgtaggaagggcacaagcaattcatgagaatctgacctcatgacccaaacacctctcattaggccctacctccaacactggggatcatatttcaacataagatctgtaggggacaagcatcaaaactaaatcaatatagttcaccaaacatatgcacagtgattcttagtcaacatcaggttggcagatctaccctgtgagatttatctagctatttaataactgccaacatactactttttaatctgactttaaatcaaatcatcacgtatatcataccagaaagcaaattagaattacatgttattaatttaccaaggaaagccatgtgccaaaaacatcttttggaatacaggaaaattgatcagaaatttaacttctaatttaatattggttccccatttattggtagtaaactataaatgctaatatccgatggtaggattaggatgagactctttgacctagaacaagaggatgaggcgtttgcgctcagctttgtagaaagctttgtagcttgggaacaaacaaatgctcatcattagcggttcagtttcttcaacttctctttctctttttcttcgcctatcaatcttataaggtttgtttctctcctgttccgttcaaagatctttgctctaataaaaagcacaatttaagaagttttctcattctggatatactttttactgcccaaagtacagcacagagaattaagttttcaaaaaccaagtgatatagaagaaagaaaaagagattaaagaacatgaaagtgctacagagactcaataaaatatatgtagtttttttaactctgaattttcctcttttgaagacaaccaaaatcttttaaaacacattatcttaaactattttttatttgtatcagttctccattaagttatgaatatatatttttaaaacagctttggaaaaatacattttctgttttattttgttctacaaaatatagatagaatacttctccgaaagatactattttcctagtacacaggatatgaaatctcagaaaagtataaaaaaagaatacaaagcttataggcttgtgatgggacttaggagaaaagtttggacaaagggacaagcatacaatgcatcttccttctcttcagacagaaacagtattaataccaaaagaatatgtaaaagtgagcaattccctctgtattcacacaatccaagcgagtgtgaatgataatgggatcttgaatctctcgtaccagacatcagtaaaaaaacaactatgtcctgtcagccttataacaaaggagcttattaagataaatgatacttttaagataacatctaccataatatgctacacttggtattcaaatgtaaaacaagccaaagtcaatatatccattgttctccctcttaattctttgccttaatctccttcacaacaaataaaattgtaaagcaaatcaactgctcaaaactaacagtgccacttgtcctatgtcaaaatttgtctaggacagtctaaattcaaatattcaattcttctatggacaatgcaaatttatttatatcatgcttccttttaacaaccttgataggaatttcaaaacactggagattaactgagtaaattatgattcaactctataatatatagtatgcaactaaaaagaatatctaatgataaaagaaaatatttaattattttgctaaatgcaaaaagcaagtttcataattttatattcaatatgtctacattttatagaactatacagatataatgaaagaccacaaggtcatatgccaaaatattaatagtaattttttaaaatgatagacttccaggtatcttatatgattgacttgcatttcttttgatctcaatcagagtagttgaattattttcttgtgaaaatgtactatccttgtttttgtttctgtatgttttctctatgtaaatcctagcttttcaaataaccattcaaattcttatgctttgtattttattttcctgaacataccagctaatgtaaaataatctttctttccaattcttgaaaccaaatgtaagctccttaagggaagaatctataacaatttgtacttcccacagcaactatattagcagagaaaaatgatttggtaaataaatacctgtgagattaaaaagaaaatcttaaggatgtaatgagatttgcatacacacagacacactctcacactttctttaagaggaggctcttcagtcctatttatttcacccaactctcatcaagttgcagactctgaaccaaaaggaatcttaggaaccctccatactgtgctgatttctcctccgtaatagtctctttgcatccagctgggcttgaatatcttcagccacagaaaaatcacttaacatatggagctcattctattgctacatatgtcctaaatactaaaacattattttaatgcttagccacaacacacacatgcttaaatttaaaaaaaaaaaaagtcagtaccatcccctaggtaatcatgtttgtaacactttaatgagtttaaggcctgagctctaaattataatcaaatgttaagttaaaaaaaatgaagcatatagaattttctgctttcttcatgttgattgcttccttatacttccttattttcaatatgtatcttacttatttaaggtatattttaaaatttaatgtgatggcagaaaacaaaatatgaaaacaatgcatactattatatatttatcaagatttgtgtaatttagaccatcatttgaatcttacttcttatatttcgatattttaagaattaagcttatataggtaaagaccaaggttacagttttactataataagttatataaaaaacaaatatattgaagcagagcacagcaaacttttcctgtaaaggacctgatagtaaatattttcagctttgggaactatacaatccctgctacaactattaatctctgtcattatagggcaaaagcagccacaaataacatgtaagtgaatggcgtgtctgtttagctgtgttccaataaaactttatttattaaaaacaagcaagatttgaatttggcctgatgtaaacatagtttgataatccctatactattgggattactcatgccattgtcctaatgaactacatagtttaaatctattccatcaataaggctatgtgcatcaggatttattcaattgaacgtgtatttgttaagctcatcatataagctcagcattgtaatcaatcaggctttatacagtcttatttaagattgcctagaaaaacagactaaagattatgcaacaaatttgagacatccaagtggcaaaaccaagtaattcaacatgaaatatttatttgaggatatgaaaaaacaaatgtacatgcgtgtgtatgcacacaggcacctgtaacaatagccttgttttcctctcttaggaagatataaataaaagcttaaatggctttcatgagagtagaagagatatcatgttatttcgttctctttttaaagcattctagaataaataaacagtagttgccagaggacctactataagcaattctggacttgacccccaaaaatgttacctctcaaaatatttctgaaggatgagctgaaggggagtaaacagtgacttaaaatctgatagtagacacttttcatgatccttgaacaaggatctatcattatgccttagtgtacctctggttcataactttgacacacacaatgattattcctcagtggtaatgaaatatttattaaatacagataatatttgatagggtttagatatctgtcccttttaaatcagctcatgttgaaatatagtccccagtgttggacgtggagcctgatgggagatgttcggatcaggaggtggatcactcatgaatagccttgtgccatctttttggtaatgagtgaattctccttctattagtttacctgagagttgctgtttaacccattctccccaagaatattcgctggtggtgcttgtggctgcagagtttaccctgagataactcgtgggttacagttctaaccttacccccaaagtttgccagggaatatctcaattttattattattttcacattgctctaatatatcaacttgggaaacaaaatacatcattctatttatagcattctgtttttagtagtggtatttctatttacaaaatatagtaattctcaattgctgaaaatgtcaaattctatacaacatagaattcgacattttctgtgttgttccatgcttcaaaatttgaaatttactaacagataaacattattaaatactgatcgtcatatacatttctattacattaagattagagacaagttctgtttacaaataactccaagaacagtttttagattttattttcacattgaaaatcaattagatttgctcctacctcaaagagcatgtttgtgtaaaattaaatgagtactggcagtgagctgcactttttttttctaaatgagaaatgggttaaaagagtgttgcacctcttcctctcactcattccctttcttgtcatgtgacatgcctgctccctctttgcctcctgccatgagtaaaagctgcttgaggtctcaccagaagctgagcagatgctggtgccccacttgtatagcctgcagaactgtgagccaaataaccccctctttttaaaaaataaattacccagcctcaagtattccttcatagcaatgcaaaataaactaatacagaaaattggtactaagagtgggctcttgtataaagatacctgaaaatgtggaagcatctttgttactgggtaacagtcagaggttggaagagtttgaaggtctcgaaagaagacaagagagaatttggaactttttagagacttgttaagtagttgtaaccaaaatgctggtagaaatataaacagtaaaggccaggctgatgaggtatcagatgaaaatgagaattttttgaaaactggagcaaaattcacccttgttacatcctagcaaagagcttggctgcattgtgtccatgctgtagggatttatgggatgtttaacttaagagtgttgacttaggatatctgacagaagaaatttctaagcagaaagcattcaaggggctgtgtggctgtttctaacaaactacaacaagatgttggaacagatgtattacttaaggttaaaaattataataaaaagcaaagcagagtgtacaaatttggaaaattcataatctggccatgaggtagacaaagaaagacagttttcaggagaaaagcagaagcagctgagaaataaccaattgctagagagacttgcatgactaaaatggaaccaagtgctgatagccaagacaatggaaaaaagaccttgaagacatttcagaaatcttcaggagagtccctgccatcacaggcctagaggcctaggaagaaagaatgcttctggggacaatgcctgggagaccactgctctgcaccacctcaggagagtgtgccctatatcctggctgcttcagccccaaccaaagctgaaagggcctgggtatacctaagctcccattatggagagttcaagccactgtaagcattggcagcttctacatggtgttaatcctgtaagtgcacagagcacgagagtgaaggcttagtaacttccacttatatttcagaggatgtattggaaaggctgggtacctaggcagaagcctgctacaggggtggagcccttgcagagagcctatactaggatagtgccaaggggaaatgtggggttgcagcccccacacagagtcaccacccgggcaatgcctagtggatttgtgaaaatggggccaccacctttcagatcccagaatataccttgagcctggaaaagtcacaggcattcaactccaacccgttacagcagccacatgggcttcaccaaataaagccatggaggcagagctgcagagctgcccaaggccttgggaagaccacctgtcatttttctccaatgtagtagtttctccaataacccatggtacctcccaccaagacctgagtcctcaaaatatctattgaatggttgtactcttaggggtgtagttataataataatgatatacttcagtattaaattttaaattttatggagtaatgataagcaataaaaataaaacaatacttcttccttgtttgctaaattacaagtagcaagccattcaggggaggagccaagatggccgaataggaacagctccggtctacagctcccagcgtgagcgacacagaagacgggtgatttctgcatttccatctgaggtaccgggttcatctcactagggagtgccagacagtgggcgcaggtcagtgggtgcgcacaccgtgcgtgagccgaagcagggcaaggcattgcctcacctgggaagcgcaaggggtcagggagttccctttcggagtcaaagaaaggggtgacggacagcgcctggaaaatcgggtcactcccacccgaatactgtgcttttccaacgggcttaaaaaacgacgcaccacgagattatatcccgcacctggctcggagggtcctacgcccacggagtctcgctgattgctagcacagcagtctgagatcaaactgcaaggcggcagcgaggccgggggaggggcgcctgccattgcccaggcttgattaggtaaacaaagcagcctgtaagctcgaactgggtggagcccaccacagctcaaggaggcctgcctgcctgcctctgtaggctccacctctggggacagggcacagacaaacaaaaagacagcagtaacctctgcagacttaaatgtccctgtgtgacagctttgaagagaacagtggctctcccagcatgcagctggagatctgagaacaggcagacggccttctcaagtgggtccctgacccctgacccccgagcagcctaactgggaggcaccccccagcagggacacactgacacctcacacggcagggtactccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagaacaaaaactggaaactctaagatgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcgatggaagatgaaatgaatgaaatgaagcgagaagggaagtctagagaaaaaagaataaaaagaaatgagcaaagcctccaagaaatatgggactatgtgaaaagaccaaatctacatctgattgatgtacctgaaagtgatggggagaaaggaaccaagttggaaaacactctgcaggatattatccaggagaacttccccagtctagcaaggcagcccaatgttcagattcaggaaatacagacaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagagtggggaccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaataatcagtaccagccgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctccaattaaaagacacagactggcaaattggataaagagtcaagacgcatcagtgtgctgtattcaggaaacccatctcacatgcagagacacatataggctcaaaataaaaggatggaggaagatctaccaagccagtggaaaacaaaaaaaggcaggggttgcaatccacgtctctgataaaacagactttaaaccaacaaagatcaaaagagacaaggccattacataatggtaaagggatcaattcaacaagaagagctaactatcctaaatatatatgcacccaatacaggagcactaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctgcagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaactgctcaactacatggaaactgaacaacctgctcctgaatgactactgggtacataacgaaatgaaggcagaaataaagatgttctttcaaaccaacgagaacaaagacacaacataccagaatctctgggacgcattcaaagcaatgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaagagagaagaatcaaatagatgcaataaaaaatgataaaggggatatcaccacggatcccacagaaatacaaactaccatcagggaatactacaaacacctctacgcaaataaactagaaaatctagaagaaatggataaattcctggacacacacactctcccaagactaaaccaggaagaagttgaatctctgaatagaccaataacaggagctgaaattgtggcaataatcaatagcttaccaaccaaaaagactccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgaacaagtgggcttcatccctgggatgcaaggctggttcaatatacgcaaatcaataaatgtaatgcagcatataaacagagccaaagacaaaaaccacgtgagtatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcgaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccacttctcgaggaaataaaagaggatacaaacaaatggaagaacattccatgctcatgggtaggaagaatcaatatcatgaaaatggccatactgcccaaggtaatttacagattcaatgccatccccatcaagctaccgatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaagaactccctatttaataaatggtgctgggaaaactggctagccatatgtagaaagctgaaactggatcccttccttacatcttatacaaaaatcaattcaacatggattaaagacttaaatgttagacctaaaaccataaaaaccctagaaaaaaacgtaggcattaccattcaggacataggcatgggcaaggacttcatgtccagaacaccaaaagcaatggcaacaaaagacaaaattgacaaatgggatctaattaaactgaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaacaaacaaccccatcaaaaagtgggcgaaggacatgaacagacacttctcaaaagaagacatttatgcagccaaaaaacacatgaaaaaatgctcatcatcactggccatcagagaaatgcacatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgtgtgtatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagtcatcaaaaatgatgagttcatgtcctttgtagggaaatggatgaaattggaaatcatcattctcagtaaactatcttaagaacaaaaaaccaaacaccgcatattctcactcataggtgggaattgaacaatgacaacacatggacacaggaaggggaatatcacactctggggactgttgtggggtggggggagtggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaataaataaataaataaattacaagtagcataaactaagatggatgtgtagatagatacataggccccttgttatgttttcttatctttcagaacaaaaaagtagacaagtttcctagtcaagatattccttagctacagcagtcacaggaaaattatagcacatgttacctctaatcatatatctgtctatagaatgattcatcctgcatgtttctaacagagcgatcattgctcagcacaaccctgctcatttaattactcctcagaatcctcaagtggctctcaatacttccaaaatacaagtcaaatcaggtttgcctgtcttccaaactcctcaacaattcaactctcagccatctttcattttgaaacacaggttgttttggtagaatttacataaaataaaatttactctttttgatgtataattctatgagttttactaacgtatatagtcatgtgactacaaataaaatcaatatatagaacattttcatcacctgaaaatgtaaccttctgcctctttgtaggcattcatctccctcagtcctagccagtggcaaccactgacttatttcttgtccttcaacttgactcctagaaactcatgtaaacggaatcataaaggatatagccttttaagtacgtattgtttcactaacttaatgtatttgagatttatccatattgttgcttatttagtaggttgagcctttcactttttattgctatcattccattatatggataggccaaagtttgtttaaccatttgtccattgagagatatttatgtggggatttgctgacaagatggccaaataggaaaagttccagtctgcagctcccagcgagatcgacgcagaaggtgggtgattcctgcatttccaactgaggtaagcagttcatctcattgggactggttggagagtgggtacagcccgtggagggcaagccaaagcaggatggggcatcacctcacccaggaagcacaagggttgggggaattatctccccgacccaaggaaagcagtgaggcactgcaccatgaggaatggtgtgctctggcccaggtactgcacttttcccatggtctacacaacccacagatcaggagattccttctggtgcctaagccaccagagccctggatttcaagcacaaaactgggtggttgtttgggcagataccaaactagcttcaggagttttttttcaataccccagtggcgcctggaacaccagtgagacagaatcgttcactcccctggaaagggggctgaagccagggagccaagtggtctggctcgggggatcccacccccatggaggccagcaagcttggatgcactggctggaagttctcgctgccagcacagcagtttgaggttgacctgggatgctcaagcttggtgtggggaggggcctctgccaatgctgagacttgagtaagtggttttacccttacagagtgaacaaagctgcagggaagttcaagctgggcagagcccaccgcagctcagcaaggccatggtggccagactgcctctccagatccctcctctctgggcagggcatgtctgaaataaaggcagcagccccagctgcttatagataaaacctccatatcccagggacaatgcacctaggggaaggggcagctgtgggcgcagcttcagcagacttaaacattcctgcctgacagctctgaagagagcagcagatctcccagcacagagtttcagctctgctaagggtaagacttccccatcaagtgagtccctgacccctatgtatcctgactgggagacacctcgcagtaggggctgacatacacctcatacaggagagctctggctagcatctggcaggtgcccctctgggacgaagcttccagaggaaggaacaggcagcaatctttgctgttctgcagcctccactggtgattctcaggaaacagggtctggagtggacctccagcaaactccagcagatctgtagcagaggggcctgttagaaggaaaactgacaaacagggatagcatcaatatcaacaaaaaggacgtccactcagagaccccatctgaaagtcaccaacatcaaagaccaaaggtagataaatccactaagatagtgagaaaccagtgcaaaaaggctgaaaattccaaaagccagaacacctcatctcctccaaaggatcacaacttctggccagcaagggaacaaaactggatggagaatgagtttgacaaattgacagaagtaggtttcagaaggtgggtgataacaaactcctccgagctaaaggagcatgtttaacccaatgcaaggaagctaagaacctggaaaaaaggttagacaaattgctaactagaataaccagtttagagaagaacataaatgacctgatcgagctgaaacacagcattaaaacatcctgatgcataaacaagtatcaatagctgaatcaatcaagcagaagaaagcatctcagacattgaagatcaacttaatgaaataaagtgagaagacaatattaaagaaaaaagaataaaaaggaatgaacaaagcctccaagaaatatgggactatgtggaaaaaaactaaatccacatttaattgttgtacctgaaagtgacggggagaatggaatcaaattggaaaacactcttaaggatattatccaggagaacttcaccaacctagcaaggcaggccaacattcaaattcagaaaatacagagaacaccacaaagatactcctcaagaagagcaaccccaagacacataattgtcagattcaccaagattgaaatgaaggaaaaattattaagggcagccagagagaaaggtcgggttacccacaaaggaaagcccctcagactaacaggagatctctcagcagaaaacttacaagccagaagagagtgggtgccaatattcaacattgttaaagaaaagattttcaacccagaatttcatatccagccaaactaagcttcataagtgagggagaaataaaatcctttacaaacaagcaaatgctgaaagattttgtcaccaccaggcctgccttaccagagctcctggaggaagcactaaacatgcaaaggaacaactggtaccagtcactgcgaaaacataccaaattataaagaccgtcgacattatgaaaaaactgcatcaattaacatgtaaaataaccagctagtgtcataatgacaggttcaaattcccaaataacaatattaaccttaaatgtaaatggcttaaatgtcccaattaaaagacatagaccggcaaactggataaagagtcaagacccatcagtgtgctgtattaaggagatccagctcatatgcaaagacacacataggctcaaaatacagggatagaaaaagatttaccaaacgaatggaaagcaaaaaaaaagctacggttgtattcttagtctctggtaaaacagactttaaaccaacaaagatcaaaagagaaaaagaagggcattacatattggtaaagggaccaatgcagcaagaagagctaaccatactaaatatgtatgcaccaaatactggagcacacagattcataaagcaacttcttagagacctacaaagaggcttagaatcccacacaataataatgggagactttaacaccccattggcaatattagacagatcaatgagacagaaaattaacaaggatatccaggacttgaactcagctctggaccaagcagaactaatagacatctacagaactctccaccccaaatcaacagaatatacattcttctcagcacctcatcacacttattctaaaattgagcacataattggaagtaaaacatgcctcagcaaatgcaaaagaatggaaatcacaacagtctctcagaccacagtacaatcaaagtagaactcaggattaagaaactcactcagaacagcaaacaacatggaaactgaacaatgtgctcctgaatgactactgggtaaataacaaaataaagacagaaataaagatgttccttgaaaccaataagaacaaagacacaatgtacaagaatctctaggacacatttaaaagagtgtttagagggaaatttatagcactacatgcccacaagagaaagcagaaaatatctaaaattgacacactaacatcacaattaaaagaactagagaaggaagaacaaacaaattcaaaagcagcagatgacaagaaataactaagatcagagcagaactgaagaagatagagccatgaaaaatacttcaaaaaatcaatgaatccaagagttggttttttgaaaagatcaacaaaatagactgctagccagactaatagagaagaaaagagagaagaatcaaataggcacaataaaaaatgataaaggggatataaccactgatcccacagaaatacaaactaccaccagaggatactataaacacgtctatgcaaataaactagaaaatctagaagaaatggataaattcctggacacctacaccctcccaagtctaaaccaggaagaagtcgaatccctgaatagaccaataaaaagttctgagatggaggcagtaattaacagcctaccaccaaaaaaaaatcctggaccagacagattcacagctgatttttatgagggatacaaagaggagctggtaccattccttctgaaactattccaaacaatagagaaagagagaatcctttctaactcattttatgaggccagcatcatcctgataccaaaagctggcagagacacacacaaaaaagaaaatttcaggtcaatatccctgatgaacatcgatgcaaaaatcctcaataaaatactggcaaaccaaatccagcagcacatcaaaaagcttacgcaccatgatcaagttggcttcatccctgggatgcaaggctggttcagcatactcaaatcaataaacgtaattgatcacagaaacagaaccaatgacaaaaaccacatgattatctaaatagatgcagaaaaggccttcgacaaaattcaacaacgcttcatggtgaaagctctcaataaactaggtattgatggaacagatctcaaaataataagacctatttatgacaaacccacagccaatatcatactgaatgtgcaaaaactggaagcattccttttgaaaactggcacaagacaaggatgtcctctctcaccactcctattcaacacagtattggaagttttggctagggcaatcaggcaagagaaagaaataaaatgtattcaaataggaagagaggaagtcaaattgtctctgtttgcagatgacatgattgtatatttagaaaaccccaacatctcagcccaaaatctccttaatctgataagcaacttcagcaaagtctcaggatacaaaatcaatgtaccaaaattacaagcattcctatacaccaataacagacaaatagccaaatcatgagtgtactcccattcagaattgctacaaaggcaataaaatacctaggaatgcaactcacaagggatgtgaaggacctcttcaaggagaactacaaaccactgctcaaggaaataaaagaggacgcaaataaatggaaaaacgttctatgcttatggataggaagaatcaataacatgaaaatggccatagtgcccaaagtaatttatagattcaatgctttccccaacaagctaccattgactttcttcacagaattagaaaaaaaactttgaatttcatatggaaccaaaaacaaaagtccacatagccaagaaaatcctaactaaaaagaacaaagctgggggcatcatgctacctgacttcaaactatactacacggtgacagtaagcaaaacagcatggtactggtcccgtaacagatatacagaccaatagaacagaacagaggcctcagaaataacaccacacatatacaaccatctgatctttgacaaacctgacaaaaacaagcaatggggaaagaatttcctatttaataaatggtgttgaaaaaactggctagccatatgtaagaaactgaatctggactttccttacaccctatacaaaaattaactcaagatggattaaaggcttaaatgtaaaccctaaaaccataaaaaccctagaggaaaacctaggcaataccattcaggacataggtgtagacagagacttcatgactaaaacaccaaaagcaaaggcaacaaaagccaaaattgacaaatggaatctaattaaactaaagagtttctgcacagcaaaataaactattttcagagttaacaggcaacctacggaaagggagaaaaaatttgcaatctatccatctgacaaagggctaatatccagaatctacaaagaacttaaacaaatttacaagaaaaaaactcagtggccaaaggctatgaacacacacttttcaaaagaagacatttatgcggccaagaaacataaaaagcccgtcatcactagtaattagagaaatacaaatcaaagtcacaatgagataccatctcctgccagttagtatggcgcacattaaaaagtcaggaaacaacccatgctgtaaaggatgtgaagaaatagaaacgctatacactgtttttgggagtgtaaattagttcaaccattgtggaagacagtgtggcaattcctcaaggatctaaaactagaaatcccatttgacctagtaatctcattactgggtatatagccaaaggattataaatcattctaccataaagacacgtgcacatttatgtatattgtggcactgttcacaatagcaaagacttggaacaaatccaaatgcccatcaatgatatactggataaagaaaatgtggcacatgtacaccatggaatactatgtagccataaaaaggataagtttatgtcttttgcaggtacatggatgaagctggaaaccatcattctcagcaaactaacacaagaacagaaaatcaaacaccgcatgttctcactcataagtgggagttgaacaatgagaacacatggaaacaggaaggggaacatgacacactggggactgtcgggagctgaggggctaggggagggacagcattaggataaatacctgattagatgatgagttgatgggtgcagaaaaccaccatggcacctatatgtcttttgtaacaaaactgaacgttctgcacatgtaccccagaacttaaaatatattaataaaaaatatatttatgtttctacatattgacaaatatgaataaattgttattaaaaattgtgcacaagattcttcctaaatatgttttcactgttcttgagaaaatgcctaggtataggatttctaagattttatgaagtcaaataaaaactctaggaaatcaccaaactgttttccaaattgtttttaccactttacatttccaccagcagtgttccgcatcttccagttgttccacatcttcactagaacttagtattgtaggggtttttttgttccctttaactttctaaagctgtgtaatggtaccacattaatctcattgtgattgtagcttgcatttttcaaatgacattgagtatcatttaatgtgcttattatatattgtcaaatgtcagttcaatattttgccaggttttaattggattatttttctcattattgagttttaaaagttatttacatattcctaataggcatcttgtattaagtatgcatttttcaaatattttctgggtcatttctttctcaacaatatcttttaaagaatgaatgttttaaattttgataaagatccatttatcaatattttttatgaattttaattttggtgtcatatttaagaattatttgcctaacataagatcacacaaatatttctgagtattttgtttctcgaagttatttaatgacatggtttggctctgcgtccccacccaaatctcatcttgtggctcgcataattcccacatgttgtgggagggacctggtgggagatgattgaatcctgggggctcgtctttccagtactgttctcctgaccatgaatgagctcaaaagatctgatggttttaaaaacaggagtttctctgcacaagctctctcttttcttgatgccatccatgtaagatgtgatttgatcctccttgccttctgccatgattgcgatgcctccccaaccatttggaattgtaagtccaataaacttctttcttatgcaaattgcccagtctctgacatgtctatcagcagtgtgaaaatgggctaatacatataattttctgttttatatttagatgtacaatttattctgatttaaatttttgtgtgttatagatcaagtccttttctttttgtctttcattcattactatttttatttttgcatatagatgaacatttctttcaccacaacttattggtgactgttctttagccactgatttgcctttgtgtctttttcaaattgatcgtacatgggtgagtgtattcctgatacattcatatttgtgtctgtccttttgctaaaacaatgctgtcttaattattaatattattcatattatgcctctttaataaatcacttaatgtgaatcttccaacttagttcttttaaaaaattgtttattccactttacttaaatgtgtatgtatccatcaacagagctttaaagtacgtcgtgtaaaatctgatacaattgaaagaagaaaccaacaaatgcacaattattcttaggaacctcagcactctcttttcagtaatttatagaacaaacaaatgaaatcagcaaagatatagaagacttaaaaaatactgtcaagtaacttgacctaattgacatttagagaacattccatcaaacaaaagcaatatctatctatctatctatctatcatctatctatctatctatcgtctatctatctatctatacacttttcaattgcatatggaacgttcaccaaatagaccacagtctgggacaagggtgttcaactataaaaaaaaatcattcaatgtgatccacataaaagcagactaagcaaggaaaacaacacataatcatatcaatatacaaagaaatgcatttgacaaactcaaaattcatgtatgattaaaaaaaattctccacaaacctagaaggtgatttccttaatatgaagaagaatatctatttaaaaatttacagctaacattatacctaatggagaactgctgaatgactacctctattggaaagactaagcaatgaaaatacacttttagtactcctattcaatattacagtgcttccagtcctagcaagtgcaagtaagtgcaataaggaaagaaaaaagattttaaaatgcatgcaaattgaaaaggaagaagtaaaaaaaaaatccccagtgatagactagatgatcatctatgaagaaaatctcaaaaaaatctacaaaaaagctctcagagttagtaagtgagtttagtacgtttgtggcataaaagtttgacataggaaatcaatcattattttatatattaataattaacaattgaaaaccaaaatactaatactaattatcatatttctttaaaaatgatatatgtaagtatgaatataacaaaacatatttaagatatatatatggtgatatggtttggctctgtgtccccacccaaatcttatgtggaattgtaatcccaaagtgtggagggagggaccaggtgagaggtgatttgatcatgggggcaattacttcagctgttctcatgataataagtgagatcttactagagctgatggttttaagtgtggcacttccttgctcttttcctctctctcctgctgccttgtaaagaaggtgtttgcttctccttcacattctgccatggttgtaagtttccagaggtttttccagtcatgcagaactgagagtcaattaaacttcttttatttataaattacccagtctcagatagtctcttcatagcagtgtgaaaatgaactaatacatatggtaaacattacaaaatgttaacaaaaaattaaggaagacctaaataaatggagagacataccacaggtatgaactggaaggctcattatagttaaaaagcaattttctataaattgatttctagatttaaggcagtttaaattaaaatattctcaggattctttttagatatcgacaattttattatgaaatgtgtacggaaagttaaaagcagtagaataggcaaaccaatttggataaagaacaaggttgaacgccttacactacttgacattacaaaatacaaaatttagcccaggaaaagttggacatgtagaccaatggaacaaagtacagttttacaaaatagcctgtacaaatatggccaacagatttttgaaaaaggtgtaaaggtaattaaataaaaatctttttgagaaatgattgtagaacaattgaatattcatgtgcaaaactgtaaatgttgatctacagctccttcttctccaaaaacatgttttaaatggatcatagatctaaatgcaaaacataaaactgaaaaaaaaatcttagaagaaaacatagaaggaactccttgatgagaggaggcagaataagatagcagaataagaggctccatcaatcatcctcccttcaaggacatcaagttaacaactatttacacagaaaaaaaaaaaacacctttatgagagccaaaagtcagatatgcacccatagtacctggttttaacttcatattgctgaaagaggcactgaagagatagaaaaaactgtcctgaatgccagcattactcacccaatgcccttcctctggaagtggtggcatggtgtgtagagcacccctggacaccagggaagggagaaaacaacaattgtgaggcattaaaaatgctattctgttagagctgaaagaaaaactggactaaactcagctgacacctgcacatggagggaccatttaaaccactcctagccagaggggaatcacaaattccagtggtccaaacttgagttcccacaaacctcaccacagagggctacagtgctctgtttctccatgtaaacctgaaaggcagtctaggccataggactgcaactattaggtgagtcctagtgctgaacggggcccagggacaatggactgaaggagcatgtgccatactgatacatcaagtggggtagtcaagagagttctggcatcacccttcccctaatcccaggctgcacagctcatggcttcaagacagaccctttccttttgcttgatgagaggaaagagtggggaggtctttgtcttgcatcttggatacagtctcagccacagcagaagggatgaagcacctgtttcaggccatagcatccaggtgacatttttagacacactcgggacaaaaagggaacccactgccatgaaaggaaggatgcagtcctggcagcattaattacctgctaacttaagagcccttgggccctgaataaccagcagtatacccaagtactatgttgagggacctgtgtgactcagcacattaccagctatggtggccgtggggcaaaactcctgcttaacaaaagcagagggaaaagtaaaggggactttgtcttgcaccttaggtaccagcatggccacgggggagacaagccccgagtaggcttttgaagtccctgatgacagaacttgacttctgcatggcatttctggacctgccctaagccagcgaggagaccactgctatcaagggtgagtcccataccaggcagaattcaccattcaccacaagctaacttaagaggaaatatcaatggtagtctgtcagtactccttgtggcttgcggtggaggtagctacagggtgaggcaactctgcctttggaatggagaggaaaaagtgggaaggattacttcttacggttttagtgccagctcagccatagtacaacagaacaccaggtagacttattaggtttttgactcgtccctgactcctggatgacacctctggacccacctcaggcctgggaaggcactgccctgaaggaaagaacacaggcctggctggctttgccagtagctgactgtagagccccaggcccttgagcaaatataggcagtagcaaaggagaggttacagcaggccttaggtgagacccagtgctgtgttggcttcaggtctgacccagaagagtcatagtggtggtggccacatgggtgcttgtgtcactccacccccagttttaggtgacttagaacagagagagaaaccctgtttgtttgtgagaaagtaaggaagagaacaagagtcttttcctgataatccagagaattctcccggttcttgtccaggaccatcaggtagtacctctacaagtctgcaagaaccacagtgttgctatgtttaaggtgtcccttaaagcagatacagcttacatcacaacacccaagtcctttcaaatatctgaaaagccttcccatgaaggatggctacaaataagcccagacaatgaagacaacaataaatacctaactattcaatgcccagacaccaaagagcatctactagcatcaacaccgtccaagaaaacatgacttaatcaaatgaacaaaataaggcaccagggaccaatcctagagaaacagagatatatgacctttcagacagataattcaaaatagttctgttgagtaaactcaaagaaattcaagatagcacagataaagtattcagaattctctcagaaaaatctaacaaagagattgaaataatttagaataaccacgcagaaattctgaaactgaaaattgcaaatggcatagtgataaatgcatcagagtctgttaatagcaaaattgatgaagcagaagaaagaattagtaagctgaaagacaggctatctgaaaatacacagtcaaaggagacaaaagaaaaagaataaaaaacaatgaagcacaccgacgggatctagataatggcctcaaaagggcaaatctaagagttattggcctcaaagcaggcatagagaaagaaataagggtagaaagcttattcaaaaggataatagcacagaacatctcaaccctagagaaagatatcaatatccaagtacaagaaggctctacaataccaagcagatttagcccaaagaagactaactcaaggcatttaataatcaaactcccaaaagtcaaggataaaaataagaattataaaagcaacaagacaaaggaaacaaataacctacaatagtgctccaataaatctggaagcagacatttcagtggcaaccttacaggccagcatagagtggtataacacatttaagtatgaaaggaaaaatgcttttactctagaacagcagattgagcgaaaatatccttcaaacatgaaggagaaataaaaactttcccagacacacaaaagctgaggaatttcattaacatcagacctgtcctacaaaaaatgctaaaaggagtactgagtacttcaatcagaaagacaaagacattaatgagccataagttatcacctgaaggcacaaaactcactggtaatcataagtacatagaaaaacacataatattataacccagtagcagtggggtgtaaaccactcttatcctaaagtataaaaactaaatggtgaaccaataaaaagaaaataactacaatgactttttaagacagcacaatatagtataaatagaaacaacaaatattaaaaaggagggagatgaagctaaggtgtagagattttggaggttatttttgcttgtttttttgcttgtttatgcaaacagtgttaagtttttatcaggtttaaatgatgtgttataagatagtatttgcaagccttatggtgacctcaaaacaaaaaagcatacaatgcatacacaaaaaataaaaagaaagaaactaaatcatatcaccagagaaaaatcatctttactaaaggaagacaagaaggaaagaaggaagtgatagcaataagaggtagaaaaatcctaggcagacagaggcaggtcctgggtgaaaccccaccttctagccaaagacagtttaaagcctgaaagccagggaccttcttcacaaggtggcaggaaggagaagggcagactgaagggggaagagccccttataaaactatcagatctcatgagaattcactctctatcatgagaagagcctggggaaaaccacccctatgatttaattacctccacctggcctctctcaacatgtgaggattatggagattataattcaagatgagatttggatgggaatgtacgaagcctaaccttatcattctgcccctgtcacacccaaacttcatgtctttttcacatttcaaaaccaactatgcctttctaacagtcccccaaagtcttaattcatcccagcattaaccaaaaagtccaagtccaagtctcttctgagacaaggcaagtcccttctacccatgagcctgtaaaataaaaaacaagttagttacttcctagatacaatgggggtacaggcattgggtaaatacacccattacaagtggaagaaattggccaaaatgcagggactataggctccatgcaagtcccaaatcaagcaggacagtcaaaccttaaagtttcaaaatgatctcatttgaatccatgtctcacattcaggtcacactgatgcaagatgtgtgctcccacagcctttgtcagtgccacacctgtggctttgcagggtacagcaccccttctggctgctttcaattgttggcatttattgtctgcggcttttccagccacacagtgcaagctgccagtggatctaccattctggcctctggaggacagtgacctcttctcataccttcactaggcagtgccctacaagggactgtgtagtggctcagaccccacatttcccttccacaatgcactagcagaagttcttcatgagggctccacccctgctgcaagcttctgcttggacatacaggcatttccatacatcctctgaaatctaggtggaggttcctaaccctcagttcctgacttctgtgtacccacaggctcaacactatgtgtaaaccaccaagacttagagcttgcaccctatgaagcaatggcctgagctctacactggccccttttagccacggctgggatgcaagccaccaaatccgaagactgcacaaagcagcaaggccctgggccaggaccatgaaaccattattttctcctaggcctccgggcctgtgataggaggggctgcagtgaagacctctgatatgccctaaagatatcttccccattgtcttggtgattcacatttggctcctctttgcttatgcaaatttctacagctgacttgaatttctcttcagaaaataggtttttcttttctgttgcatcatcaggctgcaaattttctaaacttttatgctctgcttcccttttaaacattagtttcaattccaaaccatctctttgttaatgcataaaactgaatgctttcaagagcacccaagctcttgaatgctttgctgcttagaaatttcttctgccagattccctaaattatctttcatgttcaaaactccacagatcactagggctgtggaaaaatgctaaagcataacaagagtcacctttattccagtccccaaaaagctcttcatctcctctgaaactaccttagcctggacttcattgtccatatcactatcagcattttggtcaaagccatgccccactaccttggtatcaatttactgtattagtttcttctcacattgctataaagaactgcctggaactgggtaatttataaagaaagaggtttaattgactcacagttcagcatggttggcaaggcctcaggaaacttagaattatggcaggaaggaaggagaagcaaaataccttcttcacaaggtggcaggaaggagaatgaatacaggaggaactaccaaacccttataaaaccatcagatcttgtgagaagtaactcaatatcatgagaacagcatggggaaaaccacccacatggtacaattacccccacctggtctctcccttgaaacacagggattatggggattacaattcaagatgagatttgggtgaggactcaaagcctaaccacatcaactcatatctcttggaatgcacagaagtctaatcaaagttaactaaagacttaaatctaagacctcaaactatgaaactattactagaaaacactgggacaaatctctaggacactggtttgggcaaagatttcttgagcaataccctacaagcacaggcaaccaaagcaaacatggacaaatggaatcatgccaagttaaaaaccttttgcacagcaaaggatacaatcaagaaagtgaaaggacaacccacagaatgcaagaaaatatttgcaaactacccatctgataagaggttaataatcagaatatacaaggagctcaaacaactctatagaaaaaaatatataatgaactgatcaaaacatgagcaaaagatttgaatagacctttatcaaaagaagacatacaaatggtaaactggcatattaaatggtgctcaatattgttgatcatcagagaaatgcaaatcaaaactacaatgagataccatatcacctcagttaaaatggcttatattcaaaacacaggcaataacaaatgctggccaggatgtggaggaaagggcactcttgtatattgttggtagaaatgtaaattattgtggagatgagtttgggggttcctaaataaaactaaaaatggagctactttatgacccagcaatccccactgctgagtatatacccaagagaaaggaaatcagtatatcaaatatatatctgcattcctatgtttgttgcagcactgttcacaacagctaagatttggaagcaacaacagatgaatacataaagaaaatgtggtgcttatacacaatggattactattcagtcattaaaaagaatgagaatctgtcatttggaacaacatggatggaactgcagattattatgttagattaaataagcaaggcatagaagaacaaacattacttgttctcactcatttgtgaaacctaaaaatcaaaacaagtgaactcatggacatagaaattaggagaattgttaccagaggctggaaacagtagtaggggactgggggagaggtggagattgttaatggatactaaaaaacagagttagaaagaatgaataagacctgctgtttgatagcataacagggtgactgtagtcaataataacttaattgtacatttttaaataacttaaagagtgtgactggattgtttataactcaaaggataaaagtttgaggggatggataccccattctccatgatgtacatatttcacactacatgcctgtatcaaacctttccatgtaccccataaatgtatatacctactaagtacccacaaactgtttttcaaaaattttaaaaagaaactccttggataatccatgaaagaaaaagatgataaactggatttgaaccaattaaaataatttgctctgttgtcaaaaagaggatgagaaaacagcccacatgccataagaaaacattttaaaatcatatatcttgtacccaaatgtaagaaatctcaaattttaacaataagtaaataaacacagtaaaaatatgttcaagagatttgaactgacatgatagcaaaggtgctatatgaatgacagtaaggcacatgaaaaggtgatcaacctcattattcattataaaaacgctaattacaacatctaataaaaacatactagaatggctaaaatccaaaaacaaaatgacagtagcaaaggctagtgggaatatgaaacaactggaactgtcatatgtcactggtagaaatataaatggtacagctactctgggacagtttggtgtttttgtacagttaaacatagacttactgtataacccagcaatcccacttatgttcacacaaaacctgctgcttacaatcaccccaaactggaaaccacccaaatgtttctctaagaattactggattaacaaattgcattatatccccatacaatgaaacattactgagcaagaaaaaggaacactctatttttacacaaaacaatttggatgagtcccaaatgctaagtgaaagaaggccatttctaaagtaacatactgtatgtttctacttacatgacattctgaaaaggtaaagctattaggaagagaaaacagattggttgttgccagtggttaggtttggtgggactgtctacctgcaaatggtagtatccaaggctccatagggtgttgggattgttctctatcttgttaggaaggctggttacaagaatatatgcttgcgttaaaactcgtaactctggatgctatcagaaaataaattttactttatgtaagttcaaatataataaatgatagcaatttgtgatattaaggtcatttaatttaaaaaataatatctaatcaacccaatattaagaaagtttaacattatgatcgcaaaattctaagtaatttaattgtactcaatgtgaattactttctcaaaggagcatgtgattgtaaaacctacctgtaagtttgcttgtaagatatcttatccatctctaatcagatgtcatggaagtggatgaatgtccctatcctttaaatgttctgctttaggaacagaaaaccaaataccacgtgctctcacttatcagtgggaactgaatgatgtgaacacatggacacgtggtgaggagaaacacacactgggacctctcagagggtggggctgcgggaggaagagcgtcaggaagaatagctaatgagtgctgggcttaacacctggatgatggggtgatctgtgcggcaaaccaccatggcacttgtttacctatgtgacaaacctgcacatcctgtacatgtacccctgaacttaaaataagaattggaaatttaaaaaaacaaaaagccaaaaatttctgctttaattaaatatcattatctttttataatgcaaagaaaaatgtgtcttaaattgtatttaagattacattgattttattcgacaccatcattcagtttacctgaaattcttatcctgaaaatatctgacataggtgactctacatataacaaaagaaaacaaatatcagtaactttacagattgtgccaaacttcttcctcaacgtaatggactgtgttatcagccattcaaagcatctacatctaaacgaagacatctagatgagtaacttctatgcatagcttcagttattcaattttgctcaaattacagtggactactagtgaattgtcactatagatattcataggcttcatataaaatattggccatgttcctatatgattctggttgctccagaggtcttggattcataattacctgagcgtttctaacatgtattaacatgaagcatcaattgtttctggtaaatgaggaataagtggtttttgttcagaattgctctctgtagattctctgctagtattataatcctctttgattgaggtaaaaataacctggatgactaaaggtaaatttttccacaaaggagaattaatgcactgtctgttttctgtagaattatgacagattttatgcctttgttaaatcctaagattagttggtataactactttcaatgctctggcctattttctttgttgctaaaatgaaaatagatcagaaacaccttttgaggcctctggatttataatttaagaattaactctgagaaagtagtaggtgaataaatagagttataatctaagacaacgttacattccttgtgtgagtctcacatctaagacccggcagtactttcttcctctgtgcattctcacgaatacccacacactgtaagcatagtttctaagattccataattatgaatcctaacaataagaatgactcagaatgcagaatattacaatgcagactctgtcctgtcaggtaaagtaaggaaaggtaaatactgcttaccgatacacattattaaatggtctgttctaatttctaattgtaacttcttggtttcaatattagacatacatagaaagttctgcctaagtaacttgaggctgattccctgtggcacaggtccttactaatagatggtggttttagaatttgcattaagtctttctatctagttcatttcaacaaatatttaccgaatatccactctagtcgaggcactgtgctaccatatgggaacataaagatgactaggacaatccctatcctgcaggagtgtacaattacaaagcagagatgtgttgattgttatgattaatataaagtatagcagggttccaaatgcatgaagctagactgaagcatggagaatatttaaaggagaaaaaccctgagtctacttggggagattaatcaagatttcaaggaagaggtaacattggaaagggtccactgagagggagtcagactttggtgggcacaaacccaaaatgaaggagatgggaacagtaagtgcttttgtttactgcatgcggattgatggtgagaagttaaccagtaaatcggagagcccagaccttaaatatctagtcaagtttgtgttccattaagacaataagtttgctgactaaagatttttgaaagaattagatgacattttcatgaaaaaatacactcatatggacatcagcatgcacatacatatgtatacatatttatacagagcatacatatatatttatatacatatagagtacatttcatttaaatgaaacgaaactacttggactgtggaggataaatttagagaaatctacacttggaatcacctgttacaatataaatataaaactttatggcatagatagtcatcagtgttatactcagaacattcaagtaaatatatgataattgtataatatcagggttatatgcttttatagtataatgcatataaatttatagtatgtagtatactagtaggctcaaaatatgactagtactggtgccattatttttgaaaattagctaaggcactaaaaaagataattcatgtgaactagactgataagctgaaaacattgctacttgttatttttatgtcaaatgtaatttgttttagaataaacattataattggctattcaatgcccacacacttagtataactttttaggtagaatcagtgattttatggtaacgtctaaccttgtggggaaaaatatttctctaaacttcagtttactgaaacttaaatttcacacagagtcattgactaaaaaagaaagtcaccaggaccttctcatccatctcataaattgctaatgcccacttctaatggtgcatttgcaattggtttggtctatgaatgacacacccataatcatataacttcctaataacattttgtggtttatactcctctaataattctctgtttaacaatggtcataatgattttcatacaatacagatacttaaataatattttgcatttttccagattatattttggcataagttaaacattatgttcattgtttatcttcaattaaaataacagacaaatctactaaagtgaaagacatggcaggaaggtaaagactctaaaagcacatgtttttaattgtgagaaataattttgtccatttctagaaaaaagataggaaaggtgattcttaagtatttaatgtacagataaatgattcattaataatttttacacaattatttaatttgaatggataaatattattaagaattgtcataagtatatatataagacatagtcttacatgctgtattagtccatttgtacactgcctaaagaactacctgagactgggtaatttatgaagaaaagagatttaattgactcatagttccacagccttaacaggaagcatgactggaaggccttaagaaacttacaatcatggtggaaggtgagagggaaggaaggaccttcttcacatggtgccaggagagagaggcagtgaaggggggaattatcacacacttttaaaccgtcatatctcatgagagctcactcactattatgagaacagcaagggggaaatttccccccatgatccaatctcctcccaccagtctcctcctccaattcaacatgagatttgggtgggggcacaaatccaaatagattattgtaagtataatgaaatataagtgccatttatttatttaaaaaccattttttgagaacatactatgtactagacatggtactgtaactcttgttctgaggattgtatgaaaattatcatgttaaaattcatatgacaaaagaatgggtctacctcaagaagggtatgggaagctataaaaagaatggatatttgatctggaatttaaagatcaggtagaagaagcttgtcttaatggaaatagagataagacatgagagagtgaaaaaagaaaataagcaaaaatagaagggagcttaaatgctatcccatttgttgtgggttgaattgtgttctcccccaaaatatgtcgaagtcttaaccccagtacctgtgaatgggaccttattgggcaataggatctttgaagatataattctgatgtaacttagtagatggagtcatgctggaggcccttaattcaatacacctcatgtgctaaaaaaaagagaagggacgagaagagacatatacagaaagaaaataacaccatggcagaatacagacacacacagagaaggaagacagccgtgtgactttggtggaagagatgtgagtgatggcaactgcaagccaaggaacacacaagattgttcaaaaccctcagaagctgggagagaggcatgaaacacattttccttcagaatccccaagttgcaaccaaacctgccgaaacctggatttcagacttttagcttctaaactgtgagagaataaatttctactgtttaaaccacccagtttgtgggaacttactacagcagtcccaagaaacttgcatactatgctgaataaatgaggtagagttgtcaaaaggtggaacaattagttataaaaacatatggagagaaatgagaaggaaagaaaaagtctaataaaactaggcattttgtgaataagctaaggagtcaaactcttagcatataataatatagagtttgtcttttaattcaaggcagttacattcttctatttttttttttattaaagagagcatgagtttcagagaagatgataattttgaaaggctaaaagctacagctatataggccagagaaaagacaatttcaattttctaatgagggataatgatagtttatgctatgtattgttacacatgtaatgccctctagagatgaacatgctacattggacccagcctaataaacgacctttgatgtcgttttcctatcaatggtgaagggtttcgccaatctatccagagtttcccttcttgtttctctgggggttaaggccctcattagaaagttagacagagagggtaataccttggtaatggcatgggcaatgtctttgatgaatacactcttaagagcaagataatttaagtgcacattacagaatattatggcaaacaataaagcttgcatagattgaaaaacagacctttccctcactgttattaactgggaaaactagctttgaattgtaattaattttggggttggatcagttataaaatgcatatcttataaactaaaggtttattttttcggacaagatacaacttccagtaacaggtgaatttgaataagtattaactaattttaaatagttatccaaaataacattatctagttagaatcagagggacacacacaggttgggaaatattttgcatttcttggtgcaattctatatttaatgatttttttctatgatctataataataagaacaattattgacattgtatttggtaaaaaatgcttgatttggattcgaagtttcattcttacaaaactgtatgttttggtgtcaaaatgataactcaatatacatcatattcttatatcactggaccactgtaaatgtataaaaagtctaggatatagttttctttaattttacagtttaaaaaataaatttctgagaaagtcatcacaattattgcaaataattgtatgattatgaaaaaaatggcagtagtcacaatgctacttgtaaacagaaagatacttggtcatgtgaaagatacttgtagtccactaggcacatataggccatacttcttcaatctaaaagacagaagaggcatctgagtaacagacatgtttcctttactcacctagcttcctttttctatcctttattgaattataataatagaataggtcttattatcaattaagtgatctttcttgttctcacaatgagagcagctgcatcaagtaagttttcgccttactaaaaactttcagatgtcttttggttttattattcaatttttgagatgtataattaaatccctgggaatgagtggatataatttagaaggcaattcagctctgtgaacttatacagatgtcactaaaatcatgtttgatggataatttcagaaacaatgaaagcatcattaactagagtaacttggaaaagcacaagtaaaagacactgttattttgacaatattgagttaaatagaggccacaggaaaaaaaaaaaaaaaaaacctgcacatcaaagttaaatgatcagcattcaatgtaagacattcttggagaactggaatgtttgctttggttttgttgaagtgattaacatgaatatgtcagctgcgtaattcagtgaacaaaattcatttcactgtaggaagtccatgtgggttaaaggaaaacaaaatctctttgtatgtccaaatggttttaaaaaggatctagggaacagttagtatggttcttactaattgttttctttctttaggtggaataaataattctaataaataaagggaataatcataagaatattctgaaaggaactaacagaaagctcagtgcaaaatgaaaaactataagcttacaataaactatgttttgtatatagatttataggtatataaaaggttagataaatagaacagcaatagagaacagagatagaaataaagattgattctaggtctataccatgtctttatttaatttaatataaaagaaaatcatcgatcaaagatgcaagaaattttttttaagaatccaaatgttgttagaattgactgtaataaaaatagtttgccatagggcttttcatggtacattaaaattaagaaaaatattttcccatttactagcaggtcaagttgcttcttttcagtgatcataatcaattatccaggaaaagggacagaagaaatcaggaaaaaggagaatagactctttatgcataggtaggttcagaattaacaaagttttgtggtggtggttctttgctttgacacagattcaatgtaataaaatttgtaccacctttaggcaaaattgagaccaatagaagaaaaatgtaacatagagtcttgaagttgtgtcaatagaagaatttaaaaacatatttgcttttaaaaattgttttatggccatataatttgcattcaataaagtgcacacatcctaaatgttcattttgatgagttatgataattttatacactcctgtaacaaacaccctaagtaagatatagaacatttgtatcaccctagaattacattatatgcctttctattcaatttccacctagaagtgggagctactttctgatttccaccaacacatatcagtttgttttgcatagtcctggattcttataaattgaatcatgtagtgtgtaatcttttgtgtgtctgacttttttcactcaacataatatcgttaagatccatgcatatggttgcatgtatcattaatttgttagtttattgctaaatagtacaccattataggaaaatatcaaaatgtattaatccattctcttgttgatagatattcgagttgtttctattttatctactgtaattaaggctgttataagcatttttatataacatgtttatggacgtatgttttatttttatttggataaagactctagaacacaattgagtgatcataacattagattgtatatatttaagtttaactgtataagaaattgccaaagtgttttccaatagtgttgtagtattttttgtcaccaccagcaatttttgagaatgcaagttgttctgtatgttaggcaacataatggcccccagagaagtcctaatcccaaaaacctatgaatttgttactttctatggcaaaaggagctttgaagatgggattagtttgaggatcttgagatgggaaagttattctggattatctgctgaatcgagtataatcacagggtatttgtaagatgaagacaagagagtcagcgtcaaagagatataataatggtggcagacacagaggggaaggagagaaagagaaagcagaagatgctctgctgctggctttgaaaatggtggaagaggccatgaactaaggagtgaatgtggcctccagaaggtagaaaaggcatgggaataggttatccctttagagccttcagaagaagcccagacctcccaacatcttgatttttaggacttttgaccacataacataatatttaaaagttgtgttgttttaagccactaagtttgtggaaatgtgtattagcagtaacagaaaactaatatgcatccttgccaacatttgctgtcgccaatctttttagttttagtcattctagtgggtgtgaaatggtttagcattatcattttaatttgcatttccttgatgacccatgatgttgagcaaattttcatactctatcaggccatttgtgtatcttttcctgtgaagaatttcttttcaaggctttgaccatcattctactgaattattgtttcttctgttgttgattatcaggagctttaatatatagttgacacttgaacaacatggatctgaactacacaagtccacttattggtggattttcttcagcctctgccacccttgagacaacaagaccaatacctcctctttttccttctcctcagcctactcaacttgaagatggtgagaatgaagacctttatgatcatccacttctacttgttgaatagtaaatatattttttccttatggttttcttaataacactttcttttctcttgattactttattgccagaatacagtacatagtacatataataagcaaagtatgtattagtttactgtttaagtgataggtaaggcttccactcaacagcaggcaacagccaggtgttgtgacacatgcctgtaatcctagcattttgggaggccgaggtggaggatcgcttgagcccaggagttcaagaccagcctaagtaacatagtgagacccccatctccacaaaaaattaaaatacctaatcatggtggtgcatgcctgcaatcccagctactcaggaacctacaataggagccaaaaaggtggaggttacaatgagccattattgcactactgcactgcactcctgcctgggagacagagtgagaccttgtctcaaaacactacaacaaacaacaacaacagcaacaaaaatcagtaggtattaatagttaggttttttgggagtcagaagttatacacagattttgactgtgcaggggatcagcgctcctaacgcctgcattcttcaagggttacctgtattcttgatacaagttctccttcagatttaagtattatagatatttttccagtctatagcttacctattcattttcttaataatgtcttttgattgatttttaatttttaactttggtgaattccagttgtatactttttttatgattagcatttttgtgtcctatgaaactgttgccttcctcaatgtcactaaattctcttaggttttcttctagcaagtttatgtttcaaattttcacccttaggtctataattcgtcccaaatttatttttgtctgtaaagcaatgtcacgattcattttttttctcaatataattacccagttgtttcaaaactggttattaaagtttttctcttaatcattgaattttcttggcaccaaattattaactcttgacaaaaataattgacccttaagtaagcagacagacaagcagtgcttctattttatagcaatgtaaataatacacaacttacacaaagactttttagaagctaactaacagtggtcctatctaagtacgtacaccagattttttataaccacttttaaaataaaagtatttagattttaacacatagattaggacagagaaagcatatggtggaataaactgtatctttttggccagatggtgctatttctaggtcatcttgataaagagaggaggcaaacatgaaaacttaatgaaaaactatttatgatgctggagagaacatcttggctttgagtcacttttaaatcatagaagaggattattccataaaattatttataatgcctaaaattattctttgcccaaatcataaattttcagcattaccaagaagccatttagtatgtatagggtgtttcagcaagtgcagagatgcccaggtggttgggattcaatacaacgagctgtcacgctgcacattcttggagtacaaccttaatgggcattttcccacctgtgcaattcctctgttttcaccccactccattcatatttcacaaactactctaattatagtatttattattgacctcaggaaaaagaagtttgaaagggtggaaaaaacatgcattttgtctccatggatagtaaatcactgagctattgttccttgggaatcccaattcatgagaaattacatagacttttgccctaacactaatcagctgcctgatctgtaaatatttcagatccttgcctgtatctatttctccttgcagaaaactgtaatttatctagatttttctaataattcactgacattttactgctatccaatgagtaaatcattgttgcttttggtatcttatgattttgttcttttgtgtcaaagtttagctagtttcatctatcaggttggaataaaaaatgcaaattatgactataccacttatatagttacatgatctactgaccaaagttaatcatcactttaatcttggtaactcattcagagccctaattgtaatagcctttgcctgagttacctagagagtggtctcaataatccccttttatttttcatgtagagaaaagggcacacaaaatgatattatctcgatcacccagcacatgtattaaactataacagactttttaaatcatgtgtgatcttttattttttgactgaaagggactaagtttgctgcccagagaagtctttagggagcaaggaaaggtaagcaaataaacttatctggagtcaaaggtctcaaggaaaatcttgctttctataaaaggcagacaacgtcaagactcatagattttcccagggctaaaaatcagagccaattgcctcccatcttgaaaagactcattcatcatgctggttgaagtatcacagatcttgtcaaaatattcatgactcacatacgacccatccaaaagacaaaagccaacaaaatattttaccaaattctaaaatagtgtttgttttattattctttgttattcttcaacaattattgttacctttactatatgaaatataatagcaattccttgtcttcatggtctttctgttacagacatgttttacactgattataccactttagtgaaattcatcatacatattcctgatccaaattccttttttattaaccatatatgagagaaagtggatattaaaataattttgatggtaaaataagcgaaaaaataaagcaagcatggttaaaatgattaaattatggaaaagtgacccatgtgtttcagataaactgacgcttgagggtttttgttgttattgtggtttaaattttattttattttaattttaagttccaggatacaagtgcaggatgtgcaggtttcttacataggtaaagatgtgccgaaatggtggtttgctgcacctctcaacctatcacctaggtattaagccctacatgcgttagctccctcccactgcccctgcagcagatcccagtgtttgttgttccctccctgtgtccatgtgttctcattgtccagctcccacttgtaaataagaacctacggtgtttggttttctgttcctgttttagtttgttgaggataatgacttccatgaagcttgagttttcattctacaatttactgaatgacatttgagcagctagctgactttttaatgccttgattttaataattcaatgagttattgggtgagataatttagaacagcatacatgatatcgttattattagtcaataaaatgctatttatcttatttattactcataacaaaaatatgtatatgacccttcgctatgtttgaatatgtgatatattgaattgaattcactgtgaggcttcagtaggtacctataatattcaaatatgttacctgaaagctgtgaaaaatatatttttaaaaattagatttacatgcagtcaagttttcttttgatgacacactctcttgatatatactaagttttatacttggaatctttcacttttatccttactcagaaacgtgaatattaagaatcagtagagccagctcttctacatgttccctgccaattgctatcttgcctacttttaaaacacctctaacttgagaaaatgaaaacccacaaactaacaattgttccagggaagtccatggcatcacttggaacttttcatcattagtcccagttacactcttttgtgttgtatacaacattggcatatactctagtcatctgtatgccaagttaaatgagacttcattcagcaaccagtaatatgtcatgcatcagaagtctctctcatcatattgcttatcaccatcaaatagtttccattttgtctttattccttaaaaattgtcatgcttaaaattggtgcaaataatgtagatacttgtgattctattatatctacatatatttttctattttgcaagagaagtgaattttaataaattagttctcttagattataatgctacagaaaaactgaatgacctgactcgttggtgatttgattgggactggatttgtgttcctgcccaaatctcgtgttgaaatgtaatccccaatgctggagatgggaactgatgtgaggtgattggatcatgggagtggtttctaatagtttaacaccatccccgaagtgctgtttcgtgatagagttctctgaagatctggttgtttaaaaatatgtgtacctcccatctgtctcttcctcctgctctggccaggtaagatttgcctgctttctcttcaccttcaccttccactgaagagagaggttaaagattaacccccccactctaatcacatgtactgtctataaatctcaatctatcaagaccctttcacgtggaccccttggagttgtaagcccttaaaagggtctggagctctttctttggagagcgtcattcttgagatgcaagtctgctgacgctcccagccaaataaagcctcttccttctttaacatggcatctgaggggttttgtctgtggctcatcctgctgcatttcttggttccctgaccaggaagtgaggtgattaacggacagttgaggcagccccttaggtgacttacacctgccctgcagagcatccctgcagtgaactccagccagcttgagcgatggggatcctgagaccgctcctgggtaggtgtttgtcctggtagaactcctcgtcagagtggtgcatggcaggcccccgcagatgatcaatgcaatgtctgaacactgggaaggaaccattgcttggagtccagacatctggaatacagaaggaccggtcctgggaacttgcccactgcatttgagtggaagcgtggcctgatcacccactgtgtgcccttatgggcactttggtctcagtattgattttgatttggcttgacctgtttgcaaaaaggaaagtgaaagtgagtgagtgcttgagttttagatgtgcgaggtgagcgagtgacctctttaccctttccttcttgtggtgtgagtgttgttttgtctcgggaggaaaatgggtgttatgcaaagtaagcccactctgctaggaactatgttgaaaaatttcaaggaaggatttaatggagactatggagttactatacaccaggaaaacttaggactttgtgtgaaatagactggccagcattggaagtgggttgggcatcagaaggaaacctagatgggtcccttgtttttaaatgtatggcacaaagtaactggtaagccaagacacccagaccagtttccgtaaatagacacttggttacagctggttttagagccaccacagtggttaagaggacaggcagcagtagtactagtggcaaagggacagacagccaaggaagaatcctgctccaccaacctaagggagtcagctcctaaagtcctgtctgatccaacaccagaggattcatggcaagaaacagcaccagtggccccctttccaccaagaagaaaggtctcccactccgataccccatcctataccaaaaagccacaagctctgatggatttgctccaaactgttatccagacccacaaaccccacctgggctgattgccactagttgctcatatgcctctttaacacagatgaaaggaggagagtgctccaagcagcaacgaagtggctttagaacatgttccagctgattaccaaaacccccaagagtatatgaggatccaattaccaggaacagatgccgagtgggacccaaatgaaagacagggtatgcaaaggctaaaccggtacaggaaagcccttctggaagggttaaagaagggagctcagaaggtcacaaatgttaacaaagtctctgaggccattcaaggaaaagatgagagcccggcacaattctacaagagactacgtgaggcctatcgtatgtataccccctttgatcccagtagccttgaaaatcagcacatgattaacatggctttagttagtcaaagtgcagaagacattaaagaaaatttcaaaaacaggctgggttcacggtcatgaatacttcacagttactggagatagccaagcaggtgtttgtgaatagagacacggtaagctacagagagaactgcagagagagtgaacgccaagcccggcgaaacgccgacctgctagccacagctataagaggggcccccccaaagagaccagagaaggggggccccaggaaaaatacccagtctgtccatccacgcttgcagcgtaatcagtgtgcttactgtaaggaaataggacgttggaaggacaagtgcccacagttgaaagggaaacaaggtgactctgagcagaaggcctcagacaaggatgaaggggccttgttcaatcgggcagaagggttactggactgagggggaccaggctcatgtgcccccaaagagcccattgtcaggatgacagtcgggtacgaggacatttagtttcttgtcaatattggtgctgaacattcagtagtaaccaccccagtcgcccccttatccaaaaagactattgacataatcggagccacaggggtttcggcaaagcaaacgttctgtttcccccagacctgcactgtgtggggcatgaagtgattcatcagttcctgtacatggctgactgccccttgcctttgctaggaacggacctacttagcaagctgagagccaccatcacttttacaaagcacggctctttaccgctaaagctacctggaacgggagtcataatggcccttatggttccctgggaggaggaatggagactcttcttaactgagccaggccaagagataggagcaactctggctaagtgttggccaaaggtgtgggtggaagacaacgctctagggttggcaatcaaccaggcccccgtactcatagaagttaagcctggggcccagccagtcagacaaaaacagtacctggtccccagagaagctcttgaaggtatctggatccatctcgagtgcctgagggcctttggaattgtagtcccttgtcagtctccatggaacaatcccctcctgcctgttcccaagccaggggccatggactgcaggctggcacaggatttgcgcttggtcaaccaagctacagtgactttgcacccagtggtacctaacctgtacacattgttggggttgctgccagctgaggacagctggttcacttgcctggacctaaaggacattttctttagcatcaggctagctcctgagagccagaaactgtttgcctttcagtgggaggatccggagtcaggtgtcaccactcagtaccttggacccagcttccccaagggttcaagaactcccccaccatctttgggggggtgctggcttgagacctccagaagtttcccaccagagacctaggctgcttgctgctcgagtacatcgatgacctcctgttgggacaccccacggcagtcgggtgtgccaagggaacggataccctactccagcacctggaggactgtgggtataaggtgcccaagaagaaagctcagatctgcagacagcaggtaagttacctgggatttactatctgatagggggagcacagcctgggatcagaaagaaagcaggtcatttgcaacctaccggagcccgagaccagaaggcaggtgagagaattcttaggagccatggggttctgcaggttatggatcccaaactttgcagtactggccaagcccctgtacagagtcacaaaggggagcgacaaggaacctttcaaatgggggtcccaaaagcaatgagcttttcatgagttaaaagagaaactcatgtcagcccccgccctggggctgcctgacctgacaaagccatttacactatatgtgtcagagagagagaagacggtggttggagttttgacccagatcatgtggctctggccaatgctggtggcctacatctctaaacaactagatggggtttctaaaggttggcccccatgtttgagggccttggctgcaactgccaatggacggatccagttatcagataaaaaaatagccatgccacaactgctaggagccacagtcgtactggctgttcttgaggccccacatgctgtggtgactttaatgaataccaaaggacatcattggctaacaaatgctagactaactaggtaccaaagcttactctatgaaaatccccacataaccattgacgtttgcaacaccttgaaccccaccaccttactcctggtatcagagagcccagttgaacctaactgtgtagagttgttggactcagtttattctagcaggcccgacctccaagaccattcttggaaatcagtagactgggagctgtatatgaacgggagcagcttcgtcaacccacagggagagagatgtgcaggatatgcagtggtaatgctgggcactgtcattgaagccaaatcattgcccagggtacttcagcccagaaggccaaactcattgctttaatttgggccatagagctaagtgaagataagactgtaaatatttatactgactcttggtatgccttcttaaccctgcaagtgcatggggcattgtataaagaaaaaggcctgttgaactctgggggaaaagacacaaagtatcagcaagagattctgcaattattagaggcagtgtgaaagccccaaaaggtggcagtcatgtactgcagaggacaccaacaatctttcaccttgattgccttggggaactcccgagctgactcagaggcttgaaaagcagcatccaccccctaccgggcatcagtcacagcaccccctgctccttcaggcacctgaccttgtacctacttattctaaagaagagaaggactttctccaggcagagggagggcaggtgatagaagagggatggatccagttatcagatagaagaatagccatgccacaactgctaggagctgcagtcgtactggctgttcatgagaccacccacctaggccaagagtcacttgaaaagttgttaggctggtagttctacaactcacatccggcagcccttgccaaaacagtggtgtatcagtgtgtcacctgctggcagcagaaaggtaggcaaaatgcaaatgtcccgcccagcatacaagcctgtggagcagacccctttgaagatctccaagtagacttcaccaagatgcccaaatgtggaggtaacaagtatttgctagttctagtgtgtacatactctgggggtggtggtggtggtggtgtggaggtctgtccaacacgaactgagaaaactcttgaagtaacctgtgtgattctccgagatctcatccctaggtttggactgcccttacaaatagactcggacaacaggctggcatttgtggctgacttggtacagaagacagcaaaggtattggggatcacatggaaactacataccacttaccgaccacagagttctggaaaagtggagcagatgaatcagactatcaaaagtaatttagggaaagtgtgtcaagaaacaggattaaagtgggtacaagctttccctatggtattgtttaagattagatgtaccccttctaaaagaacaggatattccccttatgaactattatatcataggctccctcccatactacggggattcccaggcactcctcaagagctaggtgaaattgagttacagtgacagctacaggctttaaggaaaattacacaaacaatttcagcctgggtaaatgagaggtgccccatcagcttattctccccagttcaccctttctccttaggtgatcgggtgtggatcaaggattggaacgtaacccccttgcagccattgtggaaaggaccccagaccgtcatcttgaccacagccacaaaggtagagggaatcccagcctggatccaccacagccatataaaacctacagcacctgagacctgggaggtaagaccaagccaggacaacccctgcaaagtgatgctgaagaagacaataagccctgctcctgttacacccagaagctggctggtccatgcctggctgaagcataaggaaactcattgtgggtctcattttccttaaattttagacttgtacagtaagtacttcaactgatcttcctcagactgaggactgttcccagtgacatcaagttactgaggtagggcgaaaagttaaaacagtctttctgttttataattattatgaaggtactggaactctaaaagggacttgtttgtataatgccacccagtacaaggtatgcatgccaggaagtgaccagcctgatgtgtgctataacccatctgagccccctatgactacagttttccaaataagattgaggactggcaactggggaaaagctgataagagtaaagtaatatctaaaacagaagagaaaggagttcccaaacaaattatcttaaaatttgatgcctgtgtggcaatcaacagtgacccgtatggaaatagaataagatgcggctgtctagattgggaaagtggctatatagtagaaaataagtatgtttgcaatgaattaggactgtatagtgatgaacatagttactggtcctgtgtcatttaggctacctggaaaaaagataagaaggaccctgtcctccttcaaaaaggaaagagtaactgttcctgcactagtggtcactgtaactcattagaactacctgatcaccattggaaaacaggagagtatgtaaccctaggaatcaatggaactggactggatccccaagtaaatatttaagtgcaaaggaaggtccacaggctctttcccaaaccagtgtttcagaccttttaataataatagtgttaggagcctgcatgttactcccctgtatgttacccatatttctaccaccttagttcatcaaaagacctcagcacaagtgtattacatgaatccctattgatctgtctcacaggaagacctgggtggtgactatgaaagtgagaactcccactagtgagtgaggttctcaaagtgggggaatgaggagagaggccatttatcttactgtctcctgtctctgaagagaaagaggaagtaaaagctgaaaaacaacaggaatgaaatcagtggcaagaccagccagtgcaccgatgaccaggcctgaggttaaaagattaacccccaactctaaccacatgtgctacctatagatctcaatctatcatgaccctttcacgtggaaccccttagagttgtaagcccttaaaagggccaggaaccctttcttcggggagctccattcttgaaatgcaagtcggccaatagtccagtccgaataaggcctcttccttctttaatctggtatctgaggggttttgtctgcagttcatcctgctacagtcccagtgctggtggccacaggagtgcttatgtcgcccctcccctaaatgcagacagcacagcatggagagagagagagactccatttgtttgggggagagtgaaggaaaagaacaagagcctctgcctcataatccagggaattctgccagatcttactgcagaccaccaaggtggtacatctgtgagtttgcaagagtcatagtgttactgggcttgagatgcctctaaagcagatatggctgcagtgaccaaatacttagatcacaaccctcaattccctttgaatactgggaaagccttctcaaggaggatgggaggctgggcatggtggctcatgcctgcaatcccagcactttaggaggccaaggtgggcagatcacctgaggtggggagttcaagaccagcctgaccaacatggagaaaccccgtctctactaaaaatacaaaattggccaggcgtggtggcacatgcctgtaatcccagctacttaggaggctgaggcaggagaatcacctgaacctgggaggtggaggttgcagtgagccgagattgtgtcattgcactccaacctgggcaacaagagtgaaattccatgaggaagaagaaggagaaggagaccagatgtggtggctcatggctataattccaacaatttgggaagctgaggagggaggatcacttgaatccatgagatcaaaaccagcctgggcaacatactgagatcctgtgtctacaaaaaatacaaaaatcagctgggcatggtggcatgtgcctgtagtcccagctacttgggaggctgaggtgagaggatcgcttgagcccaggaggctgaggcctgcagtgagccatgatcatgccattgcactccagcctgagtggcagagtgagattctgtattagaagaaagaaacaaacaaagaaagatgggtacacacaagcacagactgtggagattataataaataactaattctttaatggccagacattgaccaatagccacaagcatcaagagcatccaggaaaacatgacctcacaaaattaaataaggcatgagtgtccaatctcagagtgacagaaatatgtgatctttcagagaaaaaattcaaaatagctgctttgaggaagctcaatgaaactcaagacaacacagagaaggaattcagaatcctatcaaatatatttaacaaagagattgaaataattttttaaaatcaagcagaaattctcgacctgaaaaatgtaattgacatactgaagaatgcatcagatctcttaccagcagaactgatcaagcagaagaaagaattagtgaggttaaagacaggctatttgaaaatacacagtcagaaaagacaaaataaaaaagaattaaaaactataaatcaagaaataaagtaaaataaaaacaatgaagcacacttactagatctagaaaatagcctcaaaagaacaaatctaagcattacaggaggtagagagagagatcagcatagaaaatctattcaaagggatagtaagagagaactttccaaacctagagaatgatatcaatgttcaactgcaagaaggttatagaacaccaagtagatttaacccaaaggagactacctcaaaggcacttaataatcaaactcccaagagtcaaggatgaagaaagaattctgaaggaagaaagagaaaagaaaccaataacatgtaaggagatccagtatatcttgcagcagacttttcagtggaaacattataggccaagagagagtggcatgacatatttaaagaattgaaggaaaaaaaactttcattctagaacattatatccagtgaaaatattctgagatcaggagtttgagaacagcctgaccatcatggtgaaatgctgtgtctagtaaaaatacaaaaattaactagttattgtggtgtatgctgttaatcccagctactcgggaggctgaggcaagagaatcacttgaacccagaaggtggaggttgcagtgagctgagatcacgccactgcactccagcctgggtgacagagtgagactgccacaaaaacataataatagtaataataaaagaaaaaggcaaaaattcaaacaacagaaactgggcaaagccctccacaaaagaggaaatgtgaaggaatagctaataaaaacacgaagagggtctcagcctaacagggggagatgtcacgtgacacccaccagactggcaaaaatcccacaacccaatccatgcaagagttagggagaatggagagtagcaggaacaccaggcactgctaagaacggttgtgaaatatatttttgttatgcttctatatgaaagggtgtgtgttgtgggttatgagaaaaattacatttcttacctgggatgaaattttaaacattggaagctattgaccagaagaaacttgcacttttgtacaaaagaaatacccaagaacattcctaacaaaacagagtcctaaaggccccaacctggccaaacactcatcaacagggaaatgaagacatttcccatgctcctctcatatgaccggagatcatgcagcaataaaaatgaatcatgtcaatgtgggtgggtctcaggaagagaatggaggacaaaaatagacatcgagcagatgctcagagccatgcagtgtaggagcagccacacaggagaatttctcacatcaaagttcaaaactacagccaaggcaacagagcaagaccctgtctcaaaaagacaatggaaagttccaaaactaaatggcatattttttagggatgtacacataagtggtggaagaaatgtactatgaagaaaaatatgggaataataaagactaaaagaggaattgattccctctgtaggagaagggaaggggctagggctcaggcagggcctccggggagcatccaaagttatgtctcttcagattctattccctaaacttggtggaggtcctctgtgtccaatgtgtctgtattctttataccttacccatattgtacaaatgctttatttctattcaacatttagaagacaatcataaacaaaatgcattaaatagcaagatggcaaatgaacctcaggaaggaacatcaggaacatccatgaggttccatccacggaacctcaccatggatacgcttgtgatcaagggccttgtctcccctcaagacagtcagagatcagaggctgccctcatcatagcagtggaacaggaccagctgggacagggtccttctgtgacacctgctgtgtcaccaggctgtgcgaatggactcagctgcccgaactcacagaatatcagtaacagcaccgaaacttcacaggaaaaatggtaagttgtaagtttctccattaatagtaactctcagattagtctatgtcatccatcgcttctccattaaataactttttatagctttacatgggtcgatttttcaatttatattttattttactaactgaatgaaaagatatatattgtgtgtggtgtgtgattttgtctcagtcaggataatcatagtttaatttctattattattataccaatatcatttagtttttttaagctgttcaattcctgagggtattaatcagggtctttctgtctcatgagacaaaaaacaaatccaaactgtgtaagagaaagaagaatgcattgatcacgaggactgagaagctcccaggcttaacttgcttgggattcagctacatgtacagtttcaagtggtgtcctgtaaactctctctctctctctctctctctctctctctctctacttccccaacatctgctccatgtttagctccacgaacttcagacttaaaaagcatcactggctcctgaccaggattccagctccatgaacctcaaactagaacaccagcccggcttctctgcaggtctccagctccaaaacctaagacatcagtggcagtacaaactcatcccaggggctccagctccaggaccctcagacttgaaccgcagcaccaactcttccctggatctccatctccatgaccctcagacttaaacagcagcagcaccagttcatctgtgaatctccagctccacaaccctccaactagaaacacaccagctcctccctgggtctccagctgcacgaccctcaaactacaacatcagctcctccccgggtctctaactccatgaccctcaaactaaaacaacactgctcacccctgggactccagatccacaaaccttacactagaacagaaacaccagctcctccacagatctccagctttacaatctaagacattagtggcagcaccatctcctcctggggtctcaagctccaggaccctcagacttgaatcgcagcaccagctcttccccggatctccagcttgacgaccttcagacttaaacaacaaaagaatcagctcctccctgggtctccagcaccacaacccacaaactagaagaacaccactcccccatggatctccagatccatgaccctcacactagaacaccaacacctgctcctccgtgggtctccagatccacgaacctcacactggaacaccaacactggctcctctgcgggtcttcagctccacaacctaagacatcagtggcagcattggctcctcccatggattccagctccaagaccctcacatttaaactgcaagaccaccttctccctgtatctccagctgcacaaccctcaaactagaacatcagctcctccaatggtcttcagctgcacgaaactcaaactagaaaaacaacagctcctccctgggtctccagctctgcaaccatcaaactagaacaccatcagctcctctccaggtctccagctccacagctctcaaataagagcaacatcagcttctccctgggtctccagctgcacaaccctcaaactagaaaaacaccagctcctgcctgggtctccaagctccatgaccctcaaactcgaacaacatcagctcctccccacgtctccagctgcatgaccctcaatctagaaaaacagcagcaaactaataaaacctccccgggtgtttctagtttgagggtcatgcagctggacacctgggaaggagctgattttaatctagtttgagcatcgtggagctggacactcagggaggagcagatgtttttctattgtgaggattttggagctggagatccagggtggagcagtgttgttatagtttgaggtcatctgagggtcagctgcatgacccttaagccagaaaaacaccattttccccctgggactccagctccacaaacctcacactaaaacagcaacaccggctccttcgcaggtctccagctttacaacctaagacattcgtggcagcaccatctcctcctggggtctcaagctccaggaccctcagacttgaaccgcagcaccagctcttccccggatctccagctcgatgaccttcagacttaaacaacagaaggatcgactcctccctgggtctccagcaccacgaccctcaactagaacaccatgagctcctccctgggtctccagcaccacaacccaaaaactagaagaacgtcactcccccatggatctccagatccacaccctcacactagaacaccaacaccggctcctctgtgggtcttctgctgcacaatctaagacatcagtggcagcattgactcctcccatagattccagctccaggaccctcagatttgaaccacaagaccacctccttcttggatctccagctgcacaacactcaaactagaacaacatcagctccaccccgggtctccagctccattacactcaaattagaacaacatcagctcctctttgagtctccagctgaaagatcgtaaaacaaggacaacatcagctccttcccgagtcttcagctgcagggcactcaaactagaaccctcccccgtcttcagctgcacgaccttcagactagaacatcagcaactctcctggtctccagctgcaggatactcatattagaaaaacgccagctcctcccgggttctacagctgcatgaccctcaaactaaaaaacacccgctgctccccaggtctccagctgcatgaacctcaaactagaacaacatcagctcctccccgggtcttcagttgcctgaccctcaaactagaacaacatcagctcctctccaagtccccagatcacggccctcaaactagaacattagctccttcccgagtcttcagctgcaccaccctcaacctagaacatcggctcctctctgggtctctagctgctggacactcatactagaaaaacacaagctcctcccaggttctactgttgcacgaccctcaaactaaaaaacaaccgctcctcctcaggtctccaggtgcatgaacctcaaaccagaacaacatcagctcatccccgggtcttaagctcatggccctcaaactagaacatcagctcctccctgagtcttaagctgcacaaccctcaattgaaagcatcagctcttctccaggtcttcagctgcaggacactcacactagaaaaatgcaagctcctcatgggttctacagctgtatgaccctcaaactaaagaaacaccagctcctctctgggtctccagctccatgaccctcaaactagaaccaaatcagctcctctttgcatctccagtcgcatggctctcaaactagaacatcagctcctctcctggtctccagctgtaggacactcatactagaaaaacgccagctcttccccggttctacagctgcatgaatctcaaactaaagaaacacccgctcctctccatgtctccagctgcatgaacctcaaatcagaacaacaccagctcctctctgggtctccagctccatgacccttaaactagaaccacatcagctcctctctgggtctccagctgaaagaccctcaacaagaacaacatcagctcccctccaagtcttcagctgcacaaccctcaaactagaacaacatcagctcctctccaggtctccagctgcaggacactcatactagaaaaacaccagctcctcccgggttctacagctgcatgaccctcaaactaaaaaacacccgctgctccccaggtcttcagctacatgaacctcaatctagaacaatacctgctcctctgtggatctcaagctccatgatcctcaaactagaataacatcagctcctctccaggtctccagctgcagtatcctcaaacgagaacatcagcttctccctgagtcttcagcggcacgaccctcaaactagaacatcagctcttctccaggtctccagctgcaggacactcatactagaaaaataccagctccccctgggttctacagctgcacggccatcaaactaaagaaacaccagctgctctctgggtctccagctgcaggaccctcaaaccagaacatcagattctcccgggttctgcagctgcccaaccctcaaactaaagaaactcctgctcctcccagggtctatagctgcatgaccctcaaactaaaaaacaccagctcctccccagatctccagctgcaaccctcctattgctcctttgtttgttacccatatttctccaacttctaagaagttttgttactaccttggttcatcagaaaacttcagcacaaatgtattacatgaatgtcttgtaatacacaagtgtattacatgaatcactgtcgatctgtcttgcagaaagacctgggtagtgaagatgagagtgagacctcccactagtgagtaaggttctcaaatgggggaatgaagagagaggttaaagattagcccccctctaatcacatatgctatctctgaatgtcaatctatcacaaccctttcacgtgaaccccttagagttgtaagttcttaaaagggccaggaactctttcttcagagagctcagttcttgacatgcaagtctgctgatgctcctggccaaataaagccacttccttcttaacccggtgtctgagtggttttgtctgtggctagtcctcctacaccaccatgattctaactttcctgaggttttctcagaagccactatgcttctcatacagtctgcagaaccttcagccaattaatcttcttttccctataaactacccagtctcaggtatttaatagcagtgaaagaatggactaatacttgattattccagctaaacaaaatcaaagtagacaccatgccattgttagcaaattcaggctaaatcaccaaccaaaaatatgtgtgaatgtctcttgcaatatgtgtaatgcatctttgtgtaatatgcatatttgaatacaatttatatttatgttttctgaagagataaaatcattgggattcttttacattcagaatccatgaaggtccttgaactagaaggtatgattaatttcaaaataaatttgaaaattagttcataagtcaatggcaaaattaacataggtgggaattaatgttataatttcatatactgctttcataatttagcagtttttcatactgggaaaattataaataataataggaaatatattaatataacaaattgtatacttctggcccaatttcttcttcttttctgagaatatataattactatttgatatagattttttatgttagccatagacaatccttaattgaaaaatcatttagacaatctctcaaactttaagttaattttctatgccacattttcttaactcatcaaaatatgcattatattgattttcaattaatttattttgaaatgaatgaaataaaaatgtgaaaaaagttatccaaaatgaaacaacagtataggatgattaacaagattaacatattagtcaatataaaattccactgctatattgccatagctatggaactgttgtgatatgttcattctactaaatcctaatatttaaaaaaaaaaaaaagaaaaatgacctccagtacatatagaaaattggttgctttagtatgcattaactaattttgaagaaatagcaaagaaatgttcaaactttctttgttttattaaaacaatgctgtattgtgttagactattgaaaaacaaaacgaatagggacctgtattctttgaactgatgagcttcttgaaaatagaataaataaccctggcattggacttttaatatggtattgtttaaaggagcacttttggctagcaaaattagaaaggattttttattttttcatcctctatatatgctgttcctttctccagaagacaagccaatggtatgtgaaagagctttaaatttttcactcaaaataatcacgtagagataaaaaagaaccgaccttctattatatcaccggtctaagagaaacgtgcgttttaacttcaccctcaacagagtaagctcttgtggccttagtgcttatcatgcattttcagtagggaaagaaaatcacaatgaagaacaaaacattttcaacttttaaaaactaaaagagggaaaatttaaggcagaactaaattaagtagcaataaattagggctggtttagttggtggtttccaataagctctacagccacttccttcaccaagtacatgagtgttgcttcagcaatcattcctttaattcatgtcctttctctctctagaaaaactcatatattcattatcctaggagtatcaggtttgcaaagctggaccaaactaaagactcttcgaggtgcactttggcttcttaaaagagctaccaagattttggctgaggcatgtgacttaaaactcagcaggtatgattggcaagctatcctgtgaaacttgtaatcaatcaccatcggttttagtgaattgtattatctttgttcttgtaaacactttctttcaagttatcattgcttgtgattgaatcatgagctcttagatttctaagggaacagaaaacctatgaaacatttgaagcacttttgaaaagaaacttcgtggccagaaactcaccaaaacctgaggaaatcttttttattttgaaataaaagaatgcttcctttgtgtttctgtccttgaatccagttgttttacttgagattatagcaaagtcttctctgtcttttatataatgattctttaatatttgacctattcctcttcccccacctcatttatgagttatgtctattccatcttaaacattctcaggttcttaactgtatctgctactgtaaatggtagtttagtttttgttattttgattttttttgtttattttggtttttttctagctttattgctgtataattgacaaatagaaattgtgtgctacgagttgatgtgtagctattcatatatgttctgaaatggttatcacaatcaagttaattaacatatctattactttatgtagttaactctgtgtgtgtgtgagtgtgtgtgtgtgtaatgagaatatttaacacctaccctattggcaattatctccctattttcctttcccccaaccccacccttctactctgtgctgctataaatttgactattttagatttcacatgtaagtgagattatgcagtgtttttttcctctgttggattatttagcttagtatcatttccttctggttcatacttgttattacaaatggcaggatttccttctttttcaaggctgaaaaatactccaatatatttgtgtgtgtgtgtgcatgcacgtagaatccttcatggagtcatttatccattcctccattaacatttaggtttccctgaattggctattgtgactaatgctgcaatacacatcggggtggaggtatctctttgaggtagtgattttatttcatttggatatacatccagaaatgaaactgctacattttatgagttctaattttattttttgaggaatttccatactgctttccacgttgactgtattaacttacattcccaccaatagtttacttgggttttcttttctccacatctttgctaacacttgttatcttttatctttttgttaatagccattctaagaaatgtgaggtgataactccttgtggatttgatttacatttccctaatgcttagtgatatgaaacatttgtttcctatacctgttggccatttgtatgtcttctttggagatatgtttagtcaggtcctttgcccatattttaatagggtttttcatttttttcactatggagttgtatgtgttccttatatattttagatatgaaccccttatttgatgttttgaaaatattttctcccatttttcaggtgtgtttttatcctattcattgttttgtttgatgttcagaagcttcttagtttgatgtagccccactagtctatttttgcttttgtagcctgtgtatttggtgtcatataaaaaaaattgccaagaccaatgtcaaggacatttttttctatgatttattttactagttttacagtttcatgttttatatttgcatatttaatctgttttgaggtagtttttgttcagtatatggtataaaataaggtttcagtttcactcttttgcatgcggatattcagatttcccaacatattttattgaaaacaatattccttccccactgtgtattcttggcacccatgtcaaagattagttgagcatataggtgtgaatttatttatgggttctctattctgttccattggtctgtgtgtctgcttttatgccagtacaatactgttttgattactatagttatgtaatacagtttgaaaccatgaagtaggatgcctccagcatttttttccttgctcaagattggtttgactattcaggatttcttatgtttcagtataaattttggtttccaaatccaaatactgtttaatatagtgaacaaatctttgttttctttctgaaaccatctttccaatatatctcagaagtcagtggtcttaatgaattggtgccaccatctttccttgctactcaaatatgtgttacataaatttgaaaattatttgaaagaaaatggccaaatatatctccttcatatttctccttcatgtgtttttttatcctgaaaataaaactgcaagagggaaaaaacaaggaacaagcaacaataaagaaaaaaaaagaagtagagactaggtaactaagagcaagataaaaaggtgagttttttcactggaggattggatgaaagaactaattaatttgtctctcagtttgagcttttcaagagttctttataagtccttcatactgtgacatgatctgttagccattttcactgtggtccccattctagaagcattttactctctctctctctctctcttttttttcttttttggcgggaatgggggatgggagtaggggaatggagcctcactctgtagccaggctggagtgcagttgctgatctcagcttactgcaagctccacctcctgggttcaagcgattctcctgcctcagcctaccgagtagctgggactacaggcacgtgccaccactcccagctagtttttgtatttttagtagagatggggttttaccatgttggcaggatggtctccatctcttgacctcatgatccgccctcattggcctcccaaagtgctgggattacaggcgtgagccaccgcgcctggcagcattttactctctttcacatactttcttatatttatccttagttttttgaaaatataagagtgacattataaggaaaacttaaattgtgagtagctcctagtagaaatggcctcctacttgacttttctctcctgttttgcctcaaatcattcttcctggttaattgagtatgatttctaacatgaagaaacttgacttctggctattagcaaaaaacggaaattttttctctattgttatattatcatatggcttcagctcatggcaacacattttcactttagtcaattctaacagcatttggatttagcagtgaaattgtttgcatctttcattgataattttttccaaagcagtgtaaaataaaatgtggttttgatctggaatcactttttcctacatgcacatgcacacccacccacacacacattattaggtgctcacatccttacaatggcacaaacaactttgcactgaaccctttactagtcacttacacttctcttgacttgaatattctgcttatttatcagtgtaatggtttttatccaaataaagtaaaacaatagaattcaggccaattagcctttatatccttgttgaaaatatttaatattacaaataattttgtttttatttagtcctctttaaatttgtctttcactgtataagacaggcaatatattcatgtttatcatgtcaaaaaactgaatcaaatgttaaagtgctttaagaaagcaacagtatgaaagctgatcaagcccactgtggtctgcatcttctttatatgatatactgcctttcagaattttggagatgttattaaaaaatcaaatttttgaggtcattgatggcatagcatgtattacattctttatctcttcagttactagaactaaaacactagatcgattttatatgtatgtatgaattgataatctcaaatttttacatttttaatttaaatatttacatgtttaaattttcatctcttttctgctttttttcccaaaatatattgtgttccttagttctatgtttatatttaggaatgaataattgaacaaactaatttaggcagcttgagtggatgtcctcttcacatacttgcctctaccccagaacatgagaagtaactgtcagtaattattggcaagtattagttttcagagatgtgagcaaggaatggacatgccctatctccagcctacgtgtatcctcaattaaaaatgatttggattctgttccatgtctccatgcccactcttggatccccaattttgggcagacagatcgatcaatttctttagaatatattaatctggactcagcatgaaagaaaataccccattgcaaatatggcttggaaggcagaatagtttatctaatttatatacccatcttctcaaatctgagatctctgtaaataccaacttccaaggactcttttgtgaagagcagctttctccttcactgactcctttttctgctaagtctatgagcatttcagttcattcctaaatgtgatatcatttgccttcctactgcaaggaatgtctttgtctcctggtatcttccttttctcctattcttaatagatttatgaattattctctattttaatgtcttgtggttacgggaatctcatggaagttgacacatttctcaatatgtgttatatgttggatcccatcacattgctcaatttgcatttcataattgtgtctttggtacttgttcatcttcattgtgttcctagcaagcaaaaccatccccttagcctaacatcactgtaacataaataagcactcccctagtttctatgcatccccaaaataaattcagcttcatgtaaatatgactattgataaagatgtccacttattgaatacacttatcaaaagatttttctggtgtaacatggatataatttctgtcttaagaactctaattctaaagaaacctgtgtatggatttcacctttaggccttagtttaaacttatttaaatttgtcttcatagatcttaccctctcaagctattctgttttatgacaaagaccaacactaaggttttttatatttatatatgtgaactgaaataacgttctaaaatattttaaatcctacaaattagtttctttcattaaacagaatcctttctttgtgttggacattaattcagtgttaatgtgaatataattgtcatggattaatattaaatatttgccaatatctccctttacaacaggattttttattaaagtgtgtggatgtctttttttctttataatgtcttaaaaagaagaaaactttggtcatactataaaagttgagtctgataatgttttattatctgggaaaccatttaaaaatagtttcattgttattaaaatgacatctgggttacatgtgaataattattaaaataattatagaacaacatgcatttgtgaggaataatacaaagagattctgtatacactttgcccagcttcccccaatgacaatattttgttaaactatagtgtaatatcatgacaataatattgacattttacagtccgtccaacttactcaggttaccccagtttggcttggactcatttgtgtgtgtatgtgcacatgtacatgtataaattctatagatttttattaatgtgtaggtttatgtatctaccatcacagtcaagacactgagaagttccatcaccacaggaattccctatgctaccgtttgacaaccatgagaaagcatttttaatatatctatttttacatttgggaagggtcaaaagtcctttcattagcccagctcctgtccagataatttaaattaatgatgtctgtgttcttgtatggatggcatcactgcttgaaatatagatctccagggtgctcctgctctcactctttctgagccatgatctattgcatgtctgtacatcatcaaagcaaattgcttcttcaatgatgtgtaagtataatacatcatcacaatgggacatggtgataatgcattacccagaaaaagatgactgtcatatttgacagacaaggtcaaggagcaaattcaggcagccccagcacatttcatcagcagcattcttggtatagaagaaagtttgtttgcttagaatgatccacttgaaatgtggacaaggctaaatacatacgtatgccctgggttgattcctttggtaaattaaaaacgaggtggttgagcttccattaaaatgacatctggatgacatgtgaatagtttttctgtccacagggtgttttgaatcatgtgtgtttcttactcattcagcatcaaattgttttccagagaaagctcttcaacaagattgcaaagtccttcagggtagtaactgtcttatacatcctttgtttctttcacagtgtctaaagcattgctgagcacatggaagacactcaataaatactcgtttaatggaattgaatttgtaagcaccagagactcatgcttccttttcacatagcttgacacttggctgcccaggatccttgcatgcaaggtggtaaggttactgtgggaaaattctgttggcttactatcccatttgctgtctgctctttctttgtttcttcctcctttttttttttttttttttttttttttgtagagtctttcagccaggagctatttttataaagaatttcattttttgctcatgaggattaaacttttaagtttggcttcagggtgtgagagaagtacaacttatgaaggttgctctgcactgcaaaaaggataggatttgaggaagggatgtttctgacattggcacagcagtattccgttctcccccatcccccagttgctgccaaattggcctttctttaaagcatacagtatttatttctctagtccttggatcatagcaattttatttcaatgtcaccagtgaaggagagaaaggcaatattttgtccaagagtgggatttgaaaatgagtcctctgaggatatgttagagcaacctaagtattagatgctggaaaaatggatcatttcttgatatttcggtaggacacatctccatttcaaatatatgcatgctacaatgcagtgaatacatagtgcattttagtcagctctaaaagtaaccaagccaaattttatacaattgatacagacaatgggtgttcaagtgggaatacatgttactggctctctgccggcatgatgaaatagaggaggcaaatagatacagctcacgtgccaattctggttgctcagtcacagttatatcaatatcatgttgataaaagttataaatcagggatcaatttgcaacatctaccaggggcccaagtagaaacatgtggtatgcatgacagttatgaatcaaccctggtggaggaaaaagatggagagtcatggaccatacgcctaacaaagtaattgtacctggtccaattttggaccatgagtaaaccatttaataaaaatatatcatagaattgttttgagattacattttaagttgcataagctataatgtttgttatgattatgctaattgtatatatcattagagaaaataatcactaaatattttgaaacaaaagaaacaatgaatttaagtaataaatataatcccactcagccagagacgacaagttattgatactcttgtagatacatttattatataaaaacaaatatattatgtgatttatattttatcttacatattattttaatatcgatatttttctctcataatacacctttaatatatttcaatttcaaaagataatttctgaaaaactgtttttatatttgcatggtagttaattatatggctatacataatttttttaaacaaacacctatatttttacattgaagaaggatctaaattttgtatatgaatcatactcatattaaatatttttgcaataaaaatgtttctacttctttagtaaaatcccaaaggctgatatattggatcaaatgttctacagatttaatgggatttattcagtacttaaaaggaattgtattaaattaaactgcacaaagtctgtgccaaattatgcacctgcaaacaaatgtatctgattagaaggcagtgcagtaagttcttttaaaaggcttgttttttaaaaaatgaattagctccaaaactatttatatattaaggaacaatttgagcatgacacaaatttcttgtttgcctatgtgttacctcatctttgagaaacactaggcggatgcacaaaatggcacctggcagaacaaagccatgtagcaatacataaaatgtaagcataaacaaacctcaaacatccaacagctacttcagctcagcacaggtgtgatgagaccacccatctatatctggtgttacagctttctgtctgatttcagataattcttatttcaccactttgcaattcctcccaagctgaaaccctttcaatactcacttccacaagcaaaccttagtttttcttcaaaaaggaagtgtcatatttcttttatgaaactatatatttctttaccacttaatatggataaaagtatgctactatttttattaggttcctatgattttcttctgtgtatgtcactgaaaaagtttttgactattgtttcccaacaccagtctccccataagccatgtaatttttttttcataaatttgcatcgcaaggtgaattttaggaatacatcatataacggagctgattctttatgtgtgtatactttctgaaagattccctatgtgagataagaaaaataaaaagcgttttccttgctctcatattcaattcaaatttatgaaccagatgtattggttccccgtgacacacaacaagcagctaattctctaacagataccaactgggtatactataacttagctcaattttgacactatctacctagaattattatcagatgctacaggttaagcactcagtctcataggactaacctcaatttaaaatgccaattgcaagcctggggttttgacctgtgcttctgagtgattggctataaatctgagttcccatcaccccttcctcagattcagctaatttgctagagaagctcaaagaacttagggaaacactttacttagtttacccattcactataaaatacattacaaagaatatagatgaacaagacagatgaacaggtgcatttttaaaagagccagggcaacgtatgaaagctatttacccaccctcccaggcacctccagggaaccccgacttttggattttttatagaggcaacattacatagacgccattgattatatcatttgtccttggtgatcaactcaaacatcactccctctctcttccctggagggttggggtggggctgacaactccaactctaattatgccttggtccttctggtgaccagcccagtcctgaagctatctaagggtcccaaaccaccaatcatctcattaatatgcaaagacacatcactctagaaattccaagggttttcagagctgtgtgacaggaaccagggtcagagagcaaatggatagttcttattatatcataatatcacactccaataagtcaacacttgcctcattcaagactgattctaataaagaatgataactattatttttcactacttaaagagtcagacctatgtggaagttgcactaaatccagttacaatttattccaccacgaagcttggaagctctatgacccttaatacaatgttaatgtgaaagttttatattgtctgcaaaccaaaaactatctgagactggtctcaattaatttagacatttattttgccaaagttaaggacagtgcttgggagacaagactgtgtctttctccaaagatgattttgagggcttcaatatttaaaggggaaagggcaaatgctggagagagagaaagacatttttaaaagctgtgggtagttaagaggcaagcagttgcattcttctgagtctttgatcagccattcacatgtgacagtagggtagaaaaatcgtcacttatgcattcatctagctcagtgaatctacattttttacataaaataaaataaacttaaggctgaagaagcaatcagataagcatttacctcagatgagcgaagtgaagactttgagttctgtcctttgtcctgtatttgtgaagacaagctatcaatgtacatggtcagggtaaaattcaacataactgtctcaggataaagatcttggggcccacaaggaatttgctcttgggaaaattatgagggagctatgtagctttttcatgtttttagccatcttagaaacaaaatgggaggcaggttgcatgacgcagttcccagtttaaattttccttttgactgagggagtttggaatcctgagatttattttcctttcacatattttgctcaatttattcatgaactgtgattttattcaaaattattttattttcaaattcattgcattcaaataatcataaaatgtgtacctgcattaaatgaggcagtgttgttctttttcttccttcatttacaaaagcttttttccacttttttcattgaataaaaaagaaacttagttatggctaggataaataatgtaatatgtgactattttgccagttatgtttcttctactgtgaatagcctatgccataaataacccatttttcaaatgagcaggcatttcttctattattagtttgcatgagctctttaaatatatcttatgtagcaattttcagttggttagatacatgagtttatccctagcttttctaatagcactatttccaatgttacacacacacacacacacacacacacacacacatacagcactcacttataagttgagtgaactccaggtaagataaaccaaagaattccatgccaagagacatttacaaatcttgaagagccagagaaaacccacaccgtacctttagagataaataatacaaatggcagtagatttcttatcagaaaccatggagtcctgaaacaagtggcacaatgcaatgctgaaagaaaaggccttttaattgagcatcctagacccagtgaaaatgtcctcccagattgaaggggaaatcaagccattctcagatgagaaaacattaatttgttattatcaaacctaccataaataatggctaaagaaatttgttctctaaacaaaggaaatgacgttccaaaaatcttggaacatctgaaagaaagaaacaatacagtaagcaaaacttttgtaaatacagtaggatttgttgagttttctaaaatatgtttgatggtagaagaaaaaattataactttgatgtggttctaaatgcatgcagaggaaattttttttttttttttgagatggagtctcactctgtcacacaggctggagtgcagtggcaggatctcggctcactgcaagctccgcctcccgggtttacaccattctcctgcctcagcctcccgagtagctgacactacaggtgcccaccaccacgcccagctaatgttttgtatttttagtagagatggggtttcaccatgttagtcaggatggtctcgacctcctgaccttgtgatccacctgccttggcctcacaaagtgctgggattacaggcaggagccactgttactcagtaatgcgatggctgggtcaaatggtattatttctagttctagatccctgaggaatcgccacactgacttccacaatggttgaactagcttaccgtcccaccaacagtgtaaaagtgttcctattgttgtttcctgacctaccgtctggcactccccagtgagatgaactcggtacctcagttggaaatgcagaaatcacctgtcttctgtgtcactcacactgggagctgtagaccagagctcttcctcttcggccatcttggctcctcctcaatattagaattttctatccttttttgtgactcatttttctctctgtgttaactacattctcttcaactacaagcaatttcctccacgtggctgaaaaaggtgactgcagtcaggtctatatcgtagtggtcatttattctaagaacacttatggtttgtaaggtcaagttagtgacttgattgtatatgaagtagagtcaaccccacacaaattacatgaaatgagagcgaggggatttttccaaagatgagaacaatggacatgcttcatgtctatttgtgtcttcagtcagtcagttttcagcatgtaatgtacattcccttcagagaaaacaaatgaactaacattttaaagactggactatggagaaaataaaagctaatacccaacctatttgtttttacatttggatttctccccattcatatgttgaataggaaatttcacgtttcttaaatagatttttaaaaagtatttaaaatacgatttcctcaaatctttgcacgtattttttctggttcattttgtttcacatgctagagaaaaataaataccagctacaaatatgaagcagaaattgtctattgagcattggtatcaaattttctactgagaacactgaaaacattatctcatttaaatatatatattagagtcttaggatggtcataacaaagtaccatagaccgagtggcttaaaacaacagaaatgctgttggatcactgttctggaagcctgaagtccaagttcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgactcgagttgctgacagggcaatggtccctctggtgtatatagaggaacccttccttgcctcgagttgctgacagggcaatggtccctctggtgtatatagaggaacccttccttgcctcgagttgctgacagggcaatggtccctctggtgtatatagaggaacccttccttgcctcgagttgctgacagggcaatggtccctctggtgtatatagaggaacccttccttgactcgagttgctgacagggcaatggtccctctggtgtatatagaggaaccttccttgcctcttcatagcttttggcagttttctgcacacctttgctgtcccttgaagctgcaaaatccagcctcttcgttgccacattgttccttccttgtgtgtatattggtcttctcatggccacttcttacaaagacaccagtcgcattggattaggaaccgtccttactctggtatgacctcatatttaccacttacatccacaacaaccttttctacaaataaggtcacactttgtaatactgaaggttaggaaacactgggtgtttggacttcagtatatctttttgttgttgttggggggatacaattcaactgataatactgtggggctaatataactcacattttacagatgaagaaatttgtgcatattgagtcatttacatagtatcacaagtaacagagccaggatttaaacagattccatctaccactgaaaaaccacacacagaccagttattcacctcactacttcctgcagccgataactgttttccattgcctgaatagggtataactgccaaaaataagaacaagaaaaatgtatgaaacaagaggactttcatagcaaaagagacagccactgtatagaacccagcacactgcatttttcagaacaaaataatagatattttaaaatgaatttgttagccaaatagaaagtaaagtctggggcaaatatctctaccacatagataatccactgatgacttacagttcagttggacatataaaatatgatagaacttttcaataattatccttaaactctagaagaactttgaggagtccttgttcatattgcttttctgaatataattaataagattattaagatcagtctgcagcagtttccttgtagatggaaaagttaattctcagttcagggtataaacgagaaagaacataattactattattggactaattttcctaataaagttaggcttgctagcccttagtacaccattgttaatttatacacatgttgatgaaaggcaagataagtaaagtctagtgagtttggaatagtttagaggtccccctcaacttttaggtatgtgaaggggatttttaatgaatgcttttaagttaacaaggaaaagaagggactgaatgatcagttttttgtattaggtggtctgtttcccactggaaaagttgttatgtggctaaagagcctggtttaaataaaaacaaacagacaaatttatgcagaaagttaacgaagactaaaaaccccagtgcccattgtgctgggacagcagatgccatcagcagatgcactggagtttactccagttctttactgagcccaactatataatggctatgcacatttaaatactttaaacacaaaacaggtaataaacacgagtggattgaaacaatgggcaacatgtgtggatatgagaaagtggagcgtgtgagaaaaagtcttttagagctaaagtgcaagcctcttctaaagccattaaaatcctttttgttttttctttttgagatggagtcttggctgtcactcaggctggagtgcagtagtgtgatcttggctcactgcaagctccgcctcccaggtacaagtgattctcctgcctcagcctcccgagtagctggaactacaggtgtgtgccactacgcccagctaattttttgtatttttagtagagatggggtttcaccgtgttagccaggatggtctcgatctcttgacctcgtgatctgcctgcctaggcctcccaaagtgctcggattacaggcatgagccaccgtgcccggctaaaatccatttcttacccctaacatgctgtgctagaaataaaaaagcaactctgaggccctaatcagattccgtagtctaccaattcgatctgtcatcttcagaactctacactaaacttctccaacatataatcacagaaacaacacaatagttacaacagcatgaatgttttctatatcatttcaagtcttccacaccataaagtcactaagaataggaaattcatatttacttatacttgcccattctcatttctaatagaaaaataatatagcaaaatgatttgaatgcctacactttcacaatactcactgacttatttgtaatatgaaacaaaacaaataaaaactaacctagtgacccattcatatatgcatgctttctaaaaggttttgtttttgtttttaatgattctcatttgcttaccacatcagtgttgcaatgttagtcatctggaattctagaaattgggggaaggaaaaattagaacacctaccaagttaagctaatagaatagtattttgtaatagaaacctaaaggtacatagaagatagatacggttttatcaaaataaactaccaaaactatactaaggatagggatggagaaaggaacgaaatcaagctttcaaatgactctggagagggtggttggaaaaggctgaaaatcattcagtaacatttctgaacatatatattcatacagaggaaataaagaaagtaaccctctaagataaaagaagctaggagtgttaactgctataaatatgtgaagagaaagaaacatcaagaaaagaagaatttttaaaaatttcgtggactgggaggagaaagggagttgatatttaaaaagacattaggtccatggagggtgccctccagatgttcccaagtcttgggcattcagactctaatcctttgtatgatgcataggaataaattagccagcctcttgttacccacagtgtgatttgtaaagcatcagcttcaaggttatcctggagcttgatagaaatagagacctggcggtgtcactccctgcttaacaaatgagaatccacattttcagaagaccccaggtgattcctatgcacatcaaactgtgaagagcactgagccagactacagagtgcaaagccctgttctaagccacagtgatgctgactctcctcaccattttctctctcaaggtcctgactgtgggcaaaatatagaatcttagagcctggattatagcagttttacacaagcagcacactgatggaagcagctacagaggaaaagagaactggcagctcttgaactttcaccctctttcagaattcttaaaaattcagagagctgttctttaaagagacatttttctctcagcagttgaatctttgtagtctgacttgtgagaggacgtcaaagacttcctctcaggagtcagttccctgccattgcacccagctccttgcctagccttcttccacatctcctttatcacaggggcctcaaaactatagatggcagtgacttggcacggaccatacaattctaaaaggaagtcaacttagtgttatacttccacatggaatctgcgtttctaaagtagaggatagcattgaatataccaagaagtttcttcccagaaacaaaaccccgttctggatatagtgttaagaggaagctgttcctgtttcatgaggtcgtaatactcagatcggtgtgctgtcatcagccctgttgaatacatttccaaatcctttaggcttttgtcttttgccatactctagaaagtaaaaactataatcaaactcattttcttcgcccctttacgtgaattaatgttataatcaattgaactgcatggacatgccagtatctattttcaatctgtgtaggcagaatgaagaaagcataattgagcggtgctcatcttttaaaggcaaaatgaagttttcagtttggaattgattagttgttaggggattaagacctttgaggtaattccctgcagctggggcagttagacggcaggggatttgagtttccgccttgtaaacaaatctttaaagtggatttgctatttctgtggggaggggagcctctgtggaatttggtagttggcaagatttggcaattttctgcttgggaagaaaacaagatgggtctcaaatctaagtcctctttttctcagatcaacatcaccttttgaaaaataaattgattctttggccttaatgactactaaaggaaattaaaaacaaacaaacaaaacagaagaaaaatgattaaagaagccgggcgcagtggctcacgcctgtaatcccagcactttgggaggccgaggcgggcagatcacctgaggtcaggagtttgagatcagcctgaccaacatggtgaaacctcgtctctactaaaagtacaaaaattagttgggcatggtggcgcatgcctgtaatcccagctactcgggaggctgaggcaggagaattgcttgaacccggggggtggaagttgtggtgagccaagatcttgccattgcactccagcctgggcaacaagagtgaaactctgtctcaaaaacaaaaaaaaacaaaaaaaaaaaggaaaaatgattaaagtaagaatgaaaatttagttaatgttatttaggacagtaaaagcagatgtagtcacagaaagacaatgtgcagatgattatatggaaagaagaatgtgaaaccttcagatctctttaaaattttataatagctttgtattttcaaataaattgcaaagagtttctatacttgtatctagtttcccctattaacattgtacattagtgttgtgtagtgttttaattaatgaaacaatagtgataccattgattacgatttcatgaagtctgtagttcatttagagtcctttagtttttaagaagtgtcctttctctgttccaggatctcatccaggataccacattacatttagcagtcatgtctctttagtcgtctctttactgtgagtatttctcacacttctcttgtttttgatgattttgacagtttggatgagaattggttaggtattttgtaatctacacatcaactgaggcttgattgatgtttttctttaaaatatttttcccatttgtatacatgtgtggtatacaagtgcaattttgttacatgcatatattgcacagtggttaactcagggctttagggtatccatcacttaaatgatgtacagtgtacattgaagtaatttctcatttacccccccaaccccctcacccttgtgggtctccattgtctattatccactctacatccatgtctacacgttttataacacccacttatgagcaagaacatgcaatatttgactttttgtgcctggtgatgttttccttttgattaaactgggacacacatttatgggaggaagaccagacagataaagtggcattcttatcacatcatctcaagggcatacgccattgacatgacttattgctgttgatgttgaccatggacactgggctgaagtagtgtttttcaggtatgccactgtgaaattatattcccctgtttacaatactgtatactttagacataggttattatgtacaacccacacttaaaaagtggggagttatcttccacctccttgagggagtgaagtagtatctacataaattatttcatattcttatacaaagggtatttgtttatttcatttatttatatacttgtcttgatacaatgtaaatgaatcactacttatttatattattataaacatataaatatctatagtatagtttgggttacaatccaatacttattttgttactcacattgttcttgctttgaccactgggagatctttcagttggttcttgtaatacaccatttttaaaagcaaaatggagctaagtgtggtggcgcatgcctgtagtcctagatactagggaggctaaggtgagaggatcgcctgagcccagaaatttgagactgctttgagagctatgatcacatcactgcactccaatctgggtgatagagcaagaccctgccccagctaaaatgaaaacaaaaaacaataacaatgctacatgggaagtgagcatgacaatgtggtattttataattatatccaaagattagtaagcatgattcatggagaagtggctaaatctaagcattgttttcccatgagattgctgttggaaaagcaatagaaaaaaaaaaacaaaaaacaaagaattgagtgagtcaagagataggaagtctttcagttaccttagagtcacgttaggtatgtagagaagcagttcagattaacaaagttcaaaagatcccaccgtcagatctgtataacaagctttgcacacgaaagagctagagtatctgtgactctgatgtaagaaggtattaacccagtggaaaataaaaacaaaattaaaaatgcctaggtagactcatttatggttttatagtatccctactggggcacagatgggaagggagaaactgtttttaaataaaatgatcagaaacttagactgtgacattaatttgttggttcagtgttttaatttggaggtaaattatactaaacagtattatgacattttctgtagaaagtcttctacgtgtattgagtcactgcctgttatattggtttaatcagcaagtcatttttgctgaatctcttagtctccactaatattgtcttgaaggtgtaaatggcatgcaggttgcctaaataaagctacaacattctgtaaggcattttgtgaatgaactacttttgcagatggtacaggtgttcacccctgtaaactcacaattattttagaagtgatgtacaggttgtcagttgtccccatctgcctcattccccacatgcattgtcacctttgtgtcaatccagatctcattagctctttgtagacaaagatagaatggtagataatatataagtaaatgtggctgtgtttttgctcttcaagagaatgcacaagagactcactcttaattcttactatttcatgtatgtgcagcctcttaatgcttactatttcatgtgtgtgcagcttcttaatgcttactatttcatgtgtgtgcagcctctacaactacagtgcatctctattgtttgtacagtgacaataatggtaagaataataacttagtacataccatactgcagaaactgtttaaattacatccaatgtgcccatttaatcatcactttaaaatagtaactcctactcagtagcaatgtgcagtttatagatatctttcacatttgaagatatgaatctcagtgtacatatattggtatgcaaaaaaatcagttatatacatgtttagaccacttatattttaatcccaccaagcatatggaaagcttaaccttatgggtgtgtgtgtgtgtgggtgtgtgtgtgcaggggttctctaaacttaaaacctgttgtggatgcacatgaaattatatacagtgccaagaaggggcacaggccctgctcagtgagtcatctgactgcacgagttaatagatataacgtgaagggtcacagttctctatttgggtttttttgtacagcctctgtttctctgtctctacaaagcacgtagcctttttttcaagtctcgatgcctctttcacagctcagccctgggcctgctatcctgttttcactgcttcccttcttttttctacatgactttttattttactttaagttctgggatacatgtgcagaacatgcaggtttgttacataggtatacatgtgcaatggtgatttcctgcatccatcaacccatcatctatgttttaaggcccgcatgccttaggtatttgtcctaatgctctctctccccttgttccccaaccctccagcgggccccagtgtatgatgttcccctccctatatccatgtgctctcattgttcaaccaccacttatgagtgagaagatgcggtgtttggttttctattcttgtgttagtttgctgagaatgatggcttccagcttcatccatgtccctgaaaagggtatgaactcattctttttatggctgcttagtattccacctacatgcctatttctgagtcaagcacgttgtttatgcccagtgcattttctttatacacagaggctgagaaagaaccaggaagcctctgactgtttcaagtgtgttctctgctatatctatctactgattcaataagcacaagctcattgaatggaaaagggcaatatgcaaagggagcaaaatgagacatatatgtcaaaggaaagttccactgcaaatgtctttatttgatgtacacagagggatttgaattaggtctaggttttatgcccactttacagaaaaattgaaacttgatcaaacctatagaaccagtaaatgtcaggaccagacctggagacacactcccctcggtgcatattttatatcttcttcattttatcaccccaaatcatttactcctgaagtaaattcatttaatatttaacaaatgtttacaaaagttgactatagtaaaagtattatgttagctgctatgaagtagaaatataatcacacgattatcttaatgaagcatctctactttatagaagggaaattgagattctgaatcattaaggttttaagtgtcatcacagggattgttagtgatagaatacagagttgagtctagggcttattaaactgtatctgtcactctattcgtgtattagtctgttctcatgctgctaataaagacctacccaagaatgagtaatttataaaggaaagaggtttaatggactcatggttccacatggctggggaggcctcataatcatggcagaaggcaagggagaagcaaagtcacatcttacatggcagcaggcaagagagcacatgcaggggaactaccttttataaaaccatcagatcttgtgaggcttatccactatcacaagaaaagcataggaaaaacccaaccccatgattcaattacctctcactgggtccctcccacgacatgaaggaattatgggagctacaattcaagatgagatttgggtgaggacacagccaaaccatatcaattggcctatttcagtttgagaacatacatctgaatttcaaggaaatttgactacaattgaagaaattgagtatcattactgatttctaatggatgttgctgtatgtaatattttctatatgagagacaagatgtaaggatgaagatgagggacaagttcttcatctagaaagatcaagggtgctgtcaaggaagagttgaatttgattcagaactgaagaatatttgggctttcaactagctcagagaaattctgtagtcactagaagatccttgcatttgagagggcaaatttgaatatgttccacaagtaaaatcagaaattgggctttttattttactaaccagattaatgctctattccagaaatgcaaataggttgtacttttattttaacatggggctacttttgcctactgttttgctggtttttgttgttttattgcaaaaccacaattactgttacacaatggaagctccatcagtgaagatactttatctactttcttcactgttatattatggggtaaaaaagtgctttgcgtatgagaacaagtaataatgaaactggttacttttggcagagtctgcgttatacataggctcttttgtgaagatctaaatatggttatgtaatcagttgttcagacaagagaaacgtagattaattgaattagataatcccagtggtctctcaaagatcaaacaataaaacaaactattatcgtaccccatttgaagtacttttgtataacaacagcgttttaacatgtttatttggattaagattatcagcgactttggaagtcaattaagtgtgaaagcgaaacatggtatttgacgacagtaccagccctgtattgctgcaaatacattctataatagcactggacgcatcattcagattttatgacaagatgcaataaccagctacctgtgatgataaaatagacttttttcaaataagatttctagcaacctttactatgcatgttttctttgttgtcttgtaacattaaccatggacatcacatggcaagcatgatgaagagaatttctttagaatcgagttttataacaaagaatgtattccaaagtaaggatttatgttggtggataattatgagccaggccgactactatgaataacttacatcagggctagggttggagaaaatgaggagagagtagtacaattaaatgatcaatcataactagtctatttgtttatacaataatgaaaaatagtagtttctattggactgaaatgtttcaggtaaaattgatgttatatcaaattaattaaataataaatgtaattgccttaaatcaatgcatgcttaggattaatactgattaaaaatctaaggatgcaaaaagatttataacaaaatgacagtaacagtggtctttcctcaatctctttttctcccaaaagcaaaatctgtttataattttaatttttatgagagctacttatataaaaatgtagacaagaagaaattattttttctacttgtgcatctgaaagtatcttttcttttctttccttccttcctttcttccttccttccttcttctttccctccctccctcattcctttcttccttcccgcctttcttccttccttctttccctcttttctctttcacttccttcttctcttatcactcctcccaaatttaaaatcatctgtccattgtctttgtcatccagtatagataataaggaatctgatggtcttctcattaatagtgaacttgctgtttttctctcaaaaatgagaaagcttttgggagcttctttttatcttaagtgttctgaaatttcaagacagtatgcctgggttctttttaaattccttttgctggatactcaggtttcaaatcagaaggtttatgtccttcttcatttctgcaaaattatcttcaattatttcttgtactatctattcttcatctgtgttcttactgagataccgaatcatctgaatttgttccttttttgtatttttttctttcttcatattttataagaattattcagctttattttaaagtcctatttttattctctaagtgactattcttgtatttaactttttatagcatggtctacattttaatggttgtcatatatttttgaatgtttatttacagagcatcacttttaaaattgttttctttccataaattgggtctgtttgttttggaacaagcttttccatgtatttttctttttcactctctttagtgatctccagctgtcaattcatgttgtagaaggacagtgatgttggtcacagattccccaaatgctaaggttaggtgagaaccagcatactcatcaaagatcttcattttccccaaagacaaaatgcagtgcttttagaaaaaaattaattacttttgggatgttatttccctcatgataaacatggttgccatttacactctctactgctttgagagagaaatttctgtcaagctgtgaaattggtccacacacagcacttcaattaatttcagtttttgaccctcattgtcttctcaaaacgatcagcaccttctcaatctgaagtcacaggatggcagaggttctgcttagcagactctcccactttgaattgcagtgttttgttttacctctttcatctattttccaatttttagaaatttgttgactttttttgtaaactttttttgcatttgcacttctacatttatttatattattacttttacttctgtgggatctcagtaatgaaggaaacatatatgcctaggttaccatattgaattcaacatagagagtatgattttttaagtaaatcctgaaagaaaactttctataaatctacaaatcctcttgaaattttctttttatatttatttgcaaatttttaatttcttgtatttcgtaaactgagaattttagatacttttacatttgtagcatcaaaaataattttttaaaatgatgacatacttagagtcaatctattgggattgagtgtatttttaaaattagaattgttaaaatagtatttgacatttgctttgcttctggtactggtaggctagtttgctgcagaccaactttcacaccaaaaatctctagaaaaaaagacacaaacttcttatctcaaaatatccatgtttcagcagaggttagctgagttttgctgtattcagggtgtcattgggactgcgatctcgtctgaagcttgaggtcctctcctacacatgttcaggttatcgttccttgtggctacaggactgaccaaagttgtttcctttctggctcttggccggaggatatgtcaagcttctaaattatgctcacaatcccatgccaagtgtcctccatcataggacttctcacaacatagaagactgctttgtcttcaagacgagcagaagagcatctttctcacattaaatctgacttatcttgtccctaacctcttgacagcatttaataaaagctaaattcgttagatcagactcacactgacctaaacataagattaataaggatcagctttctattggttaatttaaagtcaagtgagtaagatgctaattacatctgtaaaccgctttgctatataaaataacaatcttggcagtaatatcccctcatattcacagtttcctcttacactcaaggggagatgattatgcagggtttatgcacatggaaccagacatcttgggagtcatcttagaattctgcctaccatgaagtctacataaccaaaaccaggagaaagaaaaagaaaaaaatatatagttcatgggaaatccagatattggggttatcttaagtaatttcgaaataaatatttaatatgttaagtattttaaatgttttaaatattcaaaaaattagatggccatggaaatgttcattagagaacagaaattaggattgctagacttaccaaataaacatatagagttccaagttaattttaaatatcaagtaaatagcaaatactttatacaatatatcgcatgaaatatttgggatatatttatactaaaagtttattgttactgaaattcaggttcaactgggtgccctttatttgacaacactaactgtaaactatcaaaataaataaaatttttgaaccttaaaatataacaaatacaattaaagactcaagaggttcaaagcacaacagactagatatgactagatataattgacaagaggatgagtaaagtgctaagtaggtcagagacaacatatactgaaaaacagagagaaaaaaatggaagattcagaaaagcataagaaacacatacgacatagtgaataaatgtcaaaaatatttattgtggttcagaacagaaaaagaatggagaaaaagtattatttaaagaaataatggctagggatattctaaaactgacaatagaaaacaagtaatagattcatgcaacactgcatttattaagaaggataaattcaaataagccatacctaccacatcatggaaaatagtaaaatgaaaaaaaaaatcctaaataagctagataagaaagtgtcatactacctttaaagttgcaacaatattataacacgtttaattgatttactataagaaacattggaaactagaagtcaaaaactgtgatccttgaatttttcttagggggcaggtaccatattgccaaactagaattttattcctggcaaaaacattctttaaaatgaaaagacaaataatggagaatgaacttgaaattgaacggtttagaattacaaagattttttcccctatttccaggtgagctcaacagccaattaagttttattataaaaaataaagcagcttatatctacttgaaaaagtgaaggcaaaattaaaatgttttcatttaaactaaaagtcataggatttatcactagcagaactacactaaagagctcttcagccatcatgagaatgttttgaaatataagcagaaaggaatgaaaaccagtgaaaaggatattatgtgggaacatctaaaagaatacttcccatacaaagcaacattattaattacatagtttcatgcacgtccgtgtgaagagaccaccaagcaggctttgtgtgagcaataaagctgtttatttcacctgggtgcaggtgggctgagtccgaaaagagagtcagcgaagagagataggggtggggccattttataagatttgggtaggcaaaggaaaattacagtcaaagaggggttgttctctggcaggcaggagtgggggtcataaggtgctcagtaggggagcttttgagccaggatgagccaggagaaggagtttcacaagacagtgtcatcagttaaggcaggaacaggccattttcacttcttttgtggtggaatgtcatcagttaaggcaggaaccggccatctggatgtgtacgtgcaggtcacaggggatatgatggcttagcttgggctcagaggcctgacattcctgtcttcttatattagtaagaaaaataaaatgaaatagtggtaaagtgttgggacagcgaaaattttgggggatggtatggagagataatgggcgatgcttctcagggccgcttccagcgggattggggctggcgtgggaacctagagtgggagacattaagctgaaggaagattttgtggtaaggggtgatattgtggggttgttagaagaaacatttgtcatttagaattattggtgttggcctggatacagttttgtatgaattgaaaaactaaatggaataagagaaggagaaaaacaggtataaaaggtctaagaattgggacgactcaggacatctgattagagagtccctaaggagattcagcatagtcctgccagcaaagattatttacttcaagagttaagagtggcagtttggggatagcaccaggagatatcagctgtgatggcttggagaaacagtgtaaaccggcagtgtaaacaagagcagggcatgtatgagtagttgagaatggtgaataggagtatgactagacagaagatagtagggatgactagttttttggggcacagtctaagttggtctggtgtctggaatgagactggggcctaataaaaaggagcgtctatacaggagctcaaatgggctgtactttgtagcattctgaggacaggtctgacttctgagaagggaaagtggtaaaagtattgtccagtcctttttaagttggtggctgagcttggtgaggtgtgttttaaaaagatctttagtctgttttacttttcctgaagactgaggactgtaagggatataaaggtttcactgaatactaagagcctgaaaaacttcttggctgatttgactaataaaggctggtctgttatcagactgtatagaggtgggaaggctaaactgaagaattatgtctgacagaagggaagaaatgactgcggtggccttctcagaccctgtaggaaaggcctttacctatccagcgaaagtgtctacctagaataagaggtattttagttatctgactcggggcatgttgagtaaagctaatttgccagtcctgggtgggggcaaatccttgagcttgatgtgtagggaatggagggggcctgaataatccctgaggagtagtagaatagcagatggaacactgagaagttatttctttgaggatagatttccacgatggaaaggaaatgagaggttctaagaggcgggctagtggcttgcactatagcatagcctgcctttgctgatgtgtggcgattaggcctggtggaactgccatcaataaatcaagcatgatcagggtgaggaacaggaaagaagaaaatatggggaaatgggataaatgtcaggtggatcagagagatacagtcatgggggtcaggtgtggtatcaggaataatgtgggaggccggactgaagtccgtgccgggaacaatggtaattgtgggacttaacaaagagtgagtacagctgaaggagccgggggagcagaaagtacatgcatcaggtatgaggaaggaaatagattttggaagttatgagaaatgtagagagtaagttgagcatagtttgtgattttgagggcctctaaaagtattagggcagcaggagccgctgcacggagacatgaggcctaggctaaaacagtaaggtcaagttgtttggacagaaaggctacagggtgaggtcctggctcttgtgtaagaattctgaccgcactaaccatgcctaggaaggaaaggagttgttgttttgtaagggattgaggtttgggagattaatcggacatgatcagcagggagagcacgtgtgtttttatgagaattatgctgagataggtaacagataaggaagaaatttgggcttgactgaagtaatgggggctgtctgtgaagctttgcggcagtacagcccaggtaatttgctgagcctgatgcgtgtcagggtcagtccaagtgaaagtgaagagaggctgggatgacgggtgcataggaatagtaaagaaagcacgtttgagatccagaacggaataatggattgtggagggaagtattgaggataggagagtatatgggtttggcaccacggggtggataggcaacacaatttggttgataaggcataaatcctgaactaacttgtaaggcttgtctggtttcaggacaggtaaaatgggggaattgtaaggagagtttataggctttaaaaggccatgctgtagcaggtgagtgatagcaggctttaatcctttcaaagcatgctgtgggatgggatattggcgttgagtggggtaagggtgattaggttttaatgagatggtaaggggtgcatgatccgtcgccaaggagggagtagaggtatcttatacttgtgggttaaggtggggggatacaagaggaggacgcaaaggaggctttgggttggggagaagggcggcaatgagatacagatgtagtccaggaacagtcatggaagcagataatttagttaaagtgtctcggcctaataagggaactgggcaggtggggataactaaaaaggagtgcttaaaagagtattgtctaagttgccactagagttggggagttttaagaggtttagaagcctggccgtcaatacccacaacagttatggaggcaagggaaacaggcccttgaaaagaaggtaatgtggagtgggcagcctccgtattgactaagaaggggacggacttatcctccactgtgagagttacccgaagctcggcgtccgtgatggtctatggggcttccgaggtgatcaggcagcatcagtcttcagccgctaagccgagaagatctgggaaggagtcagagagccttgggccagagttccaggggctctgggagtggctgccaggtgagttggacagtctgatttccagtgggttcctgcacagatgggacgcggcttatgaggaatcctgggctgcaggcattccttggcctggtggccagatttccggcacttgtagcaagctcctgtgggaggaggttctgggggaacgcctggctgctgtgattcaggcgtttggaagttcttgtgtgctggagatgtggctggggtttgtctcacagtggaggcaaggaattgcaacttttttctattattgtacaccttgaaggcgaggttaattaaatcccgttgtggggtttgggggccggaatttaatttttggagttttatttaatgtcgggagcagattgggtaataaaatgtactttgagaataagatggccttttgaccttttagggtctagggctgtaaagtgtctcagggttgctgccgaacgagccatgaactgggctgggtttttcatatttgatgaaagagactaaacgctcactgatttgggaaaggtctgataaagaaaaaggagcattaaccttgactatgcctttagcttcaccacctttttaagagtaaattgctgggcaggtgcgggagggctagacgtgcaatgaaactgtaagcaggacccggtgtgaggaggggaggtgataaaaggattatagggtggaggagccgaggctgaggaagaattgggacctagctcagcctggtgaggagcagcctggggaggaggggagaggtcagatgggtctgtagaaaaggaagattagaaagactcagtgacacttggggttgggactgaggggacaggcgggagggaaagaaggaagattgggggcgagttgcactgggtacagagactagggagggactgatgtgtaaaagaatgcctggacatcaggcacctcagaccgtttgcccattttacaacaagaattatttagatcttgcgggatggaaaaattgaaagtgccgttttctggctatttggaactactgtcaagtttgtattggggtcaactggcattgcagaggaaaataagatgcttagattttaggtcaggtgagagttgaagaggttttaagttcatgagaacacaggctaagggagaagaaggaggaatggaaggtggaagcttgcccatagtgaaagaggcaagcccagagaaaagagtagagacacggagaaggggtcgggggttcttgccctccagaaaagcagagaaggggttggggcacagagatattaggtcagggtgcagaaataagggatcagggtgcagagatataagaggtcggggtgcagaaataagggatcagggtgcagagatataagaggttggggtgtggaaataagggattggggcacagagatataagaggttggggttcctgcccctcctctagaaaagcgggacttgccgctaagagtgaaggagaaggggttggaggtttcttgccccccagaaaggcggtgaaggggtagagacatggagagaaggggttgaggtacttgcccctcccctagaaaagcgggacttgccgctaagggtgaaggaccaaggcaggtgtccctgtgtggtctgacacctctgaaatgtgggtgaataatcaggcatccctgcaatgattaaacaccaagggaaggctgccttcccagtctgtgacaggcaccggagttttgggtccatggataaaacgtgtctcctttgtctctaccagaaaatgaaaggaattgaaattaagagaagggagagattgaagtgtggcgccaagattgaaaggagaaagaggctgagggatagtgagggagattggagaagagagtaaaaagaggctgcttactagatttgaaattggtgagatgtttcttgggctgattggtctgaggacctgaggtcgtaggtggatctttctcacagagcaaagaacaggaggacaggggattgatctcccaagggaggtctcctgatctgagtcatggcaccaaatttcatgtgcatccatgtgaaaagaccaccaagcaggctttgtgtgagcaataaagctgtttatttcacctgggtgcaggtgggctgagtccaaaaagagagtcagtgaagagagataggggtggggccattttataagatttgggtaggtaaaggaaaattacagtcaaagaggggttgttctctggcagacaggagtgggggtcacaaggtgctcagtagggaaacttttgagccaggatgagccaggagaaggaatttcacaagacaatgtcatcagttaaggtaggaacaggccattttcacttcttttgtggtggaatgtcatcagttaaggcaggatctggccatctggatgtgtacatgcaggtcacaggggatatgatggcttagcttgggctcagaggcctgacacataggatttaaaatatggagagaataagaatacatggcaacaatagcataatagatggagtgaaattgagttaacatctaaatgccttgcatttttgcggaagctttaaactactatcttatattagaaatgaataaggatatatatcgtatgtttaaggaaattcaccatagaaaacaaaaaggatgtactatataatagtaaactaatgaagaatgtaataatgaactactctcaatataaaagaaataagtaggacaatataaaacagataggacaatttattttattttattttactctaagttctgggatatatgtgcagaatgtgcaggtttgttacataggtatacatgtgccatggtggtttgctgcacctataaacgtgtcatctacgttttaagccctgcatgcattaggtgtttgtcctaatgctctccctccaattgccccccaccccctaaaaggccctggtgtgtgatgttcccctccctgtgtccatgtgttctaattgttcaactcccacttatgagtgagaacatgcagtgttttgttttctgtgcctgtgttagtttgctgagaatgacggcatccagcttcatccatgtcctggcaaaggacatgaactcattcttttttatggctacatagtattccatggtgtatatgtgccacattgttctttattcagtctatcattgatgggcatttgggttggttcaagtgtttgctattgtaaatagtgttgcaataaacatacatgtgcatatgtctttatagtagaatgatttataatcctttggctatatacccagtaatgggattgctgggtcaaatggtatttctggttctggatccttgaggaatcaccacactgtcttccacaatggttgaactaatttacactcccaccaacagtgaaaaaacattcctatttctccacatcctctccagcatctgttgtttcctgactttttaatcaccatttaaactggtgtgagatggtatcccattgaggttttgatttgcatttctctaatgaccagtgatgatgagcttttattcatatgtttgttggctgcataaatgtcttcttttgagaaatgtctgttcatatccttggcccacttttggatgaggttgcttgatttttcttgtaaacttgtttaagttccttgtagattctggatattagacttttgtcagattggtggcttgcagaaattttctcccattctgttagttgcctgttcactctgatgatagtttcttttgctgtgcagaagctctttagtttgattagatcccatttgtcaattttggcttttgttgcaattgcttttggtgttttagtcatgaagtctttgctcatgcctatgcagataggacaaatttttaaaaaattcatagaatagtccatttaaactcaaatagttcagctattacattaagttaatatggacaaaatcctgcaattcgtaggcaaacaatttaaaattgaatactgaaacaaaatgtaactgtgttctgctgataagagatgtgtctttaatacaaaaataagaaagactgaaagtagaattacggaacatgataaacctaatcaaaacaaagcttgtaattctaaagaaactatactgaaaagcaagaaatatttatacataaagtttgaaattttataatgataaaaagataaaacaacagaaaaagatgacaaaaataactttgtaagcatttaataacctaatctcaaaatgaataaaacaaaaaagtacaaaataaataaacaatagaagaaaaataatgaatagctacatttacagtcatagttgaataatgcagtttttctcagtaactaaagaataagcaaaagatgattggataaattaaatatgttatatacatataatgaaatataattttgcaataaaaataaatgaagtattgatacatattacattaaacataaattcaacttgaaaactaagtgaaaatccagtcacaccctagacaaaaacttacaaaaagatattgtaaaattccatttttatataatgtatgtaataagtaagttcatggagttagaaagtattttggtgcttgcctgggactgatagatgaaggtgggggaataatgagaatgactgctgatgaggacaagtgtttccttttaaagtgatacaaatgttccagagtttgatgatggttgcacaaatgtgtgaatgcaataaaaaccactgaattatacactttatttgataaattataaattatttatccataaaactgcaaaaatgattttttaactaaaacttgcattcaatctcatccacctgtaaatggcattaaaattattttcagttcagtatattctagaccagtggttttcaaccaagcctaactttgtctcacaaggaacattcgtaatgtccgaagacatatttgattgtaacagtagaggtggagtgggtatttgcattaactaggtagaagccagaaatactagtaaaaatcttacagtaggtaagacagctttcaaccaaaacaatacaaaacaaaacatgtaactgccccaaaatatcaatagtgcaaaggttaacaagccctcttttagagacattgatctctattcctatataatttttaagcctcatggtaatagagtctatcttggaatgtgaatgaagcataatgtaaacattacaagcaacaacatgtcacatttttagaatttacatcattcagaataccccttagtatcacctgaccccaaagcttagaatgattttgccaattttgcaaatatgaaaacttagattatgttattctttttctaatgggccaagaaaggtataacactacactgtcactttttttttacttctatactaattactttctgaatatatatagatatctaatctatctatctatctattcttttaccacttaaaaatattattttaatctgtttaaaactaaggcctagcattaagagatatacctaatgctaaatgacaagttaatgggtgcagcacaccaacatggcacatgtatacatatgtaacaaacctgcacgttgtgcacatgtaccctaaaacttaaagtatcataataataaaattaaaaaaaaaactaaggcctaaaaataagaagtgctattttgtctgacagcaaaataaataagtagtttttaaaatagtaagctgaagtttaataattatgttaaaattatagtaacttttttctgcagtaattatttttgataaaaattaatgcaattacatgacataaaattaagatatagtttagtaagaaaaacacaaaacaataaccattgtagaatgaaaataagttttaatatatgaaagacttaagaatcctttaatacattaaactgactgatactagtgttctttgctgaatcataggtaacatatttattgatttttaaaatagggttagcgtagaataaatgaaatttataatttaatagtcatcaacttcacattcattttgcataccacaggagaaaaaaagaggctcagaaagattaagttctaaggataattgattttaaaattggggccagaattaggactcaaacgcatattttctgaggtctagccctttgtatattacacccttgctgaagactaaattcgagtgtgtgtcttattggcagtgagaaggcagatttgccaatatgtagtttctaaatcttgcatttatttctatacattttaaatttaatttagaaatagaacagggagagtaatgttagcaagatggtcaatcagagttgtttggcactcatccccacaaaaagggttgtggggttcccctccaacataacaaatgaacaactatatttcagtggaagttactgaggaagtatgctggggaacataaggggagtgaaaaaatccctgtgaagcacagaaactcaggatagaaccataaaagaagagggagacacacaaactctaccaaattgttccctcactgggattggctcatagccaggaggggctactgcttatcgagaaaaggtaagctggagacaccagttgtccccattactactgcagatgcctgcaggctgctacgggagggtcctgcaagcctcacagtcaacaaattctatctggggagctttctggagttcacatagctgtgttgccctatactaggagcccatttcgtatacccaccaactcccgtgacctaagttggaactgcatagtaccatcctgaaaccagactgactgctagagtatgtcctactctgggggccagtagccactgtgtctctccatccctgaggccccagcatcattccaccatgctcacaaggaaggccacagaactacaaccccagctactttaagcttaggcccagtggaatggcccaaatccatgcaacatcccctcctccctgggaaacaggcatatctgcacagcaagaaagccaacaagcagctgattggcctgtggtgcctgtgtgcctgacccaacaggaaggatggcagcagccccacccattgaagaacccacctcagagttggccagcccactatacctatgtaagccatgcctgacagccagactaggggtggccctgcagccctggaaagtccactacatagccagctggcccaccatgcaagtctgtctaaacagtgaggctggtagcgttgcccctaacaaaactgagccattacaatcacaaactcctgtagcctaggccactgatgaaattgcagacatcattgatgagaattatagctaatgaaactgcagagaaccacacagaaccaaagataatggatcatactcaactgacatcctagacacacctataggaaaaagtctctccttacaaaagttagcccgtaaagttggaaaagataactgttccaccagatatgcagatatcaatgcagagatataagaaacatgaaaaagtaaggaaacatgacatttccaaaggaaaataataattctacattaacagccccccataaaaaaatttatgcaattcctggaatttaaaataatgattctttttaaactatgagatataagagaatatggacaaacaattcaatgaaataagaaaaataatttattatctgaatgagaaattcaacagagggacagatataaaaaaagaacaaaacagatatcttggagctgaagaattcaatgaataaaagaagtacaactgagaggtttaacaacatactagccattttggcagcatatgtatttatgatttgtatagaagaaacagtttctaaatttgaagacagttcttttaaagtaacctaattagaggggagaaaaagtaaacaaaaataaaaagcaataaagaaagtctacttatgggacaccattaagtgaatgaatatttgcattataagaatgccagagggagaagatataaagaaaggcagaaatattgaaatagtatgtggaaacttcccagtcttagcaaacatatgaacaaccagatttagaaactctaagactcccaattagattacaacaaaaatgatctactccaaggtacattataatccatctatcaaaagtcaaagacaaggcaagaattctgaaaactgaaatggaatagtgtcaagtcacatataagagaattctattatactgtcagcagatcaatcattagaaaccttgcagcccagtagagaatggtatgacatattcaaagtgctgaaagaaaaaaaaaatactggcaaccaagaatactatatcagcgaagctgtccttcagcaatgaaggagaaataaaaaccttcccaaataagcaaaatctgagggaattcatcaccactacactagtctttacagaaatgcttaagatgatagtgctacaactgaaagtgaagataattactattatggaaacacatgaaaatataaaactcaccagtagagggcagctcataaccaaaatcagaatatcccagtgctataatagtgctatgtcaatcttttaatcttctgatataaagtttaaaaaccaaaggggtcaaaaaacaacttctacaattagtcattaagaaaaacaatagataaagacacacattaaggcaacaaatatataaattacagggaggggtcaggaaaaaatgtctagagtatttttatgtgaccaaaattaagttgctctcatcttagaatagtcgattataactacaagaacctttatgttagcttcatggtatccacaaagaaagaaattacaacaggtacacaaatgagaaagggaaaggaagcaaagcttagcacagcagaaaaccacccagccatagtagtaaataataaaagagaaaaaaagaacaaagagtctatacaacaatcagaaaacaattaacaaaatgtcaagggcaattcattgcctctcaataataaccttaaatgtaaatggattaaattcttcaatttaaagattgcattgttgaaaggattttgaaaaactaagaaccaactgtatattgcgtacaagacactcactattaaagataaacccagactgaaaatgagaggataaacaaagatactccatggaaaagaaaaccaaaagcaaaaggagtggccatatttatgttagataaagtacactttaagtcaaaaactgtaaaaagagacaaagaaggtcattatatttaataaagggagaaattcaacaaaaggatataccaatgataaatatatatgcacacaacaccagagtgtctaaatacataaagcaaatatcagatctaaagggagagatagactacaatgcaataatcacaggaaatttcaacttcccacttttaacaatagataggttgtctagatataaaatcagcaaagaaacatcaaacttaagctccaccatagtcaaaatgaatctaacatatacttacagaacattccctccaataattgcagaatataccttcttctcagttgcacatgaaacattctcaaggacacaaaacatgtttcaacatatttaaggtagagagtatatcaagtatcttttttgaacacaatggtataaagctagaaatgaacaacaagaaaattttagaaactttacaaatatgtggaaattaaacaaattgcttttatatcaccaatggatcaaggaataaattaaaaagaaatttaacaaattccttgagacaaatgagaatgaaagcacgtcgtttcaaatcctatgatatacaatgaaagcagttcaaacaaggtaagcttatagtaataaacacctatcacataaaaagaaaaagctttcaaataaacaacctaacgatgaacctcaaagaaataggaaagcaagaaaaaaatatataaattggtagaagggaaaaattaataaagcctaaaacataaataaatggacacaagaaaaacagttcaaaagatcattgaagagaattgttgattattttggaaaaaataaacaaaatttacaaaccttcagccagactaagaaaaaagagaaaactcaaattagtaaaatcagagataaaaaaagagacaatacaactgatactacagacatacaagagatcataaaagactattgtgaagaattttacaccaacaaatttggtaacctaaaaaagaaaagataaattactggacacatacaacctaccaaaattaagttgaaaatcataacagaccaataatgagcaagaaaattgaattagtaaaaagtcttccatcaaagaaaagcccaggatctggtggcttcactgatgaattctaccaaacattttaagaagactaataacaggtttttttgaactattttagaaaattaaagaggggagaatattttcaaattcattttacaaagccagcattacattgatgtaaaaacaagacaaagacacaagaaaaaaaataaataaactgcaggtcaatacacctaacaaacatagatgcaaaaattcttaacaaaatgatagcaaactaaattcaacagcacatcaaaaagatcattcactatgatcaagcgggattcatcctagggatggaaggatgttttaacataacatacacaaatcaataaatgtggcacaacacattaacagaaagaaagacaaaaacaatgtgatcatttcaatagacacagaaaatggatttgacaaaatttaacatccttttataataaaactctcaacaaattaggttcagaagcagtgtacctcgacccaataaaggccatacaaatgacagactcacagctaagatcacatttaatggggaaaacccaaaagattttcccttaagattagaaataagacaaggatgttcattttcactacttctattcaatatagtactggaagttctaactagagcaattagacaacagaaataaaataaataaataaataaatatagattagaaaggagaaaggcaaaatatctctctttttacaagtgacatgatgttacagaaggaaaacactaaagattataccagaaaactgttagaactaataaacaaatttagtaatattgcaggacagaaaatcaacatacaaaaattagttgtgattttatagacaaaggttaactatttgaaaaagaaatcaagaaaataatttcatttacaatagcaacagaacagaaagataccttggaataaaccagaggcttgataggtatttacactaaaaactatgaaacatcaatgaaagaaattgaagaggacataaagaaatgaaaagataaactctgtgttcatgggttgaaagaattaatattgtttaattggccatattacccaaaactgtctacagatttaatgcaatctatatcaaaataccaatgacatgcgtcacagaaataattttttaaaaatctctaaaacttatgtggaaccacaaaagacccaaaatgtccacagcaatcttaaacaaaaagaacaaagctagaggcatcacattacttgacttcaaaagacatcacctaactcccattacaatggctatgattaaaaagacaaaagaaaacaaggttggtgaggatgtggagaaaagagaactcttggtggtaatataaagtagtaaagcaattacaaaaaacaggatgcaggttcctaaaaaagttaaatgtgggaccatatgatccacaaattctactgaatatatacatacgaaggaaataaaatcaatatgtcagagacatctgcacttccatgtttattgcaacactatttataatagccaagacttggaatcaacctaaatgttcaacaaatagtaaatgtatacatatttacacaattgaatattattcagcaataaagaaatgaaactgtgtcatttcagaccaaatggttgaatacggaggactttaaatgtattcgtctgttcttaggctgttaataaagatatacccaagactgggtaatttataaaggaaaggggttttattgactcaccattcagcatggctggggaggcctcaagaaacttacaatcatggcagaaggggaagcaaacacgtccttcttcgcatggcaacagcaaggagaagaatgagtgcccagtgaagggagaagcccttcacaaaactatcagatcttgtaagaactaactcactatcaccagaaaggatgggggaaaccgcctcccatgattcagttatctccattggttcctcttacaacacagggtattatgggaactacaattcaagaagagatttgggtgaggacacagcctaaccatatgatatcatgttaagtgaaataaataagacacagaacgacaaacaccaaatgatctcattcagatgtagaatctaaataaatacgttgctcttacggaagtagatagtagaacactgttttaccagagatgatttggaaggggaaaatggagagaggtttgtcaatgggcacagagttacaattaaatagaagaaataagttctgttgttcgattgcatggtagggttactaaggttaacagtaagttgttgttaaatgaatttttgttgttgttttttttttttttttgagatggagctttactctgtcacccaggctgaagtgcagaggtgcaatctcagctcactgcaacctccgcctccccagtgcaagggattctcctgcctcagcctcctgagtagctgggactacaggtgcatgccacgacacccagctaatttttcatatatttagtagagatgggtttcaccatgttggccaggctggtttcgaactcctgacctcaggttgatccacccacctaggcctcccaaagtgctgggattacaggcgtaagccaccatgcctggacattaaatgaaatttaacctaaagctgcattcttacatattttaagttgagcctaagagtctcttcctacatagtgaactgtaacctaagtggatgtgtaaccagattataatttaaccttgtgccaatcactgggtttcagctaatcaaagcagccagttatccaaatcgtgttcaaataaggcaaacaccaagctgtaaccaatctcgctgtttctgtgtctcacttctgttttcagtacttcatttttctttttctgtccataaatcttctacgtggctgcactggagtcccctgagcctactctggctcagaaggctccctgctttgcaaatggttctttgctcaattaaactttattaaattgaatttgtctaagatttttcttttaacattacaaaacagctaggactgatgtctttgaacattctcatcacaaagaaatgataaatgcatgaggtaatgaatatgctaactaccctgatttgatatttatgcaatgtatacatgtattgaaaatcaaatggtaccccataaatatgtacaaatataatgtgtcaatttagaaaaaggaaaaaatagaacttgggaagaaatatatcttctaagaagatggcattttaggaaaacaatctctactaaacttattttcaaatgtttataaattgcataatttactttgaaagaggtatgaatgacttaaaattcagagtatcaagacttctaagttattaattgatatgtaaatacatatgctacattatgaaatataacatgttaataaatatatacctattgaaaaagtgtatacgtttatttctaagaaatataaactctagtacaattctattcctatttgaccagatgtctcctcacaacctaggtgtttgttttaatcatctctcttcctgctagactaacttgacatgtataaattctctactaatgcaattaaactgacctgcgtaagagacaaaatagccaatgacaaatctattactaagatcttgcattagtgtggtacatttgttacaattaaagaaccaatagtcacatattattttaactatagtccatggcttacattaattttcattccttttatcatacagttctatgggtgttgatatacaaactgcatatacctacagtttcatgaaaaatagcttcacctgtgattcacctatttatcctttctcttcctcctcacaagcctctggcaatgactgattttcttttttttttttttttacagtctctatagtttttctctttctaaaatcccatatggttaaactcatacagtatatagacttttcagatgggcttctttcacttagcaaaatgcatttgatgtttccctgtgtcttttcatggcttgatagttcattttgtcttcttgatatgccattacactaatatatcatagtttgtttatccatttgcttactgaagggcatcttggttgtttctaggttttggtgattataaacaaagccactgtaaacaggtttttgtgtggatgttagattttcacctcactcaagtaaatacctaaaagcataattgctaggtcatatggtaagaatacgttatgatttataaaaacctgccaaaccattttccacaatggttgtatcattttgtaatcttgtcagaagaaataagtgttcctgttgctgtgcctccttgtcgatatttggtgttggcaatgtgttgggatgtgatacatccattctaacaggtgcatatttcattgttgttttaatgggcagttcacatgtgtattttttttccttttctacagccgtattattccaacacttccacttgttgaatcgatggcctatgttgcttcattgggacggcagaaccaggtcttgaccataaagtaagtctttaattccaggcttttatatatgggagaagagtaattttttaaatccacaagaaatccttcacatattatgaatatatatggggcattatgtcaaaccacagtgtgaagggagaacatgccatctggagtgggggtttggaggcaccgggaaatgcctctgctttgaggagtcgtcgtccaggatttgagagagatttaaagtttattgttctagagaaggctttcattacccaagatttccccttccccaggctcttagccacagaagaaggggcgaggaggcagcaaggtgagtgagttgataggaaagggctgaaggaaaatgcttgaaaatactgtcagggctctggttgcttgagccttgcctcccactactccaccagcagagagcagcagaagagaagcaatggaatgggaagagctcctctataacttgtggaggggttcatttctcataggtgccatgggttctgcaaccagcaacacctgggaaagcagcatcttattctaagtcagagagaggctgagtccacttgccatgtccaagtggggcacctttgttctcactcgcagaaatatatagtatgagcctgtagtgccatagatggtagatgaagatggtctctacagacattggtcagtgttagctctcctcagcaggtatatggcagaaacagtcagcagacgtatggtggaaactcagaaaggacaggatcaatacacagaaggtagtggggaatgaagaatagggctgactggggacagtggttcatgcctgtaatcccagcactttgggacgccaaggcgggaggaatgcttgagcccaaaagtttgagaccaacttgggcgacatagtgagaccccttctctataaaaaacaaaaacaaacaaacaaaatagctgagggtggtggtgtgtgactgtggttccagctactcagtaggctgaggtgggagtatcacttaagcccaggaggccgaggctgcagtgagccgtgatcatgcctctatactccaaactggatggcagaattagtaagaccatgtctcagtaaaaaaaaaaaaaaagtaagaaaagaataaggctcagggcaaaagtaccatggcagaggctggtggtggacattaccaatgtgggagattaaagagtcccagaaagccagcagagtcagcaagattcaagatggaggcctagtcattgggccatctggctaagctccatgaacactattattgtctatccacacccttgcggatctcaggaacaatcaacacacgacagtagctacagacacatcagtccagacccagagagaacagaacttatgtccataactcaagtgacatatggtgttctccaatcagaggtcacagaagcaagccaaaatgaacatggaggttgatagagtttggatatttgtccccatccaaatctcatattgaaatatcatcttcaatattggagataaggcctggtggtaggtatttgagttatggaggtgaatccctcgtggcttggtgctgtcctcttaataatgagttcttgagagctctaggtgttgtaaagtgtggcacctcccctccgatctcactctgttcttactctcaccatgtgagaggcctgtccccccgaccttctgccatgattggaagcttcctgaggcctctgcagaagctgagtagatgccagtgccatgcttcctgtacagcatacagaactgtgaaccaattaaacgtcttttctttataaattaccccgtctcaggtatgttttatagcaatgcaagagcagcctaacacagagatccttgcttcttctatgagaatgagtaaacttaccttgaatacggtaacacccaggaaaagggcaaagaggaggtagaagggggagaaacctgaaataccaagcagttatccaaatgatgctgaggttacctgaaataaactgttttatactggaagcaacagaaatatcttgaagagatccattcaggatttttgtctttctccccaatactgagcaagaaaaaataatagcaaatacttaggcaacatttactatctaataggaactattctgcgtgtttcaaatatattaacctatttaatccttacaagaaccctgtgaaattattatacccatttcacaaatgagacccacagagattgagcaaattacacaaagttatccagctagtaagtttcagagccagaatttaattcaggctcttagccacaatgctatttttaagctttgtttctttttattttatttagaaacatggtctcactctgttgcccaggctgaagtgcattggtataatcatggctcactgcagcctcaaactcctgggctcaaacaatcctcctgcctcagtctcctgagtggctgaaactagaggtgtgagccactgagcccggccagccactatgctatgttgcctacctaaggcataataaacccagtgacggaaaataaagtttttgtggtcattgttttgttgttacacatatgaattgtagcaaatgcaccatgatccctactatagaaatgcaagagaataatttcaataacaacgataaagattggtgcgtagatgtactcaggttaatgggggcacaagaaagagggaaatggatttgtaaatacattcctgcagagggtaacacatgagctgggtctcagaaaaagagatctgtggttctgaaagttgactgtgtgctagaattaacaggaaggctttgctaaaacatgaaatactggggaccatccagagtttctgattctgagatctaagctagagccatatcacttgcatctctaacaggttcctaggtgctggtgacacagagggatcactcttcgaaccagagttagatggaaaagaacattgggaaagaaacactgggaaagaaagcaggttgagtggaggattaaatatgattagtttcatgcgcgtccgtgtgaagagaccaccaaacaggctttgtgtgagcaacatggctgtttatttcacctgggtgcaggtgggctgagtcggaaaagagagtcagcgaagggagataggggtggggcctttaataggatttgggaaggtaaaggaaaattacagtcaaaggggggttgttctctggcgggcaggtgtgggggtcacaaggtgttcagtaggggagcttttgagccaggatgagccaggagaaggaatttcacaagacaatgtcatcggttaaggcagggacaggccattttcacttcttttgtggtggaatgtcatcagttaaggcaggaactggccatctggatgtgtatgtgcaggtcacaggggatatgatggcttagcttgggctcagaggcctgacagtatgaagcaaggcaaaggagagagaaagcagaagttgggtaatgcttagtggtgtgaatttggagcagaaaaataacatgagccaatgtgtaacagaattccttggaaacctcaaaaattctgtttaaatgtgataattttaaagctaataaggcttaatgagaagaaaatagttctttgtgtataaacattttgagaaagagaatcaaaagacgctgaaatgcttcagtctgtgcacaaatatctgtgaatatctgtacctaacagaagttttatcttttgcctcttccctctctgctccatgcacaaacttactcatggtgacactccatccactgatgatgtctttttttgtcaaataaaatgttgaacattcttgaaaaaagcttgaagggactatcactgcccttctatatctagtgacgtctttttgttcaagaaggtaggttcactctgtgtaaagttttacctggacttgaatgtgagattgtaacactgccaacaaaagcaacattccatgtctcgaattgaaatgtaatctgtcaacccatttaaaacaaaaaaacaaaattacaacaaatttaggttagatatttaattggcttttatttacaattcatgaatgtgggcagcatctcattttataaaatagaataagaactccgatgagcttgttggatacagtgagttctaaacttctcttcaaagaatcagtatgtcagtatgttcagttctttgtcctccattttaaagtttaacttcctcgtagtttcagtaagcaacctttcccaccagttttaatcagtagttcacatctgttcccctggtcacctgctctgacctgagtcatcccagtcacctgctctgacctgagtcatcccagtcacctgctctgacctgagtcatcccagtcacctgctctgacctgagtcatcccagtcacctgctctgacctgagtcagttttagtcaccggttctgtcccaccaaactgctcaccccgccactctggctcatacccctgctctctttaaaatacccaatcagaattagcttagactgtgcagtccaaccctagccaacaggggaacgacacagcagtaggggcaataagaaccccttcccctccctcgttcaggtgtgctctcgccattgctccaaccatgagtcgcaccctactacagaagtaaaattaccctgctgagagaaaattatttgtttgagcactagttcgtcttttcggcatcgaagaacaagcatttgtttctaacaagctgagcagaggaggttggctttgtaggcagaaaagagttgaagaaaacagaacaaaaagcagattagtcatttcaaagttactatcgatatagagttaaaacagggaattccttattacactggttcagataaactgggctgcccctgattgtttcctgtgaataatgtgggttttttggtttgtttgtttttgtttttttaatactggcttgtttcaaagttcagtttgattatgtagcacctagcatgagtgaatccgttctggtttgttatagtctgttggggctgtgaaaggaaactgaatcttagggtccccaaatcactaagcaaaagggaaaagtcaagctgggaactgcttagggcaaacctgcctcccattctattcaaagtcatccctctactcactgagataaaagcatatctgattgtctgctttggaaaggctcatcagaaactcaaaagaatgcaatcatttgtctcttacctacctatgacctggaagcccctccccactttgttttcccacctttgcttctagttgtcccacctttcaggaccgaaccgatgttcatcttacatacgttggttgaagtttcatgtctccctaacatgtataaaaccaactgtgccccgaccaccttgggcacatgttgtcaggatctgctgaggctgtgtcatgggggcacatcctccaccttggcaaaataagctttctaaattaactgagacctatctcagatactcggagttcacagggccaagtataggcacttactctaaaacaaggatttcataaatttatttcgtacagcagtcattgacatttgttcagtttctatgtatgttcaggtgcatgcacattcatgcacacaacaaactgaattttactttttccctctgactctactgattgtgtaaataattgaattggtagacataactgatgttttgggttttttcttattgttttttttgtttgtttgttttgttttgagacagactctcactctgccagccagggtggagtgcagtggtgcaatctcgactcattgcaacctccgcctcctgggttcaagcaattctcctgtctcagcctcccgagtagctgggattacaggcaggcaccaccacacctggctaatttttgtattttcagtagagatggggtttcatcatgttggccaggctggtctcgaacccttgacctcaggtgatctgcccacctcagcctcccaaagtggtgggattacaggtgtcagccacagtcctggctctgatggtttcttttcccttgagttgttagagattcttcattgagagaactttgagcagacatgtaaagaataaagttttcttttccatctgtctttttctctctgttcccactttaatgtttcaaaattgttttacattaagctactcattgcatacataaaatgatttggattaatgtttgtgtgtgtgtgtgtgtgtgtgtgtgtgtgtatttaattgtggaatgactcaattggttcagcaaaacaatttcatttaacaaagaactaattttttcttcaaatatattatattctttttttcaatttttgtttttaagttccaaggtacatgtgcaggatgtgaaggtttgttataaaggtaaacgtgtgccatagtggtttgctgcacctattaacccatcacctaggtatgaagcccagcataacatagagctaatcttaaaccaaactgccttctaacattctatcccctatatttgtatctgaaaaggttccattatattctttagactcttccaacatttgcctgctagaaatgagaaggtttttataacatctgatcctatgtatttatcactcataaatcagaaactcaatttgaaccctgtgaagtatggaggtttaaagcaaacctttatttaacattttgtatgtcaacatttttccaaacttgacctgccaagtggatttaatagcagatgactctggaacctgaacaagtgtttgctcttatatttcaactattagtattgaattaaagactacaaggtttggatcacatggcagacttctttgatgccttatgctgctgatgctggccaagaagaggaacatctgagtatttacatgtttatgcctggggaattctaagaaatctttggacatttgacaaatatgtgcctataccactaagcctaagattgcatccaaatcatgtgcaaataatttctcatagatgggaaaaatatactgatgctaaaaagatgtcatatgagctgtttaaaaataacagtccaggaaattcactttttgtgaatctgaaattatctctcaattatctcaataattgtccaaagtataagatcatctggggaatgatgaaaccaatgagagactccgtttaacatttcttgtgcatttccgatgagtgcaaattataccacctttttaacacattactatctccttttgttctcaaagcaatccactaaaatgacggccagtgctacttccatctctaattttctctcccatcagcctactcatatgtatgcatttggtggtttacattcatcaaggttatggggctgcttgcccgtagcttattctacctgcaaaataaagtattacatatatatatatatatatatatatatatatatatatagttttctatttccagcaacagtgatttattttaaagtagtttgtcatcagtcttacccttggctatcatgatatacatttgattgttctctctacttgcaaacttgccctcccccaacatatacgaatttaggtttgtattgataaacattcaatggtttttttaatcaagcatagaaatgtagaatacatctgaactctttagcatggtctacacgcaggttgccaaatcaagcaaaatatatacataataaatatgtatgcataagtgttataaaatgttacattttctacatttataaagtatacatataaatatatacatttaattatctatacacacacacagagttgattatcattatttgcagcactcatattctataaagttactgacagcactgaatgaaggaacacagaatcactgcccctagaggaaatagttgttactgagaacctctacttaaaacattttcataaatcaatcaatacacaaccttgtgttatgcatgtttctgtttgaatacactttattttatacatagtgtatttaacactattatagtattaattcattaatggttgaactcacagccaacagtatcataactcattcctgaatgaaggttttctagcacacattattttcttcataagacgtagcaccgtcttcttgcatttagaaagaactgcatttaaaaagcacaatgcaaaaagcaaacataacaacaaatagattgtgaaaaagacacgtgtagtatgcgagttataatttaagatcgtgttatttatatgtgtttttttattttaagctgtctccccaaggtccatgcttatatccatcttgtgctaagcctgatataatatctgatacatgaaaccttttaaaatatttgatgaagaatgaatggtttaaagaattaacagaagtggtgtgaggatatatgaaacaagagaatccttagttatgtatctaaacctagttactcattatttcatttattggctcattctccacatagttagggagtaccttgtgcctaggcactattcaaggctctaaaaatgaagcaagtataagaagaccaaggctcctgtcctcatggagcttacactctgctggggcagacagaaagtagacagaaaattcagttataacttacatcatcgccatgaagaaaacaaatcaatgtgtggaaagccagtgcaataaataggacactgacatcttgacactcctccccccaccactgtttcacaatgtgcagagtaaattaaacacacacaaacacttccatatatattcagttaattttcaccactctgtatgcagagaacagtgtaaatgacataaacagtgatagagaaaagcaattaaattcaaaataatcagtatgttaataatgtaactttttcaaagggtttttgcaaagattttaatttatttatgaaacacaagtttattgaatacattttatgtcaggcattcttataggcacagaggcagaaaacttaagattgtatttcagggaagggaaacattctaaacaaattccaatcttcaggcatctgatttagagcagcgagaacatgatatatgaatgtgttagcactctatatcctcagcatgttaatcctcatgaaactaagcctttagtaaagctcgtgtattaaacatgcctgttcttttaaaacaaatggcaatcctcataaacagtgtgtccattaacaaaaatccacctattttgatttttaaactccataaagctcagagtgcaacctgctgctgaaagttgactttttctctgttgcttgggacatatggattttgacagtagagttgtagaaactgtttagctatttttaaaccatgagttgctcattctcatgttaacgcttgagtatttcttacaggctaggtagggaaacttgggtgagatgtttgtgattaaacacataattttgacaagttacctaaagctctccttatgtgtttgtgctatagtccacaggtataatgcctctcctacttaaccatgtgtgtattacatgtggtatatttttacatgtggtattattatatatggtatacattatataggtattatatgtggtatatattatataggtataattatatatacatatatatcatataggtataattattattatgtgaatcagaggatcacataaaataatcatgtcatcctctgctggaaacaatgcattgacttcccactgaatctagaataaaatgtaacctccttaccatttcctgcaatacttaaccttctaatagccttgatcacctttccagcttctctcctttacattgtcccacttattctttcctttctggtctcacttgacaactttcagtctttcaaacagactgaactctttctttgccactagttctctctgcctggagtatttttacttccacttttcacatacttggctgttttcattttccagatttctgcttaattttcacatcatcagaaagaactgcacttattatttaccactgcaaaggggccctactccgattcattgtctcatagcaccctgctcatcttatataatgtttatctgaattgttttgctatgtttagacatttacttattggaggtttctctacagccaaataggctctaaatcccgatgaggaaaggagcatcggtgctttattcaccactgtatgtctactacaagtacagggtggacacatgaggggtcttaaccattacttcagtataaatgaattaatatataatgtaagggtttaggatctttcactactagcttacttcaaggaaagatcagggacactgtgttgagaagaccttacattgttcttggtttagccattgtgtctcttttactttagccaagttgttccgcatttttagattttgattcttatttgtaaattataaataacagatataattaatataaacacactatataatgtaaaaacataaggtgctattataataatcaataatgtattttaaaagcagataattccatggatcctcacatttccttatagacttctagtttttcatcaataaagcacaaaagatatagagtaaatgcaagaaaataaaatctctgtgaccctttttgatttcctatttccaatcctctttttacccctagtttagcaatgtctttattgccattctttatttctccaatggtttatgtaatataaaattataataataaacttgataaatttagttaatgaggaaatttatggaatgagtaaaaaatacaagtaaggaagacaattttttttaccacttctgaagactgttgttagttaatagaacaatatagttgaccctgggcagtgaaattatattcattgtccaatcacaacatctgatcaatggctcattaatatctaatagtaattacttatattgcttcacagttttttttaatctaaaatataaagttcttattgagaaaagaaaaacagataagacattggtcttcataatttccaatgttctctgttatccagttatttattcagggagaaatcttaggaaaatctatgaaaaattagaggaatgatactctttctggagaattaatttacctgctactgcttcttcccactatcctattagaggcataattgacttagacacacgggatatgccaacctcattaaacctgagagcccataatgtgcagaatcacagatctaaatagcttcttttaagtttccttatgccacatatttgtatgccatagaatactgcctatggtgggacgtgcttcttgcaggatacttggaggccatctgtttattctggcatgagatcctctatgacatttgaagacttggtagcacttagtttttagtttacttcccattaataaaaaaataaataaaaataagtttgctttctatttgtatcacatacataatcaacatttccatgtgtaaaacagaaggtatgagcaaatctgaacataattgtttagaacttctcctgcagctccctgggggaattgtgtctcaaacgccatcagtataggttatcaacaagatgagaattgaaaagcccaattagagattagaatagggatagctgataagaaacatgaccaagcaccccaaattcagcttgggaagtcaaattaaagtacagagggtgaagtggtctgcatcagctgccaatgaggaatggcaatatttaaacaatataagcaaggaactcagaattcattggccaattggaggtcaaaagcccaggtttggaattaggataagattttgctgtgaaagtgagtgtctgattcatcttcattctagacagacagttccaacactttttaagtctcaaagtccctttctattgatgcaccccaattaactatgaggaatcactgctctgagatctaattaattctaatgttggtttcagggttcccttctgtaccagcagtagtagcacatggaattttgtgggattttgacaaggaaattacattactaacatatcttgaagggattcctataacagtttcttgataccataacaggttcaggtcactaagagtcctgccaaagtccaggcatggtggttcactcctgtaatcccagtactttgaaaggccaaggcaggtggatcatgaggtcaggagttcaagaccagcctgtccaacatggtgaaaccccgtctctacaaaagatacaaaaaactagccgagtgtggtggtgcacacctgtaatcccagctattcaggaggctgaggcaggagaatcgcttgaaccttgaaggcggaggttgcagcgagcccagatggcaccattgcactccagcctggatgatggggcaagactccatctcaaaaaaaaaaaaaaaaaaaaaaaaaaaaaaaagagttctgcaaagacttcagtttcttaaagaaaaagaagatgtgttaatttgtatgatttgcctatttttttctgttgtaaatactcacagcatggtcagtttcaagttatcaaaaagttaaaattcctgaattcttcacattggtgttctctaactgattcaaacaggctctggcccatcactgctggttatacaaaccttctagaatgaggaaggaaattaacttttccaagatctccagattatgagataaggtcaatctccttcttttgtgtactgaatttgaacccggtctttcttagttgggaaattcactcttacatgtgttatctttttattctgctatattggatcttctctctcagctgacacattttcaatagctaataaacagtttctgccatcagacattcttaataaaaagccataccttgaccccacacgtaatggcaacctaaattttctactctgcttcccagcaaaactttgtaaaataatttttttattgttctcatcacttctacttacattccacagggacttgactcttagccaccaataatctctagattgccaaattaaatagtgtcatttttacttctatctcaatcttttattagctttagacagggatcgctacacccttcttctgggagcttttttatcctcggtttcattgacactaaacaatgttggtttttttctttctaacctctccttcttgatctcagaattccaactcttgaaatgtttcaagacgttatccttgggtctcctttcctttttttgtctacacactcaggactggtgatttcattcaatacaaggtgttaaaaagtcccaaatctcaatctcaagcctgatttctcctcagaattccagaattatatatccaaatgtctattggatatttccatttgaatgtctgataaacatttcaaatttaacatgtcctgaacaacatttttgttctattccaggtgctggcaaactatagctgtgagtcaaatctgggtcacataattttgttcaataaaattttattggaactcaaccacaccaattgtttgcatttgtctatagcttatttcacactgccacagagacctctttagtctgcaaatactaaaacatttattatctggctctttatagaaagttggccaacagctgacctatataccaaatttgctcttcttgaagtacgtatttatctgagttgataacactaccttaagtttatatctcaagtcaaaattctcataattgtctttaatgttcatccttttcttgcctactacccccaacacatcagcagttcatatgggctttaccttgaaaataaaccctaaatctagttttaaaatgtccactgaaaccaccaatgttgcttgaagcattgaaacaacttcctaatgatttccttgccaatttttttttacccttttacaactttatagtcttcttaagttatagaaaattcttcttaaatcacatatcagatcatcttttccttgcttaaaatcatccaatgggtatgtatttctcttagaattttctcaactccctaccttctcttacaaagttctgcataatctggattcttactcctccgcctaccagttctcttctcgctcttggcccactgaactgcagctgcactgagctttctcttactccaacatgctaatttttcagttctggccctttgagctagctgggttctctgcctggaattctctcatgaacgcctttcatgaatgtctccttctcatcaatcaggtttcagttcaaatgtcacttctttcaagaagcttcttcttaataattcattctaacagagtcgtacaagtatatatcatattatcacttacctagtttttaatgttcttcaaagcattttaactataagataggtcttctatttacttatttttgtatttatttgtttgctggtgatttttctgcctcttcaaaatagaatataaattctccaagaataggaatcatttctgtcttgttcattgaagcatccatagtatttaggacaatggtgaacaatattggttgaatggatgaatactcagctattatattccagagaggtttctcaaggtggtcttgaagaatgtgggccaggttaattttcttagactaattatgaaggcagaaggaagagcaatctattctattaatttaagtaatgtaagtatccctataaaagaattaatttatttttattgtatttttcttaaatataaataagtgtaacattagttataaactcttatatttgctacttttatgcactaaaaccaaaacaattaccataaattaatcaaattaagatgtttacttatgcaattattttattagttgccctgataaactctttgagggctggatccatgtacgaatgtgctcactaatgcgtcatctgtggttgaaaacattggctgggacatagagtttggcaaatacttgtggtaaattagtgctgaatagtaaataaatacatggcctctgcaatcaaggtatgtgtgtctagtaggataggcttaaagacacaaaccagttgaccatccatctgctagaaaattcctcagaacaactctgagcttcaatattaattgtgggcatttatcggcactaactatggtacactcttaaagaaataacaataactgaacccttataacaagctttgaaagcatttatactctgattatttccttattacaagatgaaggtgagaagaaactgggaggttgtctggccacagttaataagtagtagagccaggatttacagccagtgggtctgtatatagagcctgagttccattgattcccagctaatgagggagtaaatgattctttttcattggcaatgacccagatcccagaatcacaagttatatcccactagagcagactggattttactcattaaggttgcatttttaacaagataattcattcctactgctcgatacagtagctatagacagttacttttatctaaattactcaccaaaatttgaaggtagaaggaatttagaaatactcttgtcccacctcttcatttttcaactgaggaatccagagttctagggagattaaagttacatagctaggtaataacaaaactaggaggagaaactagaatcgttttcctctgaatcacatgccctctcaaattttgcctgtgtttaatgccagaagggcaaaaacaaaaaaaacaacaaaaaagtttgctttcccttagcagaaaagtaaaaacagatcacctaaatatttctgtcctactgtgctttacttttggaatcattgccagaatgtggtagtctgctcatcaactgttggaaatataatccttctgtatctttcagatgatcgggaatccttttcatttatgcatgcatacttacactcacctttccattcctttatttacttattcatcaagcatttcttgcatggcaattatgtgcagagctttgtacttggtaaaggggaaaataaagaatagttgaacatgattttattcaaattgattctatcctctattacattttattttttaatttgcctgaagtcccttcaaaggtagacaggttgtaatttctcaataaaatagatatgaaaaaccaacaaaatcttctagcatcaatgtggcaattagctgctgactgcaacatgtattttcttaaagttgctatgtttctgcttctatcaatattaatagctaatattattgagtgtttaatatgtgccaagcactctgttaaacactccatgtatgttaactcatttaatctcctcagcagttccacaaggacatatagttattatatgtatttatagcataaggttacactcctattaagtggtaggaaatccaaactttctttctccagggagtatatgcttaattgctttatcaaatttgtaaattgataaatttgtaaattaaagttacatagctaggtaataacaaaactaggaggagaaactagaatcgttttcctctgaatcacatgccctctcaaattttgcctgtgtttaatgccagaagggcaaaaacaaaaaaaacaacaaaaaagtttgctttcccttagcagaaaagtaaaaacagatcacctaaatatttctgtcctactgtgctttacaaacaattgtttgtaaattgttagcttctatagaaaatatccaagaatttcagtagaggagtgttcaggagcctgtgagttatcccacattgaaactaggagacacactgctcttcattttctccaacaaatacacctcactttctcttgtatgatttttcacagaattcctgccctattagtaacatagctgtgattttatttaatccaaatactgataagcaattgtgaaaaatgtgaatatctgagaacctgtactttgcaaaatacatttttacttaaatatgattctcttttagaaaatgctgttgcaaagtggtgcttatttgggctctgtatttttttggggggagcgtcccgatttataagggcaataacaactcaaaaaatggtatgagtaaaaatggctgttctcctgagcttggtagaagattggagaaagcataaatagcaatctactcccctgatttattctgagtactcacacaactgaggcccaaataaattataaagtgtttggctccagtggtgttattaaattccttgtaggctggaagcattgatcatttgatacccttaggtttgcgtttcattcaaatggtggaaagatatatactaatactatatatcatttcaacttcatgcatgagacttgaagcaagaaacttctgttatagctagcaggaatagtctgtgaggtgaattggatgtacactgcacatcaaagtattgataaattgacctacatttttaaagccgaaatgtaaacctcattgtgcatcaggaggtcgacactgtcagttacctagatatttctcagtgttaagtagttatattatgaaagatgaatgattctgtacaaccctgtataaatgtgactgcatttggactttctaaaagaatataagcatgtatgcttggaaatcctctacctatttggaaatagaacacactttgcagttgatggtagaaattatagatttcttctagagaaacatagaagttacagggatttggctgatgacaaagacatattcccacagcaccactaaatgctttctaaatacttgttatacttaaatacagtattccatataatatgggagaaacagtttgatgccattttagttacattgtgtatttagcatgaactccaaaaggaaactcagctaaactccataatctctccacttactggttcaagagtcagagttgaggagactcatgtggaattcttgacctcatttacattcttgtgtttcataacttctggccctcggtttcttatttgcatagacatttagtgtctagtaatcaacgtgttgtagattctataatgaccgtataattagcatcttctgtgcattatttctgatcccctacagagctcactttgaacatgagacataagactctgggagcactgtagggtaaattttgaaacagctattcattctggctcctatatttattgtttctgttttaaacttaatttcctattagttgttaaagtgttcacttatttttcaaagctctttgaaattacaaaaatgggtagctattctctaaatcttgcctgattttttttccctaaatggaaagtagtatagatttggaatccactaaataatacttaatttattcctttatctgggtggagaattaaatgtcacaattagtcattatttatatttattgtattctagagcaatgttttcttaaatacctcagttaccttcagataaagtcctttctaagagatacacattaactccttcaaaatcagggatatcatttcatagctgccttaagggcacctctgaaacatctaatgtgtttgcaaagattgatttagatgaagcatgaatactcccataaaatactaatattgactaattattccttgcttagaaatcatacatttaccattttatacccttgctcccttcactgctagaggtattgccatagatggtagaataagttaaatcagaatgtgtttccactttcaaatttcatcatctatcatataaagtacttgttttttgtcatattttgctatgaaattattaatgctggtgggcatgaataaaatatgtcatttgtatctgaactagtaatatgaatcttagagaaatgatgagttgctgaaaagataattggaacgagtggaataacttaatttatcatattatgaaatttatttctgggcttttaatctttattcgtatacgttggctccagatataatgacatatccatccctaccattacaaattattacttctttcaagagaatatattttcatgtgacttttgttttataactaaagggaaaatgaaaatacgtatatataaaacatcagttcagaaacattccccatgctatataattaattctaagtgatatatgcacagaaaacggagaccatatgtggtagagaggaatctgacgaagtcccccaaatactcctgttttctggttattcaaacaaacactaatctagatgtctgtgtaaagaaatattacagatggaattagaatcactgatcggctgactttaacttaggggaattatttagcattatccatgtgagtccagtgtaatcacatgggtccttaaacgcagaaaccaacgcagaatatttagtcagtagagatgcattggagatacgaggcaaaaagagaaaagtcagaggattcaaagtcccattatttctggctttgagggtgatgggaattagcctagatttatcgcctctcagagccagtagtgaaatgaaggccttaatcctatgactgtatagcacttatggaaccaaccacaccacactgtacctagacttgggacccttgtgaaattatacatttgtgtggttttgagctgctaactttgtggtaatttgttaccataacaaagagaaaataatattccatatttacttgccataaccaatgcttaagcaggcaaaccttactttttaaaccatgctttagagaagttatgccagtttgcctcattaacagcctcctttttagtaacattccggataatgagtgggctcatggaaatgataagaatttcaaggggaccccaagtggtcatatttattttgctattgagttcaagtattttcaatattgttaacacaaatgctgcatccagattggacttttcataattcacacctcacaatgtcacttccccatcatatcttttgcttaaacgctttcaacgacttttgacctaaggaaaattgggcatttttaaaaagtccatgcctgatttcacctttatctgtgtctccagtgccgtacttcattcctctatgattccttgcttggaatattgtctttatatcttcaccactttacccacttgatacctagaagcactgtggtataatggttaatagggtggactctggggttattctgtcctaatttcaaatcctggccttaccacttccttgctctacaacattaggcatgatactttacttctctgtgcctcaatttatttatcaataaaaccgggaaaaataataatacctactttagcaagttgtcatatgcagaatttactcatttgtgtctcctccattttttgtgtactttcatttttttctcttacacatttaatgaatatttatttctataaataagtgtctatgatcctagacataatcaggagatgcaggtataaatttgatatttttctcctcataggaccaagtaactattcccatagctgcaaacatagattacttataactatttttttcattcactgaaaaaacatttattatgtacctactgaatttcagaaactaaggatacatatatgaataaaatatagttacttatctattctattgttaactatatgtttgatggaatatagcaaaaaatgtagtaaatctggtcaaattgtcatttattgataaactagaaatatttcagccagtagagttaggtggatataactagaatttaagcaaacttttgcactggaagaatcttttatttttacaaacttgttctattgagtgtttgtaatatgtgaagcacattatagaattataagaaaaaatgcatgtgaagcacctaggataatgcctggcatataatgagtgtttattttaaaaaatatatattgtttgagcccctacaaagtgctaatcattttctaagaaacaaggacatatcaggaatgtgataagattctgttccaatggaagaaaaacttgttgagcaaataaaatgtgcatagcttaatagcaaccagcatggtttaaaacacatggatagcctgagctacttttgatatggcatcagggatgatttgggagaggtgacaattgatctatctcctggggcccagagattgaaaaaaaacaaaaacaaaaaacaattgcttgcaacttaatccttagtgtcgtgcccctttttgttcaaaaaaacccctttcccttttgtaattcattgtaggtttttcttctcaattaaagttatgtcagaaaactaggcttaataatttagcttagtattccatatgccaaactgattagttcatattatatattgtcatggttaatactgagtgtcaacttgattggattgaaggatacaaagtattgatttgggtgtgtctgtgaaggtgtagccaaaggagattaacatttgagtcactgggtcgggaaaggcagacccacccttaatctggtgggcaccatctcatcagctgccagcgcagctagaacataaagcaggcagaaaaacatgaaaaggcgagaccggcctagcctgtcagcctacatctttctcctgtgctggatgcttcctgccctcaaacatcggactccaaggtccttagttttgagacttggactggctctccttgctcctcaagcttgcagacagtctattgtgggaccttgtgattgtgtaagttaatacttaataaactcccatatatagatatagatatatatctcctgttagttctgtccctctagggaaccctgactaatgcatatatgtttatgttatttgttctcatgtccaccaaaaaggtcaattaaaaaaaccttcccttagctgtggtaataccacacacacacgcacacacacacacacaaaaccttcccttagctttggtaatatcacacacacatgcacacacacacacaaggcatgcacaagcgtgcacgtgaacacacttaatatgtactttttaaatcctcttttacattaatggcctatttattttaaaacttgagctaattttcagaaaatcaaattttgcaagtgttgctttgtgtgtttaattgtatcaattaattactgtatttgcaaggtttaacagcccaaaagctatcaaagaaagaatcattttaagagcttcaagttgctgacacttctaaggcaaaactggaaaagacacaagctgaagaatgattgatttcttagggatatctttctgtcataaacccaagatatttgagaaaggcatgctagattttattcactgcatagtgcactgccaatatcaacattttaaaagcttgaagatatgaaaagtagaattgtgtatcaacagtaaaactttacaaacatcctacaacttatattttaaatacaataacttttaaaggtcctagcggtcagtgggaattgagagttattttattcggtggttcagaccctgtgtttatgcagaaacgatcttctagtaattttaactgtagtgagctttctaatgaaggctgtgcaaatattaaacagctactacaattatgcttcggttttcttttcaatattgaatgtttacattcttaaagcatctctgatcgatagcttttattgactgtgttttctccttcctcagctatttctttacttgttttgctttattcatttcttcatatggtatgttatttatttatttcatgttgatgtgggaaaaaagttgccctctttttattaacagattgaattatcagcaggcactgaggcttagtgccaagcaagaaagacacagacaagcttattttttctgctaccactttgaaccttgaatacagacctctgggtaatgtcacactggatacttgctgaatatttgctgaggacttcttttatgtttgtctcagcattggtttaaaacaagatcagggctaagaagagccaagctgctcttgcaaaggtcttccttcatttgccttttctctcccagactttccagcaactcctgctctcctgcatattgatctgtgacttgactctggacttcatgtgttcatgtgtttatatgttaactacttggtgatttcaatattttttacatgatgcatgaactcagcatgaccaattcaaacctataatctctcgacacaagtcttcaaacctggtctacttcagtgtaatcttatcaatgaatggagaaacatgactgtccagctcttacacaagccagaaacccaggagtcactttttgaacaactccctccctctctcattgttcgtattcattcctaaatattctatgattacccacttctccccacctccatggccatcagcactactcaaaactaaatagtcactatctgttttctggagacgggagtgtcctaactggttaatcctagaaacttttgtgtctctttacatggttttcacactggatttatctaaatagatatgaaatgatatcatgtgctccatctcatatatgaaacacttcaatggattctcattacaatcaatgtgacttataaactctacaatgtcttagctcctttttacagattctgcccaaaccacattggaccatgtcaattttattataagacttcaccatatgctatttcttttacctagaacaccatcgttcattcataccctcaaacacacgagcacacacacacacaatcatctttcgcaaagttaatttttttcttattcattcatttgtttcagaatcccattcaatgtgttcttccatgggaaaccctttttgacctctctaactagaccaatttcttttcttcaaagcacttatcacagttgtaacttcacatttatttctagaatttattagattctgagctgaaatttccatgaagggaggtaccatatttgcttttgctcaatatctgatccatgccatccagtttatcatctgacacataatatgtatttgataaatgtttttggagtgaactgcctttagttcatgtgaaagaaatgtaattcatttttggcctaatagttcttcaggcaatcccgagaagcatcatacttcccactctgacttggactttctcacttcagaaataaaatgacctgaatttatttaaccattttcatgttaaatatttagtgaccctttgtcatcctgattgtcttgccctgcacatgtttttcatattctatataaaatatagaaaactctgaaaattgggtgcctagaaatgaacccaattctctaagtaacaagcctttctttttttaccctccatacatcactgaagtccatgttcattcaattttgtagatggtagattagctaataaaatagccataaacatttctattataaggctaggcaccctaatctgttttatcagggaatttatttacctttttctgacataactcccagtttgttttagtttacacagtagttctgtcttacccacttgagtcaattatgactaaacttagaatcatgaaccccaccacagaatatctcattactgggttcttttattttgatttttttcttgttcttgagatgaggaaaggaagttaaaagaaaccaacattatttctctaaaacttccacaaagatcaaagttgaaactggaacatagctttcctgatttatagaccagaattctgaaaattacaccaaaggtggctaataattagaataaatcatatctgtaagaggctttaaaaaataagtattctgtttttcacattattttttcctattttatgcccattatccaagatgttgtttcaccttatctgagttagaaactagcaatcagtagcaaaaaaaaaaagaaaaaaaaatcctaaactaactttttaaaccttacaatgtatagacttgttgtactatgcaacttatatcatgttaagatattaaatgaacaataataaaatataagagttgaaagtcaatttactcaatcattacataaaaaatgaaatacttctaaatttttaaaacccttagattttatgtagctatgaacatttagaaaaactatgctatgcttttaactgggatccctctatattggtacccctttcaaattccttttttttttttaatagaaggactcaaaccacccctttctatttctaagcctcccagcagcaattgtgagaatgtatgccacaccacccatatgttcgtctccagatggctagcctgcttctctcagctcccccacctgcctgggccaaaggcatgctgtgcccagaaccctgtgtataacatgaaagatgctgatgcctgctgtcatccatacccttgcatgtccacagtttaatccgagcacaagcaaggaaagaaagagaggcaaagctggaaggaagcagaattagagttaaaggagagggaggatggaggaagaaaagaggagggaaaaaagagagtaagaaaggatgcaaggaggaaaaggttacagtgtgatgagaaaagtatagttattttatgagagtcaatcattattttggtaagattaagaaaattgatattgcacactcaaaaatcaaataaatagacttaaatttagtcacatgaagacaagcacaaatggtttctttgtgtaacattagaattgatgctgtgttgtactggctctgaaagtggatggtaagctgcaagtggttgttcgtctgctattctctatgaaagacacaggtaccatcctatggatttgagagaagtgtttcacatctaatgttactgagcaataacacccaagattaaaaacataacagaaaacacatacatgttgctgatgcatatgggcatcacgtgtgtgagttgcaactcaagcagaaaccctcagataaaggagggcggtcaaaaaagttataaaggagattttccttctttctaatgtttcttccctgcccttagcccagtgtatcttcaagtatgaccctgaggtaacccactttagagtcaccttgagtagtcaaggagacccatagcataaataattaatcagccaacaaggatctattgagtgatatctcaatactaagcaggtaatttgttcattcaacaatatttattgagaatcaattatgggtcacatactaagttcagcactgggatatattattttgaaaaaacatagttctggctcttttattcaactaatattctttgaaaacctactgtaatctaagcactgttttaagctttaggaataaagcattgcaaagaaataaaaataaaaatcattccttatgatgtggaggttcttgttattgaaaaccataataaataaataaatgagtcatttgtatgaatacattatgcaaaaagacaaaatgtgctggagagaaaatagagcagagaagggagtatcaggagcaagaggtatgcaatgttaaatagagtggctaataaagccttttctgagatgcttaaacttgaggaaaaacttgaagatggtgagggagtgagccatgtagctatctggcagatacctggaagaaatagccagtgagaaaggctctggttcaggatggtgtctgtgactgaagagtgagtggaacaagagagagagtggtagcagatgagaccagagagtggcaggatacctttacaatggcctgcaagacaccacaaaatctggtatcttgtaggccattataaagtctttgtcataacttgtctaaatcaatttgtattgagggatccacccccatgacacaaacacctcccatcaagcctcacctccaaccttgggaatcaaatttcaacatgaggtttggaggagacaaatatctaaaccattgcataagccctccccgaatccctcccttctttagagtgaaagccaaattctgctatatagaaaaagcctgaacaggactaaattggaagaagggaaagcaggtgggaggcaattgcagtaatccagtgagagaggatgaaagtgatggaagtgacagagttgaaaagatgtaggtacattctagatatattttgacgactggatttatagaatttcctgataaatcagtcttagaatgagagagcaagagataagtcaagttcgactcaaatctatttggccagagtagctggaaggatggaactgccattaattgacatggaagtgtggatggagaaggatttcacggaggaatgttaattattgattctgtttcaacaggttgattttgagatcctagtggagattttcattagtctagagttgagaggaatagtctgaggtagagttgccataggtgatattttaaaaaattagattggcaaagatcccaaaggtacttagcgtcatatcaagaaatgaggaattacaaagaatgtgcaatagggtactccatattagaaggtcaagaagcagagattattccaccataacagactgagaaagattagacattcatcgaagaataaaaaatatatggtgtcctggatgacaagttaaaaaattatttcagagttgaggacatgaaaaacaaggtcagaggctagagaagtaagaatgcaattattcgatcattaatagaagaaacaaaaggttaataaaataataggtaagtcagatactgttaataatacgaattaatataaaatataaaactaaatgctacaaaaagtacatcattttataataataaataacaacaaatataaggatagtggcggaaaacatgggatgaggaaatgcttgtttaaagaagtaatcttgagattaaagataaaagatatgtacaactcactgaaagtgaaactgtgaaggttttggagtgttacagccagatcagatgacatttgcaatggccttttttggaagaaaacatagtgtattcaaggaaaaggaaaaggctagtttagttttagcattaaaaaaatgaatgtaccaacttaaataaggaattatgtatgtttggaaagaaaagtcttgaaaatcatgggcaacataaaccaagatgagaattaaatgacattatgttagttaggatgttttgggcaacaaaaaagaaaatatcggcataaaaattacttacaaaataatagtttatccataagtctcaaaagagacatatggaaccccacaattctatatctcaaaagagacatatggaaccctacaattctatatctcaaaagagacatatggaaccccacaattctatatctcaaaagcgacatatggaaccccacaattctatatctcaaaagagacatatggaaccccacaattctatttctggacatctatctaaaaggactgaagggtgtgccttgaggagatatctgtacaaccatgtttatagcaacatggttattacaataacataaaggtggaagcaacccatgtgtccatcaatggatacatgaataaacaaaacataatatatataaacatggaatgtttgttattcagccttaaaaaggaaggaatttctgacacatgttaaaacacggatgaaccttgaggatattaaacttagtgaaaaagccagtcatagaaaacaaataccatattattccacttatgagagagagtagtcaaatttatggaaacaggaagtagaatggttgctcccaggggcttaagttagagagaaacagtgagttactacttaatgggttcagagcttcagtttcgcaagatgaaaattgttctagaggtagatgggtgtagtgtagtgtacatatgagtgtacttaatgcctccaaactctacatttaaaataggctggtaaatgttatgttacatgtatttcatcaaaattactactaataataatgaaaggggtcactggacccaatgaaaaagaagaaagaagaggaggaagaggtgaaggagggcagagagatgtaacaccagggatgattttagtaaattcatgatacctgggctccaggtaacttctgcatgactcttttagtcttcccttcgtggtcacaagatagctattgaaactgagcatcaagtttttccacaaaaatgtctaaggcaggaaagaagaatcagggacttttttctcatacaaccctttctttctaccaattaatagaatatgtttctcagaggccttcaaccaagatcactttagtgtaattggccagaaccataataaaattgccatacttgtctgcaagaaaaattgtgaaagaaggtttctaatgatttcagattcactttcgagggcaaaagtcagtggtgtgctgatagatatttaacaaatcactatctgggacgggagagaatgtgtgtacatatataagtgtattatacattttattgatataaaagatttgtgggacactataaataataatagtaatatataaagtattctttattgtcaattttgtatagccaaatgatctacacagtgtgcgtgcttccattgattttttttccatgcttttttatccatagccaaaatatagttgcaattcacaagtgtagttccaacaagaatggtgatagatattttcctcgtagttaatgagtgatacgcagtgaaccaatgaacacatatataaaaacttagtgtgagtaagctttttcccaaatcttctgaataccagaatatttcctcaatttttttgcactatttacaatgtaacagctattgatatgatatacttttaactttaatctctattactaatgttttctccaacacgcttaagtctaaacaagcgacaggagagtgccaagactggctgactagaagcagctgatgtgcaccactctcatgcagaggagaaagagtagcaagtaaaggctggcccttcagctggatatgcaggtagacatgctgggattcatcaaagaagcaatatgacctacacaggtcagagaggagcaacataggacagttgcccacccaggattggcatggagcaaggggaggctttccactataggaaattgtgagtaatagcccccgaaagcccactaccaattggagggccccccggcataggctgatcactttcattggtagtggctctgcatttctctgggagagagcccaattaaaaggacctctgcctcttaccgctgctaaggacctgctgaggaaggaacataaggcccgagcttaccccagggctgctatgtgcagccaaggaggaccaagccaagatctgcatccagcactcaagtgagatagaagcctacacttcctgagcactgagagggtatcatggctgcaattgtgaggaaatacaaagaagtcatgttgctgagcgtgagcctacaacatggccattacacctaagcaccatctactagatcacagcccaaacttcaacaccaaaaatacttttccaatatacccccaatccactgcaatccctgtcctgtgaaaccaaggacaagaattcagctacaaatggagacgctgcacaaagcctcgtccctcgggaaacatccagaaatgaagtcaactgacttcaacacaaattccaacacaattgaaggaacatcagcccacacagatgagaaagagccagagaaagaattctggcaactcatatagccagagtggcttatttccttcaaacaactgcactagttacccagcaaaagttctcaatcaggctgaaatggctgaaatgacagacatagaattcagaatatggataggaatgaagatcatcaagattcaagagaaaattaaaacccaacccaaggaatctaaggattacaataaaataacagggctgaaagacaaaatggctattttaagaaggaaacaaattcatctgatagagctgtaaaacacactataataatttcataatataatcacatattaaccgcaggaatcaactaagctaaggaaaaaaatttcagtgctcaaagactggttcttcagactaagtcagacaaaaataaagaaaaaagaataagaaggaatgaacaaaatgtccaagatatatgggattagatagagaccaaatctatgactcattggcatcactgcaggaaagggaaagaaaataagcaatttggaaaatatatttgaggatattgttcacaaaaatttccctaaccttgctaaaaaggccaacattcaaattcaagaaatgcagagaacccctgtaagatactatgcaagacgaccatccccaggacacataatcatcatattctccaaaggtgatatgaaagaaaaaatattaaaggcagctatagggaaggggcaggtaatatacaaaggtacctccataaagctaaaagcagaacattcagtagaaactctgtaagccagaagagattgcgggcctgtattcaggatccctaaagaaaagaaactccaatcaagaatttcatatccagccaaattaagcttcataagtgaaggagaaataagattcttttcaggaagcaaatgctaagaaaaatcataaccactcaacctgccttggaagaggtccttaagggagggctacatatggagaaaaaagactattatctgccaccataaaaacacacataagtacatagattattgataatataatgcaatgacactatcaagtctgcataatatccaggatcaaatccacaacatagcaatgttaaccttgattgtaaatggaataaatgccctgattaaaaggcacaggggagccagttggataaagcagcaagactcactgtgtgctgtcttcgagagatctatctcacatacattgacactcacaggctcaaagtaaaggaatggagaaaaccctaccaagcaaatagaaaacaaacaaaaaaatagtggctgccattctaatttcagacaaaacagactttacaccaacagtgatcaaaaaagaagaagaaggacattacataatggcaaagggttcaattcagcaagaagacataacacaacacaagagcagacagattcatagaataagttcttagagacctatgaagaaactcagataaccatacaatagtagtgggaaacttcaacactccactgacagtattagacaggtcattaaggcagaaaactaacaaagatattcaagatctgaactcagcatttgaccaaatggaccttgcacacatatacagaactctctacctaataacaacagaatatacattcctcttatctgcacttggcacatactctaaaatcaaccacacagtaagccatataacacttctcagcaaatcaaaaaagaaactgaaccaaccacactctcagatcacagcacaacaaaagtagaaatcaacaccaagaagattggtcaaaacaacacaattacatggaaattaaacaacctgctccttaatgacttctggtaaacaatgaaattaagacagaaatcaagaaattctttgaaactaataagaacaaggatagcacataccagaacctctgggacacagctaaaatggtgttaagaggagagtttatagtgctaaacacccatatcaaaaatggcagaaggatctcaaattaacagcctaacatcaacatcacaccttgaggaactagaaaaacaagagcaaactaaccccaaacctagcaaagtcaagaaataacgataatcagagccaaactgaatgaaactgagatgtgaaaaagcatacaaaagatcgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagctgggcgtagtggcgggcgcctgtagtccaagctactcgggaggctgaggcaggagaatggcgtgaacccgggaggcggagcttgcagtgagccgagatcccgccactgcactccagcctgggcgacagagcgagactccgtctcaaaaaaaaaaaaataaataaataaataaaagatcaacaaaatcagaggttgtttttttttttttaagaataaataacatagaccactagctggactaacaaataaaaaagagagaagattcaaataaataaaatcagaaatgacaaaggggaacataacctttgaccccacaagaataaaaaaaaccatcagagactactatgaacatatctatgcacacaaaatatatgacctgcaagaaatggataacttactagaaagatataacttcccaagactaaatgagtaataaattcaaaccctgaacagaccaataatgagttgaagtacggaatcagtaataaaaagcctaccaaccagaaaaagcccaggatcagacagattcacagctgaattctacaaaatgcataaataagagctattaccatttgtactgaaactattccaaaaagttgaggaagagggactcctccctaactcattctatgaggccagcatcattatgataccaaaactggaaagagacacacacacacaaaaagaaaacttcaggccaatatccttcatggacatagatgcaaaaatcttcaatgaaattctttccaaaaagtccttgtttttttgtttgtttgtttgtttgtttttagaataaataaatccaacagcacatcaaaaagccaatctactacaatcaagtaggctttatccctgggatgcaagattggtccaacatatgcaaatcaataaatgtgattgaccacataaacagaattgaaagcaaaaaccatatgatcatttcaatagacgcagaaacagctttcgatataacccaacatgccttcatgataaaaaatactcaacagaataggcatcaaaggaacatacctcaaaataataagaaccatatattacaaatccacagccaacatcatactgaataggcaaaagttcgaaccatttaccctaaaacctgcaaagggtgcccactcaccactcctattcaatatagtactggaagtcctagccagagtaatcaggcaaaataaagaaatgaaaggcatccaaataggaaaagaagaagtcaaactatctctcttcactgacaatatgatcatgtacctgaaaaaacataaagactgcataaagccttctagaactgaaaaacgactttagaaaatttcaggataaaaaaatcaatgtgcaaaagtcagtcacatttctatacactagtaatgtccaggatgaaaggcaaatcaagaacacaatcccatttacaatagccacaaaaaagagaaatatacaggaaaatagctgaccaaggaggagaaaaatctctgcaggtagaactacaaaacactgctaaaagaaatcagagatgacacaaaaaaatggaaaaatattccatgctcattgattggaagaatcaatatcattaaaatggccatactgcccaaagcactgtacagattcaatgttatgcttaccagtcaaggccattcttcacagatttagaaaaatctattctataattcacatggaaccaaaaaaatgagctggaataaccacagaaatcctaagcaaaaggaacaaagctggaggcaacacaatacctgaatttaaactatactacaaggctacagtaaccaaaacatcatggtactgatacaaaaatagacacatagaacaatgtaacagtatagagatccccaaaataaaaccacacatctacaacaatctgatctttgacaaagttgacaaaacaagcagtgaagaaaggacttcctatgaataaatggagttgggataactggctaaccatatatagaaaattgaaactggacctctttcttataacatatacaaaaaacaactgaagatggattaaagactttaatgtaaaacctaaaactataaaaacccttgaagaaaacctagaaataccattctagacttaggcctttgaaaagatattatgacaaagatgctaaaagcaattgcaacaaaaacaaaacttgaaaaatgggacctaattattaaagagcttctgcacagcaaaagaaactataaatagagtaaagagatagcccatagaatgggagaaaataaatgcaaactacatatccaacaaaagtctaatatccagaatctataaagaacttaaacaaattaacaagcaaaatacaaccccattaaaactaggcaaaggatatgaacatacactttccaaaaaagacatatatgcagccagcaggtatacgaaaaaaaatgttcagcattactaatccttagagaaatgcaaatcaaaaccacaattagataccatctcacaccggccagaatagctattattaaaaaatcaaaataactatagatgttggcaaggtaatggagaaaagggaatgcttatatacatgcttttgtttggaatgtagtttagttcagccactgttgaaagcagtttggcaatttctcaaagaacctaaaaccaattgaggcagaaatgtcattattggatatatacacccaaaggaatatatattattctaccataaagacagttgcacatgtatgtccatcacagcactatgcacaatagcaaaggcatgaaatcaacctaaatgctcaacaacagtaaaccagatgaagaaaatgtacatatatatacaccctggaatcctatgcttccataaaaaaggaatgcaggctgggcacggtggctcatgcctgtaattccagcactttgggatgcccaggcaggtagatcgcctgaggtcaggagttggagaccaacctggccaacatggtgaaaccttgtctctactaaaatacaaaaattagcctggcatgatgcatggtgaaaccctgtgtctactaaaatacaaaaattagccgggcatggtggtgcatgtctgtaatcccagctgctcaggaagctgaggcgtgagagtcgcttgagcctgggaggcagagatttcagtaagtcgagactgcaccactgcactccagcctaggtgacagagcaaggctccatctcaaaaaaaaaaaaaaaaaaaaaaaagaatgcgatcatgtcctttgcagcaatgtggatgaaggtgaagaaaattattcgaagcaaacttatgcagaaataaaaaaccaaatactgcattctcacttacaagtgggagctaaacattgggtacacatggacgcgaagggaacaatagacacttgggcttgcttgagggttgagggtgggaagagagtgagaatcaaaaaactacgtatcaggtattatgcttattatctaagtgatgaaataatctgtaaaccaaacccctgtgactcacaatttatctatagaaccaacctggacctacacccctgaaactaaaataaaagttaaaagaacaaaaagagcaaagaatttggagtcccaagacccctgggacttattagccgagtgagattgagaaggacattcacttgttttaagtctcaggttccttatctgaaaggatatcatttgaaaacagtacacatcttacagggctgtgatgaagactaaataaaactgttgacatactggaaagttttgaaaaatgtacctgacttcaaagactgaaatttcactgcagaaaaaaacttttaaaaaatcttcatataaaaaattactttaaaaaaataagcaacaaagcaataactcaagacttcatttatagcattggcctatttccacggagtaaatactcccaatatatccaatttcctggtacccacttgacaccattgaatgtaaatttgagattgtgcaatagcaaaacattctataggatttctaatattaagatataatcaatgcaaacaaactcaaaagcataggcaatagtaagaggtaataatatatttggaaaggatgaattttgagctttaattattttgcatttaatgtaattaaattgttcattaatatagtttgatgtttaatcatatctgtttataatatggcttgcaaaattcctgaaaatttaacaatcagccctcataggcctctttggatcaaatgaccagcaaggcataatactagcaagtaaggaggaatgagatggctttggctttacagattttaaacatttaaattcacttaggtatatagtagaagcatttttacttccaattgtgcttaatctaaggaaaatagcatctttgaatcttttcctttttctaatcaacttttgctcctaattttccattctagcttctaatatccctagattaagaacaaaaataacattgatttccaccacagataaaatgtccaataaaaggcaaagtaaaactggaatcaattgaatattctctgtttaacaccaaattgattttaaggctgccagataaggaagggagaaatagaatgtaaagctgtcctgagaagagatcactcagtctaagcccctcattttgaagatatgaaaatggagatacctcaagattggcctaaaatcaccgaacccactagcagcagagcaaagacaagaatgctgggctcctgagttctgaaagccatacctgttctattgctgtgcaccaaaccttaattcctgggccatctttattagaagagtgtttggcaagttctttgggtgtgaaaagagaaaacagttctcataaatcaggtttccatgcctggtctgttaaatccaccactggcacgatcacagggaagtgctgctccagctcattgtgctagaaataaactgaggtctcatagcagccattagagtctaattatatgtgacagccaacctgacaggttttgtttatttgtttgtctattctttcagtgcttatggcttgaaaaaaatgaataatgctgtcaaaactatcttacccttcaggagctctttctctgcttcattggaaagcataggaaagcatttacttctgacacgcctggtaaagctaataaggaaaaatgatttcactgagaagtctgtataattatgcatggctcatgtgacacctactgatggtcaactgtcactagtacactgtgatatacttgataagagaatgagaatcaggagcatcaaatacatagaaatcacataagaagtcttttcggaagaaatgcgagctatgaaatcatctgaggatgaggcaacagatatatctagaaaacatgagcaaaataaaacataaaattgtataaatttcataatggaactagtggacaattgacagattatatttaaccctgtcttaatttatttttcccagaccactcaccttttaagaatatcaacattatatttgtactgaaagtagatgtgataggtagatcttgattattttcgagtcccaagcagatctctatgtttttcttgaatgattccaattttaccaatgatctagctaaggacattgacatgttcctgaatgcctctaaacaaagtaaaaaaaaacaaacaaaaaaaaaaacaactttgaatggcagtattaagatccaattccttatcaacatgttgaaatgataatgtgaacttaataaaatatagtaagactcaacatattaaacttaagaagagttaaataagtaaaggaaaacaaacaacaacaacaaaaagctggagtggggaaaatagaatctaatagccatctgtatgagaaaagattttatttggctgcaaactcatgagttgatgttgtaacaagactgcaaacagcaagaatgtgaatatattgaatcttgccttcctctgggaagtgccaatgagagcttgtactagctccactccattccagactggaaagatcatgcctagtgtgccatcagcttgagaaatatgtgtttttatctcccatggctttgattaagttgggttacatctggctactactcagtctcagtttggacagtgtgggctccacagcatttgtccactcctcatttacttgcagaattctgttgtctaagttacactttttacactctgttctaatgtggctactggtgaggtgtaaacgttgttttgccactgtgaaaaatataaaaataggttttacagtgctccattgtatatacttttatatacatagtgatttctagaactaaagctttctacattattaagagttgattgtactgtgtttaattgtaggcaagacattaagtggtatgtttaaaagttgggtgtgcttacataagaatccccaagaagagaaagactctgtaaaccaatatctatgaggaatagttgaaaaaaataaagaagacttatttatgcacaagaaaaagagaaaaaattagtgggtaattcttaatggaataattacttagaagatgaattgtcattttttttggaattcagtttatttttgtgactgtcaggatgaaagttgcaaggtcacagattcaggtcagctttagagcaggttgaagtattagaaaatggaatatgatgctttataatcaattttccattcatggaggtgtccaaagggtactgaaatatacatgtattaacagttttataaatgggagtgattaattagatagtcttctaatcagtgagttacaatattcttttccactgcaagaatctatgagtcaatgttgtatcattgatgacatgatgacaaagaagctctatacaaccttcattttggttattttaatttgtaatctctcatttgaaacatagcactgattgaaaggtattttaaagtattatccctaccactcattaacacaaatcactcaacctagaagaacgtgtggtggctgtttatagacctacacctactttttgatattaatttttccttctagattttcatatatttaattagcttacaaacaactcacctattaaattataaaacttatgtatagatttgatatagcatagtttttacataagaatgtttaataatgaagagtggtgtttaatcaacatgttgaatgtgaagccaattcataatttgaaaggtcaacaataaaggggcatcatccatcatgatttaatcagtcgtatcttattaagagcagttgcaaaacaggtgagaacattcacaaaaggattagtttataatatttaggttaacatttaaaaaccatcactagccgtagtgttcatgatattaattatatagaagtatgccattttctaaaggagcaggaaaacttttaaaatattaacaacactgagattagtcttcagaaatttaaaataaaattcaagtgtctttagaatttaaatttctttatgaggatgtcaaaatgataggataaaaccccaatgaaagatatatattgcaatattcatatccaaatgaaacttctcagatcatgagtctattaccatactccattatcccgagatgaagcgattacatgttctgtttttatttttcaaatactgttgactgccaaaaagaaactagtgaagatattctttatgccaaatttccttgtcttctttcattttttcagtcaaccaccatttgctaagcagcactatgtaccaagtgtcagttactctgccactatacacatttctgtgattcaaattagctcaaataagatccacaagtaaaggaataatgtttgtattatacaaaatttcattggtttacctgtgattttcataagccaaagtagccagatgagtgtgaatagattacaaccttcagtgggaaaggaaaaagccatcatcttagctactgccctggcagtgggagtcctttcagaacattccaactaagtgcaagcagttggagcttccttcccagccaagttcaccatcagttttgttcagccagtggtaagttgcactatcttccaggtttacttcaccagcagccccactctctgagatctccattttcatcgatttggactcagtactggccaaatcttcttaactaatgttgtttgtgaattactaaaatcatctgtggcaaccttcagctacactaagctgcctgcctaggtggtctaagttagctctgcagaaacttattactgtgtttgcttgtgctttggttaaaacatttacataagattttctttatcattgcctactattatgcagaatatgaggtttcctaataacatatataattacagagaaatgtctctattgtgatagtcgcaggagattcagaagtgaattatacgcagctgatgccttcacactgccaaggtttagtaaaaatgacatgcaaactatgagttttactacaatgtgatgagtgtcattgctatgctaaaaaatacaagaattcagaggttagaaggcccaaataccatgagttttactacttccctaatagctcatttcacaataaagaatttctgatcatcagaagcttattatattgaactagaattttcacttctttatgcaatcaacaaggacttattgatcagtttctataagtcaggaatgtttctggacaactggagtttgcttgagaaggaaaattggacctgacttagtgttacagagtttatattttagattcaaagattgaaaatcaacaaacacacaagaaaataaatgaatctgtgaacaaataaaattgtttcagatagtaaggaaatctctgaaggtaaacagagtaataggacagaaagtgaccgtgtagattaagggtgtcaatactctataggctagtagaagttaagctcttctgtggagaagtatgggtttcagctaatggaagtcaaggagagatttacagcctgaagtcaccaattatgcagagccttcaggcagggacattatgtttggcaggagggcagacatgggaacactggctgcttgggaagataagaagaagccaggcaatatactagtccttaggaatttggatttgatttggcatgagatagaaagtcactgaattgtttttagcaggaaaaggacatgagatgatttattttgtgaaaatataagttgacggccagatgaagaaacaattgttaggttataggcatggaagcaggcagttaggtgttgggagacaatagccatgtgctaagtgaggcgttgcagtggtttgacagggaaaacaggggccatgagcaacagagatgaaatagataaactagagtatattatggtgacataatgtgtacattatatcatttggggatagatggaatgtgcttgtgattaatccacaaccatcaaagtccaccaagtaaacaagaacagttctctgcatctccactccattactgatgtggtttggctctgtgtctccacccaaatctcatctcaaattgtaatccccacgttcccaggttccaggatcacgggggcagttcctccatgctgttctcatgatagtgagggagttctcacgagatatgatggtttaaaatgggcagtttcttatgtgcacactttctgtctcttctgctaccttatgaagaccttccttgcttctccttctccttcctgcatgattgtaagtttcccaaggcctccccagccatgtggaactgtgagccaattaatcttctttcctgtgtaaatcagtctcaggtagtatctttatagatgtgtgagaatggattaatgcaattaccttttttcgttctttgccctcattcgctgaggttttcaaactacaattagatgaaaactttttgtgactgttacagaggttttcctgcctctatttagacattggaacaagattacctttaaaagggggtctagcatatgatatgtagatgggaatttttaaggaatatgattcatttagcagcatggactattagtaaaaaaaaaaaattatattaaatggcattctttccatatctatagggccaagtcgaaagctctccattatagctggagatgccctctttaagcttttacattctccttccgcccccaacatacacgctatacttatacacgtatacttttcaaccttcaacctccctttagaaaaataaaaattatcattaagtgctcagatcaaaaagtaataggcaatgaaaaaaatattgatttgtattaaatcaccggtgcaaatatggtgtgcgaggataagaatgtttggcaagagctacagtattataaaataaatgatatgctagtcatcgaaggcccttgtccatgtaagtgagcagaaatatatagcatttgcttattatctccagcccaagtagtaaattatcactgaaatggcaaagactgaagtggacataaatttggggttcgctgtgctgaggagtgtgggggcttggtatatttcaaaagccttaggaggctaccgatcatcatgatctgcagacagagctgcagataaagtataaggtgatttctagttggaaacttaaccaaggctctcatggcttacagttagaaaattattttcctctagtacagagtttacagattaccttttatttctttttagcttcaaacctattgttaaaatatcaaattatttgtattttcctactctctgtgaaagaatctttttaaaaaattaacctttctaccatttgattttgattacagaatgactgatttactcattaattacctattcattcctacactatagcagatgctattctaggtactagagagtgatgaacaaaagagatgtagactctgtatcagagaatttataatcatgtaaatgttataaagatagtgaaacaaaaaatgactcataataaaataaaataggagtgatgacagaggagaaaaatttaacttattttgaatgaaagtgtgtttgcataaggtaaggtacgtatgtatattggaattaactcagtccaggaagtggccgattttagagaacatagttgtcagtttaatctcctgatattgcagttagcgtattatctgattgtggctattagcttgcaaacagctgttgtttagccaaagcagaagccatatagggtttgcaaggttgaagacagacctgttaccacttctagtaagagactttcaaatatatggcctactgatggcttggtagtaatttcagcaaaaaagacaagtcctgttttcctcccttattattctcctatagattcagcactatctgttcgcagtctttgtatcaaggctgttctatttacattccatgcaaaagatgtttgttttcttttcatggtggtgatggctaatggctccctccattgtggcaataccttccagtgtcattccctatccttctgctcctttctctgcctcctactcccatgtagagtttctccaagagcagacttacttgattacctcagaaagccaactcctgtaatgtcacagaggcatagtactctatgaaactaagacgatctaagacacatgggagggaaatatgactggaaactatatttgctggttgctactaagagcctcactcagtttccagtgtctttctggtggttttacagcttttttttggtaacttacgattgtcttctctagtacccttcccaacaaaagaaatgtaggatattctaattattttgcactcattaaaatggacattcattttgctgaaatatagcttattctatatatgtttataatgaattatcttgtataatttttttatcttgacctatttttgtatgtgtaatgtcattcttttatgggcctgtgcattctctttagcattctaattcccattctagggaacaaattacagcacctttgtgttttaatcatcaattatcctactcaagtgttttaagcaccctgcaaacaatatctggtatgtgccttgcctagtttaattattgaagcacttttgaaagcaccaggatttcattagtgatcaatataaattgggccagtgttcaaccaatttgtgttcattattaaagccttcggttccaacaataacttggagacagagaactgatgaagctggttagacaattgcctaatgaggcaagcagactctgcctctgaccttaaccagcctctgggctctgaaaactttaaatggtcccagtgacagatatcacactagaaatcagccattgtccatctaatcactacctctagctgagctgagaggcataaaataacacaaatgaattgaatgaaagacagaatctatcatgctacaggtaattgtgtttatcaagcattaatatctgagactcaatcctagggctctaatccatctcataaaacaaagtccagagacaggagcaatcctcggcaaagaagccattcgtagaaagtaaaatttgtgggatccaaaaataattgacataaaattccagcaaaacagactgacattccaaaagcactttaaaattacaagggattgaggacacagatcttttagcagaaggtacagattaaccgggtcttcgacacatgcacaggatgtaggtgacgtgtacaactggagttaaatggcagttgagacaggtaggctttttctagttggagagctctcagggaaccggtgaccactttggtctggtacagatgagagatatagaaattatatcaggtgggaagtagacacctggccagggagaaatgcagggacataattaatcccatttctgctgagggtgacaacctgattagtgcccttaattaaggtcaggctttgagtatctttataaattcttgctatgggagctttgtgccaaatatatccatgtatatgtatagatagttacattatttttccctacatcaatttcatgatctctaaaatgaactgagagagatctgatttgaaatagtattcttacctgttctcaaaatctgaaagtccaggagtccatggggaaataagatagagtttttattacatattgaggtatcataactcttcctcaacatggaaacaaagagcttgcattatgtcaggtttgagcttgttagagacatcatttcagcaggctttttggattctgtgttggttgctactgaagtaaatttgcacagtactgttagcctttgggggtctttcttactcaaccactatagttgttgcagaattttgtgccttagttcagctaaaacctggttcttgtcacacgaccaggaaaatttggacacgttgaagggtgagtagagcaggattttattaggcaaaaagggaaaaaacctcacagattaaatcccaggccaccacacagaaactgaagagaccaggctcctcttgcctgcccatggctccaccctgttcccccagtgcacatgtgggcatgctccagcaaggccctgggcagcttccctcatctgtgccaaagcctctgatgtaaacacttatggagcaggtcggaggttctccagggttccctttttatctgcttaggcattcggctatctcgtagttaagattgagtagatctgggcaagaaaacaggggaagaaatggatataaatatgtgcctttcatcttcattaatttgaagcctcaagtttgtataagtatgtttccccaagggccttaacatcagatgttatgtaagtaggattttgattattcagaaaataaacttaccaagttaaacacagcgatattaccttgatttggaaaaaaatcatttagcaatggaattcaattttataccccggtacctaatacatgattccacagggaatcatgcttgattctgttagaaatactaatctggatgtaagcacttgccttcaaggagctttaaactagtggaatgtaaaaaaatgcactagaagataatgtagactgtgagggaaaaaaatgttatgtgatagagatgagtttcagttagcaagattgggcagattttaagaaagagggggtatttgactgaatcttgaagcaaggatagatagaacttcaactgacgagtaataaaggctcaaaggggaatagcatttgtttcattaatgtgctcctagagctcagcttgcataactcattttttataagactaagtttatgcttaaaaactcaccgatgtcatcaaaaatctaataggaatatgaacattttctgctagtggttttggtctctatgttagttctatacttttttttttttttgataagaagtatggatggtgggaaaccaactgctttgatggaaattcaagcaacagacagatcccctgtcagctccacacaaagatatcctgatgaagttctcctgacttctaggagggaatgtttcggaagtgcacatgagggagaggaatcctgctgtcagctgactttttcctttgcttactgtatttgttttgttttgttttgtttttaaaacaggcttggacatacattttcaattcgaaaactcccttctgagatccaaaagtaaacatgtttacagattatgcaaaagtttgagtttagtttcagaatttttctctcaaaggctctagcacaaaaaaaatgggggatgtccaaattctggaatttgaaacaaataacaggacagattgcaagctggcagctggcagggagaagtccattatttcccagctccattcctttgacttcagcctagggaaaggttaccctaaccttgcctcaccttattacccattctatttttaagcatttctcatttactgaaaaatatttaccacatacttctagtggatctaatcattagattcttaggtggacgcttctcaatcaatgaaggacagaacctatcgagcttcctgacctctttagttcctaaaacgcggcattctgttttctctttttactactaataaaggcagttaacattcactggtgggccacagtgaaaacttcagatagttttctgaaggtttactactttctatttagttttgttctttttttttccctaaaaattagtgggttccccagtttgtgtattgtaattccctttttttgagtcttgtttttcctcttcttctgtgatttctactcattcccgaaactctgcatagtaatcatgaccaaatgatttctgaattcatatatcaaatcccccaaaggcttaatatcatctcagaatgtcagccaagctcagatttccaaaagttttatattattacattggcttgaatcatagacttgtgtccttctgtagtcagcacccattccttcacctttaggcatagctccagttctgagagacctatccttgcctctactgacaacagcctggtagggatatcagtaaatgtagccagacatgtatattgccacatggctgctgcatggccctgattaggccatcttgatctgattgaaacaaagattagaaatagtagaagttgattcattccaaatacttgatgggacagcacatcaaatcccacagctcagacccctggagctgctctggtctgtgtgttttctaagcatacctttcaaaccctccctctgtttctacaaaaccctgtgtatttttcaaaggaatctctttttatgctaggaagaggtggtctctattgtctgcaaccacacacacacacacacacacacacacacacacacagatattctcaacaagtagtttctacaatgttgataggcacattgttagagatggagttaaaaaatcaattcctgagtcctaaatataggcaacttttatttcaatgaggacataatacatccataccagagatcattataataccatgtattggtaccaggacctggaggatatattgaggcatcttcctaaaacttcaacctaagttgctatctgagatttaaaaccaaaacttaagggacaagacataagccgcctcatataataaatacaggacaacttctttgccatcaggacataactgaaaactaaaacacatatttgtcaaaaggtgtgttggtaaatgttggaagaatagatttgtaaaagtgaagtttggaagttttcataaaagaattaattagtagagaggggagtaccttgaccaatgagcttcctatatcagaggaaggcagatgagacacaataatctgaagtctaatgcagtttgttcaaatcctggataacttgcttaacctgtctaggtgtcagtttccttagttataatttgaggataataacagtataaattattattagtttattgtgttgattatatgaaataatccatttcctatagtttttactgcacatgggttaatataaaatattatcaacttttttactattattattgagttggcaaagttattcctattatgggaaaagattatcagacattttagcccagtgccttacaaaatttggatcttatcattcttttagttctgatcctgggctcatgaagcaaccttctgttgctaactggcatcctacataggcctgccttgagggaagaattgctctgctaaggccaattagtttctaaggaaactctattttaatacataaaccaataatttgatttttttttaaactttatagatcagatttatttggagaaaacaaaacaccgacaacccaaaggatgggattttacgtcaagacatctcccaggtaataagtctacagattaaatcattttcatggaagatatttttgtacaaattttacatgtattcaggagccggacattaatcaatccctgtttctattttaaaagggaggacaaagtaggggagggggaaaacagttttggatataactatttggaaggagagtagacatgaagagggcaaaccctagcttttcattatctacaaccaatgttttttttcttttaaaaaaaaaataaaacaaaaacttttcaatcttcaacactctttaaaagcccacttcttagctactggccaatccacagcaattatttaattcacttggtacacacctttgtcctctgggtaaattatattcattatgcccactgctgcagcacgcataaaccaacacccctgcatggctgaacagggcctaatctaggactgatgggagaagggcttgcaaaccaagatcaaggtgtcgtttctctgctaatactgtctacaaagctgatccctacaaaaatgcacataaaagcaggcaagtttatctactgtgttgcaagggaaaccaggactttgttaaatagttctctccattaccatttgttctctcaagggaagcttaaaaaaaaaataaagaaaaacagcacattggtctgcccccctcatgaatccaacaagcattggtgtggcatttcagtggagaaggaaacttggggggaaaaagcccatcaaggttgtaagaagactcccaatttaactgtccctttccctatttatccaccatccaagaccatccattattctagagcactctgatctataaaaggggtcaaagcatcaggagcaggcaaggagtgagaaccaaaagacatcaagaaaccgatttgcttgagaaaagcagcgattcttcctttcatagctctccatggctgagagagaaaatgcccgagacatcatgtatgtgacttagagactgcttttcgggaggttaaaagtagcatgaagagcttaagatgacgataagagtctaaatttttagtttcaaggtttcagtagaatgtggatatattcaaactttcaaaaaggacagtgtttagaaagggtaaaactaggacacagaaaacattgggaattaccacgacctccaagtgcttccggctccaggaaataaccattcatgtgtttgctggaggtcacataattttcccctattacctggtgcagaatgactcatcacttcccaaaagcttcttttcagtccacaattttcccatttattttggtgcaatgcagtcccattctttatggcctaccgtctcactcccaactaccctcctgggagtaaaaaaaaaaaaggaattccccctaggctggcccccaaaactcagaattaaataagaggaggggctggcagcctcctggagactaaaacaacttgaggctaaatctacctttccaagggtggaaaatttattcagataatgtttgagaattcatatatgccaccataggataaaaactaaaaggtagaaatctcacacttttccttctacctccctcccatactgcccaaccaggttccaggcgttatatcactgtcattaccacttctgctaaatggagacctctagtttgcttttataaatcaaacttgtgattttggcaaatgaatgccagccttttcatccagctcctagaggtaggacatcctatggtagacacaaaccctggggccttgtggaagcgtttaaatggctgaagcatcaaggaagccttctgagaaatgtttaagagttaaccaggtcaaggagataatgaagttctcactgccaaggtagtatagggcaaacaaaaagcttaaggtgtcaagatatataaacagaatggggatgggggtggtgtcatgtgaggggactacaagtacttcagggttgctaaaataagagttaaaggcagatacttgtaggagactgggcaaaaagtctggctgggtcagtatttaattgtatgcccccccccaaaaaaaattaataagctgaaatcctaaatccaaggacctcagagtgtgaccttccttggagatagagtctttactgagataattaagttaatgtgaagtcattagaattggttcaaattcaatatgactgatgtccttataaaaaggggaaatttgggcacagacatgtatagaggcagggtgatttgaagacacacggggacagatgaccatctttcttccaggctaagcaaagggacctggaatagatcctttcctcatagtccccagaaggaatcaaccctttcaatacattgattttgggcttttcacttccataattgtgagttaacacatttctgttgtctaagccactaaatccatgaaactttgttatggcaacccaggggactaattcagccagattttaaacctctgtatgtatctgctaatgagcttataccttctttgcatgataggaaagcattgaagtgtgtgtgtgtttttttaatgtgtgatatgagaggacttggtgtttgtatgcattagtgtgtgtgtatgtttatagatcattatgatatccctgtggaagatggattcctggagactaaatattcaagtcaaggacatcagttagaaaattattatgttaatccaagtgagttattactatgtgcactaagggtaagaaaactttaatatcagaaggactcaggaattgtttacaaaggtagtggaatgacattcagatgggctagaattggagccacactctcgggatgtgtgttatcctctgccacctgctagctgcgtgaccttgagcaaggtacttaaccttcttgatcttgatctcatttctttacagtttgtctgtccactgaagccaacaaagtttccaaatcataaacctgattgtcatttcattttctcttcttaaaaataaaatagtcccatggcgcctgctcttaaggggctcacaagtgggacaagatttccttccttccttccttccttctttccttccttccttccttctttccttccttccttccttctttccttccttccttccttctttccttccttccttccttctttccttctttccttccttccttctttccttccttccttccttctttctttccttccttccttcctaccttccttccttccttccttctttccttccttccttccttctttccgtccttccttccttccttccttccttccttctttccttccttccttctttccttctttccttccttccttctttccttccttccttccttctttccttccttccttccttccttctttccttccttccttccttctttccttccttccttccttctttccttccttccttctttccttccttccttccgtccttccttccttctttccttccttccttccttctttccttccttccttccttccttccttccttccttccttccttccttctttccttccttccttccttctttccttccttccttccttctttcctttcttccttccttccttccttccttctttccttccttccttccttccttccttccttctttccttccttccttccttccttccttccttccttccttccttccttccttccttccttccttccttccttccttccttccttccttccttccttccttccttccttccttccttccttccttccttccttccttccttccttccttccttccttccttctttccttccttctttccttccttccttccttccttctttccttccttccttccttctttccttccttccttccttccttccttccttccttccttctttccttccttccttccttccttctttccttccttccttctttccttccttccttccttccttccttctttccttccttccttccttttcttccttctttacaccccatttttctttaattaaagtatctaaggctcaaaaccccagcccaattttactctcatccctgacatgagtttccaatcacgatagatactaatttaaaagcacctttcttgagtccttttcctttactttaccatccatctgtatgatcagtctgtctttagtcactcctggcttccaatgagtgatttcctctatacaataatgttcaacagcttttcagtatctgttgcattaaatgcagaatctcttttttagcattctagatcattcatcattctaaaacacctttcaactttatctcccattcttcccctttgtattccatctgcattgatcaaatgagattatctcatcactgcctgattctacgcagtcccctctcaattcatgcacttcttctccattctttcctatagaaattctacccattcaacagggtccttcctaaatgccatttccaaactaaaatgttctctgcattagggtactttctcagtggtgtgtagtaaacatttactcagacttgaatgagggaaatgaatttactggcttaaataattggagagtctgaaagttattttcagttttctctaagtggtgtgtgtcttagtttcctgttgcttataacagaatacctaaaagtgggtactttatacagaaaataaatttatttcttgaagttatgaaggacaagaagtctaaggtcaaggatcctcatccggtgaggaccttcttactggtggggactgtctgcagaatcccgagaaagcacaggacctcacatgagaaaggatggagcatgctagctcaggtctctcttcctcttcgtataaagctaccagttccactttcatgataactcattaactcattaatcagtgaatggattagtccattcatgaatgcagacccctcatgacctaattacctcttaaaggcctcacctctcaatactgcaatattgagaattaagtttcaacatgaattttggagaggaaaaatatgcaaaccatagcagtggggaaaatggctccctttccccatctctccatgcagcagctctaggctacaatttataagtgtagaagaggagtgaaactattatttttattgttcagaaaagaaaggaaggaaggaaggaaagaaggaaggaagggagggagggagggaggcagagggagggaaagaaataaattccaattggctctacttgtgacagatgatcacctgggccaattacttttccaagagatttggaaagtctgattggatagcttggataatgttgagagtggcatggcttttgattgacagcccagacaggaacagatgaagtgacaaagaggcatttataaaacaatatgtagaaaagataggagtggtttggaatctggtgctgcttagtcaatggtagaagtagagacagtggtctgaacactgccatagaaacatgtgctagaacgtttattggctaattatatttcttatcgctgtgtgcatgcccctgtatagtgtgactttaccatatctcagttaagaggcatttcactcccttgatcctgggctggatttgtgatttgctttgaaccatacaatctatcagaagagacaaggtatgcaatccagagctaggtccccagaggccttggagattttgtttttgatgccttaggacactgccctgacattaccatcccaatgagtaatgaagacagatagccactgtcccagcagttccagttgagcctagtccccaagcaacccaccttctgaatgcagcacaggtgagcccagcaaaagaatcactcagccaaaccacagaatcatgagaaatgatgactagttattattttaggacactaagtgtggggtggtttgtaacatagccctagaaaactgatgaagaacaggaccaggcttgcactcccaggagagcacgaagaaaagttctcaaaaccgatcagtattactagtgtgttttggaaataaacccaatgagaaaaaacataggctatttattgagagtttgttatagcaagaaagtcagccaccatcacttgtgtttgggcagagactcaaagtcaggcagaggagtagaaaagccttagagtggataaaaaaggaaggcttcagctgtgccttggtgacagggtattggcaggaggaagctggaggtgagctgactagatacagggtccccatgtgattgattggggggcatatttatctatctttgtttggctctaagttggaagtggggtaaaaattagagaagctgtcaattaaattgtggcctttttgagccagttgtggcaaggcttgttgtttggcttcctggactggttgctgaagaaagtggtccgacttgtggcctggttactgtaactagcaggttaggtgcctgtgctgttgttgcagactatgagtcagagttctatttttataggcactctaattattgtccatttgtctattccgtttcttaatatttcactttgttacaaacagaaaaaaaaaacctctctctgaattgttcggaacatgaaccccagaatgggtttaatcaagataaactaaactgtgagaagaagacctttataaaatgttcattaagatggaaagatatgggtcaggagagctgggagtttgagtcctcgagggcacaggagtcacagcatttcaggggcaaagtagcaaagaaaaatcctctaaatggaacattataaaaggtcagcagagcaagacaaaaatatatattgctgtccatgttataaaagctgtcaaaaatccaaggcagcgtcactaagaagcctctttctaaaggcagatgcctggagtgagaataaaacattaactcattaacctttttattataaacatgtttattaatttcttaagagagaagggagttctatgagggaattggacttatgacaaataagttgtgatgagttcaatagaattgaaaaaagtgaaacacttctaattcacttagcaagaccttattgtgcacaagcaatatgtaaatcattgtttatcagtgagagcaatgcaaaacgtatgtgacatggagcttccctttaaggaatggttagtctggcagcctcgtggacactaaagcatgcctataaattcctggatatgatgtaaaaagtgataagtgtggtaacaggcaataggccatgggaatatggaagaccagaatattctcctttctctttagaaacatgggcaatgatggcacggagtagaagctgttaagaagaagtttaaaggaggcgtaataatggagctcttaaaaaatcaagtggaggacaagttcaagggctaaaaagggactttgggatctggaaaacaaattattaaagctacaggataaaggttaattggttggagtgttgagttagctgaacaactgaaaaaaaagtgaagagtgctagaaaaaaatatcagtttcagtcagacagtggaagacattgaatgcctagataagaatgctgacatttattctacatgaaaatgctcacaaagctttcaggaagtagaatattattcagaacagtgctctgaaatgaacaatcaagcagtggcttttacaacagataggtctgaggtaggttgtaatggcaccagataataattcattggcaaatatctaatgggggcaacagaaacgaatgagaagagataatagatggcctcaaatttccaagtatctgaccagataggggctgagaactgaaaaaaatggaaaagagaagtataaaatcaaaataccaaagagttgttgctaacttcacaataaagagccaaaagttatcactccatgtaatttcaaaagcctgctctccccctgtgacatcctaaagggacacatggaaataagttttgaaatggcatgtggccatatgattcattgtcatacctggaaattaggactcagagttatgttttcttttctcctttttgctatttctttgaagagctttctacaacccaaatactctgccagttttccaatgtatttgtgaaatggtgatcatgattttggctaccctcatgtggatttagagaagaaaataaattgaattcatttctgcaatgcacgttgaggatttcagagattttcttttatttgaagaaaaatataagcttctaaaatactcataacagccaaggttgggcaactgaaattgccttttgctctgcggagactgcgtaatatgagctggaaggaaaaaaaaatgatcctgaaacctgaggtttcacatcaacaactgaaaaaaaaaaatgtagaacataaattgtagttttcttgcagaatatttataacagctcacttgtagtactccggtctctagctgaacagggccaatggagaaacatttctcgattcagcgttttgtttgatccttactacagagtgattgatcacagcaatttctttcacataaacaaaatcctctagacaagcttgttggagacactcagggctatgaatacactgcagaccaaaaactaatattttgcttgctgtgtttaaactcagtgccaatagggctcaaatcacttgtatcataaaagcaaaactcttttaagcatcctgatttaattaggttccagggaaagggcattgcctaaacatgtttctcctgtagagaggtatctgtcttttcattagagccccaacatacaagcaacaaaacgtatggtttaacacggtgagcatctttaatcattaggaaactatccagcaactagctcagctacctcattttggagagcagagagccgtatcgggaaggaagagaaatggaggacagcatttcccgtgatcctgaacatgttctcatattgatgatggtcgtttctgccgccggagtagccggaattgtaatttgagaggagtgtcattttctgcagatacaaaccttgtgtaatcctcccatttaaatgacatgatcctgcaggctgatgatttcatggcccacaatttgtcacctccccactgcttgagagcgaaacggtagctaaacgacaatcaatagactgattttgtcatgcctgactgttcaccttgtttgaactaatttttagtttgttaattgtgttttaatatgccaccaaagggggaggtgatcattatttttttttaaaaaaaggaaagagattgtcaaatgaggtgaggagagggtgatttaagtgggatacattacagaaaatctataaagtcacccctgctccctggagtaatttccatagaggaaataaactagttacatttaatgtttgtgtgcaaaactgattttttttacttcttgttaatatgctttattttttctatcaggattcaaataattgtaactatgtaaacacctatatatgttactatgaatagatttttgtagtttcgatatggaaatataatttttcagagatagtgagcattcagttagtcactgattcatgtgtggtagaagtcatgcctggtaagatgtcatcttttctgtttaagaatctgtaagtagactggaaaagaaaggtttcagagtttttttgaatatcatgctttttggacaaagacaaatcttaaatataaatagactttaataaagctttaggacccattaattaaatgtcactttcaagatgcagaagtgaggctgaatgcagtggctcacaccagtcatcccagcactttgggaggccaaggccagtggatcaattgaggtcaggagtttgagaccaacctgcagaacatagcaaaagcccttctctacaaaaaattattttttaaaaatttgccaggcatggtggtgcatgcctatagtcctaactacttgggaggctcagatgggagaattgcctgatcccaggaatttgaggctgcagtgagtttgatcatgccactgcatgccagcctgggtgacagagtgagacccctaatctctaaaaaataaaaaataaaatttaatttaatttaattaaatgatgtagcaataatacagattagggtgtgggtgcctggattacctctgagtgaaggcggcttctggaggttcttaatcccccagtgattacagtaatcggtagtgtccctggaagattaacatactatggtatatgtcctctttgaaactgtttctttcctcttttgttggtatctgaacattaatatctttaggatgatgaccgcattcatcatccaaactgagaggcttttgaaaatgaaggaaaagagttattagtatgtatcctgggaatattgacaaaaactggggcagtccccaccaaactgggatgtatggccatgctaaatatctgctctctggactttcaggtggtatgatatgaaaattcacccacatctttacataaatatgggaatcgtacaactggttaaatagagtgtttctatatatggtatggtatggtggcaggtgtgacagaaaaaactagaaagtgaagaaagaagcatgtgaacatctttgcataaagaaactgcctagactttattactcatgaatgtaacatattagtgatttccagaaactagatagaatgaatgatctctaatagagaaccctcctcccccaatggttttgtatactattttctcaggatacttaataatttctttctaaactgcaaatgagaaaatgaagcataaatatggtcttgactttggcacacccaattatttgaattgttggtatcattttaaaataaaattgttttatattcctcttcctaaatgattcaacctcaagaccaattcaagtgttattcaaataatttgaatatctttcacttcatcccttaagaagtacaacaaacctatggttgggttgatggagagagattgatgtcatgccccgacctaggaatcagaggtgctagctaggctctgctcattagctcagagactagaatgagctgacctgcctctctattctaccagttccacttctaagggagccatttgctgaatagctgtgaccccttatttacagaaaattgcatctgtaaaatgaacaaatgtaaaagcaaaatgagtctgaaccagcatctctgactttcttcatatcatcaattttatgtttaatttttatatatataatcaaagttattatttcttctattgaataagtttttactattaggagctttgaatttgttgtcacagttgaagctataaaaagttaatccaggaacatttttgtaatgttactttttccttaaaatatttgaaaccttatatatctgatatacccatctttcatttttttaaatttcctttccattttgagcagaatcagatataattccttccatcctctcttcttttatcccttacttcacacaaatatttatatagtgtttactatttttcaggcactattcttggcacttgggatatattagggaataaacactaattccactgtggaggagctaatgttctagtggaaggaggaagacaataaatagggtaaataaatattgcaggttagacaataagtgtggtgggaaaaaaataggacagattggaggattcaggagtactgggtcaagacgtgagagtatacatttcaattttaaataagataagccccactgagaaaataacattcaagctacatgatattgtatgagcaggagctttttattttgcaatcagctgtattgtttcacatggggaaaactagagatgaaactcaataatatgacatggttgagataataaaataacaaaaaatgtataatattgggtgctctggtaatgactttgcatgtgtcattttatttaatcttcatgacaatgttatacaattggcactgttatctgtctgtgaggaaagtgagaccaacaataaccgacttgccctgggtcacacagatagtaagcggtgattccagaatttgtatctaggtagtctgattctaactctactcccttaattactagccatgttctcttgagttctttcataccaaggaaaatgtcgctattattcctgacgtatcttcaataacctcaataattattttgcactgtgtagggcctttgaaaagatggaggacacacattaactttccaggaaagatggtggtgctcacatttgataaaatgagagtttaacatcaggaatgaagaaggcatgagacttcctcttctcactaaaaatgggttatgcgtgattaggtgtttctcacccactcttaagagaaaaagcatgcatgattaatatgaatgggggttcaagtgcatatatcaaagggagaaacatcctcttgcattttaaagattgcaaataaatatagtttaatctgctatacataattcatattagcaacaaccacctcaaaattaatgtcagcccatgttaagatttgtgaatgacatctctaaagctttgcttcaggctattctcacagagactggttaatgcctttatggctaatttcctgaggcttatttttttggtctttcctgatgaaatattaagctctttttaaaaagagatttatctgataaaaaagtaaacccttgttcaacccgttacatagatttttctttaagatagggtgaggctttgcataaaaattgaaaagattgcagagggttcagtaacactagaggatctatgagatgtttttttcttattgaacttgacctcttactgttcagcacactctaaataagggatgttaatttcactcccaaacatactttattgctttggatattgagaagactgttaatctgctacttaaaaaatctcagaaggcaggaagtaattgcagaatttaacactgaacaatattaaactctaatttgactactcattctgatattaggggttatttcaaaagtaaagactagaagttctaagagtaaagagataagagttgtgtgctgtatttattctttcctcttcttttgggaagatgccagcaccccttcagtaacaacgcaagagcgtcttttcagacttctctttgcttttggtaaaaacatttatgtgtgtatcgaaatttgaacattctccctgaaatggtactcaaggagatttctaatcattcaaataatctcctaatttctcttatttccacctcaacgttcccaggcctttcctagctctgttctttttattttgttttttttactgtattggaggaaaaaatgcctatcttcactgccaaggccaacacattcatctctgccagagcagcattcacttctagtttcctctgggacattactcccttgggtacctattttcttactggtgttttttcacctctctttctaatgattcaaatcagcttccaggtatgctcagcctccctaccctaatatcataatccttctaaagtattttttctccttagtccttttctgccctctcctctctcttctcctcttgtattttctcccctgtgttctatccctcctctttatttattttccctcacttgattgccaaacttctcaaaagtgcaaactgtgtctactttcttagcatcctggcatatgaaacaaccatggccttggaggtaagatgactgggatttctttcctgattctatcttctggtgtgtaactttgacaagggacctgaattctttggcttgcaaataccgtattatatccctctagtttccagtgatggttacacaaactaatagatgatagaatcacatatcatttctcttggaagatagcaaattttcaagaagtaataactaacatgtattcttcagggtacacccttctcctttcccctaagatgagctttttaaaaatatcatctggaaaggagaagaaatagtacaaaagaataagtaaacattaacaaaaaatactgagtgtacataatacataacgtaacaaagcattagatgcagggaacttgggtcacagaatagacattagaaattccatttcttttctcagagctatgatgctgtggcaatacatgtaggagaggcaaagtgatgagagagaaccagaagcagactaagatgaggaatgtggttcttctaggttgtcctattgtgatagatggtctcacaagatgtccacaattaagtttattcctcccatgttgctccatggaaagatgggttttcttcctctccccttgaatctagactgcatttgtgatttgctctgactaatagaatatggtagtagtgatagttccaggcctggactttaaagggatggtggcttcaggatcctcccttggcagtgagatgccatgttgtgaggaagtccaagccaaccacatgcaaaagccaactgggaaaggagagatgactggctatcccctagtggggccagccattatggctgaggtactgctcatgtgaataaagacacatcttgtactttccaggctcagaagaaagtggagcagaaggactatctggctgagtcagcactgattccccaatgattagatataataaagtgttattgattcaatccaggaagttttgaggtaaatttttgcacagcattagataacagacacaattactaatgaaaccagcccaattgtcccatataaatgatatttacaggtttttgaatcaacatagaaattgatcttcctcatcttaaaacttgaaacatatctgagttccttcctaagaaaccaactctggggcaagggaatgagactcagcagatcaccgcatccagacaatgaaatgccagacccctcatccatcatgattgcttccttacccctccctaattcctctccacacatagctacatcccttccccactatataaatccttcaactttagttgtttggggagattatttgaaactgatctgtccctgtggcttcagcagctgattaaagccttcctccctggcaacatttgttgtctcggtgattggctttctgtgcagctagcaatgagacttagactgacactaacactaatatacttcagcaagtcatctgcatttgctgatccattctaatttatcaaatgagacaactgaactagctcattgcaaacatgccccacccagcctgaattctggccatccatcagttttgcatgtgcaagtatttttactgataaaagttagaccctgagttcaaaaagtcttagaacttcactcttatttcctttatgacttaagtcctctctcatctgtctttttctactttaaatgaagttaatatcatggatcaactagattaaatgagatagtctatgtaatacataattctggaatgtgataagtacaccactttccatgaaagctcttattattaatgaaagaaagaggaggtcccacagcctgacccagagttgtgtactctgatccacaccatcagtggaaaagaaagtgccgtttgtgagttctaaagataaatgctgtagatgttttccaacatggtgacatctctgtgtttccctccttaaaaacctgataataatcttcatacttctttggaaaacttaatagaatgtaatgtactgaggcatcacatccttagtccctcttaaattttctttgttagataatcagggcagagtatcagaagtaattaaaattaaactctgcctgaaaatatgttaataaaaagtatgatatgagattataagtattgttaagcaaaagttttagaactatgtagaaaaaaaagtacagaagacagtgttaaaaaaaaagaaaggaaggaaagcatggctagataaaaaagctgaagaaaaagttaaaggacatatggctctgtagcccactacaagtttgcaaaattcatttctttttgtagacacagcttgatataagctgaatcctgacaaattattctttgtattcagagtcacttaatttaaaacaatgtaaattcaaaggaagaagataatgttcctaacctcactgtgaccccagtccaattttgctacaccacctcaagcgagtcaaattcacaatttacatgcaggaagttaaccacaaaattagagcaactctttataggccccaaggttaagcatcaaaggcagaaatccaattaaaatgttatttggattttccaatagcaaacaatctggaaaacttaccagattatgagaaggatatgtatatgaaagctagagattatgtcttgcataaatcaataaataaaatttaaaaatgtttattcatttcttcaacagagatttatatttttgcagattacatacaagattttttaaagaattgtggagaaaagataaaaaatgacttcagccctcaacttaagaagataataatttttaaaaggtagctaaaacattcaaatatctatgatggtaggtaggatattaaaattctagatgagtgatgcacataaaatgagacagctgtttaagggaggagaaactccttccaggtttagggatggtaaggattgcaaatacttgtatacaatatctaacaagtacattagactttgaagatgcacacatggcacaagcacattgttacacacaattcatattcatttatttcagtcactcagaagatatttgtgcatacctgcctagctttcacatgctgataagacagtctctttcccgagctgtataatatgtgagtgggaagaaaaggtgctttatttaaattaaaattaaactataaggctgatttgtaaaatataaaagcaaaaaacctcaaatgaagagggtagacagactgacgagttagcaaatagaatcatctatcaattaacagtggggacctggatgtcaagttgcccggtttgaatcctgaatataccacttcctagcaaagctgaatttagtcatctgtaaaattgtgataataaaattagtagctgcttcttgaggattgctatgaagattagataccgtagtcctcccttatccacggttttgctttccatattttcagttgcctgcagtctgaaaagagatgaaaaactacaacaagatattttgagaaagagaccacatttacataacttttattacagtatattattataattgttctactttattattagttgctgtgaatatcttttggggcctaatttataaattaaactttattatagatatgtgtatctaggaaagaaacagtagtatgtagggtttggtcctagccatggtttcaggtatttactaggggtcttgggaagtatctcctgcagataagagaggactactgtaatacagtgcctggaatatagtacgtgcctggaaaactgaataattgccgacagtattaagattgatgtgaaactacctagacctggaagggcttggtggaggttcaggaaagaagaaaatgtttgagctaagcttagaatagtctttggacttgctggtcacaaaagaagagctttgttaaaacaaggacactgttggaattagcaatcactaaagcttcaaaatcttttaacttagaaccattaggttctcactcatctttggaatacctctgagatttacctgcattggcattgtgttcatctttttcttgatggaatttaggctcagagaattttagaaactcgtgaaagtcagaaaggaaactaattttctaattttcaaatatgatgccttatacatcaactagagaaatatactctcaattttagtttgcgaggtagactcgagtctaagtgatcctttctttgtgtactacacataactagttatgtcactaaaagacaaaaataaggaaataaataaatatataaaatgaacggtaatgtctctaccttaattcccacatcagtaaaacaaagctaaaaattatctttgcctctatatttctaagtaatgtttgatataagtatgaaccatgacatcttaaataaaaacctgagagaataaatgatctaaggggtgcttccaaggaaaggtgttatataaatatgatatattttcattaatagctataaactgtgagtccctgagaggatgggaccttaagcacttctgttaaacctcaatgatcttgtgaagatgtgtctggtcatcacattttctataatacaaacagttaaaacaccaacatgattagaagttaaattaacgataattagaaaaggcgataccaggaattgatttagtaattcaccctctgagatatcacttgtattgtgttcagtttcttagcttacctattctattttcaagtaccttattatgagtttatttcacttccccccaaaataatagattttagctttgtacgtatttgaaaatttataatccatgttttgtgcatgtgtaactctcagctcaccaatatatttcattatctgaaacagcctaaatcattccatatatgtatgtattactttataaataatgcacatgtgagaaagtgaggagaggctgcagatgttcagtaaagtgcttggttagacgcaaacaatattatgactggaagaaactcaactaattatccagttcagggttggcaaatttttttctgtaaaggccacacagtaagtattttagactttatgggccatacggtctctgtcaccactacttgactctgccattgtaccataaaaatagccatagataatgcaaaatgagtaagcatgacatattccaacaaaacctcatttacaaaaacaggcggcctgccaaatttggccctagggctgaagtttgccattgtataaactaatgcgactcacctatttcacgtgtgaggagattaaggcatagaagatttaagtgccattattggctattattaattgaattttcatggggagaaacagctctgtctgctaacatttttattctgctttgtcaatgaatcaaccttccacaaggcttgctggaatgatctttatgaaatgcagagcaagacgtgtcttttctgtgtttaaattcctttaacagatccctgacttccatgtgagattcagtctccttgtctagcgtatttaggatctgtaatcatgagatttctgatcactgcatcgattccatagcctactccgttttgcaggaaggctctattaagcccccacagtatgataaactgcatgacacataggaagtggtcctattttatttactttatctcccatgtctaacataatgcttgatacacagtagatcctgaataaatagctggaaaatgaatggataaattaaaagctgagatcagaaaagagttttaaggcaaatttgacagaatacctccttgcttggccctgactaaagtttcctgggtctcaccacgtgttcatggaaaatgaaaggactaggatcagaaaccccctcccaggtgaccttcatcagagctcacttcatcagcctgtctccctagtaacccatttctatattaatgtctggttactcacagggccccatctgtaccgctccttaattgtgcaaaaatattccacgaactaagtaaggacattgctatcgtattatccagcatggttttcatcagctggtcacacttccttctgcttcttcaatgtctctaaggaatttgattctccaaatgttcaatttgttgtgaggtagcacaacctagagttacaacttgtattcctagggctattacagtgactcacagtaggagaggatattttgatacctggatcactgaacccacctgggatgctaatgtatatgtccgtgtaatgtgtggaattaccatcaccagaaggttgtcttccccaaggcagtatccccttcctccaggaaaatgcagaattgttatcactgtaactccataccagcagcatcctttcaaggaaggtctcacagtcttagccaaaaagagcacactgtgatgctgatgacactgtttttactaagctagacaaggtttctttttaaaaatattggccaccaaacaatgggattgtgctttcttctgcttttaaaagcatgattttttttaactatctccactcaagctattaaattaactgattaaacatatttattagccaaatacttcctaaatcatcagattgatctggagactattcagaagggaaaactttttctctacccttttacattcagtattggaggcctatgaattaaaaggacaaaagacagattagcaagataaaagataaagtatgttcatatacatacaggagagcctgcagaaaatgtagctccaagaagtggttggaatagcatctgaactagtgggatgcattaggatttcaagggacaataaatggtgagaaatgactgtgaaatatatgggggaaattaatggaaggtaagatttgagtgagaaagtcctgtttatgcaatttctcatcccagtacccacttctcctctaaggggacaggagtcactccacgtggtacaggaagacttccttaaagggggatttatgacagttgatccttttggaacacttggcttttaggcagacaacaggaatgcagagaaagctccttcctgcatgtttggattctcaaatgcctttagttcaagataatccttatgccacaatgacataacgtgaaccccttcaagaaaaatgacactccacaaagaagaaaatcaaggcaaagaattcaatcattctggaagacaaaccttttgactaaggtacccaaataatattgtagatgtgttcgaaagccctaagttaatgtgactaagtattcactttatttttcaatcaagcagagccatcttattgaaagttgaaaccaggaacactctaattgaatatctcctcccagaagattaagaatttcttattaatattttatctctaaatgaatcaattaacttctcagtacaaactgtgcctctttttaaaatatataatttggtaaatttattatccaatatagcagagctgaactttttgaaaaagaagggttctctgttagtgtgtggcagcatccataacataattagaagctcagaatattggggctaaaaggtgtcttggtaagctcagcaactgatccttggctttatagggagaaaaagaggcccagagtggttaactggtttacccaaggtcacatagtgagctcgtgctttaactaggacttgaatcttgggctcagtcccattgaaatacttgaaaagagtatctaatgacttgtaggttaatgaatagaagcacattcatcagattaatgcagcaaagccctggatattgagaaaacacaaaatgacttagagctaattaaatacagacacaaattagaaaatgaggcttaagacagaatattaataatttctggtagatatctcatctttctgctcttaaagcaccctatgctgtcttctctcacaacataatgtcaccttcttgatttcaattcattatgcatgggttcaattctgtgctaccctcccatttatatgttgaagtcctaacccccaggacctcggaatgtgaccatgtttggagatgaggtctttacagggatcattaatttaaagtgaggtcattagagtggaccctattcctatataattgatgaccttgagaaatttggatgcagagagatgcacagagggaaaacaatgtgatgagacatagagataaaatggccatctacaagtcaaagagagaggtctgacacatatccttctcttatgcccttagatggaaccaatcctacagataccttgaccttgaacttctagcctgcagaactgtaaatcaataaatcccagttgtttaagccacccagtttgtggtactttgttagtgcagttctagcaaatgaatgcacactatttactcaatttttccccaaggcaacccgcacttctaccctgcccagcaccaacagagatggtgcggacttctccttatcatctcagaaacttccagtgtctggcttttcctgggtactcagttagtgcctgtaactgaattgccttacactaaatagagtacttgtactactctaactcaactcttattcacaacagctccctactttgggtagagtagtttatattattcttatttaactgatgattttccaaagaagataatgacattcccatgtaaggttacaaagtattacaaaggaaagagatgacaatccactgaaatgctttccaaatataatccaaatataatagtccagtctttaaaatctgagttgctttttgttgaatctgaaactgcctttaatttaccacatgcagcttgaggggtctttccagtggaaactgttttccgtcagggaaaaaaataagtaaacaaataaaagccctcaaaactgatcactaaatcagctcagcttatcaaaacaaaacaaaagaaaatcccccaattaaaacaggatttaaaacaatgaattcaattttggaaaagaaattgccaagtttgatttgtactgattattacgtgtttcaacaaactatttaaagtagtggatctttctggggttttacagagctctgtgtccatagaaatcctgaaataaactcaaatttaccaattttgtattgttttccaagaggagtatccactaacactgattaataataacaaatggataattatgtcattttatatgttcttttgttacacataaaaatctagtatttcttaaatgctggctacatgctttatacatcagttagcactctggcagaaaataaaatggtttaatgaaaagagtttaactgaagaaaatttaatgaaggcacatttgtgcagagtgacaggcaaagtaagggaaaaatcagtggttggtgaggtacccaaggctcagcaaaagtgagaagctattacaaccttaggcctgaagatgtggggagttaccatcagagtccagaggaggattgtgggggatggggtacctgagagggagtgtagccatggaggaacacagccacttctagaagagtggtaaggcaaggcttctctctggtcaggaccccctatgacctggcaatcccacacagaagtcccagccctgggagcccagatgatacactctgtaaagctctgttggtctatttttgcattgctatgaaggaatatctgaggttaggtaatctgtaaagaaaagagatttagttgtctcatggttctgcaggctgtacagaaagtatggcaccagcgtctgcttctggtgagggctcaggaagcttacaatcatggtggaaggtgaaggaggatccagtgtatcacatggcaagagagggagcaagagagacaaggtggagtgccagactcttttaaacacccagaactcacatgaactaatagttagagcccactcattactgcaaggatggcaccaagccattcatatgagatccaccctcatgacccaaacacctcccaccagtccccacatccaacattggggattacattttactatgagatttggaggggatacacacccaaaccatatcaagagcttaatctccagagaccagttagacaatgaatgggaggggcagtttcaaatggagaacagagtattttatatgaaccatctaactgaataatcttcaaaccccatgacatattttacaaatttagaagcacaagatcagagaagttaaaaatgtgcccagtttttaatgagcaagtagaatgaggagtatattagtctgttctcatgctgctgataaagacatacccaagactgggcaatttacagaagaaaaagtttaatggacttacagttccacatggctgggggagcttcataatcatggtggaagtcaaggaggagcaagtcacatcttacacggagggcagcaggcaaagagagagcttgtgcagggaaacgcccccttataaaaccatcagatctcatgacatttattcactctcacgagaacaccacaggaaagacctgcacccgtgattcaattaccactcaccgggtccctcgcacaatacatgggaattcaagatgagatttgggtggggacacagagtcaaaccatatcaaggagcaaatgaaatccaactttgttttagatctaatgaagaagaacaaaagaaaaatattgttttgctttcatacaatacatttcttttaaatgaaggaaggggaagagggcattatgtgaaacttgagaaaattgtagatgagttttatgtcaaaggactttgtgtttacttcagaatgtggaatgacttgacttggtgtggaagaggagcagagtcagtgaattgacaggaggatggagaacgtgccagacgagaaagtaatggacatatgttgataaggatgatcaaagaccaaagaatgaggcctgcccaggtggtgcatgcctgtagttctacctactttggaggctgaggctagaagattgattgagcccaggggttgggtcccatctaggaaacatagcaagatcctgactcaaaaacaacaacagcaaaaagaccaaacctcataagaaacagaaaatattaagaaatgagtgggataggaggttaaacaagataactagctctcgtataacactatataatttactaaaattttagtatagctcatatgacttgatactcaacagatccttgagagatctattataactatttcccgcctcatgttgtagataaaaaaacaagttcacagaagttaagtaaatggtagatatggaatttgactgctagcctgaagattgtctaatgaaccaagaataattacttgtttgagaagtctggaagtagtctgtgatatgaaatgtcaccaaactatgatgcaactctgtgagtactaaagtagaaatttagttgtttttagtcatttatctaatcaaataactatttctaatcaaggtatgctagctaactatgtattccaaatccttttaaaattttttattagacaccttgtgccccaaataagaaagctactaaacatgagtatagcccagggctttgataattttcattagcaccttagtttaactaatgcattatctgttaaataagtctgattaacacttctctacataatcattttctaatgcgtgcaactgttgcctctagagattaattgccaagcttttatgttcaactaacagtagattgacatttagcatcttagatttatagatttcctggtatgttattggactgttttctttggatggattcctccaaccatttgaaattggatttctccaaggataggtcgatgtaagcagtggagctaatcacatcattttacttcagcctcttctcacagaacttggtttattatgatcttaaaacctcctgggatatttttctagctctggatgtatctgaatgtaccaggtaaaatcaggactactgtaattcatccatttgctgtactatcttctcgttccatatagatacctttatgttgacatgacagtattagaaaaagacagctaccagagccctgcccacccatctacaaggtcaagaactattcccaccaaactattgaggccttgtatatactaggtgcttaaatgacatttgataacctggtttattgactttgaagaatactaatttagttacttatttaatattccaatgcacaccttcttcaggtaaagtgcaatgttggctattgaggaaaagataagtttgtggcttcaactatgggaatagtgttttagttcaaatcctttagtttcaaaagagataaacctttcaaactcagttaaaataatgaatgaaattaagtggaatcaaaggcaaggagtacagagaggtcattgcttctctgaacctaaacattattgtcattgtttctctgcatagctctgtgtttctgtgtcaatggccatcactacatttgattctataatatttctactgcaatcaagtcactaacataggcaaaggttaacttgttccaggtcaaaattcctaggaaaaagaatctgattcatccaacctgtgttaaaaattaatacttgatacaatcaactgctgccaatggatctggctcccgtaataaatcctcggccactaaggacagctgggtagaaatgactattatccaggaaagaggaacacacctggccaacccctttctttctgtagtacatagggtatctactttgaccagtttctgagagtagtttgcttcaactctccctcttcctctatgactgatggcagacaatctaacatttaactctacctctgtattagtcagggttctctagaaggacataactaataggatatatatatatacacatacacactcgtatatacacacacacacagatacatatatatatatatatatatatatatatgtaaaaggagtttattaagtattaactcacatgatcacaaggccccacaataggccatccacaaattgaggagcaaggacagccagtctgagtcccaaaactgaagaacttgaagtctgctgttcaagggcaggaagcatctggcataggagaaagatgaaggctgggaggctaggccactctagtagtttcacatttttctgcatgctttatattctagtaaaactagcagctgattagattgtgccaatacagatcaagggtaggtctgcctttcccagcctactgactcaaatgttgatatcctttggcaacatcctcacagacacacccaggatcagtccttttcatccttcaatccaatcaagtttacactcagtattaaccatcacaagtctacccattgtcaacttgaacccacacacatctcctgagctcatacataaccttcaaataaagacaataataaggtcataattacacctaacataatacaactatcttttgtacaactggaaacacaccaatacccaacccaaatactattacagaaagttaacaatacttaaatgctgctatgaggtcaataaattttatgtcacatgataaaggaaaaaggaaataaaatgaagatattttcttagtacaagtatatatgtgcacaaacatgtttttaaaaaaaggaaggaggaaatactcaagggaattacagtccttgtttctgcagctggtcttgggatcatagctggtattgatgactaccttcttctactgcccattctatattccctttgccttcagcaagaacctcagcaggtcatggttttgttttgttttgttttctggtggagtgacccaaacctttattcctgaagggtgtgtgccatttgtagtcctgcctggattgggctgttgtagtttcccattgaccttaatcagagggcatggtaatactaagagacgccctaatggatctcctgtattccatgcatactctcccttacctctgttgtagagtggtagatgatttcatcttgatagtctggatcaattgccccagccaacactgtaactcccttcttagcctgttgacttaaaggtaggaggagaccaaagtgtccaggtggcaatcctaacttccagtttagtgggatctgggatcgttgttgtgtatcctggtggaagtgttcctccctctggaactaagacctctagcccagcagaaggtaatattgcaggaacaggaagcaaaaattttgctagtggatcacaggggtgatggtgagtggtgccacttccacttccaccccttgattccaagacccatgaatcctggctatgggagaaacagtaccatatattggacactgattcagagcatacacgggcttctggagaactttgcccctgccctgcaaagtattgtcacctagttggcattgtaattgtgacttcaaaaggccattccacacttctatcaatccagctgcttcaggatgatggggaacatggtaagaccagtgaatttcatggtcatgagcccactgccacacttttttagccataaagtgagtgccttggtcagaggcaatgctgtgtggaataccatgacggtggataaggcattctgtgagtccatgggtggtagtcttggcagaagcattacgtgcaggataagcaaacctatatccagagtaagtttctattccagtgccctttccatgatggaagaggtctaatataatcaacttgccaccaggtagctggctgattaccctgaggaatggtgccatatcaagggcacagtgttggtctctgctgctggcaaatttggcactcagcagtggccatagccaggtcagcctttgtgagtggaagtccatgttgctgagcccacgtgtaacctccatccttgccaccatggccgctttgtttatgggcccattggacaatgacaggggggtggctggggaaagaggctgaaccgtgtctgcagaacaggtcatcctatccacttgattatttaaatcctcttctgctgaggtcacccattggtgagcactcacatgagatacaaatatcttgtttttgaccactcagagaggtccatccacatacctcgtccccaaatttctttctcaccaattttccaatcatgcttcttccaagtccctgaccatccagccaaaccattggctacagcccattaatcagtatataattacacatctggccatttctccttccattcaaagtgcacaaccagttgcattgctcaaagttctgcccatagggaagattttcctttacccttcatcattcttcaggggtgtcctacaaagcggctttagtgctgcagctgtccacttttgggtggtgcctgcatattgtcagaaccatttgtgaaccaggccctagtcttctcttcctctgtcaactgatcatggggaactccccatgaggccatcagtgcatgctgggggagaaaagccagggtggctggagtggagacagtgagtatttgaaccacttccttatgtaacttacttgttccttcagggcctgcttgagcccaatcacatatagaccacttccgtttgatgatccagtgctgctgtgcgtgacccactttatggccagatgggtcagaaagcatccaattcatgataggcaattcaggttgcatggtgacttgatgatccatagttaaatgttcagtttcaaccaaagcccagtaacaggccaagagctgtctctcaaaaggagagtagttatttgcagaacatgccttgctctaaaattctagaggcctctgctgtaattcatgtatgggggcctgccaaagattccaaacagcatccctatctgtcactgacacctcaggcaccactggatctgctgggtcatatggcccaagtggcagagcagcttgcacagcagcctggacctgttgcagagccttctcctcttctggaccccactcaaaactggcagcctctcaggtcacttgataaatgggctggagtaacccacccagatgaggaatgtgctgcctccaagatccaaatagacctactaggtgttgtgcctctttcttggtcatgggaggggctaaacgcagcacttattcaccttagaaggaagatctcaacagaccccacaccactggacccctagaaattttactgaggtagaagtccttgaattttagtcatatttgtttcccatcctcaggcatgcaaatatctcaccaataagtccaatgtgtttactacttcttactcactagatcaaatcagcataatgttatcaatgtaatggaccattgtgatgttttacagaagcaaaaagcaatcaaggtctctctgaataagattattacagaaagccggagagttgatatacccctgaggtaggacaataaaagtatattgctggccttgccagctgaaggcaaatttcttctggggtttatggacaggaatgaagaaaaaggcatttactaagtcaatggctgcataccaggtaccaggatatgtgttaatttgctcaagcaatgaaaccatatctggtacagcagctgcaattggagtcaccacttggttaagcttatgataatccactgtcattctccaacatccatctttcttctgcacaggctaaatgggagcattgaatagggatgtggtgggaattacaacccctgcatctttcaagtcctgatggtggcactaatgtcagcaacccctccagggatgtgatattgtttttcatttactatttttctaggtataagcagttctaatggcttccacttggccttttccttcatagtaaccctcaccctaccagtcagggaacaaatgtgggggttctgccagctactaagtatgtctatgctagttatgtattctggctctggggaaatgaccacagggtgagtctggggactcattggacccactgtaagtcagacctgagctaaaacactgttaattacctgacctccttaagcccctactttaaccggaggaccacaatgacgttttgggtcccctggaatcaatgtcacctcagagccagtgtcccatagtcccccaaatgtctagttatttccctttccccaatgcacagttaccccggtagaaggccagaggtctccttggggaaggatgagagaaagattccttgcataaattgttggtaatgtagtggagtccttcctcaagggggaccagcctccccttcattcaagggattctaggtctgtaaactggcttgtctggaaattgaggagctatgattctgtttttataattgaaattagacttagaagttttctgcttgtataaattaagtacgaatgccgtaggctctctatcaatttaacttctaagaacaccatgattaattagccagtgccagagctctacatgagtcaaactgttctgattgccactttacctctgctgtccattacggtagctatgcctaccttgcttttgacagttgagtgctgccacttggcccatgccaccttgggatccaattattcccattgtatttaaatttcatagttgggtgactgtggttcccactgttagatctgacatactgagaagagcaattacagggctcttcaaagatgcaggttttgccctcacaaatctattttgcaaggcattggtcaagggtatatattctagacctaaatctccctaagcctttgcatcccttcctctacattaaatcaagggagatcaggcatttccagctcactcacaatgggccatatcaatctgattatctaatgtcaagagatccgggtcccatagtaaatccttggccactaaggacagctggtagagatgactcttatcaaggaaagaggaacatacctggccaaccccattgtttctatagcacatagggtatcaactttgaccaaattctgggagtagtttgcctcacttcttcctcttcttctatacctgatggcaaacaacttaacatttaactctaaccctaggctgttaaattttcatgctagccaaaatgcttatctgcctttaacagcagcttgaatacttccccctaccctttcaaagatttatctcaggaacagtgcagggggacaaggccaaatcctgttttgtttctaagtacaggaagcctgaactgtactattatttagataccaccacttctgaactaactgcaagcaggagagtcaactatatcatttcaatgtgtttttataacacagcggcagattttagaggtgaaacttggaagagattgatctttttctacaaggaggtagagaatatgatgagaaatttctctatttgcactgcaagatatctttagtgaatctcttctctattcctcagctacaaacattttaactttttctctacagcaggttcatcacagtaaagatagtaagccaagtcctcaccttttctctggaaaatataggaagaaacaaaatagaggtcagataaaccagaaattgcatttaggaaacatacaaattgaccttgtaatgagcatgctgtgtagtttttttcccactatgttttctttcttaaaatcaaatctaaataatacagccatcatgtctagttaatagttgtgccattggctgggtgcagtggctcacactggtaatcctagcactttgagagaccgaagtgtgcagatcgcctgaggtcaggagtttgagaccagcctggccaacatgttgaaaccccatctctactaaaaacacaaaaattagccaacagtggtggtgtacacctttaatcccagctacttgggaagccgagagaggagaattgcttgaatccaggaggcagaggttgcagcaagtcgagattgtgccagtgcagtgcagcctggacaacagagggagactccatctcaacaataacagcaataacaacaaaaacataattgtgcccttagggggactaaaacataaagttattgaggggaaaatgtcacatcacaagcttcccttgttttacaaggacttgaggttaagtaatttcttccttccttatggttgtaaaatattgacttcagaagttgtcaaattagcctggcatggtccttgttacaagtaaataggttccttctgtggaggcactagcaatcaactttcccaaggatgaggtgctgatatcccaaggcttgcctttctccctattgaatttatctatttgtgcacctgtacacttaggcagacaatgtaatacatctatttatcgctaccaccagcgtatctgtctaaagctataactgaaggcatgtgttctcataaaagaagagaggcacattagtctagtttgatgcagcagtcacaggctttatgtagtgacttatctggagataagagtcttgactgttgttagacaccaccgaaagtcattactttgtgactgcaaggaggatgacaactcaactgagtgaaacttccagcaggttgtgcattagaacttagaacaacaaaagtgagagaagtgggggtcctggatttctattgattacaaaataagctgtttatcatcataatataagctccttatgaccagtgactaggaatttatttaatattatgcacagaagttttttaaaaacagaacattgtatgtgataaatttttgccagcaaatagatgggtgcatgcatggatggatgaatggatgcacgaatgaatggatggatggatggatggatggatggatggatggatggatggatgaatggatggatgcacaaatggatgaacgaatgcatggatggatgaatggatgaatgaatggatggatggatggatggatggatggatggatggatggatgggttcatggatgcatgaatgaatggatagatgcatgaatgaatagatggatgcatggatggatggatgcacaaatggatgaatgaatgcatggatgggtggatgggtggatgaatggatggatggatggttggatggatggatggatggatggatggatgcatagatgcacaaatggatgaatgaatgaatgcatgaatggatggatggatgggtggatggatggatggatgcatggatgcacaaatggatgaatgaatgaatgcatgaatggatggatgagtggatggatggatgcatggatggatgaatgaatggatggatgagccagactacttactttcagagttttcacgaataatataggatgctaggttactaaagttattacaaatgtgtgatttttaaggaatctacaatcagaatgatgcctacttctctggctgcttcttgtaacctccacgccttgcccacagagttctagtcacaccatagttctttctgttcttcatgcctgtttagcaccagggccgttgcacaggctgttcctcaggcccaaaagcttttctttatgatctccacatatctctttctttcctgatattcaggattcacctcacgtgttctatcactaggagtgattcttttaaccactcagtctgaagtagtgaccagattgttctccatcatggttcaatttcaattctctcctcaacatttattgtgcctttatgtatttatttgatagttttattttttctttacatttgtggctttatttatctttcattctccaataacgtttgagcttcacgattatttcccagcttatttagcactatatcctctgcatacacatccagttatagactgaatgaatggaagggaggaaaaaatcaaacattctcccataggtttaattactaaaaattccctaaattatatgcacccataaaacatttaaaacagtgtaaatttatacaaattagatatatactttgaagtgatcaaatttcctactttaaaaaggtggttgtgttgacctgtttatctgtcagccttggaaatatatcaaaggttaaataaatataatcatgttatattcttaaatcttttcggaatgaagtgaggtataaacacatgtgtgcttttatatatataaacacacatgtatatatacatgcacatatttctataattcagggatttgttggttcagactaagaactcttagttcctagttctttgctctatgatgatttagaaacctggaattttttaaactgaaagggctaatgtcttttcgtgcagtggttttcactggaggcagtaagatcatctaccgttgcacttggcattttgtgacatgtgttagttattataataaatgggagcactaaaaggcatttggtggccaggggctaggtttgctatatatctcaatgcatggaaaagccttatacctgaagaaagctttcatatctcccacaactttcaaaaatctgttcacaatcacccgagccttatacataattctgctttacttttaaacacaaagtattttgcactcagacctgccaactaaactctagccccaggtactaagctttcaaataggaactgtggcttattacattttactccctttttcctgaaaattcattaaaattcagttacgaagtctgtctttaacaatatcaaatggagcctttaaacgatgaccacaatgtatagtcctttcaaggaggaatgtctttgcccatcacatatctttctgaatttctagaagtctgttaaataaaaaggaacaaatccagacttaggtaaggagatattttgttcggaaagacttttatagtgagaggaaaaggactattgcaatacagagaatactctgaccataagatctgcaaacatctcaaaggacaggcagaaagggctcctcttttacaggaaggagtaaacaaagctagaaggagctgtctgtgggagtgtgaagaccagatggtgtggtagaacaactgattggggaatgtttctcctaggtgtcagtggactcttgagaggggccttaaaggatgagctcttctatattctgatgcttggttaaagtcaagggagagtcaaactccaggtgtctgtggagtgggaaaaccctaacaaaattttggtccagacaagtcagcagatacttttcccagattgattaaattgtataaactcagtaaatcaaaggatgatttcattttccttccacaagatcacagtaaggtttgtttgccgtttggggaagtcgcattcctaatggtcgcagtgcttgtggtatatgagcagtcagtacaaccacttgtatcatctgcatttgtggttaccaaattcgtgataattctggaagaaccaatgcaaacaggtgacgactgtgttttatcttttagtgtactaaagcagttggagaatatttcatttttaattgacttccttttgtttctccgttatattaatttaaggccttatatcagttttccacttccctagattatgtgtagagctagacaacatggctgtaaatgtaatttcaggaaaataaaggtggcattatgaaatatttgttctcaaaaagggctgtaggtcctttaaaactgcaattcctattccactgccagattattatttatgtataatgactctgaaactaacagaagttgagaaatttgcccaaagccacagagaatattaatacaattacacacatacatactcttaaattgttaaaaaatgttgacatgacaagcatggggctaggaatgcagatgaataaaaatgcctttttctgtccagtaaaaaaataacttctacacagaaatgataaaaactcaattaagaagtgactggtttagcaagcaaaaagtcctagaaaatgttatttctgataagtacattaatacaaacttttcattgctggaaactttcttgctatatttaagacatgtgaaaaagcaaaaaacaaaaacgtctagaaatctatttcttaatctgcaaaatggggataaaaatatgtacctcatagcattgtgtgactcaaacaaggtaagtgatgtgatccatgatttccaaacattaatgttcttataaattacctggaaattttgttaaaatgtagaatctgatttttaagtttctgtgggaattagaattctgcattttgaacaaaatcttcagtagttaccaataatactggttagagataattttgaatgggaaagatggaaaccccttggcacattggaaggggccagttttggttggaggtccttggcttccactcttgtactagctctttttgaagaggcattggctgtttccccacagatctcacttgcttcttttatttttagatcactcccatttcactcatttataggttttaagaatgaggggagtgattagatgaagactgtttgagggactggtaattaatactcaaaaataaatttttgaatatgcttctttcttcttcctattaaaagcataatgttctggtactttgtccacgtttaaagcagcctttctggattaatatagctactaatagaaaggggagaaaagttgctatggttagaatacatgtgttcctctgaaattcctgtgttgaagcttaaccttcacagtgatggtattaagaggtggggcctttgagtggtaattaggtcatgttgtaattaggtcatgagggctctgccttattgtagagagaggagaaggactattgcaatacagtgaatactctgaccataacatctgcaagcatctcaaagggcaggcagaaagggctcctcttttataggaaggagtaaacaaagctagaaggagctggctgtgggagtctctctctctctctctctctctctctctctatctccagacagacagatagatagatagatagatagatagatagatagatagatagacagacagacagacagacagacagacagacggatagatagatatagagagagtctcacatctcactctgtcacccagcaggctgagatgcaatggtgcaatcgttgttcactgtaacctgaaattcgtgagctcaaatgatcctcccacctcagcctcctaagtagctattttttattttttttttttagggttggggtctccctgtgttacccaggctggtttcaatctcctggtctcaagtgattctccaaccttgcccttcaaaaatgctgggattacagtcatgaaccaccatcctgagtgtttaaatacgcttctaaaagaggcttcatagaactgcctgtcccttccatctcctctgccatgtttttacaagattcatcctcttttgcccatctgccttccaccatctgatgagatgcaaccaagtgccaccttggaagcagaaagtgagccttcatcaaatatggaaaatattggcatcttgatattagacttcccagggtctagaactggagacataattttctttgcttataaactaccctgtctaaagtattttgttacagcagcaggaatagaataagatataggtattattattatattcttctggagtgacattcttattactcatatataaatattcatatctacttatctaaaacaatcacatttcttattttacaaaatagttttacagttcctcaactgggatacaaaaagcccacttttttagtgagaaaaaatgataaaatgaaatacaaaacagttctactagcctcaatattctacagatgcttcttcaatggacctaagaatggtaaacagatttttttaaagacatccaaatctaagacaccttgtatttttcagttttaccaatagatgacactagtgatacacacgcacgcacgcacacacacacacacacacacacacacacgtatataataacattccaagaaaattcttcaagtctgcagtcttggggataaaagcccaaggtaaagaaaccggtaacaccgagttgttaacatactaacattgtttttatagagtttttttattattttcatagaatttgcaaaagcatcttcaaagacagtttttgtggcagatgactgagcatctaaattatttttatcaacacacaattataacactaatcctgaaataagaaaaaatcagagggacttcatgaaaggaatatgtgaatatatatttcatcttgtaaaaattggttgcttattccttcatctataaaaccatgtggtctgaatatattgtttctcaggccctggatggagtaccaagaatgcagcctagtaaggcaagacactgcctaaaaagatggtcaaattatctagaaaaattagtaatgtaatcacactgtccaaagtccccatgacatgggagtttcaagggttgtcatgccttccagatgtgagggaccatagtttgtaacctgcaaaacaatattattgtgagtggtgcttttctttaaatgacgtctctaaaagcgattcacattcttgataccactttggaattggagatatttcatttagagcccttgaaatctgagtactagtgtgcatattttattcctgccttttctcttgttactatatgcacctaaaccgagtatttttatcataggttttttggttgtttgcttgttgttttttttttttttttttttttttttggtagagattgggatttctccatgttgcctaagctggtctagaactcctggactcaagcaatccacccatcttggcttcacacagtgctgggattacaggtgtgaaccaccatgcccagccaatttttatcataattttaaattggcaactaaccagatgctttatgttacccccccatcatcccctacaaatgactccatgtcagacacagacattaatcggtttatggagttaaatttacaaaaaggaaataggaaaaagcgacaggtgcatggcattacgtgctgtgatgtgtattaaaagagagatctcacagattgaaaggagatgtaaataccagcaggacatatttttcaaaggacacattcagaagaatcccatataaggttgcctgtcaaaggaagccattccattttaactgaatatttaagaattttatagtgacataggtttcatttggttcatatgtgatatattttattagtaaaatatatagtgcatgattatcactacccagatatgaagcaaaagttgcataaatcattgtaatttttgatgaaacaaaagaatatttcgtaatgctaatcgttattttattttttcaaaaatttgtaaaagtgagaggctaatgggaagcctaaccattggcaatgaaataaattccattttgattttcttttttaataaatattgctgcacattcctttccaggatcaagttaaactccttgctaattctttcattgaacaaaataatcgtaaagaaaactcataacatattccgatttcagcatccgtgggtattagtagtcacatgatctacctttagagacagaaagttgaaatctgatttttttaaaaaaagtaagtgcagtggcttaagtgattctatgcttttagacagtattgtcttcaataattaatttgtatagataaatgtagcgtagcatctttacatattattaaaatattgttttgagattgtcatggcaatatacatgcacaaaatatgtagactggaacaacaacacaaggtactcagtaacatcattaaatgaaaaataaggtttttggttatgtacatcctggttctactctttttaaaaaaacttaaattaattcattaagaaatatttattacagagaaaatgatatatattcaaatatgtatttatatgtattcacatatataatacataagatatatataagctatgaaacacattaattaaaataaccatcactaccctacttaacaaaaaccatatattgcagtcttagataaagttgaaaaaaattattggtaaaagtttctaagtaaatctactaacataaataattaggccttttaatttttaattatcaaaaactatatttttctttattttatttaagggtaaagattctcacagcacacatgcacaaccatgatatatatcatctaagaacttatttctgtatatggttgggcagtaagcaattctatagatgtatacacctatataacctatattaaaatatggaacatttccaacttcataaaaagttccctagggttccatttcagtcaatatacaccaagatccaaacaaaactgatcaatattccaccaatgtagcttacttatgcctgttgagaactcaatataaataggattatacaatatagactcttgtgatattgtgatataataagtaagttatatttggtctctgctcttgcttcctgacacactgcttcgaaaacccttagagagtgtcttttgtatgccaatgagctgactgttggccagggttcctgagatagcttcaggatgggggctgttcaccagaaagacggaggcatgattagagagttgagactttcaggcctaccccgcaacctccgtgaaggagagagaggctgaagatcggttgagttcatcacctatggccagggatgtaatcaattatgtctacatgataaagtcttcataaatgtccaaaaagacaagagtgtggagagctttcaggttgctgaacatgcagaggctcctggggggtggtgcaccaggagagggtatggaatcttcagctcctttcctatacctcaccctatgtatctcttccatctggctgttcatttgtatcttttctaatacactttgtaaaaaatggataaatgtaagtgtttccctgagttctgtgagccatcctagcaaattcacagacaccaaggaaggagaaaattcactggacctgcgatctgtagacagtcagaagaatgggtgacagaccattacaatagtcccttgatgtcttccaagatgccttgtgcataccaaaatccacagatgataaagcccacaattggccctgcaaaattcccagaaacaaaacgtcagccccttgcatccctctaattctgtattttttgatcctcagttatttatccaagaatatggaacactcagattctgagggcagattgtacatgtgattggtgtctgaagagagggaatcttgtgggactaagcccttaacccatgggatctgactctgacttcataaagttacttcagttctgacatgatagtggtagaattgaaatgaattattggacacttagtgtccactagagagttagttgttagtggggagaaatccatacacattttggtgagcagaagtgaactattctgtgttgagctgtgagttgtgtgtattagagtcaaaaacagtttgatgtttcccatcttttccaatggttccttttctagctcagactctcctctgtgtccaacttcactcacattatataaagtctgtgaggttttttccttctgtatgtatagcaactgtttgttccttttcatagttgagtagtatgaatatgtaatttctggtgtggagctattatgaataaagctactgttgaacctctgtgtataagtctttaaatggacatgtgttttcatttgtcttgggtaaattcttaggtgtgaaatttctgaatcctataagtgatgcgtgtttaagaaactgccaaactgtttatcaaagaccttccaccattttatgaacccctcagcaatgtgtgagagctgcagttagtctgctccaggcagtcatcaactattaccagttgactccactcccacattctactgagtgtgaaatcatatcttattgtagttttaatttgaattttcttgatgattgctgatattgagtgtctttccatgtgtttgttttcatgtttatattagttacaaaaggccattaaataattcagatacaaataaatattttgtcagaaatgttacaaatatttctttttagtatgggggatgactttagaatttcttggtgtcctttgagattagaagactttcattctcttggaggccagttttttttttttttttttaatgtttcaagcttttgtgtgtactatctttgaaaactcataacaatattttcttatatttctgtctctggaatttttataattttaccttttatgcttatatctataattcatttcaaattacttttcacgcatgatgttagtaggggttgtagtgaattgaattgtggcctcaaaaagtcctatccccagtacctgtgaatgtgacattatttggaatagggtctttgtagatataattaaggatcctgtgattagatgatcttagatttagggtgggctctaaatccaatgactggggtcactataagaaaatagagatggtgatttgagacacggacacaggcgaaggtcatgtgaaggctgagacagaaattggaattatgccttttcaagccaaggaatgtcagggttcacaagcagataccagtagctgggaaagaagtatggcatggattctccttcagagcctccaaaagaacgaaatctaccaacaccttgatttcagattttaggcccctggaactgtgagaacataactttttgccattttagaccaccagtttgtggtaatctgttgcagctagcacgcggggcgggggtgggggtggggtgtcaaggtttttttattttcacagatggcataatacagttgttctagaacacatatcgaaaagattgccatttcattgttaattattttgatgcctttgtcaaaaatcaaagtgcaggtcattcctagacttgctgattctgttccattgatctattttttgcaccaatgctatgctgtactttacattttcctgtatgtcaattctctactgtcttgataacagtagctgtataacatcttttgagatcagataagatagatctttcaagtttgttcttccttttcagatatgattttgctattctcagtgttttgtatttctatatgaatttgggaattgaattgtcaatttctacatttttttgtagaaattggactaggattttgatttaaattggttcatgtttataggtcaattggtagaaaatagatattttaaaaacattgaatcttttgaatcatgaatatagtataaatgcccatgtttttgaggttctatttttgtaaaattttcaactgcgttttccagtttttctgtacagttattgcatagcttttgccaaactgatttatgattattttatattttatattatggtaagtggtattttaaaaatttatttttttcaattatgttagtgctagcatataaaaatacagttaatatttatatatttaccatgcatcctatgactcgccaagtttatttcttagttccagcaagaaatttttgtacctatgtcaagattttataatgtggaatatcacataatctcagactaaagagttttagcagttctttttttatctctattaatttatttgcctttttggcttattgcactgaatatgatctgtagtaccatatagtataaaattagtgagaacaaatattttttatctagttttctcatattaagaaaaaaagcactcagtcttcaatcatcatgtcatgtcagctgtaattctttgaaatatgtactttatcaggctgaagatgtttacttttcttcatagtttgctaggaattttcatcataaattggtgttgactttctaactgctttttctgcatctattaagataatcataaaatgtgtatcctttgtccctgagatttaatagattttattggttgattttttaaaaacatattgaaccaaatttgtattcctttaataagcaccccttcagtcaagacgcattttccctttgtattttattgaatttaatttcctaatatcgcattgaaaatgtttgtgttcatatgggatactgaatagtaatcatatttttttcttttattgatatgtcatactagtacatattttgatggtatgtgtggtagtacatgtaggcaatgtgtaataatcagcttttaatatcagggaacttccagcctcacagcatttgttggaaagagtttcctcttctgttttctaaaatagtttgtgtaagattggtataaattctttatttaatgtttaatggattcttcaatgaaagaacgagtctggtgtttttctcataagaagccattccttttcttttttgtacttactaagttactaaacttttttattttatctaacgtttccaatttttgggatatatttcctcatgattttattttatgttcatattgatatttgtaggttttatagaaatatgctcattttatttctgatattgtcaatttgtgttttctctctttttattactcctgtttggaataataagttatcaatattatagatcaatactattggtcttatatcaatattgatataaaattgattattgatcttttcaacaaactaacatttgccttattaattttttctatagtttatttttttgttttgctattgttatttttgtttatttctgtttgtttacttttgctaaaagtacttttcagcttctgtaggtaaatacttaaatcattaattttaaatatctttttctagtattgatactttaaaaatctatattttatatttaaactgtaccacttttggataatgtataattggatctgctttacttctatctagcctatcaatttctgtctattaattgggactgtttagtttatttacactgaatataatgattgatctcattggtttaagtggacgagcttactacttgttttccatttgaccctttggtgtcttcttctcttttgcatcttttttgctttcccttgggttattctttattttagcattctatttcacttccttattgacttcgcagctatatctctttatgtttttaattggctctctatggtaaacgatatgcagccttaacttgtcggaatctgttaccccttcactcttcacatgatctgagaagcctaaggaggtttggcccagcacagggatagcccagtcctaaaccagagtctcctaccgtgaacttaagaatccctgtccattttgctcagctctcttctctcctgggttctgtcctgcagattcaagccacttcagctgcctaaactctcgtgcctgccccatcaggtcagtggaacactccagctatgcttggattccagttctctcagatgtgatcataaaattatgctcaggtagcagtgggttttcagagtgctcaccttgtcaggttcccttctcagtcatcacagtttgtgctgcatgttgaccactgcctgaattcaactgcttcatgtattttgtcaagttacaaacttttatgtggtcaatgggctagtctggtaccagttattaagttatgaccagaagtagaagtcttattagaatgtactgttttgaaaaggaaaaataccgacatgtacagcaagagcaaacttggggttggagaaagattaccgtataattataaagatcaacaattgaaaggaatttgtgtggggaggcaccacaaaaagtaacatgatttataagcagacatgtttttgtgtctcatttttcatacgtatctgtaatgtaagatggagttaaaaatcacagtcttttgagttacacaaaaacggatttgaatcacttttgcctcatataagttagatgaatatttctctctcaaatatcaatttacccatctatgaagttgaaatatttatattacctatcacaaaccttgttttgatggtcattgaaagtaattaaagtaagttatgtaatgaatctgaatgtaatgaagttatggaatgaataaaattatgtaatgaatctcaataaatgtaagttattatctttatcatctgcagtagaattattattattactgccttatcattaaggcattcttaaatactttgttacaattagatggttaataatataaaagttagttttttacaaacttaaagtaaattcttactgaagaactaggtttatatgtgggggtgtgtgtgtgtgttaactcaaaatatgcaatacccacacactaaatatacacagtcctttgagtcaatacataaatttaggtacagcataggtccaactctactctatgttctttaacttgacatttaacttgacatatgctgagtatagctttgacccacaaacgtaacattatttagatgtattttaggataagaatgtaaatgtgagtcatcatttggttatgactttatttttagttaattcttaactaaaattttaacaagtttcagaaagacattgcagtctgagtttgacctacagatcaatccgataaagatcaaatttgagcaggactttttctttccccaatttgtctgtctctagaatggttatctatgtaatacaagagaattcttagctgcactcacccaataaaataaaaattctacattaccagcagataattaatttctgttttaagatttctgggtgaataattcattattatgttcagcaacccaaatagtgacaagttaaaactttactcagtaaggacaataaaggagatagtacccattcttgtctgtcacattggtctagttggaaatagaagagctgacatcagaggcctttatagtctcagatagtaggtattatacaaaattctgatcacttccatataagattgaaatggaaatagttggaaaacagctgttttatcttgtcagatcctttaatgggacttaaggttcacactagcagaacccaagaatatttgcaagaaattgctaagtaatgaaaatttatcctgcagttccaaccagaaatgaaagtatcatgtcagtgcaattcccatcagatggtctttagataaagaatctgggcttttaacttcatttaatgaaaaaaaccttggtaatcagtcttgtagtgtaatggaacttttatctcactgtgtaagtaaattatggatggagttatacacccaggaggtgacctacatagtatactcaaaaggcaaaattaagaatggtattcgaccttgaaccaaatttcacacctgtactgaaaaattaggggtaagcttggtaaagtgctgaatgcaaacatctcccagacaagccaaagtattttattccccaaacattcctcctggatgtggatccttactaaatctcaactttaggagttcttctcttggttgggcacagtggctcaggcctgtaatcccaacactttgggagaccaaggcaggaggatcgcttgagcccaggaattcaagatgagcctgcacaatgtgacgaaaccccatctctactaaaaaaaaaaaaaatacaaaaagttagctgagcatggtggtgcttacctgtggtcccagctacactcagtcccaggctgagttgggaggatcacctgagccataggaggcagaggctgcagtgagccaagatgaccctactactgcactccagcctgggcatcagagcaaaaccctgccaaaaaaaaaaaaaaaaaaaaaaaaagacaatttttctctctttgttttctttgttttttagagaataaatctgaaactgcttgaaatgtgttaatctgcacctttggttgagaccatgaccttcggcattagaaagacaatagttcaaacatcagcttagatattactatatttgtgactctggatgatttacatacaacttttgaacctcaattatcttatatgcaaaatgggactagaacttgcctggcagagttaatttggtaaatcagtaaaataatttaaaagaaatgatattactatgcttaacacattttaaatactcaaaagtagctataattattatggatgttatgtatttcaaatgtgtaaagttttaagcaaggtactaaacctatggcccccttttcctatagttaaagtgggggttatttaaaggaaaagaaatcattatattgaagatacctgcactggtatgtctgtcacagcattattcacaatagcaaagatatagaatcaacttaagtgtccatcaacatgattggataaagaaaatgtgatatatatctatatatataggcaatgtataatatagacatatatctcatatatatataccttcaaatatatacatctacatatgccatcaaatatatacatatatataccatcaaatatatacatatatatatatataccatcaaatatatacatatatatatatagacacacacaccatggacataaaaatgaatgaaatcatatcttctgcagcaacatggatggaactggaggccattatcttaagtaaaataacttagaaacaaagagttaaatactgcatgttcttacttgtaagtgggagctaaatactgtgtacacatggatatagagagtagaataatagacactggagactcaggaaagtgggaggaggggagggagtgaggaatgagacattacctatttgatacaatgtactctattcaggtaacggttacattaacagcccagatttcaccagtaggcaatgtactcatgtaacaaaactgtacttgcatccattaaatctataaaaataaataagtcataaagtgaggatattataactatattataaagttgttgtaaaaattaaacaagttattgcatgccacgtgagggaaacagtgcttgccattttgtaagtgttccataaatgttagcttttatttcaagtgagaatatcagatagtgtttaagaagaacaccagctggctgtggaaccttcctgccaggaatttaatactagctttctcagttacttaacctctctgtgcttcagtttcctcatctgtaaaatttgtgtttcaataatagcatttcccaaacaaactacttgggaggattaagtgggctaatacatataataaactcagaatagcacctggcacatgtaaatgcatgataaatggttttgtgcttttgtatgtgagtatatgctattttttccaaaaaacaaaatagagaaaattataaagactcatataacaagcatccatatgctcagtactaaaaagtaacaagtgctaacatgttgtatcattctaacaatataaaaatatttcaatagcctttttattctgaagtgaaatattgagagttttttcctttttttctgtaacgctgccacactgaattttaaaatgcaaagtactagatattagtaaagaccatgcgtcctcgaaatcagatttcttaagtttgaattagtaaagaccatgtgtccttgaaatcagatttcttaagtttgaattctagttccactacttagtacctatgaaatcctagctgtttcctaaacttcttttatcatgctttctcaccggtaaagtgctggtgatacgttctttgcaggtttgttacaaatgaaaataaaagtaggaaaaattctcagcacagagctttgccatgtagtaagtgctcatttcactggaaaataaattcctgaaatattttcataaagtcataggagtaaaatgggatttgaaaagccagctaatctactccctttttaatgcaatttttacatctttaaatttatgaagatctcactggtatatttaatctccttgaatagtgattttttttggactattggttttaacattttcataggatgtaaagttattttaattagttgcgatcagaattaaaagatactctatttcaatttaagctctacaagggcagggttttgcttatttcgttatgtatatatgtatacgcacacacacacacacacacacacacacacacacacacacacacaatctcaagtgccacatggtagatgctcaaatattttctgagtgttaaatgaataaatgaataagaataggattgattcaaatggttatttttaactacataaatttcaaatatttgtttgaataaatatataaatgttgtatttccttctgacctgaaccccatcatatagtctatatgatttacgcatatagactataatagctaacatttatttagcatttactacatgctaagtactatcctcagcactttgccagtattagctcatttactcctcatcccagtcctgtgaggaggccattattagcctattttaaaaatggaagctgagatacaaagaactaagtaattctctcaggactaaatagccaataaatgtgaaagcatttcacaaattcagctgcaaaccttggcagtaaagcatttgcttctggctagagtccatgtcagcccctgtttgtatttaacagacaaagaagaagatactttaacaatgaatcattcttgtgagaaaaaaaaaaaaatggtggtggtagattcagttctaaaatctcaccagatgacacaatcttctacctcgtgaaatactgcagaacttaaaaagagaaaagaaaagaagacctctttcctcctacagggtaagaggattggaaaatcacttgcacttttctctttatcacttctgttgacttggaatgcaaactttcaaaaagtaacatgtgtggtgtagtgtgatttttaactaaggttggatttcagtttcactaaagagccagaaatagatagaacagaccaactaagccctgctttgttttcctaaaaatctttccttaaatataaaactgtccctggacctgctaccatctttctatgctacaccagagttcatttcaccttactctgggccaccttttaaaatgtctattaacggtcttgttttattgacacatctctgctgtctacctcgctggttcaagaagttctcaagaatggattgttttctcaatcagttttatcctagtgcttagcacagcccagaacttcttgagcattccacaaatattagtttaaccagtgaaagaaggatgacaatggtttaagaaaaagggatactgtctatactcccaacaggcacactgtactgtgggctgacaatcagaggaaaatgtgttcttctttagctataggtttaagctcttaaatgaataacaaatcaagaccttcacccacactaaagaaggcaatttcattattattattaagatgcttaacacattgttgattgttgacacttgattgaggtattctttacttgagatggccattgaagcctctaaggttgaaaactgctaaactgtgaagggaaacacaaaagataaaggtctgcattttctttgatctagtcagggtgtctgattgcaatttactctctttaaaaattttattggattgaaccttaactgagaaaagagcgataggagagagactaatattttagacattttcatattaatttagagaagtaaggcaacaatagggctgcacccacagacctttattcagttttgaatctaaattacttggggataccaatccttcttcattgtgcagctacatgcacccacacaacatatacagaaatacatattcccccctttctctctctttattcccaattgtatgttcctttaatatgctgtacttagatttttattcatatgttgtttcttctttgccagaaaagaatgcagagcctcccaagggtaagaaatactttgtttgcgtatctgtcatatacattctcagcactttcacccacttgggtttcctgtcataagcttttctttagattgagcaactaaagctcagataaatcagaagaattgcctcaaagatgcacagatcatatgttttattgttggaccccatacgagggactatcatagggtttagtgctggaccccatacaagggactatcatagggtttgttatctgtgtgaaatgagagtacatatctgtgtgaatttgatcgggttacatgcatagaatcaagttgtgtttacctatatgcctattaaacccattccagtgtaggtttcaattgagtattgagtagtgaaatctaaagaagatgcatgtgttattttctggtggaataattttattttccctttgtagattggcaaaaaaaaatgatgagaacagcttaaattttgttttggggaaaatcttttaacaaaaagttgttgtcatgaattttgttgctttatgtatctatatatctatatctatatctatatctattacttcttcaaggtcctttagggactcaaccatttttcaataacagatttttagcagtaaagttgcatatattccctatatcatcccttccatgaaaggaagtggatcctaaacaacttgggttgtaggaatgataaatccctaatgtttatgtgactcagcaggtaggggataaaggcttaatttttgaaggtatattaaggtaagtaattagggaaccattatgtgctagaacagtatatctccaaagacaatctacttctacttagctttactgacctgcccagtaaattccacagaagctgatggcgtaatccaaatccagcctattccaagaaacacatttagatataattttagttagagtcattgttgagtttgaaagagatgaacacatttcccttcatcttgaaatgttcccttttggaaaatctaattctccccaagaaaatgattggatacctaaatcatctttgaaaagtaaaatctttccctagatcttatctcatcttttaaagctcatgtgtttgtctctgacaatgctataaatgcattttcaagagaggaatttgtcctactctttaaattacttttatgaatagtcaaagtgattttcctttagtgttcaaacttcctgcagatgattagtccacacttccagaaaccaaaatatataaagacttcttcctaaattagtcatataactttatattgggcaataagtgaatactgtgcaattttgctttgtcagtaatctgacaaatactgaaaaatactgatgtatatcaagattcaacttctgagtgcccagtggctttctaaactgatcagttaaaaagttttgtcagacgcctgtagtcccagccactctggaggctgaggcaggagaagggagtgaacccgggaggcggagcttgcaatgagctgagatggcgccactgcactccagcctgggccacagagggagactccgtctcaaaaataaaaaaattaaaaaaaatttttaaaaaagttttgtcatccaatgacaacaagtttaaaaatattttaagagaagtatgaataagtaaatactgtatcagattgattataaattatagaaaagttaaaataggtcagatttttcattcttcgttttcatagtttgagattcttagattattaaaatagaaaggaactggttttctaaaggaactggattcaaagtcacttctatcttatgaacccattgtatacatgacatctgatgaagaagaccaatatgaaaagcaggggagagtctctggttgaatcagaaagctcctggccaccacaaaacttgtaacttgctccttgtcctggtggctcaagaagtttgtgaggtatagtttgaaaactactgatctagtcaaacagtactttatagagggataaaaaaaaaattctggagatgtggcatgaactgaattatttacgatcacacatagaagtgaaggcaaaatttaaaatggaaatcagcacacctttaaaacagccttctccatggaaacatccctgagaaattttcacccttactgatcattttgtcttcccatcttctcagcaaacacatcatttattggctatgtccacagtaacaatgtaatttgtgaaatgtttcaggtcagtgaagtaatctgggagaattgaaaatgctttgagggtagaactacatagcacagctttttgagtcccatagagtgcttttggtctatataaacaaacaatggataaaaggaagataagaccaacaatacagtattatacagtattgctttggaggcaatatatagcacagaacacttttatacagaacgtgacaagtgtttcaaaggaaaggatttcatgcaaaagtaaacttgataaagtctgcactaaacaaagttaaacagtaatgattgcctcctctgagttttgaatatgctaatgtatattaagaatctgcaataatgggaatttttcgaattttccatagagccttaaaaatatgatagatattgcatgcctcaagttcatggtctgcagaatatatttagtaaaatttaagaaaggaacaagactagaagtcagaagtttgatgttttgaactcaaaccctgtgccacaaaaactttggaaagcaacttctctgatcatcagtctcttcatccataaaatagcattgcctatctgagagttaaatatcaaagaagattaatataaaaggctttgcaaaaagttaagctccactgaaacataaagcatgtttattgtgttgtaagtttacaaatataactttactgattgacttgaatagaggcacaaacagcatcccttcaacaacattttcagaataaaacaatgatatttctagacaatagtgtctcaaataaaaaaccaaagttttattcaaataacttgcaattatgatagatatttttcaattttatttagtagccaggaatttgaatgttaattactttatcgtgaacttatttcttccatgaagaagctaattgaaaaattaccaaattctgtatttttgtaaacataacaaaaagatacattgagtaaatattttaaatctactcaagttacttgaagatttttctttatgagaggttacaaaaattaaacaaattcacatttctaacaaagaacaacatattctctctacaaatatatacattgtataatgtaatactaagtctaaaaagatttgcaaggcatggtggctcacacctgtaatcccagcactttgggagggcaaggtaggaggattgcttgaggccaggagttcaagaccagcctgggaaacacaacgagaccctgtatctgccaaaaaaaaaaaaaaaattgaccagccataatggcaatggcctggggttccagctactcaggaggctgaggtgggaggattgcttgaaccccagagtttgaggctgcagtgagctatgatcacgccactgcactccagcgtggaaaaaacagtaagaccctgtctcaaaaaaaaaaaaaaaaaaaaaaaaaaaaccctaggaagataaatttaagctactggttatttttaaaataattagtcacaatatttttctaaggaaataaagctcttttgaaacaactaatattctgatttactctaatttgccttgcccatgtcatcaaaacacttttgttatagaaggactacaaaaggctctcataactaatagtcttattagaaatgttttaatgcatagaagtagtcatttaaaggaaaatgaagacttttatgccaaaagaatgttgaattgatataaatggaaaaagtagaacaaggtttccctgtatttacatttggataaaatcaaagaagaatataagttccatgagggcatgcattctatctacttagtttactactgaatctcagagcccagaaaaatatttgaaatatgcaaggtgctttacacaaatacttgttcataagatccaggattgacagtgccctggtgcctgacggtggcaaacaaatatcctttctggaaaaagataacattgtccaagttttcaaattatttctacaaaccctatttcaatatttcctacacataataaaatacatccaggcagataaataaattgcaacacaagcgacaggagacacagaagcacaggtactacagataactggaaataaaaaaataacagataaatttgcaaatttgtaatgaactctcaactcagaattatatagtcaattaaaatattgttcaataaccaggttaaataaataaaatgtaatatagcaggtctaaaaaataaccaaataaaatcctataatagataaaataatctaaaccatttaatagatgttatagtggaaaagctagatttactgaaacagtatttggttaaaacaagtaatatgctgagagatatgttagaagaaactatccagaattaagacagtcaaaaggacacaatatagaaatctgagtagaaaacaataagagaggatgagaaggtctaatagaagagtcatgaatggaaagaataagaagaattaggcaaagcaatattcaataaatgttatgatctgaatgtgtccctccaaaattcatgttacaacctaagacccaatgtggtaatattaagaggtggggtcctttggaaagtgattaagtcatggtggctctgctctcgtaaacggtattagtgccctggtcaaagggcttgaggatacagcgtctgtcccttccaccatgtgaggatgggatgctggggtaagtcaccatctatggagtagagagtgagatcttaccagataatgaatctgctggcgcttagttctcggtcttcccagtctccagaactgtgagaaataaatttctattatttataaattacctggtctagggtattttgttacagcagcatggacagactaagacaatgaggttgatccttgcccaaaagaagtagaatgcataaatccacaggatcaataggcctaacaaatatggagcagtataaatggaagttagcacctagtcatattgtagcaaaatgtcagaaaaacaaatagaaacgtaaaattataaatgcactaagaaaaaaaaaagaaaataacaggatgccttcaaaggagccccaattagaatggcaataaacttctttaaaataataataaaaaacagaaaacaggcccgacacgatggctcacacctgtaatcccatcattttgggaggccaaggtgggcaggccacttgaggtcaggagttcaagaccatcctggcctatgcagtgaagccctgtctttaccaaacatatacaacattagccaggtgtgatggcatacctttgtaattccagctactcaggaggctgagagaggagaatcacttgaaccctggaggcactggttacagtgagctgagattgtgccactgcattccagcctgggtgacaaaaaaaccaaagcaacaacaaccaaaaaaacagaaaacactggaataatatcaatgcactgcaaaaaaacagaattagataatattcaatgaaaatattattcagtaatattgtttaataattttattatttaataataataattgtttaataatcaacgtgaaataaagacatctttcaaaatcaaaaattgagagaatttaccagcaaaaccccctgagtcaggttacattttccaattattgttttttaaaagtgtgactggcactgcacctgctcagaaataggatctatgttgtctcccctggaatctgaatgggctctgtgactcctcttataaataagtatggaagaggtaatactttgagacttctacaataaggtcacaaagattattctcttctctctgtctctgtctctctttcttgctttcttgaattttgcctttggaactcatgcatgctgtgaggaactccaacccaggccacatgtgggagagcacacagagaaaataacaggaaaagaaactgaagttccccatcaatagacagcatcaattccagacaagtaagaaaacaagacttcaaagattccagtccacagccttttaactcttccaaccaaggctccaaacctgtggagtaaagattaattatccccctataccctatctacatttccaacacacataaactatgagagacaatataaacaacttagtgttgagacttgtaatgtaatcacagtacctgaaactaattttggtaccaagagtggggtcctatgtaacaaagactttaaaaagccacaatgacaatgaatgggacagatggaagttgaaagggctttgaacaggctgagagtggaagcctgatggagacgatcagtgagagattatttaaaaaaataataaaggaggaaaatttgacacttgaagaaagggaatccttgttaacatactggcaaaaagtttaccgacactacactcacagtaaagtagtaagtagaaaatgtacttagtgaaatggataatttatttaaggagatttctgggtagagtgtagaaatgcttcctggcttctttttgctgcttataataaaatgctagacaagagaaataaacaggaaggcctgttaagtagagaggatccaagacttgcattcaaaaataaaaccgtctctctttccaacatccaagattctcaaaaaagaaagtatttcagagcaaagcaatattctttataaagactgcaagtatatgaaatggtgcctatgagaattgtagagtgaaacataagttcctttatggatcttaaagacatgctatattttttagaatttcatttaaaaaataaatctcaaattcaaagttaataaaacataagggttgacttttactgttagaataatatttttccaatgcccccaaattggattgaccaataattttctattcatgcaatatagcatttagcttcttgcaatatgctggggtcttcattgaccacttaataaccaggaagccaaattaataatctacagcataaaatgaatataatttctcaaatcaagagtactgtatttcattaaatccggccattgatagatatatcttttatataaaactaaaaaaactgacaaataaactatgacacaatactcccttattttataaaatcttattactaaaatttgtatttatactcattacattcaattatttaaggttttttaggtttttttcttataaataatttccgtgtggtatgtaaaaagataaatacttttgaaatggttaaagtacttctaaaacatcttaaaattaacttctaattatcttgattccctttatatctcagagctgttgatgtcattgttttcccacaccatagtttcttttgtgccatccaagacattattggtgcagcatttctaaaagattcctccactgttgtctgtaggattttcttctaagctctgacatctcatccattctgcaaattttactgctttcctgattttaccagatgataacaatagaaggttttcaggaaatatctaaaacacatagttctcaagtgattcttaggcgatttagtattttaaatgtcaaaaggtcacaggtatccagtgatgccacaaataataatgacaaaatttatatgtgtgcaagccactacttcatggatgccttctggccaaaaataattttaagatgttctgattgtgagctatctctagattaagatgttaaattatgacaaaatatgcatgctagaatcaataaaggatgatattttgggtaaaactatatgtcacttaatagcatgtgttgtcctaggcctagagtactttatttttatttttttatttttattttattttattttattacattatattttatttttttttgagacggagtctcgccctgtcgcccaggctggagtgcagtggcgcgatctcggctccctgcgagctccgcctcccgggttcacatcattctcccgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagtctagagtactttaataagctcacttagattttttgtggatccaagagtgacatccagtaggatataaatgaattagattttccctttcccaaaggcaacctgaaagttatattagagaccctataaagtgaagaattggaccctgcctacctacagtggtttaatttaatcagaatcacaagcccaagctagttggttatttatttctgctgcctaagctctagataatataaatgaaattttatatggtgccagtgctcctctgatcaacatagctttgagtagcaatctgtttggtgtgagaaaattagtaaaattttgataaatatcagggctctgcaagttgaatctgatggtatcaagcaagtctaataataggatggggtattaccattcataggttttcaagactttcataagctcatttgtatttccacagttccaaatttcctggagaataaacacaagagttacaacttgatgacagatccctatgcattccaaatggccacaaacaagtactctattcatggaaattttgctaaccctggatatttacactggttttaaaccaagttcagtgttccaaataacaagtgctccagaattatgagagtcaaacattctgtttaaaaaatttgtttagctagtatttgggcataaaagtactttttttgctaagagatatagaatgtatttgtactgatagctcactatttatgaaatgtatcatttatatctgctatctgctatttaggcccatctatatgtatatgattatttgcaatctgcaaatagttataattaaatgtagccaagcaaaagcatgatacctgcaaatttctctccaaactgagtataattgctgctgatcaactagttatcaaatgtcttttttctgcttgctttatatcagtaattttaatatgaacgtattgatatttaaagcatcatcagagtagtatgtttctttctgttaaactttgctatgtgttttagtgtttggatagaatcagtgagtgaaattttgcaggcgtgtgtttaacatgagaggaggcaagataaagtatactgctttgaccaggtctgcaagtaatgtattaatagtatttacattcctgacctcaaaaatcagttcatgtaaatttctatcttgttcaacatattggcaaaggcaagactgccagaaagacaatttaaaatgccaatgtggtacaaagtaagagggatgtccaggagagtttggagtgagtgaggctttcaaatctgggcccgtggcggaaaatgggggaaaaaagtgcatgttctctggctttgttaccaaagtaggagggtagcattcagatgttgctctgtccaatagcagggtacagtggtaaacgctctgagcttaagatttagaggactcagagagagaggttaagaggctggcccaaggtaactaacataaaagaagcaggatttgcagtttattcttatgttttgttttgttttttactctataaaaacaaccactattataggtaatcttgtgtatcagaaatatatatatatatatatatatatataattaaatctccatagatagctcttctatggtcttgaattcacttgaatgtgcatgacatcatccataaaacttagtggtttaaactaataagcatttgtgattgctttgacatctatgtgtcagctgagtggttctgctgatctgagccaggtttggcccatcttggctgggcttcctcatgcatctgtgctcagctggcaggtgaacagggcagtgggtgtccctttatggacctcacccatgtctggcacttggctggcagtcacctggcacaacagtacacaataggccctgtgtctttcattgtccagcagagtatactgagctcgtttttatgtttatggcaagtattgagagtgagaggcaatgtgcaggcccttggaactggcatctttcacgtccatcacaatcttttagacaaagcaattcatgcaaccaatcccgattcagggggtagaaaaaacatactctcatcatgatgggaagagctataaagtcacattgcaaatggcttgaatacaaaaaggacatatttttaattattctatcaaagcttgaataagaatgctttagaaatctcagataaaatatttcaaaagaggtcacagtttagctgaaagtaagagttaaacaaatgttataaatgcaacaattaaaaaaggtgaatgttttggctcatgtggagataaaggagtagagtactaatagtgtaaataattgaagtttcatgaaagcaattttatgtagaagtacttactttaatttatatgacgtgttaatggttgaaaaagtgagatgaagaaattacacttatttagtgaactgattaattctaaaatattattgtaacatagtttatcttctgcttgcaaaatttctatatttggctactgagcctaaagtattccaatgtagattcatgtgaaaggttctacatatcagacaaacccaattaagaatgtgatagggatatagcatcacagagcagtttattacaaggttttttaaaagaaagtaattgttaatgtaactatttgttttatttttcttctaatatccaagtacataagaaaataacaaaaaagactgattgcatcaatacaaaaataaaaacagatggtcatgaacttttacttacaattattcaataaccttagaaaaatataaagatcattctcctgctttgaaagaatatgaaaggtcatctggttgatctttctgactttagatggaatattcttctcttaacacacagttctatatttagcaacaacatttttagaccagtgtacacaaaacaacaagagattagtcatttcaaaaaatgaggttaaaaaaaccttgattttatactgcaattagtatgtccctgcccccaccttgaacttattctgtacctccattctgcatctccattctttcgagtgcattgtagcctctgattatgttacccagggacaagacacttaacctcactggaatcgttttctactttgatgagcaggagacttatatactgttaaagttggatgctgtattacatgtgattacactaaaaaccagaacactgtaaatgttaagtgtggattttgcagacacattggtctttaaatcctttttctgtactttctagttaaatctcattggtcaatatttgagctttattagacttgatgtctacatatgaggcaagcagataatcacattaactcccttagttcccatgacaagtaactaagaaaatgcattaaatgagtcccttgcacatttccaatgtgtggcaagtgcttccatggtagtcataaaatgaataaaaaaatggttagacacatcagtttttcctaacttatttgatatagatgataagctaacgattattaacaaaagaagataaaagactgcggtaccaagctctgagctgaatagagcatcggtcactggattactccaatcaccttcaggttgcgtaagcttaggaccacaacagatgcacattggactcgatattattcaatcaccacaaacagaaacacccacaatctctttggaagaaaatttttgattaattcatttagtgttttatttaatattataattacttaattgttaatgactttcctgctctacctaaaaagtttccatttaaaggttttctttctcatttattaagaatattctaaaatctcttttttttcttatctctcaattttctccaaacaacaaaattgtccagtatatccatttttccatagctatctttagctattttaactctgaacacatcagttgaactgtggaataatttacatttgttcaacaataaacaaacatatagaaagctgatagatcaatgtttccctaggcttacagtgcaattatttaatctctacatggtataaagtcacccatatttatttttctcctgttcatatatttttatgtccaggacagtaatttccttacaggagagttcctaatgtttttgtttgtttgcttttatcaaagcaaaaataaaacatggagccctaaattgttttcaggagtcaacaggctttgttggggcgagtatgtatgcataccagaggaagtaatgaaatcatttactctattcactttcctcacaagaaacctgccaagaaaacgcgagtaaagacacagatcgatttttaaacctggaaaggacctaagaacttctctaggtcaatctttttattacatcattgaagaaactgaggcatagagtaagccactgtgcaaggacgcaaaactatggaaaaatctggataggaatataggcttttcttcttcctaattcagcatgctgttctctacatcatggtaagaggacggaagggagatctatagaaaactttggtccctatgtggttctgcaaccaagcatctggtgatagacctggggctgctatgggcaaaagccatccgtggaaaaaatgatagacacagagtggatgagagtgagaatacctggagcttgccaggcacctctgtagttgctcaaggactccatctgactatgacaacctacagaatgtaatggatgtaccacttcactcactctttccaaatcgcatgaaagttcatcttttgaccaaatctaacctgtcaccgtagagtgaataggattctgggaaatagagtaaagtttagctattctctcccagtaaaaccaccccagctggtaacctctgatccattctaaatgtaaaattcttcaggcatcactctgctaaatttattattttagaacagcaaagttctaaggtgaatagagtgaaatacaactttttgaaacctttttaaatttctacattgtaatattattgtgagccttgatgaacctcagtttctttcttcaatatctgtcatcaaccaaacctttaaaaaaacatgtaatactccttcctgtcaaaatgttcataaaacagctatttggatctctctttctctctctctctgtctctctctctccttgtgtgtctctctctctttctctcttgttccatctctccctctcttcatctctttccattactctctccatagctagctagctagttagctagttaggatagatagatgatagatagatagatagatagatagatagatagatagatagatagatagatagatagatagataattgagagaaagatagatggagaaatagttttaaacagcttcattacataaaagaatattaaagttctgaaactagatttttttttttttgtaaatttcaaaagaatgtagacttctctttttctttagtcaaatttttggtgctttcctggaagctaaaacagcactggtgctgaaagggtggccattgcgatcatactgtcttccccatacattttctcaagtgtgttgaaccttcccacagatgaaatgaactcttaaagggcaagcactgtttgtagtgctaccaagaggaaaggttccttctataaaacagtaccatttatcagacccactcaacactaagataaaggatagggatatggaagcaattgtcctggtcatctgaggaaataaccaatggatactttaggctaaagcatgtttggcctgaactacccaataatgacctcctagctccatgtggatatgtttgaatgtccacttaagtttatgtctctcttcactttttcctctgtttgtccaaatacaatatcaagatcatccccaggtgatttttttattatactctgcttgggtctttcagggagtacactcctaggtagaaccaagttgcctctgtccgggcaacggaagcctctgcttccaattatttctgccctgcaggcacttcttataaaggagctttctttgccaagttctagttattatttcctgaggcctttttttccctttccaagatacctcttgagagcaaacttctgatagaactgcaactttgtgacactagatagtacaagaatcattattttggctttttcactttctgactttttacacacctataattacatgctttgcagtctttccattcagataaaagcagtattctttaagacttttttttcctttcctttatttctgtggttatgattggaaagagaggcttccaggaacctccttgaaagtaccaacatatttcattcatttttaaagttctctttaatttattttttttctttcaactagttataatctgaatattattataaccataatatggtggcaaaactgtcaccctctttgcacgttcacagctgcacttaaagagacacttatgataccatggatagaatcacacgttgttcttactcgtgtgtctaaacaaagttagaaatattgctgaaaatcgtcaaagggacgtaggttctggatatgccaacattttgcatgattctgaaaatactttatagttgtgtctttcaggcgaatcaatcagaactttagtcgtaatcacaacataatcagcgaatccagtatttccctttgggtcatatagaaggaacatgtatctgatcagtataccaataaaaatcggattagttctgagattctccttatgattgagaatctacttcatctcaaaactgctttacaggtctgacctgctacagttcaggttaatagcacacatgtgtgacttaaaattacttaattgaagctacagatgtgtttaatttagattccatagtaacgtgtgtgtgcatgtgttggcatgcacacatttgtgcaatcaaaaagaccatctaattacaaaataaagtaaaaattgaggattttaattatgcataaatatattacagatagttgtacggcttcaagtcaattgaaaagaccattgggacgttaataattaaagtgtggatttagaagctttattcactgcttatgctacttaaatataattttcttttaactttaaataaagggaaaattgattctgattaaacaacaaaatggaaccattgatgttaactaatgccatctattgcaagccagatttttctagcgtaatctttttttttggaagacaatatgagatggagatcacagggaaaacttgacgaagcttgcaagataatattccaattagaaatacagaaacatcttgtttgaaaaaacattagcacacagaagccttcatattcttcaaacacacttatatacctttactcaattcagaaaaataaaactgtaagcttgagcaatatgtatagacatcacccttgtgttacatttttaaccttgcaaattctatttgcgttggaattcagttttccatttgtaaattggaatcactgagtcagttagcttacttgctatagatatccaaggataccaagctacaatatacatctgaagacttactaaaacacaagcaaccttagtgagcaggatatcagtgggatataatatagtgggttttggaaccacattcaccagcattcagagcctgtctctgttatgatttagctaagtcaccaattctgagtctcagtgcccatgtctataaaataaagataaccatatttaaggttttgtaacaattcagcgaggtcacctaggttacagactttttactgaaactggcatatagaagttaatgttatggttcatactatcatatatttcaaccttctgttaccaatgaggtaatatgtgacttatctcgaaccacgctattctagcatgtttgggaaagaaaacgggttttcttattctcttttcctgcagtgactaaaagaaaaaagtattgtaatttttgagaaacatctctgtgaaaaatatgtgatctagaagatgtctctgggtacatggatcaatgagccatgaaaaaaatgggaaaataaaattgtcaattttttgataattcaatctgtttgggtaggacctttcctgctaatagcttcccagtgggtaattctttatcggctttttgtcttatagttaaaatggcacaagtggtcccagtggctgttggcagaataatctgacattttatgttattggtttcaaattcccaccaaaaacacctccccatgaccagaagatttagtatagtccatagacagccaatttccaaatttttggctcaacgtagaagggttttgtcccattaaaaaatatcccccatctattccttgattgataggattcaactgctccacttattttgccatttgaccagacttaaatctaatagatacggatcataactaacagccagcctgccaacaaatgattcaagaatgctgtatggataatttttttctttagtaaaatcaaaatcaactaagccacctgctgaatgatattgctggaagcattataaacaccatgaccaagaaattcaactgcaacctcttctatgacaatcactaacaatgttcctcatagcttgaagctgaactgaacagaagcagaatgtataaaacaggcatgttttagtcattgatacctagatgggaggatctcactttcttgttctataaatacagcaatgctacttggctgtaggtaaataataaagtaaacaaaattatgttcttcatacccagagccttgagttcaagtgctggctatgctcctcattagccagttgtgggatcttaagtatgggaccacagtatgttgggattgcaaaatgagaaaagtcagaataaattacttttaagtttcttttattctaagttttaaagattgtccttttctacccccagtgcaggaacacagaagtctcaaatttccacttacaacattataataaacttacttattcctttattttctttgtttaatttggttattcaaaaaacttgcattggatatctgttatatgtcaggcacagggcaaaattctgaggatgaaacaacagtccacattattaggaaacaaatcatagcaatgagtcaagctgtgatcctctgtgatatttcttgcttcattcaggtcactgctttcacttatctaaagtggcaattatttggctacgcaattcatgctattgcaggttgcaggttgcccttggttccttatgaaatacaattcttgacagtagttatggcgaggagttggttctttttattatttcaaaaacatttacctttttttttttttttttgagacagagtctctcttttacccaggccggagtgcagtggcgtgatctcagctactgcaacctcaacctccccagttcaagccattctcttacctcagcctcacgagtagctgagactacaggcaaaacccaccacgcctggctaatttttgtgatttttgtagagacaggatttcgccatttggccaggcttgtctggagctcctgacatcaagtaatccacctgcctttgcctcccaaagtgctgagattacaggtgtgaaccactgcgcctgtccaggttttacttttattaaagaagcacaaactgaatcaaaaaagtaaagtttaaggtgaaattaaattaattctctgatgtttcaattatattataggctgataaaaatttcagaatgtggccaggtgcggtgacttacacctgtaatcccagcactttgggagtccaaggtgggcagatcacgaggtcaggagtttgagaccagcctgaccaacatggagaagccccatctctactaaaaatacaaaaattagccaggtatggtggtgcacacctgtaatcccagctactcaagaggatgagggagaatcgcttgaacccaggaggtggaggttgcggtgaaccgagatcgcaccactgcactccagcctggacgacagagggagactccgtctcaaataaataaataaaaaaaaaaataaataaaaataaaattcagaatgttaggtaaaaatgattttgatttaaaaaaggaaatatgttaacaattagttaataaattgtagtttatttggtagaagatatattaagacatgggatccaaaatgtaattagactatgattgaataaggtaatatttaacctccctttaaacttaaaatgacaagattcttcataactttgagttgcttctttaggtttcagagtttaaaattcaaacttccacttttggacccatatgggatctcaagtttgatacatgatacccagagccgattttctttcttctctttctttcttttcttttttctttctttctccttccttccttccttccttccttccttccttccttccttccttccttcctccctccctccctgcctccctccctctctctctttctttctctttctttctttctttcaaataggctggatggacaagagttatgaaaattctggattttttaaaatagtttgtttttgaaataaaaatgtcaaaagacaaaaaatatacagtcaagacctataggtattgtattattgtttgtttgttttttagtattcagttggaaggcaggaattcctgaagatatactaaacttccttctgaaatattcggaagaaaataaaaagatataactgtagaaaacataaactcaaacatgacattatctgaattctgcactattatattaattgcaaaatgttccctatactccatcatttctgtgcattgtcctcaatttatatacaaggaaactgagacttaaggaccagaaataatccaaaagaaatgaacgtcagtgtggcttagtgaagactcatattttttaaccttgagaagaatagaagctagaacaggaagaactcaaagaacagttgtggtcatcacaatcaaactcattgttcccagaaatatatttgacaaaacttgagagtagtatttattctggttttattatatcaaattgcttttttctcaaagactttataacatgatgtgtattggaattacaagtaagaatagttctgaatatatatttgtttattcacccatttttgcattcaacacctatttcttgaatacattcctgtctcaagaatctaaaaatttaagatacagagggaaaccagataacatagttgtttccctcaaagagtttacagggtggtggagaagacaaatgttagacatataagcccagtgaagtgtgatacacactataatcacataatatgtaagcatattacataatagaattaagtgattgtagaaagttcctaaaagaagtggtatttaagctaagttctgaaggacaaatatgcattaattagaaaccaaaaggtaatgattgagtgtgattgatgacattgaactcaatgaaatattaatgtgttcaagtgccaacagctacatttgctacagtataaagatatgattaacacttgacctactttatttactgaactcttgaacttcttaaagtcaatccaaagtggtcctttaacataattgttttcaaaccttacagggaattgttgccatttccagatgtcagtgattttcagaaagtgcttcatgttgaaatgaaaatctactcaattacatactaaatcacatttcacgagaaaacacattacataactaaatgaaaataattatgtacccttcaatgagactatgaattttcttaacaatattaagtttttaaaaaacattttgatgatacaaaaattacattcttaaatataagtaagtaaaggtagtcagaataccatggaaaatagtcttctctatttaaaattcttgtaatatgaattgaacacattagattttataatggactctagtaattaaaaaattgatctaactataaacatatcgatttcctaataaaaatataaacctaaagccccattatatcatataaatatgaaataacttctagtaatatggtagactgagttggtgtagaatgacttctcccctgacccacaactacccaataacagtagatagaaattctggataacatgtaacacaagcagattaatagtgtcatcatccatctgcaaagaggagggaatggagaaggtagggggaaagaaaccttcaagatgtcagctacaaaaatattttttccaagtggcaaaatgttaccaatgttctagcttctcacatagttgggggtaaggttgagggtggacgtggtggggaggaaaccattaaaaatgagcttatagctaaaatcacaaccaaagttgtgatctactctgaggcataattaacaggatcaagaagtaggagaatcaacatatagaaaaatacaaacatgatacttttttatatgtgtcagaagttactaaaaatcaagaaagttttatgactagtaattatttatttttaattttatttttattatactttaagttcagggatacatgtgcagaatgtgcaggtttgttacataggaatacatgtgccacggtggttggctgcacccaccaacccgtcatctaggttttaagcctcgcatgcattaggcgtttgtcccagtgctgttccaccccgtgccccacatctcccaacaggcccctttgtgtgatgttccccttcctgtgtccatgtgttctcattgttcaactcccacttacgtgtcagaacatgcggtgtttagttttctgttcctgtgttagttggctgagaatgatggtttccagcttcatccatgtccctgcaaaggacatgaactcattcttttttatggctgcaaagtattccatggtgtttatgtcccacattttctttatccgttctgtcattgatgggcatttggtttggttccaggtctttgctattgtaaatagtgttgcagtaaacatacatgtgcatgtgtctttatagtagaacgattaataatcctttgggtatacacccagtaatgggattgctgggtcaaacggtatttctggttctaggtccttgaggaatcatcacactgtcttccacaatggttgaactaatttacactcccaccaagagtgtaaaaacgttcctatttctccacatcctctccagcatgtgtttcctgactttttaatgaccaccgttctaacaggtgtgagatggtatctcattgtggttttgatttgcatttctctaatgaccagtgatgacgaactttttttcatatgtttgttggccgcataaatgtcttcttttgagaagtgtctgttcaaatccttggcccactttttgatggggttgtttgtttctttcttgtaaatgtgtttgagttccttgtagattctggatattagccctttgtcagatggatagattgcaaaatatttctcccattctgtaggttgcctgttcactctgatgacagcttcttttgctgtgcagaagctttttagtttgattagatcccatttgtcaatcttggcttttgttgccattgcttttggtgttttagttatgaagtctttgtccatgcctatgtcctgaatgatatcacctaggttttcttctagggttttcatggttttaggtcttacatttaagccttcaatccatcttgagttaatttttgtataagaggtaaggaagaggtccggtttcagttttctgtatatggctagccagattttacaacaccattgattaaatagggaatcctttccccattgcttgtttttgtcaggtttgtcaaagatcagatggttgtagatgtgtggtgttatttctgaggcctctgttctgttccattggtctatatatctgttttggtaccagtgccttgctgttttggttactgtagccttgtaggatagtttgaagtcaggtaacatgatgcctccagctttgttctttttgcttaggattgtcttggctatgtgggctcttttttgattccatgtgaaatttaaagtagtttttttttattctgtgaagaaagttaatagtagcttgatggggatagcattgaatctatacattactttgggcagtatggacattttcacaatagcaattctttctatccatgagcataagatgtttttccatttgtttgtatcctctcttatttccttgagcagtggtttatagttctccttgaagagatccttcacatctcttctaagttgtattcctaggtatttgtagcaattatgaatgggagttaattcatgatttggtctctgtttgtgtattattggtgtataggaatgcttgtgatgtttgcacattgattttgtctcctgagactttgctgaagttgcttatcagcttcaggagttttgggattgaggtgatgggtttttctaaatatatagtcatgtcatctgcaaacagagacaatttgacttcctctcttccaatttgaatgccctttatttctttctcttgcctggttgccctggcaagcacttccaatgctatgttgaataggagtggtgagagagggcattcttttcttgtgctggttttcaaagggaatgcttccagcttttgcccaatcagtatgaaattggctctttgtcataagtagctcttattattttgatataagttccatcaatacctagtttattgagtttttagttgttgagtttgatcaaaggccttttctgcatgtattgagataatcatgtagtttttattattggttctgtctatgtgatgggatatgtttattaatttgcatatgttgaaccaccctgcatcccagggatgaaggcagcttgatcgtggtggataagctttttgatgtgctgctggattctgtttgccagtattttattaagaattttcgcatggatattcatcagggatattggcctgaaattcttttttttgttacacctctgtcaggttctggtatcagcatgatgctggcctcataaaatgaggtagggaggaatccctttctttctactgttatagtttcagaaggaatggtaccagcacctccttgtacctgtggtaaaattcggctgtgaatccatctggtcctgggcttttttttggttggtaggttattaattactgcctcaatttcagaacttgttattggtatattcagggattcagcttcttccttgtttagtcttgagagggcgtatgtgtccaggaatttatccatttcttctagattttctagtttatttgcatagaggtgtttctattattctgtgatggtagtttgtatttctgtaggatcagtggtgatatcccctttatcatttttttattgtctatttgattcttctcttttttcttctttattagtctggctagcagtctattttgttaatcttttcaaaaaaccagctcctggattcatttattttttgaaggattttttgtgtctctatctccttcagctctgctctgatcttagttatttcttgtctactgctagcttttgaatttgtttgctcttgcttctctagttcttttaattgtgatgttagggtgtcgattttagatccttcccactttctgatgtgggcatttagtactctaaatttccctctaaacactgctttaactgtgccccagagattctggtaccttgtgtcttagttctcatcgatttcaaagaacttatttattctaaattaattttgttgtttacccggtagtcattcaggagcaggttgttcagttttcatgtagttgtgaggttttgagcgagtagatgcagtttcttcatagtgtcattggtctttatattttggtatgtctttgcagtggctgacaccagtttttcctttccatatttagtgctcccttcaggagctcttggaaggcaggcctggtggtgacaaaatcccgcagcatctgcttgtctgtaaaagattttatttctccttcacttaaaagcttagtttggctggatatgaaattcttggttgaaaattattttctttaagaatgttgaatattggcctcctctctcttgtggcttgtggggtttctgcagagatttgctgttagtctgatgggcttctttttataggtaacctgacctttttctctggctctccttaacattttttccttcatttcaaccttggtgaatctgacaattatgtgtcttgctgttgctcttctcaaggagtatcttagtggtgttctctgtatttcctgaatttgaatgttggcctatcttgctaggttggggaagttctcctcaataatatcctgaagtgtgttttccaacttggttccattctctccgtcactttcaggtgcaccagtgaatcgtaggtttggtcttttcacatagtcccacatttcttgaaggttttgttcattccttttcattcttttttctctaatcttgtcttcacgctttatttcattaagttggtcttcaatttctgatatcctttcttctgcttgatcagtttggctattgatcgtatgtatgcctcatgaaattcttgtgctgtgattttcagctccatcaggttatttgtatttttctctgaactggtttttctagttagcagttcctgtaatcttttttcaaggttcttagcttccttgcattgggttagaacatgctactttggaggagtttgttattacccaccttttgaagcctacttctgtcaattcgtccaactcattctccatccagttttgtgcccttgctggcgaggagttgtgatcctttggaggaaaaaaagacactctggcttttggaactttctgcatatttgtgctggtttttcctcattttcatggatttatctagctttgttctttgatgatgatgacctttgggtggggtttttgcatggatgtcctttttgttgatgttgatgttattgctttatgtatgttagttttccttccaacaggcccctcttctgcaggtcagctggagtttgctggaggtccaccccagaccctatttgcctgggtatcagcagcggaggctgcaaaatagcaaagattactgcctgcttcttctggaagcttcaccccagaggggcaccagcctgttggcagccagagctctcctgtatgatgtttctgttgaccccttctgggagttttctcccagtcaggaggcatgggggtcagggacccatttgaggagccagtctgtcccttagcagagctcgagtgctctgctgggagatttgctgctctcttcagagctggcaggcaggaatgcttaagtctgctaaagctgtgcccatagccgccccttcctccaggtgctctgtcccaggaagatgggggttttatctataagcccctgactggggatactgcctttctttcagagatgccctgctcagagaggaggaatctagggaggctgtcaagttccagtggctttgcagcactgtgctgggttccacccagtctgaacttcctggttgctttgtttacactgtgagggaaaaactgcctactcaagcctcagtaatggcagatacccctctccccaccaagcttgagcatcccaggtggacttcagactgctgtgctggcagcgagaatatcaagccagtggatcttagcttgtggggctccatgagtgtgggaccccctgcctgaccaagaccgcttggctccctagcttcagccccctttccaggggagtgaacggttggttttgtctcgctggggttccaggagccactcgggtatgaaaaaaacttttgcagctagcttagtgttgcacaaacagtgcccagttttgtgcttgaaacccaggactctggtagtgtaggcaccctagggaatcttctggtctgtgggttgcaaaaaccgtgggaaaagcatagtatctgggccagattgcaccattccttatggcacaatccctcacagcttcccttggataggagagggagttccttggccccttgcactttctggatgaggtgacacccccaccctgcttttactcaccatccatgggctacacccactgtctaaccagtcccagtgagatgaaccaggtacctcagttggaaatgcagtaatcacctgccttctgcattggtctcactgggagctgcagactgaagttgttcctatttgaccatcttgccagattctcccccatgactagcaattgtagtatcataaaatattagcttgaaatgagcaagttaatacacttggtatgctgcccttactttaagaaaatgataaagaagtaaattgacaaggtgattttgtttttcagttttgatcttacccagtgccacctctcaaaatatgtatacatgtacttattttattgttttgattgattgtgaagaatcagtttttaaccaaaataatatgattttattaaatgacactttctcacaaaagccatttgaagcaatgcagaatgggatttttctctgaacatgtcaagttctgggagaacatttttagtgtaataggagaaaactatattttatctattcaattctgtcatgcaaattggaaaagaacttctgaaggaattacataggacttcaaaatataatactttcagcaagttaattgcatgaattaataacaacattttcagacaatcaaatcagcccactccactatgatataagcacgaaaagcatggctccagttttgtcatttgtgtgaccaacatataacactgattaaagcttgtcttggacaaatgaatttcagttattcaaatgaacagatataacagcaatgtatattaatttgaaaatgtaatttcacaagaaaatataacgaatatttttcaaaaaactacaagtgagagcttttctatgagaaacccagttagctttattattagatagtagctgttggtaatcacactgtttacacagctgaggaaggccatggattcagtgctttgctattaataacattaatagttgcactaagccctcgtcaaatgtcagacctttctcaggcttccctgtgatgcaaaagtgaagatgtgataataaaaatgttaatgctggtgatcattgtgaataagtccatatatcttcagaatgatgattttgcgcatatatgctttggtttgaatttcctctgaagcagatcctgagacaagaagttaagagcaaataatttctctgacaggtgcaaatgacattggtaaaattataggaaagtgttacagggaagagaagcagcaaaaagtgtgataacaagccaggaaccgtatgaatatctgtagctctgttctacaggaagactcttaaccatgatgaaaagcacagacctcagaattacttcacaagcaggccaaggaagccagataattatacatacatttcctagaaccattgattgagaccttctctcagaggttattaataccctggcacttccatcctacaataaaacatggataaacagctttctatggctctgtaaaatgccttaggctcaaatatgtatttactggcaattggaacttggtggaaacacaccaaaatagtgagttctgaggaacatgggtggggcactgagaacatctgctgcaactgacaaatgatttagctaattaaacaatgcattttaatgagttatctatgattaattccaaataaaagtagcatcgtatgaaatcagctcacaattgtttacacattcttttgctgattagcaacatcttaatgatatagtgttgaaaagaatgcttttatatatattgaaattctgcatattagaattgataatagtaagccatcctgcactttttaatttatatacgactactcttgggctccaaggaaccaaaactccaactgaaggagcttaaaccataagaagattaactattttgtataagaagtcctaacacgtgatggataccgaaatggttggctcagcaactataacaatatgagctaagattcatgagattcattgcctctttagcaggtggactttggcccttaggacagacatacccatgattacaaggtaggttttggagacccaaaacttacgactgaagcaatgcacaatagaagaaaggtttatttctatctaggtatctctttaggaatgaagaagttttgttcaacatcaccaagcacaacatttgtttatattcattttacataatttacttttaatactgatataactaatatatgacacaatttgccattttgaagtgtacaattaaaaaattgttggtatattcacaagattgtgcaaccacctaattccagaacattttcatcatcccacaaaaaaacacaatacccattagcatttacttctaatctactcacccgtcctctgtaactactatctacattatgagtctatgggtttgtttattttgggaatttcatagaaatgaagtcatataatacgtggccttttgtttctgtcttctgtcacttagcgtaatgttttcaaggttcattcatgttgtagcatgcatcggtgtttcattcctttttacgacaaagtaatattttattgtagtagtaatagcagtagggagaagatgagaaggatgaattataatagtaatagtagtaagtagtagcaacagcagtagtaatagcattcaagaccacagttagtttattcattcatctgtttatgaacatttgggttgtttccatatttatctattataaattatgctactgaacatttttgtaaagtttgtatgtgaacatacgtttttagttctcttgcatatgcatatgcagaattcaaattctttattatatggtaactctgtgcttaagttttgaggaactgccaagctgttttccactgtggctgcaccatggtacattctcaccagcaataaatgagaattattccattttctccatatccttggcagaatttgttattgtctgtttttctttgaatatagctattccatatggatatgaaatggtgtgacattgtggttttgatttgcatttccctaattactagtgatgttgagcaacttttcctatatttattgaacatgtacatatgaattttagtgaaatttctattaattgcttccccatattttaattgggttatctttttattgttgatttgcaagtgctctttatatattctagatacaaaacatttatcagatatatgatttgcaattattttctcccattcaagcattctattttaactttcctaacagtattatttgaaacacaaaagctttagatattggtaaaatcctattaatgtacatttttcttttgttgttcatgctataggtgtcaaatctaagaaaccactgccaaactcagggtcatgaagatttaaccctgtggttttttttttccctaagagttcaatacctccaatgcctccattgtggtccattttgtgttcatttttgtgtatggtacaaggtaggggtttaatatcactcttggatgtaaatatccagtattccagcacaattctttgcaaggctatttttttccacaatgaatgttctagccagggatgtccatttggtttctgtgggccactttggaagaagtattgtcttggaccacacataaaatacactaatgcgagtccaggcgcggtggctcacgcctgttatcccagcactttgggaggccgaggcgggcggatcacgagctcaggagatcgagaccatcctggctaacacggtgaagccccgtctctactaaaaatacaaaaaattagccgggcgtggtggcggcgcctgtagtcccagctactcgggaggctgaggcgggagaatggcgggaacccggggggcggagcttgcggtgagcagagatggcgccaccgccctccagcctgggcgacagagccagactccgtctcaaaaaaatcaatcaataaataacaaatacactaatgctaacaatagctgatgagctagagaaaaaaaaatgcaaaaaacccacctcaccatgttttaagaaattatacgaatttgtgttgtgcgtattcaaagccgccctgggccacatgaagccagtgggccgtgggttggaccagcttggtctagacacccaagttgaaaatctattggccaaagaggtgtaagtttatttttggactctcgattctattccattgatccgtatgtctaccattttgccagtgctgaactttcttgactattacaggtttgtagtccattttacattcagaaggtgtaagccctccatttttttttctttcaaaattgttttggctatttggggaacttgcattatcttatgaattttacagccatcttgataatttctgcaaaaaaaaaaaaggcaggtaaaattttaacaggtattgttttgaatctgcagatctatttggatctattggagagtattgccttcttaacacgttaaatcttccattagataactacaagaggcttttccacttatttaagacttccttaactttggtcaacaatgttttgtactttcattgtaagacttggacttcttttgctaagttgatttctaactttttttatgctaccgtaaatataattattttaaatttcattttcagattgttcattgctatgatttaatgcaacagaattatgcatagtgatcttgtatccataaccttgctgaactctcatttattaactctaatagtttctttttggaggattgctttatcttaccatctgcaaatataagtaattttaacgttttctttccaatttggttgcctttcctctattttccttgcctaatagtcctgtctagaacctccagcacaatgatgtatagaagcagtgagagtggacttctttgtgttatttttgctttggggggttaattatctggttttttttacagtttaggatgatataagattgtggttttctataaataacttatcagattgaggaaatcaccttccattataagtttgttgagtgtttttaccatggaattattttttttttctgcaatcatctgctcatttggcttactggctaatctattacctcagcatagtgtattacattgattggtttttgtatgttgaatgaaccttgcattccaggataaattttgctctgtcattgtgcaaaatcatttacatatgctgctgctggattcagttgctgttattctgctgaggatttttgtgtccatatttgtaagagatattggaccgtagtgctcttgtaatgtttttgtctggtttaggtgtcagagtaattacggcctcagaaaatgagttataaattgtttctcctcttctaaactttcaaaagggtagtgaaggactggtcttaattctataaaagattgatagaattatccagtgaatatcccttagtcttgagctattctttgagaaaagtttcgattactaaaccaatttcttacttgtaggtttataaatattttctatttttctgcagtcggttttattagtttatgtctttccaggaatttctttttaatatcacttgttggcatacaagtttttatagtatttccttataatcactttttatataaggtcattattaatgttccctctttgattctgattttagtaatttgaattttctctctgttttcatggtctgtcatggtaaagtttatcagatttgctaatcttttcaaaaaatcaacttttgattttgttgattatctctattattttttctactgttcattttattcacctctggccttatctttattatttccttctatccaccagctttgggtttggttttctcttctttttctagttcctcaaggggtaaagttaagttatcgttttgtaatctttattctttatttttgaaggtgtttacaccttgtactctctgcctgccttgcttctcctacattacagcatgttatgttttcattttcattaatatccaagtattttctaattttccttatgattttttctttgacttattagttgtttaagaatgtgttgtttaatttacatgtagttttaaaacttccaactttccatctgttactgatttctatctttattgtagttggaaaagatactttgtaagctatcagtttttaaaaatttattgaggcttgtttgtgacctaacaaatctgttctggaaaatgttctacatgcacttcaaaagaatgtgtatcctgaagtttttaggtgaagtgtggtctatatgtctgtaaagtgtggttggtttatagtgtcattcaaatctatttttatattgaacttccatttagatatcctatgcattattaaacattgattattacgtcttcaattactactatagaactatttctacctttcattctgacaatgtttgcttcatagattttgatgcacttttgcttgatgcacatatttgtttttttttaattttattattattatactttaagttttagggtacatgcacacaatgtgcaggtttgttacatatgtatacatgtgccatgttggtgtgctgcacccattaactcgtcatttagcattaggtatttctcccaatgctatccctcccccctcccccgaccccacaacagtgcccggagtgtgatgttccccctcctgtgtccatgtgttctcatttttcaattcccatctatgagtggcacatatttgttaatatttttatttcttcttggtgatttgacccttttattaacagataatatccttccttgtcttttgtaacaattttgacttagagtctattttgtctgatattagcatagccacaatagctcttttttagtatatatatgcacacacacacacacacacatacatataaaatctttttctgtacttttacatacaacctagttatcactttggatctaaagcgagtctgttgtagacaaaatatatttggattttttcccattctgcaaatcattatctttagattgaggttttggtctatttacatttaaaaatgttactgatagagaggaagttatttttgatgttttgttatttgtttctttatgtcttaaataattttgtttttgttcttatcagtcttcatttcttttattattgcattctttgtgcttagtttatttttatatcctcctaatttccttttatgtatattattgtattggtcagggttctctagaagtacaaaactaagagtacatatattaggtatatatatgtgtatatatactatatataattatatatgtatctaatataatatatattttatatagagtgtatatatataattatatataatgtcctttcatctcaacatgaagattctcttttagcattggttatagggtaaattttgtggtaatgtacttcttcatgttattaaggtgaaatgtcacaatctctcccatatatatatatatatatttcccatatatatatatatatatatttcccatatatatatatatatatttcccatatatatatatatttcccatatatatatatatatttcccatatatatatatatatttcccatatatatatatatatatatatgagtttatatatgtatatgagtttattaagtattaactcacatgatcacaaggtcccacaataggctatctgcaagctgaagagcaaggagagccagccagcccaagtcccaaaactgaagaacttggagtctgatgttcaggggcaggaagcatccagcacagtctaaagatgtaggctgggaggctaggtcagtctagtcttttctgcctgctttatattctagccatgctggcagctgatgagatggtgaccacccagattaagggtaggtctgactttctcaacccactgactcaaatgttaatctcctttggcagcaccctcacagacacacccaggataaatactttgcacccttcaatccaatcaagttgacagtattaaccatcacaattattaacatatttttgtgtttatcattgagagtatacttaacattctaaatttataacaatctagtttaagttgatactaatataactttaatagcataaaaactatgcttttatagtttcattctctcttctttatgttgttgttgccatgttgtcacaaattacttatttatacattgtgtacccgaaaatacagctgtatatttttaaaagtttattttattttatagcttgtaagataagctttattagcagttgcaaactgataataccataatactgactttttaaattgcctatgtatttagtacaatcagagatctttaattatttatatggcttttagttagtctaatatcttttcatttcaacgtgaagattcccttttagcattggttttaaggtaaattttgtggtaattactttttcatgttattaaggtgagatatcacaatctctctcttatctttgaaggatgattttgtgggtatagaatttttggttgacagttgttgtttcctagcacttttaatgtaacatcccactgttttcttgcttatatggattctgataaataattagctgttaatcttattgaagaatccttgtatgcaatgaatgtatttttcttagtgcttttaatattttctctttttctttggatttcaaaatttcataatatgtcttcatatgagtctctgagtttatcctatatggaggtattgaggattttggatttatagaatcatgtctttcattaaatttaggaagttgttagctatttcttcaaatatagtttctgaccctttctttctatattccaccttccacctccacccacacctgggaaattctataataaatatattgattcacttgatggttttcacgggcccctccattctctgactctttcctttgtctgcctgaatctatggttgaatgcctctagtaaatttctcattttacttattgcacttttcagctccaaaatttctgctttgtttctttttataatttctcttcattgatattctcattttgttatacacaatttttctgatgtcctttaattctttatctatattttctaatattgtctatgttttcctttccttggccttgtgatttttctgttaaaacttggacattggaatattatgatgtggtggtcctggaaataaaatctccccctttatcaggggtttgcatttttcaatattattaaggctgttatcctccatttatttagtgacttctcgaaactttatgcaaagacggtttcttgttgagtgtgatccctacagtctgtggtttcttgtttgtatttacttagtgttttaaaagagattcatttaaattccagaagccaagaacaaatatacagaagaataaaaaaaaaaccctcctccagtctttgcatcttgggtctatgtaggacactttctcaatatttagccaggcttgcactgaagttttagcttaagatgaaaacttatgaccttctcagatttttctctgagcatgcatcttatcctaaacaaggtttctaatatagattttttaaattcccttcacacacaagtctttttggatgtcctaattttttgaagatactctcccagcttttgatcctgggtcttacacagtctattatatgttttgactgtaatcatttggcccagaaatcttggttggttagtttgctttgcagtgtttttgagcaatgcccgtcacttttccagcctatgtttagaggtaggtaaaacaaataatagtgtccttaatcaacctccccgctatcattcaggcaggttagaatagaaatacacaataatctgtacataaggtctttgctctttccagagcaagagatcaggattccaaactgggaacccaaggtttcctcttcgatttgtgctgtgccagagagtggtggcaaaaatacaagtaaaaatgtcataaagctttcctatcattttggagttacatttcttgattcattgtttgcctaactgctgtaaacctttgactctctcccagagttttgacaaacttggttctgacactttctgcttggtttccaatgttttagctggggtacagtagcttgaagccatcattttgctgatgccactgctttggctatgagtgcattgtcttggttcagagaaatcagaatgtatgtctcagagcttggaataaggccatccactccaaaaggacaatgttttaaagagaaatgtagctggaactccctgtgtcaccattacttagttttatgttcaggaaactttgtctagaaaaaaaaaaattagaccacctaggttaagatgtctcaattgtattttccaaaaaactttccctaagaaagctaaaactacatataaatactttttttttttcttcagggaattcttgaatataagggtatcttagataactatttgctcaccttaacaacctgcatgcttatcaaacaataaattacttatcaaggattacttaaagacctttgccttactatgtccatcaagcttaagttgttatcttaaatgttgtcctacctcaataatttattttccctgaaagaccttccttaacacgtgtaaattcagaccccaagttctgtaaatacccagcttattgcttctccttctgaaaaactggcaaaactctgtcaggctggtgtctcctttattgcatgttttttaaaaaatgttaattttgatttatgaacagattggtgatattttgaagaattctatattaagtgagcaacagtgtacattacaatgtctaatagttacagtagaagttattgaaacttcgaaacattaaaaagtgtgtttgagttctgtacctgcctgtagattttaacatctgcttaacttggagtattataataatctaatcctgaggacttcataatttctaatgtaatattacagtttacatatattgatggttttaaaataatttacaaaagttatgtttttttgataataattctgttccacaaaaaaatcgtgcgtatcatttttcccaacctttgaaaaccttgttgctagattatattatgaaaaactagcaaataagtaattgcgaccacttagcaagtgttaccatctgagttgccacaagtatcaagtaaacttcttcgagagtataatatagattgtaaagcagcacgtttgtatccacagatagaattatctgcccaccaaagatagtgaagtgattagtgtcacctcttgcatcgtgaatagttggatggatagagttggttgagattgctgaggtgcttattattaacggcttaactcttaagtattttctctctttaaaatttcccattaaactaccgcacccactggttaatttcagtattagttagctttaagtttcaagttaatagaggaaaaaattttatgcgctttctcctcctatactggaagaggaacatgaaaccgaaacgcaaattctgggtttaatgaatctaagataaatcagtatcttcaaatggcaatataaaaagatggagagctgaagacataataatagactaagcagaaaaccaacaattgtgaaattttcttccttggtgaagaaaatattaacaaagtatacactgacttactccgggaaggttaacgttttgaggcacaggttgataaaaatactgtaatttaagttggtgttggatatgatgaaaacagacactgtttaaaagtctgattatagaacaagaagaactcaagactgcaagttccattattcatgggcaggtggataaatcttccacatttcaagagatagaagatttaatctttgaaataattcaattagctactcccaacttcaggatccaaagaagtcagacactgctttctgaattatgagacttgagttctcattttcttcctaacttttagaaaaatgacagagagacttttccttcaaggaagaatataggtgtatccttctctggctaaacaggacaactccaggtaagagacacatagataattgacatttgggagcaacaaataaagttcaaacaaattgccaaagctggccagaatttgaggaaacactccaaggtgggaaatgaccaaataaacacactttttaaaaaagaaaagctttacaaaaaatctcaggatgaacaaggctttacaaagagtagaacacttcaaaactgtataatctgtaccccttgggaaaacccaaaataagagcagaggaagctatacaaaagctataaaaattgcaattagagatcaagataagaattttagaaactcgacaaatgagtagataaaattagaaacatctgtgaaattttgcaggatataaatcaggaattcttttgaaaattagggggataaaaatcaagaaaatagtagagaacatataagaaaattgagtgagttaggcagaacaatatccctctaggagatgtctcagaaagagacaacagaggaaatactggggaagaaattaagaaggaaataatacaagagaaaacaatctcagaactataagaaataagtctccacattagaagggctcaccaagtgtccaagaaaatgaatgtaaaaggattcactctgaggcatgtagtcatacattttcttcaaaatactgcttataaaacacatatcctgaaatcctccagatactgataataaaaaagtttcatacaaagaataggaaatcagcatgacatgaggctctttatctgccacaccaaatgaaagttagaagacaatggataaaatgccttcagaattcagacagaaatgattttcctctttaaaatgtatttactcaaataatatgactgaatctggatttcagtatgaaggtagagtaacaatgttttcagatattcactgtctcaaacattttccttccatgcaccctttaaataaaaattgaatataggatacaccccaaaaataatgagaaaagaaagaaaggggaaggataggattcaaagaacagaggatctgttgcaagaaagagatcaagagaattcccaagatgaggtcaaaggaaatattgtgaaaagagcctgacaacaggtttaaataaaagcaactggtatattttggagcagtatgaaagtaaccccagaaaggatatctacagaggaaaaaataaaattgacagattttctgacaggtctgtctatatgaacattttattgggaggacttttcggattttttggatagtataaaaatttggcaaaagatccaaagactattaaacaataaaaatgaataatgtttaactataaggaaaccaacaggggaagtgaaaaatatgaaagtataattgtagtaaactatgactcaatagtgaacaatatctattatgatgtcataataattaaaacactgattatggcattaagcaaagattgtgatataactacattttgaaatataaaggtcgggaaagtagacagtaagaaagcttaaatcctcacttgccaaagtagaaaatttaatgaataatgtcaatgtacatctatccaccaacataagcatgttatttggaactatagaagcaagatccaaaagtttctccttccatgattggcgtgatgggagcaggaaccctggtgtttattctatgcacttagcactattgaatgctcaaaatgttttccttgttttcctttgataaaatattaattaattaaaaattgtttggcaccagtacatgtgcttggccattgtgagaagtgctaagaaaaaactttgttctgaattaagaaattgggttaaaagcaagatgcccaaagagtttggctttaaatcttgagttctattccacatatctgtatctgcttgaacatttatttactctctttacttcatatgcaaatatcagataattttactacttaccttgtggacttgttgattcttctcacttctttgttaaggtagcaagataatgatgtaaaatgctgggcacaggaatagcaactgtttaatgaatgaatgactgatgatgatgaagactatagggaaaatggtgatgagacaatcataaatccaacaaaacattcattatttcccaagcatcctcaaaaattcccaaactatacagtaacctactttattctctattcttttataaaactgtatctgatagtatcatctttattgtcatcaaaatggctgataaagtgagaagcattttcataaagacatacaaatttggattatcctaatagtaattaataccaaagttatttggatgtgtattttttcatcatttttcttaattttgacaccattttttgttgacatttttaatccaagtcaatatttttcattcactttgactattcaacgtttttaatatgcatctctatttaaacttgaagaagtctccacacatgtaagatatacacaagtgggaaggtggggaaaagaaagatgcccccagtgggtggattgtttgataaggagtgggttagaagaaggcagataaattatctattactatgattttttaataaaacattaaagaagggtgtaaagattgaaagctaattgttttttgcctagtgagattctgtccttgccattttgactaatgtttcctcaaacattagtttcagaaatcataccatgatttgaggctattaattcccaggaaaagagcatatgacattttgctgctgaatcttgtttttaattactaattacttaaggagatatgagaagcatatagtggcttttaatttcttttccagtttacaatttaaaaaattagtttaaattatttacagagaagatagtgtcacattagtacactaaattgaaatagaattgtattccactgccttggcttcaaatgacttagtgtgcttgaaatgattacctgtatatggatggctaaatagagaaatattaggtgtttagtatgttgtgaacttcttcctggcctatttattgcctaagtggcacttaagaaaattagacaaaattttgcactaagcctgatgcataatcaatctattcaataattcccactatgccttgaccttcataaggtcactccactgttgacaagtcttgtctgtaacttaaaattacagacagctgggtaagcccatcgagtgtcatggacacatctatttgggcacttcttcaatactttgactttgaaaaactttcaattcaccaactggtatcagtggtctaaagagggtcacttcttgattatttgacagctcctggaaatctctgtgttttttttttgcttctctctaagaataattatagatataaaggcttggaattcattttaaacctgtgatagtgtgactacagttcaacataaagattgataatgtagtgtctgttatgactcatatcttagccagtttttgttccccaatgtcagttttcatgttatacacatttccttttagttgagtatgaaaagtagagctagcaacatatatttggagtttttgagtttgtaggcatcattacaattgtaataattttatactcactgagagggccacagttatgttttaggtatattgtaattgcctatgattcctagctttggttggcactgctatttggacattagttgttgatcatcaacctattcacaaattgttattcaacataatggaatattctgaacaagaaattttgcaatgattgtgaaaagttcatacattttggctgtgttgaccatgggcttcagacttgtttccaagaagcatcaaaataattaaaactaaatttcaggcacaataaatagccatgtcaacttccatatctacatgataaagtgagaacggtttgggagtatacagctgggtgcataaacttacaagggagtttctttgaagaaaacaatatttttctcttacaagaattaattcaaatgctgctggtttgtggtgctaaaaaaatgtttctagctacagtgttttaaattcccctgaagaaaacaaaatgttttatgaatattaggattcagttttagactttcttacatttggaaacagggctacttgttggaggggttctcattttacttcacagtgagtgagtggctccagctgacttcttgggtgctttgttgaattggtggaataggtaatagtggtgaatgactaaacatagcagacataaccattagtaactcatagtgacttggaagacacctcaagggaaacagcgttcagccctttcatcttttgtagctaggccttcggtctttcagttgcaagaaacttaaattcaactcaaactaactcaaagaaaagagaaattaattgacccatatagtcaaggagggatttaggagtatttaccgaatagaatttttaaaaaacaaacagcagatgaattaaatatttagaacccacagtttaaccgtgctgggattttctttgaccttctcttgcttctgtttcttgctgtgtgttggctcaatttccttctagtgatcataagctttaaaacaaccacattttagcaacttcagtgggaaagcacatgatatttgtaaatacttatggattaatatcaagcagagagttggatttatccatcctttgagccaaccactattgtctgggaaataggttataatatttgctaactcctattgctcatcgctatgaccagagggctagtgcaaactacaggtggaagaatataaaagacattcttttgtaaaaacaggaaaaaaataacactgcctagcacgtccactgcaccacttcttgtgcaaacacctgtataacatccttacaggtactcctcagcattaactgggtaaaatgtaggatatgatgaaaagtttattagacctggcatctatctcatctctgtttctagccagttttgtggtgatgaaaaagacattttgcagctctgaactttatttcttcatccataaatttgttgctctatcattttcaatctctgtgaataggaattactgactgacaatctcattctgttgttgtagaactcagatcaagctccattgagctaaatgttgtctttcttgcattataatacagaaattaagagtgaactcttatatcagataacccttagtttgaatcctagtatgtggtactcagcaattcactcaaactctctatgtctcagtttcttcattgaaaggatttaattagaagatgtatataaagtgttggcaaaatgcctagcacatataaacactggataaatattagtcattgctcttattagtattattgttttcattattatttttaacttacaacaactggagtttggcttgtcaagagtcgtgcagaattaaagagtctgtctttcatggggacaaatctttctttccctcctgcttcaccatagtttacaattctttagagaagaggcgctttggatacttccccacataatacagacgatatctttcatttctaattgcccaggatcaaagactagttccacattaactaaacggccttaccattttaatgtgttttgaatcatttacaatccagagatatggaaacatagcaaaattttagagtaatggtaaaaagcacctgggaacatggtgtaggatggtgtaggagcaggtaattgagcacagacagttcatttaaatgcctagatcatgtaaaattatttacttggaactggcccaagtaatttgcaataaatgaccttattttttgcatgttgaaaactgctttttttttttgcttgagacaaaatctccctctgtcgcccagggtggggtggagtggcacgatttcggctcactgcaacctccacctcctgagttcaaaggattctcctgcctcagcctcctgagtagctggaattacagacacctgccgccattcccacctttttttttttttgtttttttgtttttttgtttttttttttggtatttttactagagatgagatttcaccatgttggccaggctggtctcaaactcctgacctcaagtgatccacctgccttggcttcccaaagtgctgggactacagacgcgaggcaccacgcccagctaaaaactgcttttgatcattaattttttgacatgtgctattatctggaagaaagtaataacaggtgaaaaaataattgttactttaaatgatgtcttagggacagccaagacataccattagctagggcaaaaatttattcaaactacttcagaattatgtagacagtttttttgtttgtttgtttgtttgttttttaatgggatgggcatttttgatcaaatgtgcaaaatagcttagcgtcattttttatgatttttaattttctgtcttaaacttatatacttttttgaacagtggtattttaaattaatattaatgtggaaaattcagagcattcttgtttcatcatcttgacaaccaggttagactggtaaggtgggaattataatgattatcttcattttactaaaacaattttcccaaggttacacagctagtctatggccaacacagacttgcagacatacgtattataaccaaaagaaagtgttcttattaatggaaaatagggtaaggtatttgttctgtttttctaatgttgctttagattctttagacaaatcatctgtgctaaggttgcttataaaagcatctgaagatcaatggaattaagttgagacaattctgaaatgaaaattcaagtgatgaaattccccagagttcaattatttgagttaaaagtgtttgtaataacagatcttggtacatagttggcacatttctccgttgtgtttttcctctttctatcacctttcagtttctattacaacactcttagggagtttactaataaattaattattggaaagcatatattgcctgaaggtttatgtaccagtagccattagccacaatatgcctagaatagatatgtcatttcccggttgaaatatcgatccaggagaacaaatgaacaaattatcaatttggacatgccaagaaaaaaaaattgaatatgtagccatgtttatttgagacattttactccataaagcatgtttaataaaaagaatgagttcatgcaagaattgcaaacagccagtcagagccatgtgatggtactggaagttgttttacaaatgtatgttccagttcaggagcatcctctcttagtaaaaacttccttttaatagcagcatcttaggcacttgatccacagaaggaagtaattaaatttaatacatgcaacactcattttgaggacaccctcgatttaaagtagcggggggcataattaagtctaatagaaatcatggcttgagaatgaagatacactatcaagcaaacacagaccaagtctacacagaaccaattacctggttaattagggctacaagctgtgtttatttcatgttattcaaccaaagcaaagcttgagggttgatattgtttgtttatttatttagttggaattacatttataattggaattaaatgaatataaaccacaatattagatgagcttaatgctcatatatagccacccaaaaagaaaaacaaagaagtggaatcattaactaagtgtttttaactgaaagagtagatttggaagcatatatatacatagcctaaaccatcagaaaaaaaaaactatattcccctttccactctttatcataagtataacttcaattaaaggaaataactttgatttatagttagaccacaacatagtatctgttgtcctgtctgttatagatcaagtcagcttggtgtaatggaaacaactctggcttaggagttaagagttcgtggtttttatcatttcaattcatttatacttctgtttgtcagacatacgttgaccctacagtgtggtagtcagcagagggaaagatggggaaaataactaaaccaacaagatctaattcttaccattgaggagcttgtagaatactgttagaagtaaacatttgagaataattatggtaagatgtatttaatagtagaatggatgtttgtagaaagagttgtaagacataaaggaggaagaactgaaaaataaaacaggaatcagttactctgtattttcccggaccttaaagggtgataaccaaaggcccagggaagggcaatggaggtagagtcagcagcacatgcaaggacatgaacagaggcccaagacattcctttgagattccagattatatgggggatctgtagtaaaatgggcgtgggactaggaagctctgattgttcagagcagatgaaacctgaggtgaaaaaggaaaagggaggccagatgctgggtacatttatgggatatatgtaaggtttgactttaccttttggaaaacaatctttgaagccaagaagttctttatgttttgcctatattgttacctgaaccctgagaccttatacttccttttatccaaacagtgtctggtatactgtgtgttgaatgaatatgagtgaagaaataattggtaacaattagtattcaattttatatcataatttttaatttatgattttaaggatcatgcccttagtaaattagacacacagtggtcttcctggaatgcgtttatgcctagatacaacaccagaagcacaatgtaaattgacgataataaagaactgacacatgtgtcaagaaacagcaacgtaagcagttgtgcctcagagaaaggcatagagagttttagcaaaaagctgtgcattgggtaaaaatcatggaaaaaaagccaaagaaaagttaactcaggctctccaataatctgattgtgaggtttcactcacatcattcctctaagttttattaattaattatataagttttttgagcacttactgtgctcaaggacattagggcatgaagcaacaatggacactgttctcgtcctaatttggcttgcatttaatgggctaaagtcagcaaggactctttgagagcaagcaacagacaccaccgtgagttctcaccagccaaaacggacttaattagaagcacccagagtagcttacagatggaaagaaagatggaaatccaggccttggaaagaccagagatcaacaaaatagaaaattacgtagtaggaattaatagaatatggaatatatatacaatggaccatggggtgcagtgggggagcaattttgcaaaggagaatggaattatcactaacagaaaagatagggtatattgaataggcaaaatagaacgtttgtacaaaaaaaatctttttctttagataatttctgaggcgttttctggttgtaaaagttctggaagttggcaaaggatcatggtttggtgtttcctacttttttaaatcatatttttctttctttagaatgcaaccctgccttttgtgaatagaatttcataagtgaaggaagctggctttcatctcaaagtgaaactaaaaaaaaaaaaatagtaaaaagttttcctttcaaaagaagaggctgtgattgtctttaaagtagttctataaataagcattctgcagtctgtgacacactttagagaaagagcaaagttcagttctatagctcatttaaaaatatccttcttgagttgagatggtcccacagagatttattttcatggatttataagctctgagaaactgcagtttaaacataggctggctgaaaaatgcttaattactcagtttggtcactgaagcaacaacattagccctctagtcaaagaaaatgacagtgttatcaaaactaacctgcaaagctttattaaaactatctttggcgataatctcttttaagaatgcattgtttttaattagaccttggctttgaaagcaagaagggtcaatgaaaaaaaatttaatcatgtccaagctactgtgctacatctttacaaaattcaattatttctatccagtgtggcacaagaaacatttggcaactgattaaaacaattcttaaagcaaattacagcactgtcagaaaacaagaaatcagaatgtcaaaatacaaggacatttctatgcaaaatgtgttgcaagtgtctttgacagagtatttctgtctgcttgttttattactttcattaatttggtccacatcaagtaaaaagaaaaaaaaatacttccatgtgttagctatttgaaataaaaattctcaaatgaataatattcccaaagataaccaaagtagccatgtggggaaattttatgctttaattttatccaagcttactcagcactgtaaaaatctatgttgaggtttctagctgtagggatcccaaaataactgcttttttttttttttttggcagtaaatccacatctatgcaatttcagctactactaatatgtagatgccattagacgtagatgttatgtattatttcagggcagaataaaacataacaatatgtaatttataatatatttgatgtgcattttaaaaagtgaagttttttaaagtttagaatgaataacaagtttgtttttcttaattatgctttaagttctgggatacgtgtgcagaacatgtaggtttgttatataggtatacacgtgccatggtggtttgctgcacccatcaatccgtcatctacattaggtatttctcctaatgctatccctccccctgacaggccccagtgtgtgatgttcccctccccgtgtccatgtgttctcattgttcaactcccacttatgagtgagaacatgtggtgtttggttttctgttcctgtgttagtttgctgagaatgatggtttccagcttcatctatgtccctgtaaaggacatgaactcatcattttttatgtctgcatagtattccatggtgtatgtgtgccacattttctttatccagtctatcattgatgggcatttgggttggttccaagtctttgctattgtgaatagtgctgcaataaacatatgtgtgcatgtgtctttctagcagaatattttataatcctttgggtgtatacccagtaaagagattgctgggtcaaatggtatttctagttctaggtccttgaagacttgccacactgtcttccacaatggttgagctaatttacactcccaccacatcctctccaggatctgttttttcctgactttttagtagtcgccattctaactggtatttcattgtgattttgatttgcatttctccaatgaccagtgatgatgagctttttttcatatgtttgttggccacataaatgtattcttttgagaagtgtctgtttatatccttggcttgctttttgatgggattgtttgtttttttcttgtaagtttcttgtagatctggatattagccctttgtcagatggatggataggttgcaaaaattttctcccattctgtaggttgcctgttcactctgatgatagtttcttttgctgtgcagatgctctttagtttaattagatcccatttgccagttttggtttttgttgtcactgcctttggtgttttagtcatgaagtctttgcccatgcctatgtcctgaatggtattgcctaggttgtcctctagggtttttatggttttaggtctcatgtttaagtctttaatccatcttgagttaatttttgtgtaaggtgtaaggaagtggtccggtttcagttttctgcatatggctagccagttttcccaacaccatttattaaattgggaatcctttccctattgcttgtttttgtcagatttatcaaagattagatggttgtcaatgtgtggcattatttctgagacctctgttctgttccatttgtctatatatctgttttgctaacagtaccatgctgttttggttactgtagcattgtagcatcctttgaagtcaggtagcgtgatgcctccagcttcgttctttatgcgtaggattgtcttggctatgcgggctcttttttggctgcctgtgaaatttaaagtagttttttctaattctgtgaagaaagtcaatggtagcttgatggggatagcattgaatctataaattactttgagtagtatggacattttcacgatattgatttttcttatgaggatggaatgtttttccatttgtttgtgtcctatttcctcaagcagtggtttgtagttctccttgaagaggtccttcacatcacttgtgagttgtattcctagcattttattctctctgtagcaattgtgaatgggagttcactcatgatttgtccctctgtttgtctattattgtataagaatcacaagtataagaatgcttgtgatttttgcacattgatttttgtctcctgagactttgctgaagttgcttatcagcttcaggagattttgatctgagacaatggggttttctaaatatgcaaatatgtcatctgcaaacagagacaatttgacttcctcttttcctatttggataccctttgtttctttctcttgcctgattgccctggccagaacttccaatactgtgttgaataggagtgatgaaagaaggcatccttgtcttgtgccagttttcaaagggaatgcttccagcttttgcccattcagcataatattggctgtgggtttgtcataaataactcacattattttgagatacattccatcaacacttcatttattgagagtttttagcatgaagaggtgttgaattttatcgaaggccttttctgcatctgttgagataatcagatgatttttgtcatttttttttttacgtgatggattacatttgttgatttgtgtatgagaaccagccttacatcccagagatgaagcagacttgatcatggtggataagctttttgatgtgttgctggattcggttgccagtattttactgaggatttttgcatcgatgttcatcaaggatattcgtctgaaattttactttttgttgtgtctctgccaggttttggtatcagaaagatgctggcttcataaaatgagttagggaggagtccctctttttctgttgtttgaaatagtttcagaacgaatggtaccagctcctcctggtagaatttggctgttgatctgtctggtcctgggctttttttgattggtaggctattgattactgcctcaatttcagaatttgttattggtctattcagggatttgacttcgtcctggtttagtcttgggagggtgtatgtgtgcaggaagttatccatttcttctagattttctagtttatttgcatggaggtgtttatagtattctctgatggtagtttgtatttctgtgggatcggtggtgatatcccctttatcattttttattgtgtctattttattctgctctcttctcttctttgttagtctggctagtggtctattttgttaatgttttcaaaaaacagctcctggattcattgatttttgaagggtttttcatgtctctatctccttcagttctgctctgatcttagttatttcttgtcttctgtcagttttcgaatttgtttgctcttccttctctagttcttttaattgtgatgttagggtgtcaattttagatctttccctctttttcctgtgggcatttaatgctataaatttccctctaaacactgttttagctgtgtcctagagattctggtatattgtgtctttgttcccattggtttcagtgaacttctttatttctgacttaattttgttatttaccctgtagtcattcaggagcaggtagttcggatttgagtgagtttctgaatcctgagttctaatttgattgcactgtctgagaaactgtttgttatgatttccattcttttgcatttgctgaggaagtttttacttccaattatgtagtcaattttagaataagtgcaatgtgtgttgagaagaatgtatataatgctgatttggggtggagagttctgtagatatctattagatctgcttggctgagagctgagttcaagtcctaaatattcttgttaattttctgtctcattgatctgtctaatattaaaagtggggtgttaaagtctcccactattattgtgtgggagtcaaagtttctttgtaggtctctaagaacttgctttatgaatctgggtgctcctgtattgggtgcatatatatttaggacagttagctcttcttgctgcattgatccctttaccattatgtaatgcccttgtctcttttgatctttgttggttaaagtctgttttatcagagactacaattgcaaccccagctctttttcgctttccatttgcttggtaaatattcctccatccctttattttgagcgtatgtgtgtctttgcacatgagatgggtctcctgaatacagcacagagatgtgtcttgactctttatcaagtttacccgtctgtgtcttataataggggcatttagcccctttatatttaaggttagtattgttatgtgtgaatttgaccctgtcattttgatgctagctggttattttgccctttagttgatgcagtttcttcatggtgttgacggtctttacaatttgatatgtttttgcagtggctggtaccaattttcctttccatatttagcacttccttcaggagctcttgtaaggcaggcctggtggtgacaaaatacctcagcatttgcttgtctgtaaaagattttatttcttctttgcttatgaagcttagtttggatggatatgaaattctgggttggaaattcttttctttaagaatattgagtattggcacccactttcttctggcttgtagggtttctccagagagatcaactgttagtctgatggccttccctttatgggtaacccagcctttctctctgactacccttaacattttttccttcatttcaaccttggtgaatctgacgattatgtgtcttggggttgctcttctcgaggagtatctttgtggtgttctctgtatttcctgaatttgaatgttggcttgtcttgccaggttggggaagttctcctggacaatattttgaagagtgttttccaacttggttccattctcctgatcattttcaggtacaccaatcaaatgtaggtttgctctttttacatagtcccatatttcttggaggctttgttcattccttttcatcctttattctctaatattgtcttcacactgtatttaattaagttgattttcaatctctgatatccattcttctgcttgatcgattcagctattgatatttgtctatgcttcacaaagttctcgtgctgtgtttttcagctccatcaggtcatttatgttcttctctaaactggttattctagttagcaattcatctaaccctttttcaaggttcttagctttcttgcattgcattagaacatgctcctttatcttggaggagtttattacccaccttctgaagcctacttctgtcaattcatcaaactcattctccatacagtttttttccgtagctggcgagaagttgtgatcttttggaggagaagaggtgttctggtttttggaattttcagcctttttgcactagttttttctcatcttcatggatttatctacctttggtctttgatgttggtgacctttggatggggtttttgtgtggatgtcctttttgttgatgttgatgctattcctttctgtttgttagttttctttctaacattcaggcccctctgctgcagatctgctggtggtcctcttcttcagacttctgtgctggcagtgagaatttcaagccagtggatcttacctttctgggctccatgggggtgggatctgctgagctagacaacttggctccctggttcagccccctttccaggggagtgaacagttctgtctcgctggcattccaggtgccactggggtatgaaaaaaaggaaaactcctgcagctagctcggtgtctgcccaaatggcagcccagttttgtgcttgaaacccagggtcctgttgatgtaggcacccaagggaatttcttggtctgtgggttgtgaagaccatggggaaagcatagtatctgggccagaatgcacctttcttcacagcacagtccctcatggcttcccttggctaggggagggagttctccaacccttgtgtttcccaggtgaggtggcgccccaccctactttggctcacccgtgggctacacccactgtttaaccagtcccaatgagatgagtacctcagttggaaatgcagaaatcacccaccttctgcattggtctcactgggagctgcagaccggagctgttcctactcggccaccttgccagccaccctgaaaagtgaacttttaagttacataggtctgagccatgtgttctaaaatatattgttgttttgacttcaatttaagtgagatttgtgctttttaatagaaggttgcacatttttcttctcttttaaagcttaacagaaattcaaaggcacacattatagaaaagtgaagctctaggttgataataaaataagataaaccacaaaaaaatctgccttttattaacatagttcttgtcccatgtcaaaattcaagcactagagttttgtattcagccttattgagtcagttagctaactctatgctttgcttctatgtggctgcttgttttagtgaggcagagccttgactatagtagttatccaacacatttgttgaagtatattgagataaagagctataagaacatttgagcctatttgaattgcttggcaaagaactatatattcaatgttcacaaattttatggaattgggtcttcttaaatagagaaagaatttgaatcatggaggagtttctaattatgcctactatattggcaactataatgttgtataagtcagatctcttttaagtaataaaacctcagctgaaactggttcaagagatagacaatagatagatagacagatggacagatagagttttttagctcaggaaataatgtttcataagtagtttggatttgatttaggaattcaaataatgtaatctggatttattctctttcagacacatatgtgcatgggcacacccacacagacttacacacacttctgctttcttggttgttgacttcattctccagtagctcactccctctacgtagttgactccaaatttctaggcttacactctcatatcttagcaagtggtcctggtagaaaagtgatcatccctaattgaatagacataaaaatgtcccagacttgagaatcattccttaaagtcagctgctctctctgtgggcacagagatgaactggactggctctcatcataggtctgtgtttgtgtctggggtataggctccagggacatagatcagtcccgtgtctgggatataagttccagggatataggttggtccctcctgaaagtgaatgaaaatagagacagatggctcaccacatgaaatatcattgtgttaattccagatgaactgttaaaaactattaaaataagtaaatacagtcaatgttcacaactggtatgaaacatagtagtgaaaaaacataagggaaaattatatactgtaacatcacacttggcttatggtcttcattaatatctcttaacttcaacatgaacctcacacaatgatttagtgtcctcaactccaatgatctccattcattagaaaacagaagtcagtgtttgtggcttaaactacggtaggtactgaagacaagtcttggcatacatatgggatggaggtagcttagtgctgtaggtttgaaaccatgtggagctaaacagtctcaaaattccacacccacattgccaactctatctgcatataccttagtatgacaaattcaattattccaacagtaaactaattcagtatgtctcaagctgaactgattctttcctgccaaatcagttatcttctaactttctattaaactcctcatgattcttcattggaagcttccccataatgggttctacaacatattttgttttttaaaaattaatttaaattttgagtatataattaattcacttttaacagtaaaaggtttttctctcttctttatctgttagctccctgtatgatagtgtacacaaacactactataaatttcttataggttatctttttaaagatacatatgtatacacaaaaatgcatacttaggttagtctaaaataagttatgttccaggatctaccttatttttaaaaatacatattttttcaagagacagagactcactgtgttgcccaaatgaaatgcagtggctattcacaggcttgatcccactactgatcagcctgggtgtttggatctgctccacttctgacctaggctaattcacacccctaggcaagctggtggtcccccactccaagaggtcactatattgataccaaacttattgtggataacctaattagtatagcaaactgcagcccagagctctagggctcaaaaaatcctcccgccccagactcccaagtagcagggactctaagcacctgccacagtgcctggctgggctctactttttatccctttacaatatatcttatagcttgtttttatatcaatttaaaataaacaatctcattttaaaatggatgcctaatatgacctgatatccttgcatataatatatgtaccagtccttttttgatgagcataaatttccaactttttgctgttccaagcaatgctgcaataagtaacactgtacatatattacatatatattttattattgagttttaaaatctctttgtatataatggaaattaagctcttgtctataaattctaaagtttttttattcaagtatgtaatagccatgctcacagagaggaagaatcaacattgttaaaatggccatactgcccaaagcaatttatagattcaatgctattcctattaaattactgttgatattcttcatagaactagaaaacactattttaaaattcatgtggaacaacaacaacaaaatatccaaaaaaccaaggcaaccctaaacaaaaaacaaagctggaggcatcacagtacccgacttcaaactacagtaaccaaacagcatggtactggtacaaaaacaaacacatagaccaatggaacagaagagataacacagaaataaggccacacacctacagctatctgatcttcgacaaagctgtcaaaaacaagcaatggaagaaggattctcatttcaataaatggtgctgggataactgcctagccacatgcggaagatcgaaactgaccctttccttataccacatacaaaaattaactcaagatggattaaatacttaaatataaaacccaaaagtataaaaaccctggaatacaaccaaggcaataccattctggacataggaatgggcgaagatttcatgataaaaacaccaaaagcaattgcaacgaaagcaaaaattgacaaataggatctacttaaactaaggaacttctgcacagcaaaggaaactcttgacagagtgaacagataacttatatattgggagaaaatatttgcaaactgtgcatctgactaaagtttaatatccagcatcgataagaaacttaatgaaatttaccagaaaaaaataagcaaccccattgaaaagtgagcaaatgaaatgaagatgcttttcaaaacaagacatgtgtgtggccaaaaatcaaatgcaaaaaagctcaacatcactgatcattagagaaatgcaaatcgaaaccacagtaagataccatttcacaccagtaggaatggctattaataaaaagtcaaaaaagtaacagatgctggtaaggttgcagagaaaaaggaatgcttatacactgttggtgggattgtaaattagttcaaccattgtggaagacagtgtgatgattcctcaaaaacctaaaaacagaaataccattcaacctagcaatccccttactggatacatacccaaaagaatctaactcattctattgtaaagacacatgcacacttatgttcattgcagcactattcacaatagcaaagacatggaatcaacttaaatgcccatcaaggtacactggataaagaaaatgtggtatatatacaccatggaatactatgtagccataaaaaaaggacatcatgtcctttgcagaaatatggatggagctggaggcattacccttagcaaattaatacagaaaaagaaccaaatactgcatgttctcacttataagtgggagctaaatgatgagaacacgtggacacatggagtggaacaacacacactggcacctattggacattggagggtgggagaagggagagcatcaggaaaaataactaatgggcactaggcttaatacttgcatgatgaaataatctgtacaacaaacccccttgacacaagtttacctatataacaaacctaaacatgtacccctgaacttaaaataaaaattaaattaaaaaaataaaaactaaagtgtgtgggttctaaattcagaaaaatcatatttccgagttttggacctacatattgaagctgtgtgaaccaagactaacttccatgtaatgtgcaacttatgaaagtatctataggactctatttcctcatctatgtaatggggttagtaagactcagttgctatgagaaataaatgaggtgatgccttcaagccactgattattttcattgacataatatttgaatttgcatcattgggtagactgaacctcttttataacattggatatatactctgctttataagataacctcaccatgtaagataattgccatgcataatgttcaaaggatcaatatagaccactcacatggcttgaggatgaagacatgtcagcgtttgaaccaatttgttaagcaacaactactagaaaacagatgcctcaaaaaaatcccaattgaatattaagaattttgtcagtcttcaagaaaaaaaaaaggtactgtataccttcacagtcaaaatactggagatttaaggtgactggaatactgccaattcttttgtttgaaattgatttgccctttgaagtgttttggcagaattttggcctcattctcccttttcccaacaaatgcacctatccggctaccataaagaagttacagaaatgttttgctttatataatcaagggaactagctaaacttgaagaatctgcctgaaaacccataatccagggtgactatctctatgttttatcaaattggtttaaaaagtgcaggatctttacttctggtaacttcaggtgatgctctgtgcacatgctcactgccttatcttgagagaacaagaaccagggaataatgtttcctgatttcctgcttgaaatcccttaggtgaacattatctcccatctccctatttacttgtaaacaaagcataacaaaataaaatccagaagattgagagtgttggttctttcagaaacttcccttttggtgaaaatcattagtcagtgaaaaatagctcttcacctaggagacaaataaattagaaaaggccaatatgtttgtgagaatttcagggaaagtataaatggaagaaccagattcacaaggaaaaaatatttcttcaattcagagaggacactagaacaaaacaaaacaacttgatttaatacaatcagagggagaaaaacatttaaaatgtgttgtgtgtaggtatgtaatgccctaacggagacagatatttattacgtatcatttattcaaaattttagtgtgcctgtgtgttgttgtgtatttgttgtacaagtttctgagtaatacttccaccagtttcagttcagcaacctttggaatttgttgagaaaagccaggaactgtactgtagggtcagaatggctgacttctctccatgctttcactcgggtaacgaggcaagctgtcataactatggtttctggtgtacaggggaggttttgactccaatgtcataaatctcagcagtagaaataatcaaataggtaagttctttttgtagggcatgtcagtacatgtcctctgcccaatttctaaagtataatgtatctcttgggttttcaaagtcaggcacaaaatcctcagtttagaatgtacacagtgaccctcaccattactgaatgaattgcttcatgctgtactgtccagaaatatcagagagtaggtctctgtgtttaacaaacacagcactgactctgtttggttcttgcatttgactaggttagcagttgtcaactcggggtgaatttgcccccgcctccccaggggacatctggcaatgtctgatcatgtgtttaattatcacacctgtaacccagtgggtagaggccagggaccctcctccaccacccaaatgtcaatggtgccaaagttgagaaaccttgggttagtttttgggttgagcacaaattcagataaaaacataactcagctccttaaataaaaatttgataaaggaaatgtaacaatgaatatactgaaatttcattttgaagtccctgagattttgtcatataaaaacatgtgggcacagtttcttacccctttaattctaattctcttctgataagtggattttgccaagtgaaagaagactgaaacttatcttctctaggagaaaaaaataacttggttgtttgcattgcagtagctcaattatgaataatctataattttccaacccttgagaaatggcttttagctatttttcttttttttctctaagaaaatgtaagattaaaatggtttttacctatgcaggtataccttgccttaagcaagttctatatatacgaaaacacaaatttataaagaatattaatctgagccaagtgtttgctttagaaaaagaatttgttgctttaaaaaagacagtgtgggaagtttcctgcaaatttttaaatcatggcacatttacagatagtttgacccattttctgctttgggaaacacataaatattaattgaaaaattaaaaatataaaattagcgaatcaattagccatcttaaaaatatctgctaattttctaacagaaatcgcttcatttggctgagtaaatacaatagttgaagtgtaggctttacataagtattgtatctattaaacaggttccaataatgttcttttcttttctctacactgctatcattcttctgtgaagaatggtaccttaatcttatattgaggtaatcattcttatgtgaaaaactgccaaaattaagactttttgtttttcttatcagtctaagttttcaggggtgttaacacaactgaacaggcttacatctaatgcagtattgcatcatggatatgtcaaatacatattgaaaatcacaagaaaaaatagaataacagcattaaatataatccaacccaaatccctagcaactattttcaaaatttctgcaaaatgcacactttattcacttattcattcatcccttctagcaacaattatatatctagtacctgtgggattttagtacccaggagaggcactctagcacctgcatctttggttatggctattcagtttttaaaccacataggcaaggtccttccctaagtttacagtatagaggtaaagaggatgagtgaaactcagtctgctcagtggacagctgatgaagggcagggccatgaaactgtacagaagcagcaaaactagctttgtccagagagtcagggacaacctcttagagaaataacttaggaagaaaatcttttaggagatccaagaaaaagagatgacaaatgagaagataacctccttaagtgcccatggaaatttgaagttcacttcaaaccattcattacattgttatttaataaactcagatatagtggtgggagcatttatttgtaatagaatccaaaagctagactagaatatatagaagattttttttaataatcagtacctaaaagtgtatcagtgatataatctccagagtagattcaccctttttttttttttttttttttttttttttttttttttttttttttactgacaggagtctatctttgaccagggtatagattcaaagagtaaatccataatcgatgagctgcgtacccgtggagaattcatgagtctactctgagtctcagttttgtcattcttaaaataggcataatatctacctttagaattttgtcctgagaattcaaggtaactccataatttctagctcatggcaggtacacatcaagtggtagtttaatttttctcctaactaaaagaaattggtcatcaaatataaaaacatagttcccagacaaaaattactttttaaagataaatgataaatctacatatatataatacatatattatctgtgaaaagcattataaaataatttcttaatttcgtataagagaaataatttaaaaagaacatttgataagatggactggcaaacctgaaagagatttttattattggaatataaaaaaattatataaaattgttaaacatgacaaaaatggaagatgagtaataagcaaagactaaagtaatatgtacacaaaactgtatgatatggaagataatcaattcatatttaaactattacattttatagtaggctgaattatgagccccaaaaatatctctgtcctgattttcagaacctgtcaatatgtcaacttgtgcaataaaagggactttgcagatgtaattaagtaaaagatcttaagatgaggagattatcctaaactatctgggtgaacccaatgtaaccaagcgttaggatttttataagaaggtggtgggaagatgagacttagtaataggaggtgtcactttagaagcaagaggttagtgtgacgcaagaaagggcctgagagccagggaatggaggaagctggaaaaggcaagaacgtgaactctccctctgagcctccagtgcaatgtagcttggccaacacctagattttggacttctgactgccagatcggtagggtaataaatttttattagtttacccactacgtttgtggtaatttgttacagcagcaattaaaaaaaaactaatacaagtctaaacatgcccaggtgttcagaaaatcatgtgaaggaagacggctgacaatggctgacacaataaatgaattgaacagagaatgtcagaaaccaaaatgtattatagatgtatattttctgttgcaaaagtaagcaaaaacatatttatttatttatttatttatttatttttgagacggagtctcgctctgtcgcccaggctggagtgcggtggtgcgatctcggctcactgcaagctctgcctcctgggttcacgccattctcctgtctcagcctcccgagtagctggaactacaggtgcccgccaccgcacctggctaactttttgtatttttttagtagagacggggtttcactgtgttaaccaggatggtctcgatctcctgaccttgtgatccacccgcctcggcctcccaaagtgctgggattacaggcctgagccaccacgcccagccacaaaaactttttatatatttagaattacacagtttcgaaccatattaaatccattttatagcagtatgaaatgagacgaggataatgtgtattgaaataccctgcgacatttgtagaataatatggaagtagcctagagatacctcgttcctcagtgagatgcattgccatttttgtttattaacaaaatcctcctggtcaccatttcagctcacccagaagttaaactccttattctgtatgtttgttcatttgtaattaatgataagtgttttttagtgttagcgtcttcgtagttagcacgaaggagctttacagaagcctcaacttgtttctcgaattttagtaaagttgatttcaccatagagcaactcctctttgtgtatttacatatctctattactgtaattttaatttactgagcaagagtcaacatctatatcattatgtgtgattagacaaagaagatctattaacgttttcctaaacttatactgctttccccccatggttgaccctaccatatgaaaaagagactcgtggttgaaatggtacgttggatgaaaacaatgaatgacaataaagttggagagaggggagaaacagctgctggaaaatctctcttatccaatgtccagaatgctgattgttttggggaggaagtaaatttgtattggcttaggggaaatcagtttgtggacaatactggtttggggaaactttgttacatttctaatttcctgacctgggtcgttacaatcaaacaaaattttattcttttcacttgcactccagatggaagaaaatgtaaacagctgtccaagcggtgatggagccttttcttccacattcttgcatgtcattatgttagagatttactttttcagcaaattgaaacctctaaaccaagcaatcaaatttttccccctctccctctctttgtattccaactgtcatcaattgcttactttcagaaatagttttctaaagatgaagctctgttgaatatgcatggtcattatcatatttactctcatcagtaccatatagcattatgttgtttacaataattagctgctggaggcaatcctgtaaacacagccatgtgacagcccaaatggagagaatcaagtcattgttaagaaagagaataggtatgcgccggttggactcctatgctgtggttattggtggtgattgcaatgtatgggtccagtccaaaaagaaatctcttactcaatacttctctagttgctgggcacatatgaaagaaatgaagacatgagggaattcagatggttaaataaagctaacaagacagatttttctttttaaaattttgtttaagtctgtgggctaaccatattcacttaggaagcaatacatacagtaaaaatgcaaaattaatatatttaacttaaacaaatttagatttatgcatagggtatgcccctatttagggtacacccctattactcatattaagcagacagttgatgcaatcacacagaaaacaatcaatgcaagctatcaaaatctatgaaagtatgtataaagtttatttcagggtttcctgaccattagaaagaattaaaattcactgtttaagcgagcctcaagtagatagtgataaaattatcactattctcagggaagaaattgaagaaaattgagggcaataaagaaatattactaatatagaattagaggagcagatatatatgtgtgtgtgtatatatatatatatatatatatatatacacacacacacacacacaaagctttatgtgttacttaatgggagttttataagcttttcaaggattattttaattttatggaattgctgctttccttgaactgcctcgaaaaatgttactccacaatctattaactaattcaacacacatttattgagtacctcctagattgaaggcactactccatggagaaaacatgaataatcagacacttttgcttttaggagctgacagtctcaatggtactgatacatcaaagtaaaatgtgatgcaatttcatagcagaatcaacagtgtgctaaccaagcatgaagaagtatggaaagtgatgtgagaggaaaaactctttataatttgttcattaaaatatattgcagttttagagttccattgtgtttaccaaattatcaagagaatacagaaaattccaataaatagagaagaagtgggtaaaatgtaggtctttactagcttattttaagatagagtaaatgtatattagtgcatatacttttgtgttttgctttttcttttagtgagagagggcataattttcaaagctgtgttgtggctagatagggaatacacaatttagatagtgaaacaatcaagcccattctaagtgccaaaagtttaatcccttaatgagaatctaaaaaagttttttttttaagtgtctctgagaaatactaatggtaactttaaaaatgtatatatttatatgcttacttttattagcgattcttagtaagctcccccataccaataatctcatattactgagcaatcactccatgtagttagagcaaaagtcttctgctgttgtacggaaaaattgatctttaggctgtgtagtggatgttgttgttgattggcacagatcttttctgggtctgcacttgtccatcaactgctgtgagtattatctcaatggttgtcttttctcggccaagccagagcccctacggctaggaaggtatgctgctctctacctaccctcttccaaagcccagagccaagactgactgtttttcttgccataaaatggaatcaactttctggcactatccatactctggagcttcccactggacaggctgaagttaggttatagctacttagctttttccccctggcttatcctgctttttttactccccttatccagagagcacgtgtccagtacattactggaaaaaagaattctcatctcagactctcttctagggagcctgaactaagttaatatccctacattcccagtacctaacccagtgcctgacatatgtcaaattcagttagtgataattgaatgaatgctgaatgacgtttgcattcatggtattagccatttggcaatactcaggactctcagtttattgcaggatgtatgtcttgatagacctctctacactacaacattcaaaagggaaatcattttagtgaccacttacagattcatgaagtacaacattgaaaatccactgacatttttgttctttgctttttttttctggttcctctctacttaaggaagtcaattttagaggtgatccacttatctgatactagattcagccaagttgcagaagcaacaaccaacacaactaagaacaaataaaatgaaaataaaaataaaaaaatctggagtttaaaaaccaagcgtgttgtagtcaataaagtgttaaaattttttaaaagttttcaaaaatacatgctgtaaataaactgaggatagactagctgcacagcctcaataaaaatattgaagacattatgaaatggtacacttgcatgatgatttataatttacacatgggtattaatttgaaactaccccaaaaaatacagcctacttacatagcttcagaatttaacccttctcccatttttcccccaaaagtgtccaattatctcctgtcagacctgacagtgagttatcttgttaaagagcttgcaattccattatagacaagctccaaatattgatttgtgccttttatttccttggtctttgacatcattgtaggactaaaaatgttcaaatctgttgctgcatgacagaaagaaaatggtcaagagatctcagatacatcaaaaaatagtttactgaatttatacttcacaagacactgtttttgtagtgtaggcctacgtgggtccaaaggagaaccaagtacaaaagtgtgagcagggaacagctttggaacacactcagtaaaggtacctggaaggggcttgtcagggaagcctccatggagtggcctcagagaggcacactgacatcatggcagccaacagagaaggaaatattgtcttaaacagaattcacaatgcctattttgtaggcatgcaaattattaaatatttaatgtgagctcttggggtaaagcaaacaaatatataaacaaaaactctttgtctctttaccctttgaaatctatgtcaccataaatagctagaaaaatgctcattgaacaaataaatgaatgagtgaatgaatgaacgataaattcagaataattactttgtatttatttggcactagatgagggaataaaatatgttccttgaactccagttttcataatcagtttgttcacctgtaattgatgattttcacttgattttaggaatttttggtgtgataataggtggatttgaaaatgtcaggttttatcattaaataaatagtattctaatagagaaagtagaaattgaataattatctaataaattccaacagtgagaactactaagttggataaccaccctgaagtaatttgtatttttctttcagagtaaattcttttaacatatgtttaatttctttaaatgactccactcaacctaagataataagaatagcagtggctttttagagcattcagatttcaaatacattttctggtaataatgtttctaccaaataaaagaggattaactctgtagagtattttaaagttgtgttcttaccgtataatcacatagacatttatagttaatgctacatttcttccatttgcagatttaactaacactttcatgaacattgttccattttttttgttccagtagtttatctttacaataaacaggtaactataagcaaagtgctatcctgagttctgtgaatccttctagaaaattatggaatctgagacaatgtaatgggaacccccagatttatagcctgtgggtcaggacccaatgggaattggttactgacatattaagtgagagcagtcttgtgggactgagaccttaacctgtgggcctgtgctatctaaagacagtgtcagaatggaattgaattattggatattcaggtagtgtcagagagctggagaagacacagcatatttgatgtcaggaggaaaagatccttttatcaactgagtcaaattttgagctacactataaaagaaaaatgtcgaaattgaaaaaattttaaatacaattaaatgtgtacagatagacacaaaaacactgagtggaataacttggagataaatttgaaaaaatatcccttaattaagataaaaaacagtcaaggagagacagagagtaagaaaagatataacaaatttcattggatcaatccgatgaattaaacacaaatttattataatcttttagagacaaaaagcagactaagagtgggggaaggtgtcatcaaataaaaaaaattaccagcacttgaaagacacaaatgtgtgtaggaatacagagaatctaaactgataagtgagaggaatttttaaaaataacatacctaaacataccatcataagatctcaaaacaccaacagaatgtgctaaaacttccagaaaaaagaaatctacaaaatattgagaatcaggctggcatcacatatcacatcattaaaactagtctctaggaaataatgctttcaaagtttgtcaggaaattattttgactataaatcctatttcagtcaaataaccaatgccaaaataaatatttttcagacaagaagactcacgggatatttgcaggtatgtgccagaaaaacttagagtgaaaaccaagagaaaggaagatttgagatacaagaaacaatgacaataacttagaagtgcaatgaaaataagcctcaggatgatgcccaaaaagggaccaatttagaaaaggaaattctaagaatctaagttgaatgtcttcagaaaatgaaatggagtcaattagaagtaataatgaataataaattagaaaatgctaattaatatttgaaaaatattttccttctctggacaagaaaaatataaaataaatgagaaaattacaaaaatacaaggcatccaagtttcaaataaaaagtaaaataaaatgtactatgatcctaagcaactgatgagttcagaaaataaacaatttatctggacgtgactcaagaaatagtttttattaaatgtcttagaagtagtggacactgaaaccacaggaaagaaaagtgaatccaaaatagtttaaatgttgctaatggttttcagtatttcaaatcaattggtagaaaacccacagaagtcttaattatgtttactggaccaaaaacaatgttatcacaactgacaaatgtaaaggaaactagaggctggtggacaaagttgaaggaagagtaggaatactatttttttttgtttttttacatagtggagtgtgtagaaatagtttctaaatgtgatgaaatagtgagatgtttaggtgtagtatttgcagatttaaaggtaaccaacaggataaaaataataaagctcaagatatagggagaaaagttatctgataaatccttgtgttagtagaagccggaagatgctgtctaaagttacttaagcaaatagaactacaaataagtatttgtaaactaaacatagcattttgaatataaaatttgaaataactgaaaccccataaagttaaaagtacttgcatctgggaaggatagctcagcatgaggaggggcagaatgcaatcattggtaaaacacaaagcaaatctttgcttttcttccacattcaaaagtgccaaaatcacctattttaagagtaaaactaaataataaaaaatgcaacaattttatttccatttctttgtttctcataacatttgttaatagttcttgagaacctcttccaaccctttcagcctcctgtcttgtgtcagctgattctgtgcagtctttgaccagattcacacaactgccatctgacagcatttgcctccagtcctgcattgtgccctttgttttctgcctcagggcttctgtgtcctcacagctgtgaaatacccatgactacctgtttaacatacacatatacacacagcagatggcacatgtatacataggaaacaaacctgcatgttatgcacatgtaccctaaaactgaaagtataattttaaaaaataatttaaaaatttttttttaaaaaaaagaagtgtgaaggagttaatgaccttctgggacaaatctaacaaaaagggagtcagaagctgggggaaagatgcttctgagacttacttaagtttcaagtggtgcaatgggacagagcaacaagtcatcatagcaatagaatagacaatgacacatccttgtattgactcttctttcttgtctccgccatccctcacgcttcttgagttcatattctggatttaaccacccacatggaagccactatctctggttctgctttgaagaaaaccaaggctaagacccaaagaccataagcataattggcagtaaggcctgagtgacagcaaaatgcctttactgtaggaatcagtggcgactaatagattatgatattcctttggatgtaaaacattgccagtctactaaggggttactggacttgtgatattaaaaacaaaagtttaaaagagagctaaggagcagaaggctgatatcaaagatcacaatgaaaaatccacggtgtttttgagttgtaaatttccatatgtcacttctaacccagggctacttggctacctgattcgaggtggaccaggaagagcctgtaatgacactacaattgtacatagtaaaaatgcctctgattcttccttagagagaactgtggccatttaccaccatacttgtactctggaaggaggaatatccagaatttggagaatttttgagaattgtcggatataagtctgaactgacgcctgtcaagctatgatagtccactagttaatgtggactttggaatccagattgaaaaaaaaaaaaggctgacccaagtctgtgtgtgcactgtatatatggaccaattatttggttatttccccaattccttaatataaaattggatagatatgcctaattgtcagccagcaaaaccttcaaattggcttcctaccatacagagtaagagttgctatgatagaaaagccaactgaaagattcctaaatatcctttcctttccctacccccaggcaaaaatatgaaatctgaagaaataacacatcccctgaggaaatgtgcaaattagcaccaccagaaaagatttaaaaattgtaatgttagtactccattgtatctctgtttgattgagctgcaacaacaaaaacaataacaacaccaagtgggttgggcagttggtgaactacatataccattaagggtgtagccccaaatgtatctgctatgctacctgtgttctctttgctagaacatgtcaacacagcctttgaaacttagaatgtaactattggtctaatgattgtgttttttgcaactcacatcagaagaagagaacaaaagcagattgtctcttcatgtgaatgacagtagtacattttcagcgtcttgttacagggctgtttacattctcctaccttgttttcatattatagtccagggcaccttgattatctttgaattattcagaatattactctgttgcactatactgaagattatcctaattgacctggtcagcaagaaagacaagtaatttagatgtcctattaagataaacatgccatatggtgggacataaatccacaaaagccctggaactgttatattaaaaatacctttggatttccaaatatctatggcatcctaagacatcccttctaagattaagaaaaacaccttatttcatcttataattcttattattaagggcaagtcctattacttggtgggcttttggatttttgagccaatatctattgtacctataaatactgaccaactgaagagggaagaaaatacctcaagcctatgtaacaattcacttggtgtgaaatgtttctgtgagccaaaagtgggctgatgtctcattgtttttcatctcagaggtggttctaaacaaagtggcaaatagaaatctttctggaaggtggagctgtgagctgtgcattcgttgttctctttttaggcatggtaaagtgaccagagttacaaatacacatcaactcttgaccagtggtgaatggtttgtctggttagtaaagagtctggtaaggacaagaatggaagttaaaaacaaggaacaaatcttgatgatgatttgctcatttctttgtgtctcatgttagtgtccaccagagggcacccactgcaaagaggcggtcaaccacctagctgttgaccagtagagaacaacctgtttggtgaatgtcagttttctttctttggccacaggagtgctagtgcaatgagcccatgaattgagtgtccatggcctcaggaatagtagtgaagcatggattcaacagcatgggctccctcaaagcagagaagatgacgtactgccactgctgattgcctagtccactggcaacagagaccaatcatgactacttaatatgacatcattcctcaaggagtccagccacactcttgatgattataatagacattatccactctaaagggaacagtgatttattcttatcagtactgaaaactactcagggtatagattattttttttctctgccagcaacaccatctgagaacagaatgcctaatctatcattatggtgagatatatgtgtgtgtgtggtgtgtgtgtgtgtgtatatatgtatatatgtcatatatgtatatatgtcatgtatatgtatatatgtcatgtatacgtatatatgtcatgtatacgtatatatgtcatgtgtacgtatatatgtcatgtatacgtatatatgtcatatatgtgtatgtgtgtgtcatatatgtgtatatgtgtcatatatgtgtatatgtgtcatatatgtgtgtatatgtgtcatatatatgtataagtgtcatatatgtgtacatatgtcatatatgtatatatgtcatatgtgtatatgtgtcgtatatgtatatatgtcatatatatgtatatgtgtcgtatatgtatatatgtcatatgtatatgtgtcatatatgtatatatgtcatatatgtatatgtgtcgtatatgtatatgtcatatatgtgtatatatgtcatatgtgtcatatatgtatatatgtcatatgtgtcatatatgtgtgtatacgatatatatgtcatatatgtgtgtatgatatatatgtcatatatatcatatatatacatatatataaaaaactaagatcaagggacccattttgtagcaaaggatgaatgacgatggatgaatgacaatggaattttcaacggttttatcatgtaccctgtcactcagaggcagccagtcaaaaataatgatggaataaactgttcaagattcaactaagttgagagttccaggaacataccctgcagagttaatgctcagtcctctagaatatgaaatatgctctaagcctgcatttaatatatatggttctgtgcatagtgggtggaagacatggatccaggaaatgacaggtaatggtaacattagtctttccatttgcagaattttggcctcccatccccatgagtcctacctcttctctttaactatcttattccaatagacccaaagaaaaagaaaaaagttaatatatgagtagatataattaacccataatgccataagaagcctatttgctgctacacagtggcatctggaagaagtatgtttgcagtgctggcaattcagtggagtatctcctaagatttactgtacagtaataattgtgaaagggcaaatacagcaatatagtttcactagggcaaagtatgcaatattatcatctcttcaaggaaaaatgtctggattactcaaatagataagcaacctggaaaagtaaaattagtagtgaagcatgaagaaagtctagatttggaagtaaagaaatgaaatgatggatatgaattacggcttaagacaagttcagtaagcttgtgaatttttttctctaagtctgttacccttaagtcattgcagggaatttggctgacacaattcagaatctgactttgttactgattggacttaaagaaggtcatgagtagatctgagtggttcaaaggaggaactatattctatgccttgtttttctgcatcatttcaaatattctcatcctgaccaaacattcaagctaatgcttcattcagcctaacataaatattacctgacagtgatccatttctcacaattctcatttcccatccagcagtttctctgatactgagtactcacacaaagctgactcttactcatataggtatgtactctagatgtgtagaagagttaatatcccacaggacaaactttgaccaatatgtggggtggccacacagtctcactggctcaggattgatttcagctataccagttttttcagttactattattaatactttctcctttcactctggttattgtcctgttttacataatggggtatatggtcaccttgttactaaggtatcggagccaatagatagatgcttcttccatgcttaattcaggtggaaagccctgagaggcatttgatacactttaaagatgtctctatactattgaacacgtattcctatatggtgttgaaaaactcaatacatccttttattggcttttccttgctccatttttaactcacactgtgattactgttttctgagatcacgttttgaaatgagtggctaacgtgacaaaaggcaaaaactctttgactgaagctccgctcttgggagaacccagactaagtcagcttggtttcaataagtgataatattgtatcgactagttatggttccatagaaaatcatttcaaaattcagtggcttaagacaagaagaattgatttctctcccatgtatacaagatggatgagggtaaggtcatctaggctgtgcttagttgggcagctctgatgtttactgagatctttggatcaacaggaatagctctgttccaagtacttttcatcctccatggattgcagtttagccaaagtgagtttttctatggtaatagcagaggtaacaagaaggtaagaagaaacacaaacgacaattaaagcctaggcttatagccagcacgttgtgacttctagtcacatgttattggtcaaagcaagtcacatgtttaagccccaaatcaaggggcagagaagtatactccatctatgatcaggcaatggcaagagtgtatgtgcagggaaaggtgaggaattgagactaataaatcaatctaccatatgattataaaagaaatatcagtatatttcctgtgaaagaaaagcctatgacgtatttctggtaatgatgctagtaggccaataggtaaattctatttaatgggaactaatgactctcatgttttctatgtctaaacatcaaagaaacacaacacaacaatttttacacttcataaattacaaacaaacaaaaatggaggagacagaaaagttatttaagagactacactcttgatgcatagtaagattttagagggtatggcttctgacctcttcattatgcctgggaaataagatacagtaataattattacatgtggaacatctctcaatcttcagagttgaaaaaaattagagtagaagaggaatagcattaatgaaatacatttattttcactggggcccaagcaatgtattctataatttagaaagatcacaatgggctttatggtaaaaaatacctctaaaataataagccttgcagagcaattggcactcattaaaattcagtgttggaagcagcaggtggcaggcagtttcatggaacaattttgcagtgtccttccagggttgaagcaaaacaattcatgtcataagataccaggtcttacccagtccccattttaagttgccgtaagtaacagttcctctatttttatatgaatagattcaaggatcttaaattgaatgtattacaatagctttctaaaatatacattttcctaccatgtggtagaaggtgaatatatgcatttcacttactattttccctttgaaaaggaatacgtttcacggcaaaatgttgttacttgtttttccagagggaagtgaaatttgaatatctgtaaaattacacatatgtggtataagtgaaaaaaattgttttgggggcaaaagactaaggaaattgttatcaccctcccttcaatgcactttttcctgagggaaagtaaacgttgatatgtgcagtggatttctcttcatgacactctaatccctaccactccctcaccaaaaaggaaaagaaaaggcaagagaaaaaaaaatgatttccatttcctgggaccatttaatattttctattctttaccaaagcaccgtggaggtttgagacaaataattacattcagaccattttcatgaaaacaagcagttctttgaagaatgtcggacttaactatctaattaattgttaaatcttggcagttatagcctaaaacgttacatatttaagagaaactttttactataccttcaacactagaaataaccataaaattatagcacttattttcgccttctatttgatataccaatggacatagcaggggactcttgacaagaggtttagaatacaaatgctggggttaggtggacttggattcacatccccgtttatctttttaccgttgtgtgatcttggcaaaaacctcaattgctagtcaaaggtgataggaatatctgcctcatagggttgttaccaggactaagtgagattttggatttggtgtctagctcacaggaagcactcagaagattatagaagattattcatattttggtaatattagaagtgtctgtggtgaatagaagaaaagtatgttatagaaaatatttttttaaacaatggttatttagaaaagttgtacataccaatgggcataacaaacaaaccaaagcaataaataacaccgagacaatattactcatgttggtatatgacagatctttaaaataattgtgcatgttcaataaattattatgtgttaatctttgcttttaatttatttggagaaaaaactgtcattacaggtttcttcacaacaaggcaattatttaagagcaatagtcaataatattttcctgtaggaggcagaagtagatcagggttttgtggagcctgaagtttatagcattttgaatgcccacttcaagagttggcagtgaagagcaacccaagtatttcactggaaagtatcaggaaaagtacagacattggatttttccccctctttggtaaggagagaagaggaaatagcagctataggaagaggctccccttggggccttgagggattaaaaaaaaaaaaaaaaaaaaaaaggcagtgcttcctggttcactgaagtggattttactggcaaagaaactttgccacagcattccttcagagaaattctacttgtgagcttctgcctaatgtcggcgtccgccaagtgatgcaattccactggaatgtgtgcaactgaactgttgggatcaatgcctttgcaaacctcagaaggaaaacatatattcagtacaaatgttagctgctacactaaatacaaatgggacaagctaccctataaaaagacaacgccaattttttttcagtcaagctgaatgatgtttataagaaaggcatctaaaacagtgagaaaaagtgttaatattctagtatatacaggaaaacaaaaaccagaaagaaaggagaaatgctgaaaataattcatgtcaaggagatgtaaacatatttaaaaggattcttaagatgttatataatcataaaaacaaaatccactagagatatttatatatgtagtgtgtatatgtgtgtgtgtgtttgtgtgtgtgtgtgtagcctttatcgatgaaacagtttagcagcagaatatatagtacaaagcttcttgaaagataattgctccatttgaaaaatatttctgggaaatatttaagataccgctcacagaacttgacatgtcaagtagacaaaatgtgagaaagagtatagcgatttgaataataaaacaatattagtctagattcttgagtcaagctgcttaggttttattcttcccccactgtcacccagttggatgttcttgggcaatttagttaaactttttatgttccaattttcttgttggttagattttgcaaataatatcaaacccatcaggttgttataaggattgaataaattgctaatgccaatgtaatgctgaagacactacctgacacataatttgagttatagaagttgcctatcaatatgttcatcatcgtcttcatcattgtccagaaaaaatataaatgaataaaactaactcagatctataagaaactaaaatgtctaaacataaattgagattagagaggtgattgtttcactaaaatcaataataataataatgtacacaacaatattttggtagaatgatagacttattgattttattttttcaaagcctttaagagaatctacagtctgtcatcatttaattcattaaaaatcaactttattgaggtatactttacatgaaatgacatatacccatttgtctaggttgataagatttgtccaatacatatacccttgtaatcactgccacaatcaaaaacagaatgtttttattacccgaaacattccctgttgcccatttgcaatttatctctttctccttatccctaaacaaacattctgttttctgtcagtatagaattgcttttttttttttgatatctttctcttagcataatagctgtggaattaatccaagttgtgaatatcagtaatttctggctttttattgctaacttgtattacaattatgcattcaccacaatttgtttatccattaacctgttgatggacatcagtgttgtttccaacttttggctgttataaaaaaaatttgctataaaatttccttgcaaaaatttctgtggacatatgctttcatttcttttgggtgaatacataagagcggggtttctcagtaatattactttaagagtgccagcttgttttacgaagtaattgtagcactttatatttctaccagcaaggtatgagttccaattgtcccacatactcaaaatcttttggaattttcaatgtttttattttattttattttattattattatcattattattttgagatggtgctcactctgttgtccaggctggtgcacagtggcacaaacacggcttaccacagcctccatctcccgggctcaggtgatgctcccaccttaacctcctgactagctaggactacaggcacctgtcaccacgcctggctaattttttgtatttgttgtagagatggggtttcaccatgttgcccaggttggtctcaagctcctgggcttcagctgtctgcccaccgtgtcctcccaaaatgctagcattacagctgtgagccaccagtcccagactgaattttcagtggttttcatttgagcctgtttgattagtgtctagtagctgtgtcttgcggttttgattggcatttttaaaataatgatgttgagcatcattttaatgggcttaaatgtcatttggatatctttgctaaaaatgttcatttttttttcattttctaatgggttgcttatttttttgttattgaggtgtaaaaatttcttaatgatatatttcaaaaatcagtctttttaaatttaatgaagtccaatatttctatttattctttatgttctgtgtttttatgtgtgtgtatgcacatgagttttaagaaatctttgcttaatcctaggactcatacattttctttcagaagtttttttttttttcaacttttattttaagttcggggtacatgtgcaggatacgcaggttttacgtaggtaaacgagtgccatggtggtttactgcacagatcatcacatcacctgggtattaagcccaacattcattagctattcttcctgatactctccctcctcccacccgccacgatgggtaccaagatgtgtgttgttccccctccatgtgtccatgtgttctcatcatgcagctcccacttataagtgagaatatgtggtgtttggttttcttccagaaaatttaatgctgtacctttaagtgtgtgacctatttcacgttagctttttgtgtgtggtacgaggtaaggattaaggttaacttttttacaaatgaatattcatttgttcaagcaccatttcttgaattatgatgcctttatcattgaattacctgataactctgtctaaaatccattcacctaaaatcggcacatatccattagcacaatatccattgaattacctgatacctttgtctaaaatccactgtatatgtgctgatctgtttttgaacacttaattatgttttgttgacctatcctgccaacatcacaccgtctttatcgctctattactagtagtaaattgtaaaaatcacaggatatgtctgccaactttgtttatcattcgattttactttcttggttaattttattgctacataaattttagcctcatttgatgattgctacaagaaaatctcctgatattttcactgagattattttaaagctaaaaacctattgggagataattgacttcttaaaaatattgagtgtttttgacccatgaatgtggcatatttctttacttatttaggtcttaattaattttccttagtaattctgtgtagcctgtagtgtacagaccttgttttagatccttgatacccacacctcctcccccagtgtttaaaaattaataaaatgagaagatatcagcaaagggatctgagaaggagcaggtagtaaacgagaagaaaatttaagaaattaagcaaaagcaatgcttaaaggaggagtacttggtaaactgtattacttgtgagtgatacatcaagtaaaattaggactaagttgaccattgcattattctatgcgtaatttaatattgactatgaccagaaacacttatgtggaacagtggggacaaaagactaatcaaagcagattcaagataaaatgagaaaagatgaatggagacagtaagtacagagaattccttcaaggtgttttactataaacagaagcaaggaaatgcagtagtagacagaggaagacggtatgttaaaggggtgctgatttttaaaatgggccaactagcagcaaatctctttgttgtgatgctacagaaggtagggagagttgatgattccacagagagagacaagtgggtagaatggtcccttgagtagaagactatctaaagcacaggtggatggcttggtctaaggagggagcacggttcacctcaagtaacaagatgaagggagagtctgtggtcacaggggccaagtatgtgactagatgtagtgacaggagcttattgaagttttcttctggttcttattcctttttgggtaaaatagaaagcaaagcaatcagctgtccttgaatatgagtcagactgttggagatttgagtaaagggatattctttaagcttgaatgaatttctttccacaaaaaaaaaataaagcctactacataatgattatttttcttaaaactctgcagaaaaagtcatcttggcatttttacaaataaaatatatttttattcctacagagcaagaaatacttctattttttttaaaaaaaaaaaaaagaggcaataaaaacagatattctttctataaaattattagtctagtttgccttcttatgaattgggagaaacaatagggtagcccattttgagtttaccttgtgttaggaagcatcatctcctttctaaagcctcttataatgttggttagaccctgtgaagaaatccataggacatagtcataaaatgtagtcatagaaaccttcttgctcatcagatgaaagtaaactgaggccaagaaatatcttttgacttatttccatttgatttggggatttcattttctcagtatccacttactttaagatgctaagagtataatttctttgtatgccaacatgaaaataagtccaaactatcattcttttctcatgttatagttatgtttgtatgcactagagtctcagtgtgcatgtatgtgtaattcctattccttagttttcatccttcaagcagttagtcccttcaaaacccgatgacaagacccaaacatattaaaaagtttagttggagggcccagggtgaaacacaaaaacaattcttcttcttacagagctcttaggcaaacacatagacacttgttctctgcctctggaattacaaatatgttactcggaaagcagcaatactcttttggacttgtttgacttcactttctttacctgtctttaagaagcctcatacacacatttaaaaaatacaacttataaaggttttagtgatagtgcatacaatcatttgattttatttcccttttctcttcaccttcactaataggagttactggcatgcttcaaaaagcttacatttgaatactgtctaaatcagtgcagacccttgaccagcttaatctttgcttgcaaatgacaatgcagtgaaaccagaggaagaaaaaaattacttcctttcctgttggaaacctaataagtagttagtctgacccagttttcaataagagagattttctgatgacccgacaggagtgactatctccagtcaaagaaagaggagggtgaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtaagatctgtaagtacaaaattgtgctgtgtctgctgcaatgagaatattgctgggcaagctgcagcttttcttcctttcaatgtctttgtattagcataacaggtaaaagctggggttgggggagaagtcactgctttattgatgctgtgtttctatgatgctgatgtttaaaatgcatttattccttgtgtgggagaaatgtattgaatctgtattccgggaggttaggatcaaaccagggaaagaaagactacaggtatatttctcagtgtttcactagtctttgctgcagtaaaactaatgggcaagacgggatgacagtgctaattctgggactttcagatggctacacgccctttctgtaacggcagatgggaaaatgtgatcgctaaatgttttttgtcttttttttttttttaatcaaagggatgaggggtggggtttgcagttctcaccggatgatttaaaagaatggttataaagtttcctaggggagaatttggtaaggggagcaaagcaagactggaggtcatatgggctcaccaaattttgtctggcattttgctttatacccagcttctagataacagcctctggagtttcctttaccatttacaccagttaagttgtcagtattaaggttcttataatactttatgaaaactttcagaagttgatgacttgggaacaaaacttttaagagctctgagattagccacgtataacccattatgttaatgggatactgtaacattggggtttggggggaaaattggaattcatagtttttgcttctccaaatgaaaactacttatgtttaaataatcagcatcctgactatgtcctctgagaaacattcacagaatgactaaatagaagttatactgagaaaaaatagagtgaacagtagaatcacacagaatcaatttggaaaatgaggtattcataattttatctacagtggcaatgttttctgaagatgtctgtaaaagaagaagcatatgctgaatattgaattgcttgttttgagcaattttcatttatctgatgggtttatcatctttttatttttgttgttgaaggtttcaccaatttatgtgcattgtattttataaggaaagaaatgtttaagcagactctttttccctcctccttcacacacatgtgtaaacatacgcatgttcacaaaacaaacataaacatacaaaaatacttacacaatttgtgtaaaaaaaaagaaatacagaagcatttcatctttgatgtttcagtggggtttctttttctttttttaagcaataatcatggctgtgcagtccaaagatttcaaatatataaatgtggaaacttttatataaagctttatgtgaggttatataaatgcataacttatcacatcttagcaaaaaagtcaatcatttataaatgacttcattgcattacttcctttgaatatttgtagtgaaggaccagaatttttttttagaatttttatgtagctttccttaatgaaaacaaattcacttgtttacttagaaaaggatcacatattttctctgagtttagaaccccctctaaaaaaaatcaattatgttgtgaaaaggatgtgtggtatattaaattgattgcatacttctgggttttttttttagtaagtaaaaatgctcagtagtataatagtaaatttgtaccttttaaattcttttatgtgaggagaaggaatacaaaatatttgcttatttattcactgtttattttaataacatattaattggaatgcagaagtataagttctacctattaaaaatgactcaaactatacataaaagttcaaaagggaaaacccatcacctgtaaataacaatcatgaaatttggcgactatcattggagacatactggtgcctaaattcagataagatgagagataaatacttttgtaagaatggtttcttactatacaccttttaaaaaataaataataaatatttagataatatagtcaataatagatactcttctgtaagaatgagatcttatcctacacttaaaaaaaaacagaaatattggccgcgcgcggtggttcacacctataatcccagcactttgggaggccgaggcgggcggatcacgaggtcaagagattgagaccatcctggccaacatggtgaaaccccatttctactaaaaatacaaaaattagctgggcgttttggcgtgtgcctgtagtcacagctactcaggaagctgaggcaggagaatcacttgaccccgggaggcggagcttgcagtgagcagagatcgcgccattgccctccagcctgggtgacagagtgaaactccatctcaaacaaacaaacaaacaaacagaaaacagaaaacagaaacattgagtttaatttttgattttagattttaattaaactgaaaaaagagaagttgaaacaacattgaagaaattgttaaatttcatgtatagatttctctccaatggagatattatgtccagaataatacccttacagttaagaccaaaaattttgaaaatagaaatagtttgaagatttttttggatgcacgtttaaatagtaaacaaacttttataacccttgttatgatagttaaatgcatttgcaatgtgacttgtcatcaactccacccataccacctcaatttaaactacatcagttttacattactgagtacatacattctggctgaattcccatggtctcagtttaaacttatttcaaatttgtaaggaattatcctttatcaacaggcttttactacccaattcaccatttctgtgttctttattttcaattattttttgggttgttagatttcagtaagtagtacctctccaccaaagaaatagtcataggtgctatattttctatgagtttgcatcttgaacatgtatttcttttgccttagacatgcaagatacgttatctttcttggatcaagcttaattttttcttttggaaatgtgtaaatgtttaaacatttttggagacccttcctgtactgaaagttgttttgcaacatttttaggtctgtctgcaatttccgtcattgaatgtgacttgctttttttctgataaatgcctacatgattcttttgttgtgtgtgtgtgtgtgagtgtgtgtatgggtgtttgcttttacagaatattcctggatttgttccattttcattaactttttttgaggtttgccccattaatttaagattcttttattttaggatttgttgtactatttcttttttgtcccttaactgggcgtggccaaattgtggttatcttgcttctttcttttcttcaggatcaccaattttgtacatgttgtatctcatttgtctactttccacatctttcatatccaaatttcttttcaattttaattgacaaattggttatcttctttatttgagaaccacttgttctcttgtttgccacttgaatgaatagtatagcttgcaataaacctattaaggcacaaccttctgtattgtgatcttgtaaatacatgtttccttctcttaacactctagcaatttcctcagctggcaggtttttgggcaatctgtatcctcctgaaagtaagagaaaaagaaagtactgatcggttttctctgatgtcccccaaaggtccatgatttttagtatttggctacagtggaaatgggcttcaagtcgtgttttggggttttgtccactaacattttcactgaagacggagggtttttgcttcgttttttatctgcaccacgaccactgccaccttttatatttctctttattgtttctgtgggacaatagaggacatttaaaaatctctttatttaaggagttttaaatagcaatctttcagtttggaggaattctttgaatgaaaattttattagaatgttgttattctcagtattcatattgaaaagagctgttctagttaagactgagttcatctgcatgatgtgttgtagtattaaacatttattacggtaaaggcgtaacacaggacatagtagaggaaaaacagagccattgggcatgccttctgataatgtcccctattagtttatattgatgaagtctgtggcctacttaactattttgcaatgagtcctaaggtaatttacagaaacgttacatcatagtaacatgaatcaaaatctgtagactcaaatcctttttgaaagtatactgagtagaaaacttatatgtattaggtttacaattaaatgaataaatgaatgaataaataactgaatttccctatatttcaaatccttaaaagaggcaataaaagaacatgatgtgtcgtatgaagtattataaaaaacgaatgatcttactaaaaagcaaatagcaatttctcagtgtcaataaaatgatagtgagagcaagattcaggaggcaagctcttgagctgaagtgccgcccattgtagatttccttccctatatctagcacagaatagctctgtggtcttaggcaagtttcttagcctctttgtacttcagtttccccattcatagtggagataatattagtattgactttacagtattttcaagagaattcagcaggtaaatatgtaaaaaatcttggaagaaagcctggcaattaagaagcactctatgtgttagttgtttagttattgttatattattattgctattataacatttatatatgagccttaggatcaattgggtaaaaataatataaaacaatgaaaagactaaaattataattatcatctaatcaattgtattgggtatttaatagagaattaaatttggagtgtaaatcataagtggatattaaaatagagctcaggaaaaatggtgagaagatatagagatgctggtctctggatccaactagattaaaaatagaaatggtatttctgtatacaccaagcaattggacatgatcaagaaaaagggtatatttgcgggggggggagggatagcattgggagatatacctaatgctagatgacgagttagtgggtgcagtgcaccagcatgtcacatgtatacatatgtaactaacctgcacattgtgcacatgtaccctaaaacttaaagtataataatactaataataaaataaaaataaaaaaaagagaaagggtatatttgattttttgattataaaagcaatgaacagaaaagcacgagaacaaataagccagaatttctttcttcaaagaaaaacatcacaaatacttgtacatttctttcctgttgttttatgttgttgttgttctttttttatgataatgccttaatcaagtaatgtatgcacctggaaacaacaacaataaaatttgaaattatagagaaaacaataaaataaaaaataaagacctttccatgatttcctgtcttatttcacagagatattttctatagtttattttattgtaatgttttccttctggccaccattatacatttgaataatatatttgacttctattgcagaatctataaactcaacatcatgtctgctgactccatttttttaaagatgggcagtttttcctattttcacactttcacaagacaattttaggtgttacataagtctttgaattcttttggcagtaatgcacacacacacacacacacacacacacacacacatatatatatatatatatatatatatatagtgggaaattttaagtattcaggtaaggattaaatttaataatgaccaattcccacccccagaattaccaaatgctaaattttattggagatttaacatcttcagtattcataaaatgaaaatactaatacaatatataataagggcctacgttgtaactctacctagtccattcctcattctacattaccatgaattgtatatttacatataattgttatatatgtatgcctatataaaatattattttaaaatattatggaaatagtatattgaaagcaaacttatttaacttgtgtaactcattccatattagactatttagactcattcttataaataaacacatttcgccgggctcagtggctcacgcctgtaatcccagcactttgggaggccgaggcgggcggatcacgaggtcaggagatcgagaccatcctggctaacacggtgaaaccccgtctctaccaaaaatacaaaaaattagcagggtgtggtggcgggcgcctgtagtcccagctactggggaggctgaggcgggagaatggcgggaacccggggggcggagcttgcagtgagccgagattgagccattacactccagcctgggtgacagagccagactctgtctcaaaaaattaattaattaatttaaataaataaatacagttctaggatatatttcaccttatgtgttttatattcttattattcattcccttattgagggatatttaatttattgaaaatattcactattgcagtgttctattatcacatacattgaaaacttatacacattaagtgagattttcattaagaatatcaagtccgtgctgcatgtcaacaatttcatgtttgttatttctggtctcagaattcctatgtttcaacaaatgtacttaattcatccgcacctactatgatgttgatgaagttggacttatttcttacttcttacttcatattcaaccaaagtgttttttagtaaacagtcttttattggtttgaggaaatattctttattcattttttcaacttttattagttaaaaatggtatactccctttatcgtattttagtaaataactattttaacataaaatgtacttttatattttcaaataaagactaaagatagtgtatatatcttcttcataaacaggacaatgacttgtttaaatttactctgagatatttctcccagtgctcatatttgcactatttatttttaaactgcccccaatatttttgtcaaggtttttttagacttatgacgtgatttcctgagttctttatttaccatattcttgctatttatgtgcatctcctagattctcttcttgtgctctgaagaccattttaaggtcattcaaaaattgttttaaactcccttaaaatttatttgttgaaaatcgcttatgttagtcacattctaaaataatactgtagttcatcagagcactctatgtggaagatacttttctctcaacaatttttgcatattctgttccatgatcttctggaatataattttgctcatgaggggactgtttatgatgtaattatcacacttttgaataaatattcgtcttttcactcggacagattttaagaatttctctttgtcattgatttcttcaagttcactgcaatgtatgtagttgtggagttgtttcaaatttatctcatttaggcctctgcaagctcctaaatctttcttccattctgaaaaattctcagctattatatatttcaatcttgcgtcttttaaatccctttattttctccttcaggaatgctcattcattatttctaggcttctgtctttgatttctttgcatttctttcattttctagtgttgcagtcagtgtaatttctaccaatctgtattttatacttttattttttaaaaaacagttttaatttctataatttatattgctcttttaaaaattatcctgctattctgcttgttcttaatagtttctctcccattcttaagctctcaaaaaaatttcagtaagtttattttagattgtgattgttttactattttaatttttagagtcaaatttctttattacttatgtctgctggatttccctcatggtggttcattcttcctggtgctcataatttttttatgacaaattcaccttcaacagatgttgttttctatgggagaccaaccttgtttgagttgtgtatgcttttgcatagcatcgcattgctattgattctacagtggctctacaaatatctctggttctggactattttatatgtgaattttttggcttcaaattatattaccatatagacagaatgaatttgggccctacaaccaagcatagtacacattctgggttctgattgcctttttcggattcttttttctaccagatcaccaagtttccataaggtcagctatgtaatgcaaaggacccctttttgggaggttattccaactttacaatctccttgccagtctgagtttctctccatttggtgcctctgagggcttacctctttaacatttaacctcggctatgtgtacttcttaaagagttttatacttacatagcatttacatgtgtttgtagtggaaaagaaatccctcttcacgttgcatggtgccgtgtacttccctatacttccatgttggctggacttgttcccatccgctttccatcatttagaaagtcatcaaactctcacttgctggtattttatttttatcaggtactcttatggtttcatggagttattttgtaataggcaatggaacatttgctaatttttttctggaaacattgtcaagtctcaggtatataatctaataagaaatggttaatgtcaattgtatatgtctttccattggctccacaaacattactgtaacaaattaaagtgcttgttttagtccaatgacagaatatgttagggagctctagaatttagttagaaaagcaagccagtggatgttattagtttatatattctttgggagtggcagctctattaattccttaagtttaatggtatgcaaattcttaaaatctagaggcaattattcaaaaactttgttagcacagcaattcctagtgacacagtacaagctgaatgctaaacggaccatatttttaagatgatttctgctgaataaaagtgagaatattggatgggtccttttaaaatccttttttaaaagtcttcttttaaggcgggaaggagagatcaaataagatatttggtgaagtttctagtaatttatcattcatgcatgtaagaggccaacatgaatgagctctcaaaagaatgtagacattttattttcaatgccttttttgcatattgtttcaaggtttatttggtttcccatatttgtatgtctaatgtggttgtgtaaggagctctatatggagaccgctgagctatctttctaaatagcaggagtgcaatatacttgctggaatagagcttttagtgaaagaacatgattttcctctctggcatctatcagggtctcccaatcactaaagcacagtaaatgaaagagaaactcagaaatcaggtgtgccgctaattttctatcaacagagttaagaataaattaagaacagtcctgccgggcgcggtggctcccgcctgtaatcccagcactttgggaggccgaggtgggcggatcaccaggtcaggagatcgagaccatcctggctaacacggtgaaaccccgtctctactaaaaatacaaaaatgagccgggcgtggtggcggcgcctgtagtcccagctactcgggaggctgaggcaggagaatggcgggaacccggggggcggagcttgcagtgagcagagatggcgccaccgccctccagcctgggcgacagggcgagactccgtctcaaaaaataaataaatacataaataagaaatagacatgcattaaaataataggtaggctatataatacacagaaaacatttatacaaaattaatgtccaggccgggagctgtggctcacgcctgtaatcccagcacttttggaggccgaggcgggcggatcacgagatcaggagatcgagaccatcctggctaacacggtgaaaccccgtctctaccaaaaatacaagaaattagccgggcgtggtggcggcgcctgtggtcccagctactcgggaggctgaggcaggagaatggcgggaacccgggaggcggagcttgcagtgagccaagatggcgccaccgcactccagcctgggcgacagagccagactccgtctcaaaaaataaaaataaaaaaaaaagaaagtccttaaagttgtgctgagatgaaaaagtttctgttattctagacttgatagaacacacttgtttaaagtggaacatgaaggtgttttctaggcatttaatgtcgttagtcaattcctaaacatgctcagttgtgaatctgtgttgctgacaggtagaattttgacagccctatatataaatttaccacaaaagtatatgctgaaaatggttctattagaattagccggtgcttataaaatataattttttcagagttgccgactttccttttttgttgtccctttgtgcagactgtgcctatgcggtttgtagaaaagagaaggaagttttctatctgctttctttagggcacttaggtggcaaaagtattatttttactgacttcactcttattctgtcttttgtcatgcagatgtacggagtgattttgcaataaacagaaacaactttctcatagaaaaagagagactggagtttaaaggaaaataatctattcgttatgcgtagttcaacataggaagccaaacagcagtttttaagaaattacacacacaagacacaatgcctgagccaattgcttttaccattagggggctccttttacttatgaggcaaaagtcatttttccaaagaaacatggaacaaaaattcattttctgccagtgaagtttcaagattcacatatatctttaggtatccaaaaataatgttagtctttgagtattagcccccggatgttattttcttttatgattttttttctacatgaaacggtcttcaattcgtacaaaaattctagttaattctgataaataatttaacgtactaaattaccaatattaataatatttttattcaacaatatatattagtaataattccacaaatattggctgaatacttactatgtaatagatgctatttcaggcactagtgatgcaactatgaacaagacagagaagagttctgctcctgtaaaattcacatctgatgcgtattcttgaattcaatgaagtatacaactctaccaggtggaaaggggggctaacattgttaattttcggtctcacctgacaaatgagcattagaagccattaaattatttaattccaagatgattattttagtaaagtaaacttgcatagtgagatgcaccaaaaagactaaataaaaagaaacatatatttactaagaataataattattcctctgtttttatagagagtgagatattctgggtttttcagaggattaacaaaaataggatctcacattatacacatgtttatggaatttcctaatcacagacccaactctttccctgaaaggtattcattttcgtcaagtgaatagtaccagtggatttactaagaaggtaaaatttgttcaaaatttgcaaactacactaaattattgaataaccttggtaaattagtacgtatataacaagtgaaggaaaattaataaccaacagaatatcatttaatacatttttccagttataaaatcatatatgtttattattacaaaatttggagaagacaaaatatgcatagattgttattctattactctgcatgtggcatcctttcagtcatcttgtatatgtgtgtacgtgtgtgcgtgtgtgtgcatttaaaatacaaaattgaaattaatgcatatgttctgctttatagcttgtttttattaattaacatcttataaacattctcaagtatcattaaatattctcctaatgctgaaggatttttcaccagatgggtgttccctttttactcaaaccaataacctattgttagatatttatcttttacacaatttattgaacaatgctatggtacatatccttgtacctgaatcttttaatatgtgtctgattatttcttaaaaacaaattcctagtagtacaatttgcatgtcaaattgtgggtttttaaaaatgtgagtgtgtatattactaaattgtcctttaggaagacaactccctctgtacttgcaggcaggtgagtgctctttgtgaccatccttgttaatactaaatattattaattgtaaatactctccgattggattacaaaacaaatacacagataacagtatttcagtattgctctatattacattttttggaaaatgcatgcctgaatgaatatttcatgagtgtttgaaccattcatatctgctcattttgctgaagtcagcctctgtcctttgtttattcttttgatattttacattttttcttatgctcaggaagttcatcagatatcggtgagataacttgtaattttcacttttcttcaagtttataagacatttaacttattacattttaagtgtgaaaccttgaaaaatgttttataaattatttgaacctcagttttcaaatgtacacagtgcagccggtaatacctgacctggctttcacaaactcagaatggtcagataaaaactgaaatagttaatgtttctaaatgtatttttatagctacaagtgatataaagttattgttctagtcttattaaagataaatcagtgtttgtccctaattgcacatctggtcataagcaagtctacaacttaaagtttcctaaatataggtccagtgttatcaactttttacctccggcacctagcattgtctggcctgtggtgtgtgatcattaagtgcctgcttaatgaatgtagattctaagtatactagagaaacataaattaaatacatctgtgctcattccaagtatgctattacagtgtcatctaaatctaatggtgaacaaaatagcacatattaagatgatattaatgttaaacttcaatttatgcctctgcccttggtaaccatgataatccactccatgatgaagcagtcaggaaatgtaagtagttatttatttcatcactacaaattgtatttgagacctgtgttttggaggtaatctatattgtgggctcttcaggaatttggtatgttaggaaaattcaggactgcataaggggaacaggaataggtttgagggtaaaaggaaattgtaatcatccctgaattaaaaaataatttatatgttacagacaggtaaagtatacacaaggtgtgtgatattttcttcttcaaaaaccctccccaaatgtgagatatataacttgcttttccagatagtcagaacaagaaagaacttcttatttttgttttagcttgcatttacgttgccataacacattatgttaatatttgatgttatttgactttggcagaacataatgaaataaggtgtttgactttgccaaagagagtttttggaacaaacctgtgtttgatttagatctgaggccaggtgttcaagacgagcctaggcaacaaagtgagacccctgtctgtaatacacacacacacacacacacacgcacaatctctctctctctcaaactttggcatatttagtaataaatattaaagccatgaaacaaacatattttacttatagcttagaataatcacctttataaatttcttaagtgatttgtagtacactgtggacttgactgttacttttatatcaggttataagtaatgttggctagacgtctatccaatgaactttccctttcacttcacatattctctgggctcatggttagccagaacaatttagaagccaaaaacataaccaaaattatcacatgtatttttactgcatggtgggattattttgttttattgacatatatcattttggtcaataataataataacaataaaacagcgttgagttactcaaatattagttggggctcttcagagaaatagaacgaatagtgccacattatctatctatctatctctctaaatatatgaattttccctttctccattttctgttttattaagggtctcaatggattacatgatacctacattggaaatggtaatctactttactgagtcccctgactcaaatgctagttttatctggaaacaccctcacagacacgtccaaaatattatttaatatgggcaaaccatagcctagtcaagttgacacataaatgtaatgatcacaatgatactagtaagagaaattcagttgaccttgctgataaataggtatttttcacacaaaagccagaaaatgatcataaaatatgtcatatggtttaaaattataattgttgagtacccatttcaaaatatgattgttcatttgaagaataaattttaagttggttcaattctatagataattatgacatgactgaatatttattcatggcaaatccaagagcattcatttgcaattgccattcatgtagatgtcaaagatgccactttttattgcacatattgtgagagggtaaaacaaataacctttcctccttaaaattagattgctcattaaatgtgtcattaatcatattttagactccaaaagatcaaagtaaaatggctctgaattttaaattttccagggtgacaaaagctgaacagtttattaatgtttgaccatgctccaggtgtggtggctaatttctgaagatgatgttcctctcctttcaattgcctttcagctctcatggtaggtgctaatgtgtataattagcatgatttcagagttgtgacctgaacgacagaccaatatctataagggttgtggtccagccaggttagaataataccaaattgatatgcaattaattgagcttgcaaagaggttactgaaaggagttaggtctaaattgcagtttcaaaataaatcacccgaaattatttaagagtataactgggactccccaaaagttacctccatctgaaaggtttagatttggaatctccagttgtgatgataaatataattataattaaggctctgggtgttaatgtcagtgttatgcagaaaattaccctagacatagatagctcccagcatctacatcccgttttcaattttatttctaataaaaaaatttaatccatttgaggtgacaaaattccttagagaataaatgttttttaaccttgggtagtagaataaaatatagagacaatgacatatatcaaactcatggtattagaagttgtgtatcccttatccaaaatgcttgagaccaaaaatgttttagagtttgaaattttctgaattttggaatattcgcatatatataatgagatatcttggggattgggacccaagtgtaaaaacaaaattcatttgtattttatataagctttatacatataacctgaatgcatttctatatggtatttttaataattttgagcaggaaacaaagttttgactacattttgactgtgatgtgtcacatgaggtcaggtgtggaatttttcagtttggagtcctgttggtgctcaaaaaattgtagatcttgaagcgtttcagattttggatattgagctcttgagtgctcaaactgtaatatcattgagctgtttagaattaagtttgtattaattagaatagtttctacatgtttggtgtaaaaagtgcttgttatatttaaggctctaaggagtctttgccagatttgatttgtatttgcacttttaattttgtaaataaataactgattttagacttacccgtttaagttgaaaagtactgtatataaaaattaactaactttttagaaaaagttttgaaatatttaaaagaagttaagatttactattttgtaagggtaaatacaagaattaaattcttaggtttttcttgttaaggacctactgttgatttgtcagactgtttagacactttaagagaacataataattcaattttagaattaccatttaaaatatttaaagcaattgtagtaaagtaagtcaaaagtcctgattgtttatgtgtgtttagtctgttcaacatgaaataattgaattttaattgtggcaaaagagaagaaagtttttcttgttttaataagattataaaaagaataacagacatataaatgaggctaaaaattttaagggggaaacagcgtttgcatttgaaattataataaatttgatattatgatccccgatgagcactggggctctaaggggattcaagggacttgcccgagactacagagcaggaattcacatacagattttcatatacgaatgcagtggctgtggtttccacattcattctcaaaaactcaatgtacctttttggagatgcatgcaaaattgtagaggaaaagaaagtaatatttagaatatagtttctaatcttttattgttaatcttcttgtttacaatttaccaaggcaaaaaagaaacacttttaaaatgtcaaaataatataaatattatctaccattgtttttctattcccagtttaatagacaagtttctctgtgtggcaataatttttaactctaaacagagccagtagctcctctattactttggactttttaaaagatatagttattttgagtttgcattcacacatattctaacttagaacacacaaaaatttacattatttattttctcttaacatatttgcaaagatttagttatatctgcaaaaatgatatattttttattcttctatttttacccaagttgttgatgatcttctgagatccatctgaacagaaaaggaagagacacatacttctatttatatacacactcatattttgtgtgtgtatacaaccttattagcttcttgacaaagaaactaaagagatttaatttttaaatgcttcttcccatactctatccttttattataatttttaagtctttaattatttttacatatctcttctatatacaggtctttatagctgggtccctactgctgactcagttttgaactacccatcgatcttatcttaaaattgttgtctagttagtggagcatttatttatcagcttttccatttgcttgaatattttacatggccaaatatatatctgaccaatgtccttctttaggaacagtgctttatgtttttcacatctgatatttacatcaggtgcattcaaaaggcagtgaaccaagtcctataaaaacagatagaagaatcacttttaagtattaatgtcagaagaagagaattgctttttgatttaggaaatgtaaatagtcaatcttattaaaagattgactttaaaacatatccaactctgctaaacaatggaagaatctaatctttttttgattgaagaaaccacataaaacaggtataccatcatggggaaggtaggtactttctgtattactgtcaaaagacaaaaattgcctcttgacttaggattccataaacttttatggaggtgtgcatggctggaagacatcaataccatgcattgttccttggatggtgggctaggcacatattctaacctttgaacatttctaaaatagtatctttcaaagctggcaaatttggggaaaaagaaattccttatacagacgaagcttgaaggaaggtgatgtatgttgtaatgggtttgctaagattttcacttaatattcagcagccctgagaagttttcttatcttctactctaagtcagtactttgaaaaaaaaaatatgaggagcaggtttgacaatgttgtcaggattgtgattgagatgaagctagaacgatgtgcagttgaagtcctcccaggtcctgattcaaatctacatctgatttcatgacctctgctgcattcctctgtcatgagaagagcagggactcttagtccgatgacagaatcaaccttaccctttggttaattagaaggggcagtagtaaagaactcgaattttagagccaggcacacctggatttgaatacttgtcagatgaaccacttactacatgattggccagagacatacactttgatttcactggcctcatttttcctatgtgtaaaattgagaaataatagttgtcccacctcatatgattgtatggaggattaagtgagattattgaatctaaaagtcttagcacaatgtctgacatacagcaactagtagtgaatttcagccagtgtagcattattgaaattattatgaataagggactattgtagatgttatgcggaaagcagtagtcccctggggccatatagtgaaccccagtgctatttagctcatttctattgtctacgcattatatacagttcaaattagtaacaatcacaacaagaacaaccatcaattgatatagtttcaggcactttctttagtactttaggctaacgtatttaattctcataaaaacctcaaaggatatgtggtatcattccccatcttatagaaaagtaaaatgagattcagagatgtaaagtaaatcggttaaatagaaaaaacagttgttagattgtagagtcagaattcaaaaccaggcaggcttttgccaaaattaacgcattttaccaccacattcttaattcccaaacagagcaccaagcaccctaggatgcaacagtgaactcagagaaggatcataggatgtaattaaatattctggtgaaacagtgatgctcaacatctgtcaattactgagtgtgaggtagtttcatttcaacacatatcttattatatttctttcaatatcatatatttattaaagctgggtttccagcggatgttgtggtaaaaaggaaatactgtgtgaaatcagtgtagaacaggaaatgaggctgggcaatcttattccaagttttgaaaagttgtgccgtgcccagtggtagtatgcttgttgtaagtagaagtgggtacttaagaataaaataagaatgctatttttcctctaatatatacatattatatttttaaagcatcctgtaagtcacttgaatataacttctttgagccaaaatacttaaaaatggaactattatgtagttattttgccctaggggtgccataaaaatgattgatccactaaggagatcatgatacgaataagctggggaacctctgaactatattattcagtttatcagggaaatatgtaaaacttaaggatcagttcatcaaacctcattaaccacctgttacttctcaagtacttagagattcctttctaaaagagctcacagcatagtaagaaagatagacactgtgttagtcagggtcctccagagagacagaatcagttaagtatgtgtatagctattatgacagaagtttattagaaaaattgagactctcgattatgcagactgaaaagtcccaggacaggccttttgcaagatggagcccttgggatgctggtagcctggctcagtctaagttcaaatgcccccaaaccagggaagcccatggtttaactcagtccaaagccaaaaacctgagaacctggagtgcttctgtgtaactccaaaagctggagtttcaatgtcggaggcaggagactagtgtagcccagctctggaggcagagaccaattcaccttttctgtttttgttccatccaggcccccagctgataggattgtgcccacccactttgaggacagatcttccccttagttcactcagactcacatgctaatttcttctggaaatgtccttgcagacacgcccaaaaataatgcttcactagttccctaggtattatttaatccgatcagattgatccctaaaattaaccatcacagacacaacgtgcatactgaaatatagtgtgtgaaccaaatttccaaggggccagactcccaggcaggtcacataaatattcaaaaggccatagcattaagaagtgagaggaagttgtattggggagaaaagcaaacataagaaattttccagaagagatgaatgaaagaggtccaaatgcatgctatttatagaataatgagtatggtaataatggagcccccactaattacactatcacttattaaatacttgttacgttccaggcaatgcattaggcactgggttgtagagatgaaagtcagagtgactttcctcaggctctgacgtctcttgaggagtctgacaagaaaaaagtacattcaggcaaatgataagagatgagactggaaagcatggctgtggtagaagtaatatattgcctgtaacttctaaagaggccagggacttttagaataattaacacaaggtctaattactttggattaactagtaaccaaatgcattcacaaatattgatgttattcaaatttgcttcatcttactaaaaaagatgctgtatttgtgtattcttctgccaaataaatgagaggcatatgtatatttttccagaatcatgacttattcagtttatggactaattattggttgagaagataagtaaataacaaattatcatatgaaaaatgtgagactgggagtaattaatgcaataaaatagattgctcaatatgcgaacaacttcattgtaaattctaggaaaagggcctgatttcagaagaaagataaagtcatcaaaagtcttaaggattaaattaaaagataattttaaacatttactgctgtagtatttaaatttaatgattctggcaatgagactattgaatatatgctgtgttatatgtttaaggggatggactcaggtagttaggatgtgattattactgtcctacgccctctagttaaatcctgatagaattctagttttaactgaagacctctatttaatcataggctgcatcaagttgcagacacaattcatgaatactcatatataatggcatcatgctactaaaacacattagttaaatactctcactcactcaaatggtagaggagaatcatctttctaagatatctctccatgactacagtatgggcacagagcaaggacaatcctgtctcctacatggtcaccattcctttatttattcattcagtagagattttcgtgcacagaggcagctactgtgatagcacaagtattacagaattcaaaagagaaagagatgatttccagctcggcaatcagggaagtctttaagaagtaggtggcattcaactaaagaatacactcttcggttctgtgtggcttgatgagtatacaccattataatcgcagactttggcagaacgggagggttgaaataagataaaagaaaggagaagagcagtggcaaaggcagaatgactggtaacattaattgaagaattctttatttgtattcaccagtgtgggcctctttcctatttagccatcacttgaatgcacgttgtcattagcttgctttactcatcctatgaatcaagccttggagatgttgagaacccagtttctgtgtgtggcagaaaagtaaagagatgaatagaagtaatgacatagaatagcatcctcttgctttttccactattaattctattctgccagcagatatttagcagcttttttgtgttaagtcctatgtggatacaaatttaagaaatgacacattttctttctcaaggggatcacaggtcaataggaacacagggatctgtcaaagatcatgataaatgtaataaataagagaacataaatgtggacatagtaaaatggtagaccagaaaaggcaaaagataattattgatgatggtcaaggaagaatacttcgcaaaagtggtatttttagtctcaagacattgagcaaagacattttttttgctctggtcatcccataaaatgactctcaataatgaatagaacaagaaacaaaaaactaaatttcattttcaatgaaacataggagaaaaaagtcacactaaagtgctttcaaaggaggacaactggaagaagcaagtgaattactgtgcagactcccctagaaggctcagaagctgggcatcttaggaggcagtggtagaaatgcttaaacctaaaatagagggctcatctgaaagtctgtcacttagaccttctttttctctcaacctacgggaggttggaaaatatttgtaggtaaattgagctgcaggagcagcacaatttcagttttaagaccaaaaaaatagcagaaagctgggagtttatatgatccttctgtgtataaggtgaaagacacataaatataaataaatgtaacatatgcacataggctcttaaatacccatgtttagaaattccccagtaaaaaccagagttagccttgataacctaagaagaaagcccacaagtcaacaagccacaatgatgagcacagataaatgaatgtattgctagggttatcacatttgaggagtcctcagtaaaagaaggtaagaccccaactaagtaattactggcattatgaagaaagattaagaacagttccaaaacatcaccattttcttcatagagattttaaagcctttttcaatcataaaagggaagcttaaacaataaacaaaagggccgggtacggtggctcatgcctgtaatcccagcactttgggaggccaaggcaagcggatcacaaggtcaggaatttgagaccagcctggccaatatggtgaaatcccgtgtctactaaaaatccaaaaaaaaattagccgggcatgaaggtgcatgcctgtaatcccaactactcaggaggctgaggcaggagaattgcttgaacccgggaggcagaggttacagtgagctgagatagtgccactgcactcccacatgggcaacagggtgatactctgtctcaaaataaataaataaataaacaaacaaaagaacaccaacagagaataagaaagaatttgaggacgtttcagttatgatagccagactcacaacaaacaaaaaaggcaacaaaacaacacttattacaagaattgtaagataaaattgaataaattatccagaaaggagactggaaataaaaataagttgatgatagtagcagtaacgtcagaatgctaaagaatttttaatcctaaataaaatgatccatatcttggaaccatagtgatacagaggacaccttcagcaaatatgagagtaaaataaaaatcctttttgtattccaaaattatgtaaaatttattccctgtaatcagaaatctgaagacatgctccaaaaatcaggaatacacaaaggaagctaaagacaaggagtgtaaaacaggagagtcaacaaggagaaggattaagggaagtccattaataatagcagtttagcaggcctggagaaaaacaaatgtgtattgtagtagtgtaggaaagggcttcaaagaaataactctagcaaaatcgaaggaatgagtggattatctgacaggaactatcatgaggaaaattgtatcaagacgattttatagagtacttgaatagcaaaaacaaacaaacaaacaaaacctcttctgtagatgccaaaacaataaaagcaatgaaacttacaaataaattattaactcttaaataaaaaagcaaaagttgtttacaatgaaaatgtgatcatactatttgaatcttcagtggacaacatttgtataggcttaagcatgaaagtactgaatatggaatatggatggaaagaaaacctgatatagaattatattggaaaactgagtggagaatagagatacaagagggtcgtattgttacctgttaaaattggatgccaatggagaatgccaagtcatcaaatcttttttttttttttttttttttttgagacagggtcttgctctgtcgcccaggctggagtgcagtggcataatctcagctcactgcaacctctgcttcccaggttcaagcgattctcataactcagtctcccgagtagctgggattacaggcgcctgccaccacgcatggctaatttttgtatttttagtagagacaaggtttcgccatgttggctgggctggtcttgaactcctgacctcaagtgatccacctccctcagtctcgcaaatttccctctgtggcttcacaggcatgagccacagcacccagccggggaatgccaagtcatgaatcaaagtatcaccgtgtcatagacattatttagagatatggaggtaaatgccagggagaataactggaaaatagagtggatgcttacagggaatggcctagggaagagatttatattgcctttgttgttctcaggtttatttggcttcttaaacacacgtgtgcattacttttatataaatataaataattgcttaaaattagaaaaatgaatctctgacaaagatttggagtaccatttggtgtttaccaggtggaccaaggacagaagaacatggtagccagagaggtaagaaaggttaaaaacaaaaatcagaaacagtaagtcctgttcagggaactgcaggtggtttgatatggctgaataattaggaggcagaaaagcaatgtgttatagtggttatgggttcaggctctggaccctatctttctagttttgtttgatcggtatgtgacttactgtgtgaccttactaagttctttaacatctctaagcttttgtatcaatttctatatgtgaaaattgggaactttaatttgtactgcaggaaatgaacctacaacctgttagtatgcatttaagttcacctgcagatactactggagagttccaagcttctctccttcaagttcctgcattgctccctgcatctttgaggttccccagaacttgctaaccaatgcatagggcaaaccagaaatgctgactggaagtagcaacaagtgatttaatgttcccagaggtattcctgaactgatgaagtaaaagagtaggttgataaatataccaggttctccatccctttatacagcaattctaaagtgtatattatatagaacctcagtgggtctacagagaaactgagcttcagttctttgcagtgtgattcacaccattctgcacattttactgaattttctcccttccctgtctcactttctccacactctgatttgtgcttctggtaatcacttcccaaataagcccttgcctcaaggcccgctgttgaagaaaggcaatctaaacaaatacctatgccatgttttcaagaggattaaattatatgctccgtacttagtaaggctaaatatgtaactctgctgcggtggttgttaaatgccagcatacgaggaaagttcatttatgcctgtattatcagttaagttattatcctaaaggtgaagagaagcctttcacaaaatgagttcaatccacaggactcggtgactcactgaacacgtgtggtgaggagcggggctagggaaagatagtgctctgaatgactcacagctttctaacctgtatatgacctgtacggaatagtaatgctcacaagcaagaagcataatagaacaattacagttttatttctaaacaaagcctaaagtcctggtttcataaatgaagaaaataatgctgtctaggtaaacaatttggccaagattcacaattcactgatccaaagtcctaagtcccccaataatgtcctttttctgtaagttttttcaactatcattcatctttattattcttgtctcttgaggtcatgattggtgcacaggtggtcaatataggtaacataattgctgaaagaattaataaagatttatttcctaaatcgatccaattcatgttgttttcttctattcaagtactggtcacttggtctttcatatagtcatgtctctctaattcataatttaatggaaattattttggcaactccagcagacatctgagagataagcatagcttttgtattgttagtgttttctgccagactgaagaccttggtgttaataagatggctgctttccaatacctcttaaaaaaaaaaaaaacaaacaaaacaaaacaaaaaaacaccattttcctctctcctttttcttttatttacaaatgtaatctctgatccatgaattcataaggtgagaacggtgagtggctagctttttatgggaccatacataaagggctaaattcagtgatccatctcccatctttctaactacttagggaaggaatttgaaaagaagtcaatgtggcagatttgaaggagaggctgttggaaagtgtgccacaggcttttttacattctgtcttcgagacaatttgagtctgcattttttaagtgaaactattagtaacgtagtgatttcaggttttttttttttaagttggtagatgtaggtcataataggactataattttatttatttattgatggtctgattttaagcccttagaatattaatgtctaggaacatttgagaaagaataacagaaaaatcgtgtgtgtgtgtgtgtgtgtgtgtgtgtgtggagaatgtctctttggcccagataaactcttcgagctttgacatcttaaaaactctatgattaccatatttttatacatagtcagatacatataggttcatagtcctgagaactggttaaactgagttgtcttattgccagggtctgaggaaatttgaaagagagcatcatagaagacagtgtgttgaacactgttaggctagtaacaaaagaatgagagccacaagactaaaagagaattccacttgtgcgtaaacagaacttcagttactagataagcatggctttttcctcatttttctaccctttcctttattcactttccatcaccccccttagttccctccaaaatatgaaattgtcattgactttattaagatataactcacatataacaaaatgcacacattttatgggtccagttaaatgaatttgaaaaacgtgtatgcccatataaatccctgttcctccctatcaaaatacagaatacttatatcacccaagaaagtactttcacacttttttgaagtcaatcctaccacatttcttgcctacaatgactgatctgattttgatcaccacaaattagtgtttttctgattctagaacgttatataaatggaagcatgtagtacggtgctttatgttggacatttagttcagcacattgtcagtttcatccatgtatttacacaaatcactacctttttcctttttattgctgagtagtattccatatgccacaatttgtttatccattcacctattgatggatgtttggtttttttcaagtttgggcttattatgaatcaaattcctattaacatttaagagcaattctttgggtagatacatgttttcatttgtcttacattctactttagagaggaattgatgggttatatgtgatgtttatcttagtaaatgtttttgaaagtggttgtgtcattttacattcctgccagcaatatacgaaaggtttagctgttctacctcgtcatcagtgtttggcatggtcagtctttttagttttagtcattattctgggtatgaagtgctatatctcattgtagctttaatttgcatttccctaatgacttatctttttatgtacctattgactctacatattttactttgtaaagtgtttatgaaaatattttgcctatttgcttctttttaatattattgttttatatattttagacacaaccttctatcagatatatgtattttgaatattttctctcagcctctgaagagcaggtagtcttaatttttataaagtcaaatttatctatatttttatggttggtcatttttgagtcctaagaaatctttgcttatcccaaggtcacaaatattttctcctatgtttccttccagaattgtatagttttagtttttatgtttactctgtgatctatttaaaattgatttttgtggatagtgtagagtttcatacagatatcttgtttttctgatgtcattttttggaaagatcatattcctggctaaattactttctttattacaaacttggaaaagcctttttaaagcctcttagcttttatctaatggtagagtacataaagtcttctaaagtttgtttggagattagcattattcctttgaatattttctacatttctgattttatttaaaatatgaacatagtagataggacacatactacataatgatcattgtttaataatatagaaagtaaattaatatagccaagtcactgagttgggaagaaagtgtgtgcagttactggcctctttattttctatgtaactccctttcctttttctgtgtcttcatatgtatgtaaatatttcttgagaggtatgtagtactgagctactctattggaacacagagttaaacaaattgacaggatcattattgataggagcttcagggaaaacattgttagaactaatcattacaagttttttgaaattgaatctcttatttataaaaaagcacagaaacatcagtattccatagctcctttataaggtctttgtgttatgaagctcatgttgcaagatggatattgagtagtttgccatattaattttgatttgtatttatttgtaaatatgatttcatcacattaaaacaagagctacaataacagaactttaagtaagagttaaaaatattcaccaccaatctatttctcctaccttactgatttcacttgcctgtattcttttgctaatctttgtatatagtcagaatgtttatataaggataaccatactacagaaatggtttgcctttctgattttttttgaaacatataagattacaaatatttttcatgttgctacacagccttcatatttatccattttaatgactacgaagtagtctagtaagtgatggatagtaagaccatcatttacctattttattactattgttgagtttaggtaggccacacatttttgcttagagctgactccaaacatgagaaaacacatgtgtattgccttttccttctttgtataatttatatttagaatatcagcataattaagtgcttgagaataaagaagctagatttttgtattgaaatcccacctttgccattttccagctatttcactttgggcaggtgttctgatctctctagacctcagttttcttatttgtaaaatagggataataacagtgcctgcctcatatatttttcatgaagattaaatgaattatttttttgcaaatcaattacagcagtaaaatgaatgtaaaaactatataaatgtcttcttaaagttctggttaatggaactagtatattaatttaatttatattgtccctgaatgtatgtgcatatccagatataccacagtatgaccccaaccttgcaggaaatatacatttacaagaaaaaagaaagagagagagaggaaaagaggaagagagaaataaataaaggaaaaaaaggaaagaaagaagggagggcgagagagagggaaggagggaaggaggaaggaaggaaggaagggaggaatgaaggaggaaagaaggggttctcaaccagcggtgatttaaaaacacagtttattgaagtataattcccatgacataaaagtaaccgttgtaaagtggacaattcggttgcatttaatacaggcacgatgttgcacaaccaccactatcctcttggaaaacatttgcatcaatccaaagaaagaagctcttaccaattagtaaatttctccccattttctccctttcactttccaggccgcaacaactaccaatctgtcctctgcctatgtagatttatcagttctggatattttgtataaatggattcatgcaatatatgacctttgtgtccagcttctttcacttagtataatattttcaaggtttatctacgtttcggcgtgtgtcagaacctcattgctctttatggctgaataatattccattttatgtacatatcacaatttgtttgttagttgagcatttgggctgtttccaccatttggctattttgaatgtgctactataagcatgtgtgtacaggtacttgtttgagtgccagttttcagttatttagggtatatacctgggactgaaatgatagggttacaaggtggttctatgtggagttttttggaaaccacaaaacgtttccagtaccacactgttttgattatcatacattcatatttagctttaaaactgggaagtataagtccttcaagtttgttctttttccaagttattttggctattcaggcccttgcaattacatagaaatttgaaaatcagcttttccataaccgttttctaaaaaagccattggaattttaacagggattgccttgaatctgcaatcacatgagtagttaacactgacatcttaaccacattaagcctcctaatccatgaacataagatatctttctatttattagatcttctttaattaatgtcagcaatattttctagttctcagtgtacaagtctttcactttctctgttacatttattcatgggtattttatccttcagaatgctattatacgttgatgtttttttcttaatgtgcttttcagataattgctggcatataggaacataactaatttttgtccttattttttatttgttttttaatttagtttataaaactaatttttatattttgatcttctacctacaactttgctgaatttgtcctttagtagctttttggaagactgagatttttatatgtaagattatgcaatctgcaaatggacatggttttgttatttattttcttcccaatttagataccttttattcagttttcttgcctacttgctctggttagaacttccagtacagtgttgaacagcaatggtgaaggagactattcaagtcttgttcccgatcagagtgggacagatgtcagtcttttaccattgagtatgatgttagttgcaggtttccctccaatgtcctttattttgagaaagtttctttgtagtcctagttttctgaatgtttttatcatgaaagtgttttggactgtgttaaatgattttctgtgcattaattgatatgatcatatgaggttttctctccccttcattctattaagatggggtattcctctgattgtttccttatgttgaaccacccctacattcctgggacaaatcccgattggccataatgtataattcttttaatattctgttggactagaggtgattttggctcccagtttatattagcaatgtcaagatatttttgattgtcataactggaggagggtgctactggcatctggtgcatgaagacaaggatgctcctggatgttctacaacagagaggaaagcgttcctttgtctcacaacaaaggattagccaggccaacgcgccaacaccacccagattgagaaaccctgaattataccaaccctgctactattcttggtataccccacccttatctctctagcctgtcattctgtcttttcccctccatctcctccaaacacataactttgtgtttcagtactccaaccacactgaacctcacttaatttcttctcttagtcaagttacctttggcctattatcttccacacctgtactttttctaatccgaacatcctgtcccataagaatgatataatcgagtttggggactcagggttgggggagattgggagggacctgagagataaaagaacacatattgggtatagtgtacactggtctagtgataggtgctctaaaatctcagacatccctgctaaagaacttatacatgtaacaaaaaaccacctgtatcctaaacattattgaaattttttttaagagaaagaacatcccttccgcttcttcactccccaacatcatcacctggttttacttattatgattcaattttcggccacttcctccatgaagattttctgactttccttagaccaaatgagttacttgtgctgcatttttcccaaacaccagcattgcccatgccatagcacttatcagagtttattaaaatcacgtgttaatttctacaaggtctgggagggtcgtattattgctcctatttgctcactattgtatcttcaagacccagatcagtgccagtcacaaagtagtcattttgttattcttgtttttaagttatagaatgaatacaagaataaatgaataaatcagcctaaatttttctgtatctggaacattcaggaaatgtgatagttaagaaatatgttaatgttttatgtgtgtacacctcagatatgcctgagaaacagaaataaccaatggaaatatttttattttagttatctaaatctttacttatctgtcttggccctaattgactaaaactatatctgattttttaaaaattctcaaatgtttgattcagtatctgtgcagactgagacacagacccaaagctttacagtgtgaatttttaaaactaaatcttgaataaattatcagatacataagcaaaatttggaagggaaatttgggacaaaagaaagcagttcattttagccttttacatcaatgggcttggaacatgacttccaaggaattgctggtgttccctggcagtgcccaatttctgaagaaagaagcaaaatgtaatctgcacacagtcaaatgccagaggcaatgtgagtattatgcaggttcaaaccaggtcagaataaaaatgactactaaccagccattcagcttgtaaaatgatagaagaactagttcttgcttattgcccttaacaaatattaaaaaataagtcagagtgtcagctactagatgcaccaagttttagtgctgctttatgggctagaagtgtttcaagtaagagttggctgtgatgtgaatttctgtaaattaaagcttagctttccacttaatctaatcaaagtaccggtaatatattctaatgatgatatgacaaccacagacatattgagatagtatcattttaggagaaaagatttgagacaaaagccaactccatgttatgatggtgaactagataatgttctgcttttcgggcactgtagttttcagtttgcttttagtttcagtttggctttagtttggatttatatttcacaggatttttcaaattgtattctctctttccaccgttaactataccccaaaacacgctagaatcgtaggaattctcctaggcctaagaatcttctcaagcaatattatttaccccagagtatttttgtctttcccatatgattgtctaaatatttaaatcaatgactgattttgagaaagttgctggttttattagcttattttccttgaaggctttctaagcctccattcctcactggaaaatggaaaggtataccgaaagttgaatcagtatgtgattttcaaaaacatgtatatacatgtattcaaatgtgtcctaattataaatgtttattaaaataaatatgattctactggttaagataaaccagattctctaatttccctcctttgtcttgccatgtagaatggtgagagtccatttggctcagagaatgttcagtttgaccttttccagtcagtttatctaaagcagcagcaatgatttccaatctcattataccccaggtcactgtcttattatcacatttattcccctcttcatacttatcacaatctttgttaattgtaactctgcctattttcctactgtctgtcaccaccatctttagaataagagctccatcatggcagtgagcatgtttgccttgttcaattttgtatcactgacatgaagagctcttagcacactcatcaatcaatatttgttaaatgagcttttcttggctgcagacaccacattttattgactggaaacaatgtcttgagccaagcctgaagagaagagaaagtcataatctttacattcagagttacttcctgtgtcccttcaacgtgattcttccaacatcaccaaggaacttcctacatgattgaagaaaagatagaaagaaagtcatctggagagttaacacatttcccattggtgctgaatattatctcctaatattctgaagatgtcatcaccaggtcaatggaatctcaatatcctaagttatatatagacatctgcatacatatgtacattatatacaaatacaatattatttaatacaaattatataaaagtatacaaattatataaaagtaaatttagtttttatatattttatatgtgctatatataatttatacatgcttctgtaaaagtgtttactatttcatttacgagcaaaatagaaaagttgaaaatgcctgtttttccctactaagggatgtggaaatagggttgcttcaaagacacattctagcacagtttaataataattactcaatcaccacagacaggaaaaagttaatttatttggaaactcaactttatataaatgttactagtatataccaatgacagtattacataatggacaaaaggataaatatttaataagtttgatacttcaggtacagtaagtaaaaatccatttttaattacataaattctttaagtttaaagttacctagtcaaatttatctgtactgatagctgctgtcagaattacatgtaaacgcatagacctctctaagtgattatgttgtattcttctataacaatgagattcagtaaaagccgtaaatgataacactagccaataatttgattcaaccaacacaaccagaagaagcctgtgaagtcaataaaccagttccatgtcttatatacaaaaataataggttgattgaatttttactttctgaatctgttactttgatacttattctagacattaaatatattttgttgattgaatttttgcacactgagaaaatacaatctaaatatagctggagggtcttttctatttttttccaaatttttcaggcctttcattcggccaaagcaacaattgatgtggtattttctaatatctgatacagcttttcaattttgtgtgtgtgtatatatacatgaaacacagattgttcaaggggaacagaagcctatgagatatagaaaccaaaggatatgccttttaaattgagtgagcacagtctttagggcctacagtttcaaagttttgtattagggaatggctgaccacagaaatttttctaaattaagtgcataccaactagaattacacaattggcttccgttttgctacttgaagctcccaccttgagctggtttcactcacttattgttgaattatagagacagttgtaactaaatttgactcttttacctcatccttttgaaattgtgatctttcttccatctccaaatataattttgcagaccatgaccttcaacattacttctgcatcataaatgtgattttggcatcttgttgcagaatgcctactctgaggccttaattctcacatctgatgataccctgaggatgacatgtgaggccaagagggagtgaagcctcatccccactttgtgcttctttattaaccaggtaacagttatagtgttctttgtcatctggtcaacatcactaatttatcctgtgcacaattggaggatcacctagtccaactgcctccccactccacaatttgtcaaagagctaacactcaatgaagcaaagtacattccaaaaatcacacagaaaattaggcatggtacctgcaccaacacttaagtatataaatcaacgattatctagagaagcctggagtgatgggatcattgagtttagaaactaagaacatagctgtgctggttttagagaaataaagtcactattcacctattctattttccttttccttttgagtgccaacatcctcctgcagatgcatatatttatttacagagcaacatgcttgtgttagctgtttgtttctaaagtttttaaaaaaatgacattagaacttccaattttctctttagcaacccaaacacatttaaattataaattgaaatatattgcacttttaatagttcaagctttctgagtactattcagttccataaaaccattttggataggtaacttttttatttcttatcttctctaatcttcacttcaatattggaacaactagatatatgccttcttttgtttgcataatttttctttttagtgtttatgtaaatacatagaaggtaaaaattagtgaactatattcaaggaagggtgttagaatactaatgtagctaatgctgtgcttgggaactacttagggagaaatagattggtttaaaaaggaagttatagaatttaatcaatcttgagagaccagcagcatgctattgtggaactataactttagagaacatctatatgacagtatgatcaccaaaaacttcagcatatgctgccaagataatgtgcatattttaagtgcaagttagagggctccaccttccctttttgcctgtggtctcctgattatagcactcaaagtattgcatctgggtaatcctccattcccaggcgacttgagaaatttgatcccgttggtgtgaccaaaatttccaagtgaaatacagaaattgtaccgtcttcatgcatataggcacaggctggggaaaggtttgggatgacttttggctttgccctttcctgttttgtgacctacagtaaattacccaactttctgcacagtcactttgcattttttcgtaaaatgtgaataataatgcctttctcacacttattttggagattaaacataaatatgaatgtgcaatgaattctaatatgcaaagtgctatatttattaaatataagatgttttctgtaactccagcaagtttccagtgtcaatgttggtatatccaacacttcctacatgacatctgctggaggcacatgtctataactgaaagttaaatgtatgtgacttctacatgaatttaagtatgaatttctatatatttatcaatagttattgatttcacgtctcaagtcatgcttttgaaaactatttacatcaagactctattcatttgtataaaatagtttgttttttaaaaacagtttttcaagacttttataaaataatatccttttgaatagatacatacatatacaggtaaatctagatatatttttaatgttgagtttaagaagtagtttaaaaagcaaatctttaatttttagtgtgatttatctattaaaagtcctgtcttctctatattctctctacttaatgaaaaagccgattgcaaaacaagaagattgattaggggtaataagcttggtattctagtaataaaaatccttgccaaagtccaatctttacacaggacattgactttatttcaaggccaatttctaaccctatatctaaaacatggcaggggtttaatcattgtagcagatgctgtctatgcccttagtgaatctcctaccctcactcccttcacccctaggatttgccactgtaaccctgaaagataacacggtgaaaacctaactaagtatccctgactgaaggctattttctggcctaggaagcgtgctttcctccaagcaagaaaaagcagaagtgcctgagagttaatgctccccagagcaactctcaagcaattatagatggggaattgataaataaatacccatctttctagccccgttgttgagttcctgagcattgttctgcaccaccttccagtggtccccagaggaactgagatccagttgatgacactggcaaatggcttgataacaaaccttcactggcttcattctctttctgagtaacccactatcctagcaatgtttcttgggatcccaactaaacttgcattcaaatccttgattcagaatctattttgggggggatctcaaatgaagacaacaatgtttgatcagtacatcaattgacatgtatgaaaaaatgtgcacatatgcagacaagaaagcttctgcctgtctgtgtcaaaataggaatgatttgtctttctttaacctggtttatagcaactattagaaatggaattcaactaagtgttgcaagaagtccatcatttataaattaagatggaacttacttactgtactttgtctccagagattctttgagtgtaaataacatagacaaaatcatggaatattaagaatggcaaaggaactgagaactctttctcacagctatcaggttgttccagcgaaataacaggcagaccctggagatgttccataaagctggctgctgctaaggtctgctctgatacctgctatgtgataaaagttcctgacacttagcaggagttgatgtcctggtattccacctgcaaatggtaggtctgcagggcacaccaagcacgatgatattcatcctggaaatgtagtgctgagctcagaagtaagtagggtgttaattatccatgactagtcacataaaatcatgtcttatactcagttctggcctggaatgcagggtacacaaagggaggtactcattgataccagcaggagctatatgcaagcttccaaaggaacaattagtccttcagtgcctcattcaaaggctgcttagggggttgctctccttgaccttgagttaatgggagtatgagtgttcaatgaatggagattagccccagaagacagggaagcaaattaaacccctattttgatttgaattgggagtgaataaagtgttcactgctcactaaactcaagtgaagttaacatgcaggaatgaatggagactaacttctctgtgtggcaaggaagacctcaaggcagttagcacctgggaacctccagggatagagctgagacagaggtggtcattcatcattctctggggtgataagagtttttcagtaaatgctgtatcaatgtagataaatcttcctagaaccaataaaaatgccctttgccttttctatcttctgttacaagtaattgctattcaccttgttatgaatatcttgaaagtagtcacagagtacttggagtgcctgcgggatggaaagtttgaaggaaaaatgtagccgtatatcattggcattcatgagaaaattcagattagatgtttgaaaggcaggtccccaggaggcaatagagaaatcaggaacaatattgtgccaaaaataccactctggccaggacatcagggagtttatgtcaggtagagtgaaggaaagcaatttggaaagaaaagatatatgtgcttttctatatgcatttagtttatttatatgcgtacatcctctgaaaaactagtatgttctgggaatcgacaagcagattgggcctgacacttctaaaatatgtaactgtgtttatgtttcttttactctaaaaactctgaataacatcttgtaatatgatcaatactttttcaaactcatgtcttttaaaaatctgtttgcaaccaataagccaaaaatgggatgtgctcaaatatcattttacatttgggaggtcaagtttatgccattggactttacgtgcagattacaaaatattttttctttctaaagacacacctactctggtgtcctaaaaatcagttatctcattgatgacacaccagagatatatgttttttaaaatgtgggctgggtatggtggttgaagcctgtgatcccagctctttgagaagctgaggcaggaggatcatttgagacaaggagtttgagaatagcctgggcaacatagaaagaccctgtttggggcaggaggatcatttgaacccaggggttcaaggttgcagtgagctgtgatcccactactgcattccagcctggataacagagggaaactctgtctaaaaaataaataaataaataaataaataaataaataacgtgaagatgttgtggatgatatcatccttgctgggggtcactttactgcacaaagaatttcacttctttccctcttctagagtgtttgaataacagtcacttgacgacagttagttcagcttaagcctacttacttttcttcattccctttatttaaaaaagtcttatgtgtctgctttcaaggagactctcctgaattctatcaagataacaagaagaacaataactcaaaattattattgcttctgagaggctttttctataatatacctgaaatacatttaaggcactcataagtagcaaccaatcacccactcattcattgaataaatataagttagtgcatcatgtatacaaggacacatacacaagatcctgaaaaatacaccaagcaatatgccgaaaaaggagacgtgccgcaaatattttgtttattcattaaagataaattgattagaagttgaaaggaaagtggaagtacttttaaatgaaggtttaatgaaaatttcgtagaataaggtcatcgaatcttgacaatgataaaaattagagaattccaaggagatggaccaacataaacaaagataagacattcttcaaataacttgatcttttcaatttggttgttttgtacttacttttgtagtaataataataataatagcagctagtatgtattgagagtgcagactgcctataaaatattgttctaagcaggttatatgagtaaacttatcctcaccttaaatgtggaaagtagctaccattattagccccattttactgatgaggaaactaaggcacagaagagttaagtaactcacacaaatccttcacctagtgagagccacaggtcagatttaaacactggcagcctggctgtatagcatggactcagctgtgactgccccctcttgaggcgctcatggagccagtcagtgactttattttcttttccattttcctacagacatgggtagactgacaaagtcaatgctgtcttggatatgtgagctcagggccatgcaagataaactcctagattaggttggtagctatgctctagaattaggacttctgattacatcatgcagggaaaaaggattactgttagggaaacatgtgttctcatattcttctttccttcctcggatcctctaagtctaatcagtagccatcaagactgaagcaaaggcagtatctggagcaacagcctgctgtggatctcactacagcccttcccttcctggatgttttctcaaaagtaccttcacaatcaatcggcctcctgtgctgtaagccagttaatcttttttttcagactaattccaaatacatatatccaggtagctaacaataatactgtgcttcctgtaaataatatggaaagaccactcactgtgaagtcaaaagatctgggtacaaggccccgatcgaccatataacgtctatgtgcttttgatccgttacttgaagtagtgttatattacttggaagtcggcctcctccttttggccacagcatctcgacttttatacttgtcgttactgagttgcctgctctcccatctcaatttggaaatctgagaccagagttgttgctccatttactcaactaatgttgctggtgatagatagtagggctgtcacggagtcctttggattcctggcccagtgttctttccactgagctagtctcctacagtgtgctctgtggaacctaagcccttggggaagctctgcagaaggtactttttcttccctctaaatgtgattttagcatcctgacataatcccctccacactgctagtagcccgtgatactcttgcctagacctggatacaaattaagatcacagttttgtcccaagtcacctacattcagagggtccaaaatgtaaaatgatgcttttaaaagaatatgaagaatttatcctctgtggttacaggaaagttagctaatctccctgaacctgagttttgttttttttgttttttgttttgttttgttttgttttgttttccgggtagtttaaaaaatcaaatgagacaatttatttaagaaagcatctttcacattataaatcagtttacaaaagcagggtactatttatataaacatgaattccagatattggaaggtggcaatgtctgctgttagtaagaatgcaggaagcacacaagcagtgtggaaaaatcttagataatattttagtcccctgcccttggagaaatgtatcatgaggtcagtgggtgaatttctttgcctgcaaattgtatctcctttggatacaatttgcaaagggctgaggaatgaggttggacccccatgccccatagcacaaagtatttctgctcagcagtcatgtattttgcaaaaataacccacccacaacgaagtattgcctgatttaaggttctgcaatttctaaaagccagggcacttaagatactgagatgaaataacattccctgttcccaaatgaataatgcattttctcactcttttttatttttattatttcaaaattcttgcctctcttttgcagagaaatttcccagagttttacagcatcactgttgacaggcaaccacattttcctcccaaggcgactcctatttctgtgaggtcaagattgacaatgggagcacatatcaggggatgggttgatggaagagaaggcaaaaggtccaattgtccaggggctgggtggggaccgtgaaccttagccaacagaaacagaatggaatcagtgtacatcctgctgtcagtgctctgtgattattttcccctttccttctcctaatggataagcttggaagaaagtgcattctttctcaggagagagctcagaactgcagggttttactgtatttattgtgctacatatacatatacacacacacatacataaatacactgtatatacactacatatatatattagtttcaataattctttcctaggtaggtcagaaaattcacattgctatgcattattaaaaagaagttatgaggccaggtgcagtggctcacgcctgtaatcccagcattttgggaggccgcaggcgagtggatcacctgaggtcagtagttcaagacctgcctgaccaacacagtgaaacgagtctctactaaaaatacaaaaattagctgggcacggtggtgagcgcctgtaatcccagctactcgggaggctaaggcaggaaaatcacttgaacctgggaggcggaggttgccgtgagccgagattgcgccactgcactccagcctgggtgacagaaccaaactctgtctcaaaatagaagaagttatgccatcgtgtgtggttagagagtcactgattggcatgaaagcaattaaaacccacccaattttcctgaccacttttataagacagagaaaatttaataagttaatcccttatggatatcttgggctctttgaaatttagagagctctattacatcctttattaattgaccctaaaaaaattaggagcagtctgtgtggtaggtagtatggtcacaagatttacagtgggcaacccaagaacagagattctaagacttactcaaactacattgttagctattgacacgattaggactctaagacctctgttattcttgtccatggctctttccccttgattagactttcccaaagtgtgttctgtgaagcgttcactgttggaaaagcactacagaaaaccgaatcccatgatcatggaagtttgggaaacagtgcaggctatacccctgtcttcaagttctgtaatgtacactggccctggagagatacagaaatcctgcaggaaaggaactgttttgccttatttagccttgcattttgcatattatttagctgcatggtgctttttttaagccccataaacacactgtaggaagccttaccctgtgccatctagctttataacaactcagggtgggagtcctcaatttgcacctctaataagtagaaatgtttctctttcaaatgttcagatttgagcaaaatctcccagagtaagctttcggcaaaattgtaaagtctgtaagattggccatcgggatgaaaaacatggactcaggattctgatgatactggtcaaatgagggatttttctgccacttatcatctgtgtgcactttgtccagttacttagttcctcccagtttcagtctcttcacctgtaaaatgaaagcaataattgtatacctcttatttgactgccgtgaagatgaaatgaggcagtgcatgtaactcctggcatagaatctcgcttctgttgggtatttgaaaaattctattattactattattctcattatcttccttttcagcctacctcctggcaccccattctgtctcttcctcctcctatttttctatcttgtcacacaatcttaaaggactctgcttccagctatcttgcttacctggtatagtgtagagatggtatacacgatgccttccaagactgggcaggtaatatgaaagagtgaagggaactaggtgtgagacaatagggggtgtcccccaaactatggcaaacacttgtgttaaagggccagtcactccggatatttgttgttgttaatgcctttttgttgtacttttaccgcatggaaatatggactagtgatgccaaattttcagataattaatgagaagtcaaatgtttatttttatatgtaattttccaatttttaaacactctttttaagaatctgttagactaccagttgatgacccctggatcaggggatttttagcatcctgttcctatatagtaataaagagctgcaaatttagaagtgtttaagaggtcatctagttgaacttcctacttgatcagaaatattatttataatatactagaaaaggtgtcatttatctattcctagtcagagagaactaagcatctcatggaaaaaaacattacactttgtatgtacaaactcactgaattctcttatgaacctcatgaggtagatgctactttttccattgtaattatcatgtcatccaggctcagaaaactaatttacttcttctaaagtcacaaagctattaagtgtctggtagattttaagaatggaattccagactgtttaggtttcaaagccagtgcacttaaccactggctaaacaattctacttgttaaaatgctcagggctgatattaagctgaaatttgctgccctgaaatgtccactatttggtcccagttttgctctcctgagacacaaataataagtttaatctttcttccacaagacagcccttcaaatatttgaagatgactctcctctgcctgctaaatcctctcttccccaggctaaacatactcatttcttttcactgaccctcataagtcatggctttcagccacttcatcatccttgcactgctccccaggagagtatttcaatttgtcaaagttcctcttaaaccgtgatgctcggaagagaacacaatccctctgtgtagttacacaagtgcaggtcaggatggaactagcacctccctggttttggccaccatgcttttattaatgcaacctaagtcatgccagatttttagcaactatgtaaaaagaaaagcaaacattgaatattggtccaacttcacactatagaattttattctctgctttttttttttccaaacttgaattgaaggaaagccacttttactcactctactcctacccaatatatttaagcaggtcatttttaaaactcaaatacattacttagtatatattcttattaaataccatctttatttatttactgttttggccgatactgatctgttttgttttttctttaatttgacaattatagcaaaacagaagagaaagaaacattttctgtagtgtgaccactttttcttaaatacattaaaaaagggttttttcctctaccactctaatattgctcacagataaatctatttatattttcccaaaaacaaaattttagaaagtgctttgcacacatttctgttttaataggaccttgctatattattgctttgtttagttttttaaaaaatttggaatatatgaagaagcaaaaacactgaaaaaatctgctgcttgccattttacttacatatatgtattatatatctatataattatatgttatatctatttgtatgtatgcatctaccttttcattcttttcattccagatatttccgatttctgctatctgatatactcactatctcttctagctttctgtgattctgaggttaatcaaatattcagtaggattgggctgagaacttaccactagaaacttctctctaggccaacctttagcccaggggtgggaaaactatggccatgaattaattattcttcacctgttttttgcaaataaagtttttattaaaaaaactgccacttccatttgtttatgtcttgagtaagactagttttgcattctaatagtacagtttagtaatggcaacagtgaccaggctggaagtatttgctatctagtcctttatggtcttttacagaaaagatttcccaatctctgctttagtcattagtaagtagtccctgcattctgttattgaattcattgctgagaattgaaactagcataaattcctatccctgtactaaaccgcactgaaagcaaaaataatttagctacttgcttcaggaaattcttgcttctagaggacaaaacttacttttcaagaccaacatcatcatctgtatcaagagcctgaccttcttgtactcatcaaattaaaactattatgccctaatctctacccacatttaatcagctcctcatcttgcaagaacaaccttaaaatcacctaacccaggtcacgaagccctaaaaatattgttttaaaaaaaaacttcagctgaattaaattgaaaggagtttaattgaacaatgaacaattcatcaatcaggcaacccctgattctggggcaaaccccagaatcacagcagatttggagagactccagggatacctcatcatcagaacaaatttgtagaaaataaaagggaagtgacttacagaaatagaaagcgaggtacagaagcagctggattggttacagattggcatttgccttacttgagcacagtttgaacactcagcagcgtatgactggttgaaacatggctgctgggattggccaagactcagctattgtttcaggcacatgttcctaagttagattttcaatcttgtctacctattaagtcaggttactgttggtcctcaaggactcaaatatagaaatatgtatttcttcaggccatttctagtttatattaacaatatcacccacttatttctccttctgagaaagtattacaactatgccaagttgtattctccctgactgtggaaagtctagcaaacttagatttgtccaatgaataagtatttcttgtcacctttttaggaacggaaagtcaacactacaaatcctcaaagctatagcagcgtcactcatccacattcttgtattctgatttatataaatacaaagagcatttctataagatataattacctgcatattgcagatagaaaaacaggtgcacacagaggctggagctatgctttggtgatgtgtgcagtgccccagatcaagaggtcacatagtagggggggaccctcaatcagggatctgccttcaagtcccaggtctcgttctaggtcatggactaaattttatttagttaactatcacctatatatgtaaataatggcaactacttatctcctctaggcctcagtttcctcagctatgaaaatagaaagctgacttctattatctatatagtttctttcaattgtgaaattcactgaaagtatgatttttcagcagtcttaaaactaatttcttcacactagtatctttcagcaagacttcatggcctcaagcaaaaggcatatgagagatactctcttgatgactgagttaagttctacagcttggtttctctgattaaaaaaaaattgtagaaatgattctgactatttccataacaaacatatttgcatttatttcatgctgttaacaacttaacatgtaatcatggctcctctaggaaaagcagtactgcttcttctatgatcacattaaacacgctgtgttacgtctttctactaatctatcatctattatggctgcctattttgagagcttggcataacaattatcataagtgatagcattatattctgaaaacaaagaatttgatggcacaatttatcttgctacttggcctaacttaatggtggtggggtttcctagtctgtactatatttttctcagatcacaaatagttcactttttaatttattattgatttagcttaaaagtaaataactccgtgaatgctaaagttggaaatctgttataaaaattattaaaaatcttctcttccttctggccatggatgtttatcacactgaaatcaaactgtggagctacctgaacaaagtgaatttgagatttttaatttatctggtgtaattaactggtcaactaaaaacaaaagggcaattagtgctgcacacatttgttctgatgatgaacatggcaactgaaaatggatcttgatcttcactatgaaatcctttagtatcaaagcaatgttgctgtaaataaggggagaacgaagcccgtgaggagtcacgcacttgcaacaatgatgtcctgataaactaaatccacaccagtaagacaactagagagagaagttggccaatatttcaaagtaatattcctccttgaccattctactgccctgtacttgaacagcaataaccaaagccttttagtagtagtttctacttttcctgctaccaatgtgagaaaatcatttcatgtactgcaaaagaggtaagaaaaaggtataatttgtaattgacctgaggatttccataaacagtatgtattaatgcacataattctccagcgtccaagtccatgtaacctagatgtatttatagaaattaaaaagcacaatgttgacagaattggacaagaataattttctattttcccccaccatagagtaagatgttttaaattattttagacattctctgtagcttctaagttaggttgggaagtaccaacccttcatgagcacctttcagaagcttattacagagctatgcatgcacatctactctgcctttttattcaagaaattgaccctagttctcactggaaaaaataaagttggaaaactcctctgtaaaagatagataagagaataacagaggtaccatctctgtttaggataactctcattgtctctcaagcctgccggacaaaccaaggtttaacatggcagccaccttccagaattttcctgatgcctgaggtccagccattatttgacttacacatttattcctggtttactggcaattgtgcacatttatagactgacgaatagttttagagccaggagatggagtgagtgacaattttccattcctaaaaaaaaaaaaaaaacatgattattctgaaccaaacaaagaaactcttaatgttgtttgggttaagcataattagcactgtgtataacctcactgtcacagcaataattgctgagttctttcatctgccttctgggatcagaagcaagtcagtgatacatggtgagaagaggtcgtataaaggcagggctcacagtctgcagctacttcaaaatacaggactgcatctttttctactacatagatggtattcttgttgagtacgtatacactgaattagaaaaatacagttggataatcctttaacagaaatcttcacagccaaatatattttagagtttagaattcattaaacgagagatcagcaaaagaaaattccagaagctcgaaagccagaaagggtcagataataaatattttcagctttgcaagccatatggtctctggagcaactattcagccctgcctttgtagcactaaaacagccatagacaatacatcaataaacaggcatgttgggttgcagtgaaattttatttaccaaaaaaaggcaaagagccagatttggtcagcaggctatggtttcctgacccttgttttagcctttagaaaggcaatggggtacgaattcgtatgtatttctatatatttataaatttgtgtgtacaaatttatatgtatttttatttgcatgcatatacatattatagacagatatgtacattaaagatacatataaatttgtgtgtgtgtgtgtatatatatatatatatatatatatatatatatatgtatatgcccaatgaacaatacacttatcatcaaccaacatctctgtttcagcagaaaaatacatcaatatttataataagctgggtaaaaagatctaagcaaccacacattgcttggtgtgtattgcctggggacagttctctgccaccaaataaattttgctaccaagctttcatgtaattttcaactttcagagattctttttaattgcaagaaaagtgattatagacctgtacatactctttccttgaagtgtttgaaattattacttttgtactgagcaatttcatgcaagaaaaagtaaatacacgttagtttatgaaccaagatactcactgctctgggccaaattatcatttaaaagacctcatctaaaacaaaatgctggtgatacatttttgagactctttttaggttctagaagtttctttaagttagatttatatactggttttcctttattacaccattttgcctcaagtgacctgtaggattctaggaacctagaattaattcctgtggctattttgcatgtcagtgactagcagaaattttactcactgaatatttctactcgattctgctgtgagtaaataactacacttttcttaactacattgttgtcattgagccagagtattctccttcctcaggcaatttaaactttcacaaatgaaacttttacaaatggcaacccatgcataaatattagctatttaggctagcagtatagaggaatgccaaataaaacatctttcgggctttggcctcattatagtatgctgataagcaatcagatgataaagggcaacatttgctatgaaattatacactggatggaatcaaaccatcttagaatattagagctggaagaaacttgaaggtgacttctaggtcaaacccttcaattttcaaaggaggaaactgacaatcaatgtgattgtacatgaatcactcaatgttactcagctggttaagagaaagagacaatagtagaagcaaaatctctagattcccaatgtagcctttttctctgtaccaccaggttgttcagctgtcaaatgcaaacctagctcatgcttgctgaatagctatgagctctgcattagacaccacgccgagtattacgagtaagtgttacacatggtgtttatcgtcaaggtaaaatgcaaaacccttggcttttggagtctttggtaagtgcaagccttaagagaaatacattgagtcagtgtgctctagaatctttaagagaaacttcatataaatttgagataaacgatacaggggactgggcactgtggctcacacctgtaaccccagcactttgggaggccaagatggacggatcactggacatcaggagttcaacaccaccctggccaacatggtgaaaccctgtctttactaaaaatacaaaattagccaggtgtagtggagtgtgcctgtaagcccagctactcgggaggctgaggcaggagaatcacttgatcccaaaaggcagaggttggagtgagccaagatcgtgccattgtactccagcctggacaacaagagcaaaactccatctcattaaaaaataataataataaaaaataaaaaataaaaaaagaatgaaggggcttggggcttgtcggattacttaggtagaaggagacaaaaacaaaatacaaacaggactaggcaaaaatttgtcttcttggctcaggtaagatgtttcatgattctacggtactgggtatgattctaggttctttggatgatggaatgaatcacagtaacactcagatacagaaaaagcagaactctgcttcttacagctccaaatgaggcaaagggcacacaggaaattgtacccaggaacagaactacagcaagcggggactgttggaggtagcttgcgaatggaaaatggcatagagatggctaggctttgcaggcctccggaggattgggtattttaaataattttctagcccaaggaagtaggggctgtttttgggtgttagagatttggagatctgtggtatttgggtctatgtgtattataacccaggattattaaagcctaataagggatatatttggggttgagtcttagcaaactgtccatgaaggggaactgaaagtttttagctgtagctgcaaactttcgtcaagataacagttgtgagatataccagatcaacgggtttattatctcttgatgacttaatggagagattatacactttttctgataatattgacagaggtcctggcttcgactgccattggtttcaattaagcaatatgctgaattttttacaaaatattatagccaaagaaatagataactgattgataatgacctggtcatatgcttgtccctggagcaagaaggtggaggcaaataactccccagctgtattgtctgatggtacatagggagatggttcctcaaaagaaagtcacagaccttttatcacaagaaggagacagaattattgggtaaaaaaataatgaatatccgttaaataagtgtaccatgtaatttacgttataagctgaggcttttttgagaaaaagagtctattgataattctgccatgacaattggatacatggaaactgtccagtgaaaacaaagatttatggccatgctaccattgtataggtttttagggagatacagaccctaaggaggaattctatgcaaattaaatgacatctatatagagataatacataatgcacgtgcacaggaagtagatctttgtcactagattggaaatatttagtagtagtctccttggaaaaggaagattagaaacctattgtgcatagtcttgaatatcattccaaagactttggatgtttgtgaaattgaaagtgattaaagtctccattgcataaactggcataattggaccaatctttgttttaggaagaaaattttggtggtaatatttaaatgagtagaaaggacaagagatttaaggcaggaagactattcagagatccaatttttttttaatcttcaaagccactactctatttaaaaccttcattattcctttcttgtactacaaaagtagcctttaattactctgtataattccagtttttactccatctctttcattctccacggtagccagagatataacataaattttgattctgttctgctcaacattctcaattatgatctgaaagtacagcattcatatgcattaacatgacctaaatgtcttgtatatttcagcctctttccctttctccaaccttgtctcatgccgcagttcttctgaatatcaaaccggactttctcatatctttgaacaggcaactcaaggcttgctataggacctgagcccactgtctctcttttgtttaggaagctagtctcatccttccttcatacctattgtaatccctacagctctgctgttttcatcccatgtacacacactctttgcctggcaaagagctactcatatttcaagcctcagctaaaaaatgctaactgaattccaccctataaatctcatacatattacatttttctttaatattatcatatttactacacaaatattttcctgtgtgcgtaaggttttttttgttttgtttctctgtttttgttaaatgtctcacaagagaacagtgcctcaaaggtagaaatgaaggattttaggctcaccattaacaccatagtgcccattgtcttgcaaagaatgtgattatataaagaaacaaacaaataaataaatgcttatgaaaatataattaatgaatgaatagatataacatatgatctaatttatgtaaggcattaaaggctgtggtatcaaaaggaatggaaagatgatgtcagatatgagaacatttgagaaaaacattgactcaatacctatgttgacccctgaatattgtttatttttcctgtgatttttatcctttgattaaatttggaaagcatttaacttaaattttatttaaacgttaagtataatcaatgtttttggtttaagatgaagtaactcatgacagaaagaaatgatttttacaatttaaaaatacatcaagaaataaaaattttattatttattatcatcacacttaaactccatacacttccaataaatatttaaggttgcaagaaaatatgtttccactatgttaaagtttccaaaggatcttatcacttgatatataatagttttatcaaatgtaacctactacatctcttgatagaaaagctgcaaaattataccataaaaaggccatagaaataataaaggcaataatagtggctgtttttgtaaacaatcaaccatagtctgttacaatcatacagttcataataactgagcttaattgtcaagattaattgttgagcttacctacatgagttgttacagaacatggacatagataagtttattctgagcttattctaaatttttatgagtttaggagtttttatgaacctcttattagatttctcttttgggctaaaggccaaactaacattttatcttgatttcatttatcactgcatagcttaaatgtcaaaataaattagagaaaattatgatgcaacccccttaggaaaagcaagtctcgtacctgaaagataacactgctagaaattgatttcttgcagaaattttgcagcacaatattaatttttctcttgtgatattaggacaaataatgttttctaatatttgaggtgtgaattgaaattaagaaaatatgagctgacattactggaactcgcagaacaaatgtatgtgtagaaagcatccatttaggttgctttattttggataataatattaatattaaattgaattaatatgcaacaaaaatatgcttattaaaatattcgtgtttgtacgtttttcatttcatgacaattttgtctttttcagactcttgagatactgactggaagatagactgttttgttccacctgattgtatgggagaaatttttgaccttagaaagtggaaatgaggttgctatggaaactggtaattctgctgccactcataaactcttctgcaggtaaagtgttctattattataagttttgattgataaatatattggcattgtatttctttctatgggtgaagcaattttcaaaatgcacaatttgtatgttatttgaatgactaagtgataatgttttgaaggtaacttctatgactcagacagggaaagtttaatccttaaaaatgtatcaaatgccagttttaaatggaaactaacattattacatttataaattggcaaatatgacatttttatacaatgtaattatgtaatatttaattatataatatactatgacattttaataaaagaatgtaattaaatatttttatcaccaataaacagtgaataattattcttattttcattatagtgaagtctttaaaaaattaaaattaaaatacatatttctctcatgtttagaaattgatatggcaaaaaaatcaaagctatattcatttagaagaaaagatgatatagaatgttacctcagaactagaaataaccttagatatattttctttttaattattttaaaagaatagacaagaacatgttcttttattcaacttgaacatattaatatctgtgtatcagttaacttttgctttgtaataagccacgccaaatgtgagtgtaataaaatatcaaataatcatgtatttagttgacaaatctgtgggttaacaacttacgatgggctcaaatgggtcttcttttggtttttgcctgggtgcactgcaacttcgatgagctgagtcatctgagacatgactagtctagaacattcgtaactgagacaactgtgctgccatggctgtggtccaaatgttaccctctgtgagtctgggttcttttacatggtggctgctcagggttccaagaaaacaaaagacagaagaatgcagcatttcttgatgccaacgcttggaactgctacattgccatttctgtgagttattttgacaattataagtcacaagacaagttcagctttaatagatgtggaatgacactacatctcttgatagaaaagctgcaaaattataccataaaaaggccatagaaataataaaggcaataatcgtggctgtttttgtaaacaaccaaccatagtctgttacaatcatagagttcataattactgagcttaattgtcaagattaattgttgagcttacctacatgagttgttacagagcatggacattgattagatcatatgattatcaaagaagcctctcttctaccataccatgcttcttccccccgactatgtgttgataggtactagtgaagtttcacgtacttataacaaagcagtaatacattgacagacatgcaggaataaacataatttaaaaggcagaaacacagtaattgtaaaggacatatattttatagcaatcctgagaaatagatatgctgatcttaaaatgaatgagaatgctaaaatatgcagaaatcaaacaggagaatcagaaaaccatacaaataaaagcaattttaccactagcaaagctagcagctagaagtgccatagttatatttactcaaagtgattacagtattttgattggtgacacctctaagtctctgtaacaaagatttggggttaaataatagtgtattctttttttggtaatagattaagaaaagacagagaaaactcatcaaggtgcccccaaatcatatatgtgtgaataagaattatattcctacccttaagtttcatcttcctgtcaaaattcaacattaacattttgccctttaaatatgtatattgaattagcataggatctctaaaagaccttttgtgttaaattaaaatgaattattagtctcagaacacgtatcaaatctgagaaatactccagctcttatattaacttttatttatacaaactggatgtgattcaacatgtcctgttgctttattctgatgggagaaatcatcatatacccttggtgcacaatttcattgtgaaagaacagattggatctattaagtagccatagctacttaaatgagataatctaagctaaacattgctccagaggtaaggatgttgataatgacatacacaagacaacactgctttaaatctgtttgttttgttagacgtttcatggtgtgtctccctattcgcagatactattttagtttagaaaattagattgtctgatgatagagttctgtgactatgcatagtgataatatcttgtttttccaaaacatactttttattcattctgaaatgccagcaaatctttcacaattacttactttttccttgctatttgaattattataatttttctaacaggttgatactttaaatctccctagactctaaattaaaacttaaaattttttgacaacctctcccctcattttctaaaaattaactacaacttctagtgcttttactatagtcatggcctcataggcctttacaatgaaacttaatccatacagtcatacatgattgattctgggacacttttaaagttttgagtacttaaaagtttaattgttctattttagtatttttaaaatattagaagaaaatgaaggcccatttaattaggaaatacagttaataattatatactttttaactgtttcattgatatgcatgacaggctaaataatggccccaaaagatatctaggtcctaatacctggaacctgtgagtgctacttgatacagtaaagtggattttgcagatgtgattaagttaaagatcttcagatggggagattaaaatagccctggactatccagattgtaagaaggaggcagagttagacctgacagaggggaaggcaatgaggcagcagagcagagggagacgtgaagatgctgcactgctagacttcaggactgaggaagggatcatgagccatggggtgtgatgaaggaagctctagatgctgggaaaggcagggggacagattctcccctctatctgtggactgagcatggctctgcctgcaccttttttcagccccgtgaatcccattttggacttctgacctccaggactctaagaaaataaatatgtactgttttaagccataacatttttggtaacttttatagaagtcataagaaactgaagtttcttcctcactatgctttaagcttccagatggcagggactatatcttgctggtacttggtagggattcagtaaatatttgttaaatgaatgaattaattaattaccaaaagttaatgttgtttgttctatttatgttatcacagtagaataaatttagtcatataatatcctctggggaactgttagtctggttcattcctttatggttgccagtgtgtattaaagttacagtcataagtttctagaaatagaattgtaataacgttttaaaagttttaaatcatgccgtatttgaaactctgtgagggcaggaaatttcatctggtttatgctttactgattctccatcccctaatacacagattctaaatatttgctaaatgaataaaagaaagcagcttcattcacttcaacaaatatagaaatatattagaaactatgatgtgccaggcaaggagcttgatgttgaccttcaacaataggtccatagtccctgccctcttcaacctgacagtctaaacagggaaaccagcaagtaagtccacttaaactgagattctgccccttgtgacaaaaaagttcttgactaatacagctttaaaaatttggttttgaggttgagttagtaacagaactctgctgggataaatgcttattcactaatgaaaatgaggaaaagagcaaataaaagaattttaagaagtcacaataattcctggaaggaaaaaaaaatcaagaggtttaatatagactaagaacgtttattctcagccctgagttactgaaaaatctacatttcttaaagtagaaaaaatatgttaatgagataatttggataaccaaattaataaacggagaaaaacttataactgtaagtctactttttgtctttgtagacaatgcacagattgttttcatgaggaaatattttatttatttatatatttgtttgtttgtttgtttgtttgttttttgagatggcgtctccctgtgttgcccaggctggagtgcagtggcgtgatatcagctcactgcaacctccacctcctgggttcatacaattctcctgcctcagcctcttgagtagctcagattacaggcacgcaccaccatgctgggctaattttttgtattttagtagagacagggtttcaccatgttgcccaggctggtctcaaactcctgagctcaggcaatccacccacctcagcctcccaaagtgctaggattacaggcatgagacatcacaaccggtccagaaatattttattttttaataaatactgaacaatgtcagtaatgggtagaagctgaaaaaccacgtagggtcaaattttgttgaccctagaatgtcacctgcctaagaaacccaagattaactgatgtgattaactgtcacattttcccacagtgaaaaattctcagaatgcacaagatgattctattttattaaatctttcaccttaccatggcttttatgtacaatttgaaaaatattagacagatttcaaaatttagttccaatctttaaaaatttgataattattaaaaatgtttaataaagacttgatgataataggttgaatcgtgtgctatatctgttcttatgagttaaccagggttagagatagcacaattttatctgcggactattagaagatctgcagtccttaagaagagtgtcagtgagtgtcaatggctgctattataactcaaacataataaacaatagcagaatagtagttacaaggagtgtgattttcctgatactaaatattcatatcatcttaagaatttctgcctaatgtattctcttttaacattcttattttaactaagtactactatttaaatggtagtttataaaacattcacttggttcataaatataaccacttttttgtcatttgtgtttgttttgccatgggttaaggacttttatatgtattttatgaaattacggactgaatacctatttggttagtcctgaagaagtaccagttattcagtatgagacttggttttatcatgaagaagtgcaataattcaagaaagtcaacatagagctagtcacatgtattggcagactagaatcaaagccctccttgagggattctaattattgtgttatgccaacagggcctaatgagctggtttctcctactgtattaattactcttgaagaataaactgagactcaaaattataataagtctttgcagccatcatttttatgtaatgtttgctgacaaatgtggttatattattttcaaaacttctcccaaagtagttgacttttaacactaaaataaagttgtttttagggctgatacccataaagaaagaaaaaatctattttgtcagtatttttacatagcttacttctttataaataacacagcctgaaagtgaatctgggagaaactgtcactctttctaaatactcacagtcaggcacctaggaaaaagggacattggaaagtatttatgattgcttgaatttcactctatttcaaacatagccttttattgaattgagaggcagagcaaacgaactacctgagagagaaaaccagaagaatgaaaatattcactatgaccaagatttcttcaaagacaacgatgtatcacacagcaaatccatgaaaattggcaggtgtaataaacctgctttgctcaaggatcccagaagcacatactggatattcctttgggtcagagtgtgaatgaatattgagtacgtcacaacccacactctgcctacggtcttgtttggatttattgttagcataatagcacctttaagaatggaacaccaggctgtatttttaagccaagtgacatcttcgcaatttctaatagaaatggtccaatttagaaatgctgaaaacaccattttcatgcaatgcttactgataaaggtggttatatgattatcaaaccttcttccaaagtaattgattcttaaaccttaaatgaaattgttaggactgataagaatgtaggaaaaaaaattatgttttgtcagcactggggggaaatgattggtatgcagactggcatactataggaaatgtaggctcttagttgaatggaatgtgagtaattgtgttttcaccatgaagtctttgaaggagagggtcaagtatgctatggaagtaataacaccaggtcatattttcactttaagggtactcaaaaatagctatgctatgacttgaaaatagcatggaaggattcataatatttttcttttcttttctttcttttttttttttgaggtggagttttgctcttgttgcccaggctacagtgcagtggcacaatcttggctcactgcaacctctgcctcccaggttcaagcaattctcctgcctcagcctcccaagtagctgggattacgggcatgcaccaccacacctggctaactttgtatttttagtagagacggggtttctccatgttggtcagactggtctcgaactcccgacctctggtgttccgcccgcctcagcctccctaagtgctgggattacaggcgtgagccaccgcgcccggcccaggattgataacatttttcttcccccgatttaaacaactccagatgcttaaaatcaaactccttgccattccatcaagtcacgaaacaatctggcttcttctgcctacctctttcatctctacttttacttaacttccctttgctcattgcattagagtcacatttttttcttatgctcatcaaaataccaagattgttctctgcttagggtctttgcatgtgctgttcagtcgtgtgaaacactcttcacatctttctatgactggctctttccattatacccatctccaatcagtcacctccatagtctgacgttcccttaggaccttgtctgggtaagtagtagcttatcccactattggtcctagtcactcttgtcaaccttttttactgttttcaatgagctcgtcgctatctggaattaacttatttatacattgtttaccagtgcactttctgcctatacctagaggaatataagttttatgtagttaaaatattgtgagtcgtataagtggctgcatcactgatgcctagtacagtgcctgacgcatggtacgcactcaataaatatttaaaataaatgagcacgttattgacctctcaaaataagaccccaagactgcttagggataaaccaatattcccaaacacctttagcaattgaactggttcttgttagaatctacttttaggcataaatgttttagtcacaatatatcttttgggcttaggattttttttttaatttttaaaaactatgctgtatactgaaagtagaaagctattcctaatttttgaaacgaatacagtttgcttagacacacttgacctaggcaggggtaacttcagtgtggtttgttcagggagtagaacatttaacatacagccagtgctgtttcagtattactgggtagcaaatacacgttgactttgtgtcacaaataatttaaatatttaaacttgtgggctgtattttatctcaagatgtatttttttattcctttttagttctgtcattaccagtcaagttgatccaccattgcctctccccccaagacatttgtaccagcctcctacagtttctctctattttgaggcatcctctgtgtcctttccaagacttagcttattgacacagatgcctatgcagagaaaacttcataaagcacggctgattttgtcattactctatgtcaagacctttacagatcccatctcctataaagttcaaactgtctaatcaagcattcaaattcaatttccttcaacaaatattggaagttctccaattaattcaattctacctgtgtcatgagccatgccttcccttactctccttcatgtatcctttattcaagtcagactgtgctacttgtaagatctctgcactttttaaaaatccccaagtctctccttatatcattgtgatattctgcattgttcttcttcagatccatttccatttattaaaggcaaatccaatctttaacacacttattcgaatgctatgttcattctgattaatcctcccagtaacatattcttccattttctcctgaaaccttgattctgtgaagaagaattttgtcatttccacactctttgcttagaatcaggtcatttctctcaaatatatgctcattctgagaaatatatagtatttacacttgttgaatttgtaactgtagaattcttagtcttaaagggaaaataaaaactcaactcaaatatttgactcgttatacctcataactagtgcattcgagtttataaagcactttatgaatagtgtttcatctgatcttgatagtgggcaaaggaagaaacgatatttgagtctcagactttctttctttctttctttttcttttctttctttctttctctttctttctttcttgctcttgctctttcccttccttccttccttcctttccctccctcccttccttccttccttccttcttctttctttttctttctttttttccagtctcgctctgttgccaaggctgaagtgcaatggcgctatcaaagctcacttactgctggcttgacctcctaggcttaaacaatcctcctacctcagcctcctgagtagctgggactataagcatgcaccatcgtgcctggctaattttttattttttgtagagactgcctctcactgtgttgctcaggctggtcttgacttcttggcccaagcaatcctcctaccttggcctcccaaagtgctgggattacaggcatgagtcactgcaccttgcctctttttttttttatttttaattttaatttttctgtgtacatagtaggtgtatatatttatggggtacatgagatattttgatataggcatgcaatgcataatcgcaatagggaaactggggtatccagtcccttaagcatttatcctttgtgtcacaaacaatctaattatactcttttatttatttatttatttatttatttaatttatttatttatttatgtacttattgtctctgttgcccaggctggagtgcggtggcacgattctggctcactgcaacctctgcctcccaggttcaagcgtttctcctgcctcagccttccaagtagctaggattacaggcatgtgccaccacacctggctaattttgtatatttagtagagacggggcttcaccacgttagctagcctgatcttgaactcctgacctcaggtgatctgcccgccttggtctcccaaagtgctgggattacagatataagccaccacgcctggccctgttattttcaaatgtgcaattaagttattattgactagagtcaccctgttgtgctatcaaatactagcttttattttttctaacttttattttgtactcattaaccatccccacctgtccccctcccgccgtcccagtttccttcctagcctctagtaaccatccttctactctctatctccatgagttcaattgttttcatttttacatcccataagtaagtgagaacatgtgaagtttgtctttctgtgcctgacttagcttaatgacctccagttccatccatgttgtttcaaatggcagaatctggttcttttttatgactgaatagtactccattttgcatacgcaccacattttctttatcaatttatctgttgatggatacttagattgtttccaaattttggctattgtgaatagtgctgcaacaaacatgggcatgcagatatatcttcgatatattgatttcctttattttgggtatatgcccaccagtgggattgctggatcatatgggggccctagttttagtcttagttactggatcatatggtaactctagttttagttttagaggaagcccaaaactgttgttgatagtggttgtactaatttacattctcaccaatggtgtatgatggttccctttacttcacatccttaccagcatttgttattgccagtcttttggatataagccatttcaactggggtgacatgatatctcattgtagttttgattcacatttctctgatgatcagtgacattgagcactttttcatatgcctgtttgctatttttatgtcttcttttgagaaatagctattcaaatcatttgcccattttttaatcgcattattagatttttccctatggagttgtttgagctccttatatattctggttattagtcccttgtcagatgggtagtttacaaatacttccttccattctgttggttgtctcttcacttcattgattgtttccttttctatatagaagcttttaaacttgatatgatcccatttaaagattgtttcttgacacagactcaattttttttggcagcgggcaggattttcctctgtcactcaggctggagtgcagtggcaagatcatagctcactgcaccctcaaatttgtgagcttgaactatcttcccacctccacctcctgactagctgaaactacaggctcataccacaatgcctggctaattttatatatatatacatatatatacacacatatatatgtgtgtatatatgtgtatatatatacacacatatatatacacacacatatatatacacacacatatatatacatacatatatatacacacatatatatacacatatatacacacatatatatacacatatatatacacacacatatatatatatacacacacacatatatatatatacacacacacacacacatatatatatatatagacaaggtcttgctaattcttaaactcctggcctcaagtgatccttttgcttaagactcccaagtaacagactcaaatttatgaaacagttaacctttaaaatctgaaaccaatttaaagggggaaatcacccagggccttgtaagtcatactaaggaactggattgtgttcaaattaccgcctaattaccatagtgggggcttattcatggaggatatgtgccaatcctcccagtggatgcctacaaccatgaacagtcccaagccctatacgcattatgtttcttcagtctgataacagagccagctactaagtgattaaaggtgggtagcatacacagcgggggtgcactggacaaagggatgatttcctttctgggtgggacagactggaatggagcaggatggtgtgggatgactggagatttcatcacactacccagaatgcaatttaaaacttatgacttgtttatttccaaaatttagcgtttaatatttttggaccttggttgagcatggtagctgaaactggggaaactgaaaccacagaaagtaaaactgtggataaggcgggactattatatatagaatttttttttattttggcaaatatactgtcattaattttatttctttttatcttataaaaataaataccttaatatatttatctagtataaattgacagaacaattaatctatataaaaataatctggttctcaaacttaacttcacattggaatcacttgaggacatttaaaaaatactgttactacaatcccacttagaaatttagagttaatttatctgtgttcaatgtaatcattcgtttgtttttctttttccccccctcaagacaaagtcttgctctgtcccccaggctggagtacagtggcgcggtctcagctcactgcaacttctgcctcccaggttcaagcaattctcctgcctcagcctcctgaatagatgggattacaggcatgcgccaccacacctggctaatttttgtatttttagtagggacaaggtttcatcatgttggccaggctggtcttgaactcctgacctcgtgatccatctgccttagcctcccaaagtgctgggattacagacatcagccaccacgcccggccaatcattcagtttttaatttttattaaaatccaaaatatctcagtaagtataatgtgcataaattgtgtcagttcaatgaattttcataaattcaacctacccatgtaagcagcacacaaatcaagatgcaaccatggctggatcccagaagccctttccaatcacagctgagacacagaagggtagccattatctgacttctcatcacacaatttacttttactgtatatatatatatatatatatatacacactacctatatggtcatttagtgtgtattctttcatttctggcttgtttcattcaatatcgggtttgtgagattcatccaagttgttgtgtataatggcaagtttgcttactctcattgctgggtagtacattattccattgtatgaatcttttacagcctgcctttccattctactcatgatggaccttggtgtttttaaaaggacctaagtgcttttaaaagctaagcaaatgattctagtatgctgtttctgaggttgagtatcaccaatgtagtcataaatgtacgtaaaaaaaaaaaaaaagaaaaattaatttgatatcccattaggcttccatagaatttgtggtagtgtttttaaatttgcataattctcatttttatttatctctagttgaaaattaccgacatatttagccagggtgtgctggagctgactcgtagcagctcatgaaagctgagtgttagtttcaggaattttgtaagcaagtcgtttaaacacagctattattaaaaattaaatagacatccaattaaaataattatattcaaaatttcataaatatttaaaattcattacttccaaattattttagaatattttcctattacttatggtcttgaggttgttcatatctattgtatttgtatggtggaaatatcatatcatggaaactactgtgcatttcttcccaaattatgtcatgttattatctggaaatcactcatgggtagtatttacaccacagcaactggcaaaagctacaaagcaggtcctcacttagtgttgatgctgaaagagtttcagtaatggatataatttgtatgacagtgagaaatagtctaagattatattgcatataatgatatatgattatatatatatgatatatatatatatataatgatagcaaatgcttactgggaataaagttagcagcagattgggatacaattccaattgtcaggtcatggttgaactgcaactgaagcttagctagagacataaatattcaataaaacttagcaaaagccttctatgaaaatcaattgacttatggaatttgtaattaattatgatattatatattttattatttttaattgtgggctacacatcacatccattgcattagtaaatttgataataaacatgtgtatatacatatatatacatttatatgcacacaaatatatgtatccacattcttttcagagacatggttgttaaataactgctagcatgctgctctgttgagctatgttttattttttagccatttttattagtggaagtatgccatgttttgcagatttattcggtacaaaaaacaaggtagagaagtaagtaccaagaccccatggtgcccttaggaatatatatatatatatgtatacacacacacacacacacacacacacacacacaaacatatatatgttctgtacatgtatatgtgtgtagatatatattttctatacatgttacattacactaaatgatattgtaattgttttgtctattttagcactaatttagattttgatattttatttttcatacagaattagtactaaattgaagaacaaagataacatatttggactcagttaaaaaaaaatctcaatctgaagatacctaatagtttaccagaaaacagatgaagagtttctttcctccctcataaaaaatcaaacttggtttaccgaaccttgcagctaacaacaggtgctgtctgctcactttgccagaagctcacaatagaacagattgggtacacacagaactaaaaacaacatttgagtaaggaacaaaaccctcccaaatattctgaccagctctataatcagttcttaatattgagcctggaaacaataatgatttctttaatgtcaaaatgggcaaagaaccttgtttgtattgttttgttttgttttacctgtatttgtgcacatgggaatttcagaaagcacttataatcaaacacaaaagtgctacatttggggttgtacagctcagaagggaggggaaaaaaaaccccttcttcttcgtaaaagtcttacagagaatcaccaatcacagagggagaagtgtgttctaatatcaaatctgtgtggctgcaccatcccttcttaattgccaattgtcttttccactttgtcctctttctgtaacattgctaaactgaatctgaggccagggctttaacttgatatatctaagttcatggccatacatttattttacttactcaaacacttagtctctcaaatagaattgatgatttgtcaaatgatttgttgttgcataatgacatagctgtggaagccggatcttgctttatgtttgagaacacatttccagagtccaaaagcacgtgaggattgatggcacagatgggcttgaagaactggtttcagaagtgccatcttctactcaactgccagtttttctgtttatcatctagctagacattctgaccctttgtatcctcccattgcttatatttttacaacgtcaaaatcactccaaatgagaaatgtgggaacagaaaagcaaagcaaagagtattcagaccacagaaaatcatctgtgcctagggactggcctggcagcctcttgttttctgtttgtcccttgaagacaatggaattgtaatccttgtaccaggagatcacaccatcctttccagttctgattacccaatgattctaagatgagaagcgttacacagttttacaatttcttaatagttctgatgaaagaatatatgaggacaacgcagcttgttttagctaaaaggcaatttgggactcttctgtgaattttatttatccatcttatgctattcccttgggtaattatgagtgaattgctctgtgctgtgtttcatcaaactttttctgactgttattttgaaattattatcaagagcatcactgaaggaacatagtcacaaatggataatgcttattaaactgcagtgttatatttgaatgccactattctatggctaaggttgtgctatgccctcatgtgccagccttgaaagctcattaatttgtttggttctgccagtcaggctggagtgcagtgacgcgatcatagctcactacagcctcgaacccctgggctcaagagatcctcctgcctcagcctcccaagtagctgggactgcaggcacatgccaccacacctggctaattttttaaattattactactttacagatgaggttttgctatgctgcccaggatgatctggaactactggcttcaagtgtcttcccacctcagcttccctagttgctgggattacaggcatgagctactgtgcccagcaaagctcattgattagtctgcctgtctgtcaatgcggtcaatcagttaattcagtgagatactcagacactccaaacaaactattaatctgaggagacaacctgaaacacatgattagcagctgatgtcgtaagaacataaacacttagccaatctgtaatcaatggattcatctcaatttaaactactgcttcttttagtggtaaacattgaagagcaggggaaatctgcaccaggaaacaacaagtttcactagactgacaaccttggctgagctagaactatgttttcagaatttctcttccctatccagatctggattagagatgaacaaaaaggaaatttgtgtgagatttggaaggtggaaatgatgctactctgtgaaagctgcatgtaagtttgtctggtgagaaagagacacaggttaacagagagctcgtcctctgtttccttcttcatatccaggttttggcccaactggtggcactactgaccaacattgaccttaggtccactccagttttagaggcaacagttcacaaacgcttccccttcacatgcccattctggcagctgaacttgctggcttccttgcaagatctgacttgaccacctgctccagtgcccaagagggcttgttagcagtatcactgtgatatttcccctctcacttttgtaccatcatcttctcttacaattacataaggtcttcctcctaaaatgaatcctctattttacatgattcacagtagttttgctttcctgattgaaccttaactagtatctgtacagttcaaatttgtcatacatgacaggggaatgatatccaaatcactatactttggtttttcctatgatagctggtgaatatggaggctttggaggggctatagttttcatgtagaatgtgattaggatactgaagaaattcttgacatatattaggactcagaagcctatgcaacttggcataggtattttttgtctcttcctctgtattgtgaagcctccctgtgccatttagtttttaggcagcagttcctgcttaccatccaaaccccttttgaaccttacagaatccccaaaagtcagccttggccttaagtcccacagtactgtgctttacctagggagcatgttaattcatgcataaaaattaaggactcaaggtacattatatcactgtacatctgagtggatttttttgtggcttaaccttgatttttagtgctataacccaaataaagaaaaatgcaagcatgcattggagggtattgggctgtaataaggtaataaagactgtttcagtggtatcatatatagtgctttacagaatatagggtattttcacacctcacctcatttacagttcatgatctctcatgacattattagagggtcagagatgttacatgcttgtccatggttatttgtgtggcttggaggaaccagaaaccaaccaagtgttcatatcctagtgttcatttcactgaaagatctggctttttaatgaagccgttggctcttcccattcccattctcattaccgctcatctaggctgttgcggaagactctgcaatcctcttttctcctattatcagccccactcttcctcccattacaccaataggaaatcataatagttttatgtttctcattttgcaaatgagtttcaatggtccatctgcttggatcaaacgcttcaagtgctgtccctttgctgcagaaccagatagattcttctcaaccttgtattgaagctctagcaggattccaatgagctttttcaaacttttttcctacctttcttctataaagacactttgtgctggccaaactgagtgcatcacccccactacacacacacactcacttctacaaggacttataataataataatcacaacagctacctgcattgaccatttagtagctgctgagtatctcactagttctttatctatattacccaggcaataaccatgagatgtgcattactattgtttccatttgtaatgaagaaatcaaagctgaagaggttaagtgacttactcaagataacatggcaggtcagtaacagaagttgtattttagcacggactgaattttaaaatggcactctcaaactctctgtgccactgcctttcttcgagcactccccatttcttacagtgcctgatccctctgaacacacattttcatttcttccttcccttcaagggccactccaaaatcagtaagtcttccatcatctccacattaccacttacccacagaaagtctccctctcttgaattcctacatctctgagaagatgcatgaggaaagagaagtataacttatgagtcggtaacattcagtgctcatttctcagtgcgttgcttggatcctggcatgcaggggcagctcattggcatcaactgttctaagtactggctaaacaagagacaagctctgaggcatatagtcacaaatatgggcagtaaggagttatcgtgggagtggtgaatgtggaggggctctgagtgggaaatagttcaacctcattttatagatcccacatctaggatacaaatcagttaagccacttgcccaatgtcattcagataacacaagagtacccgggagtgctgagatctgaacccaagtacacatatattcttcctgcattttgccaaacacaaggcaatttctaggcttagtggagttaatgatgagcaaaaaaaaggcacatcctagaagcttctggtcaaatggcagagatgctaagatacagattaaaattttttttaagaaaatacaagtttttaaaattgttttaaaggaatcaaactacacatctcatccagatgacagatgctactggggaaggaagcacagcacttatctatcagtagggctagggagctcttaagctgattaaggacacaggctccgcaattaaagacacctgtggcacatatacaccacagaatactatgcagtcataaaaaagaatgagttcatgtcctttgcagggacatggatgaagctggaagccatcattcttagcagactaatacaggaagagaaaaaccaaacactgcatgttctcactcataagtgggagttgagctatgagaacacatggacacgggaaagggaacatcacacaccagggcctattggggagttgggagcaaggggagggagagcactaggagaaatacctaatgcttgtggggcttaaaacctagatgatggattaataggtgcagcaaaccaccatgacacatgtatacctgtgtaacaaacctgcacgttctgcacatgtatcccagaacttaaaattaaaaaaaaaaaaaagaaacagtggttgtgagagaacagtgcagtagagtggtagggatgaaagacaaattataaatggtggaggagtggggagaataaaacaaaaacaaacaaacaaacaaacaaaaacaccttggttcatacctggcaccttactacttgtgtggcagggcaagctactgaacccctctctgtcttacatactgcatgacaaatgatacacattcaagtcacactagttttcattttttcctatcagttgccaatttcttgtactagagatctttacgggaggtcttacctaggtgttaccttccttttcacctagatgacgtatctgaaatgttgcccagatggggatccatatccaatgtatctttttactctgtctccgaagtacctaacatggctttggtaaatatcttttgtttagctagcaagcacatattaaaataatgaagtgccccgtgagtcacaatgatcatcacaaacagccatacgacatttcctatgcacttttacactcttttaatctcccaggtgattagatatatagcttaaacataccgtaagtccctcaggtgggcaaattgtattggccccattttacagatggggaaaatgagggaagggtaagaagcttgccccaaggtacagagtgagccagtggtggaactgggatttgaatgcaggctgtctcgctcctgaatctaacttcttagctgctagattcaaccgctgttcaacagagtgaagggatgctaacacccaacatatattgagcactcatatgtgctttcaaataattccatgagttaggatctcaaaataatttgacgacataggaaatgtcattctttttttcatttcatttatttattttgagatgaagtctcactctgtcactcaggctggagtgcagtggcacaatctcactgcaacctccgcctcctgggttcaagcacttctacttccctcagcctcccaagtagttggtactagaggtgcacgccaccacgcctgggtagtttttgtatttttagtagagagggaggttccccatgttggccaggttggtctcgatctcctgacctcaggtgatctgcccacctcggcctcccaaagtgctgggactacaggcgtgacacatcgcgcccggcctggaaatgttattaaccctgtgttttaggttgggctcctccagaagccgactttcagaaaaaaatatgaatgaaagtaatttatttaaaagataatccccaaaagccccagtaaatggtaagtgagacagggtgagaaaggatgaggtttgttattgagcagtgcacatctagtatgactgagactctgtatacaggaggtagtgtagaacacacctcagtgtcttatcagaatgtgactaagggaccaggaagctgggacacttgcccgtcactgccctttcatcactggcatcaactgttctaagcactgactaaacaagagacgagctctgagacgtatagtcacaaatatgtgcaataaggagttatcttgggagtgttgaatgttgaggggctctgggtgggaaatattttaacctcattttacagatcccaggtctgggataaatatcagttaagccacctgcccaatgtcactcaggtaacacaagagtacctgggggtgctgagatctgaactcaagcacacatatattcttcctgcattttgcatgttctctctaagcacagagcaatttctaggcttagtggagttaatgatgagcaaaaaaagggacattctagaagcatctggtctaacaacagtgatgctaatatataggttaattttttttaagaaaatacaagttttgaaaactgttttaacggaatcaaactatattgctgatatagagaataactcaggtggacgtgagtgggaagggtgtttaaaaaggcgtattcctggcaagggaaagccaaagtcactcatccgtggagacaaagcaggccagaatgactgatggggatgcagtgagtggcagaggaaggatggtatgaaatgaggaagaaggaagggaaaaggcagacatactagtctcagaggccctagtcatgctttaggatttaattctaaaagcaatgagaatttatcaaagagcatgcaattggcagaggatttgttcttctatttagcctaagaggcctccagattaaatgttctttctaaatacttaaaaaaggtgacatagtctaaaagggagacagcaaaccagctagaggctgtggtcaggtgtggggaaggaggggacattcagcctccttgttgtattcaaccgccttcctcagctctgtcttctcttttctgattctgtccacattccactttaatcctcaatgcttgtgagatgatccagagtttgactgcatatttagcttttcagggatactgcagataatgatgagaattattcatctttcttcagcataaaccgtatttaacgaggggctagaaaaataatataaagaggctttatggtcaagtttcagagctgagttaggaaagtaattccaagtagtagagtttcagcatattttatttcctccttttacttctctaaattttccaaatggatttatactatttttaaaataaaaatggtcaagcctttaaacatttgtgccaattatgtagatagcctgcaaagctgagacacttctcactatgctaatcagataactggctcaggctttctattttatttgataaactttggtcattctgaatttccaaatatcaccaaaaattctgactttgataaataatcaaatatttagctctattgtgtattttcttacaattttcaagtgatatgggtggcccatattatattcaccttaaattttattagaaaaagaatactttcgccggttgcggtggctcatgcctgtaatcccagcactttgtgaggccgaggcgggcggatcacttgaggtcaggagttcaagaccagcctggccaacattgtgaagccctgtctctaccaaaaatacaaaaaaattagccggatgtggtggtgcaagcctgtagccccagctacctaggaggctgagacaagagaattgcttgaacccgtgaggcagaggttgcagtgagctgagatcatgccactgcacaccagcctggatgacagagtaaggctccatctcaaaaaaaaaaaaaaaaaaaaaaaaaaagcaatacttttaatatgcttactcacactattcaaagatctttaattataatcatttaaaaactgtgaggtagaaaggacaataagtgttattctccccaatatacagaccaaaatatgggtaacgtaagctaaagacccacagttagtagcagaacccgttgaaaatcgagtgtctatttaaataacaaacctgggtgtctatttggggataaaacacccaatctctacagccctttgatttcaaaagaactgatatcccaggaagatagagaacttaacataaataagaataaccaaagtgaagcttaaacatttgtacaaaccttgacaatttcattttttgtattgtttgtattacccaagtcttatcacaggggacactgagaaccaaattaagtgtgtcaaaaatcaaaaggaaagatacataagccatctcctctgaattttttcctccttcccttgtttcttccttataaacactgctgggtacttaacttttaaaaacatgggctttgaggaaggacatagctgggtaccaatcccatctctgctctttaagaagttgggttacctctgacaagttacaaaccttgcttagcatctatctctttacctttatattagccacaatacccactccatagagtgggttttatatattactatttgtacagacttgcaagaatgcaaagtgcgtagaaagtgctcgataaacagtaactagtggtgactggggtaggggtagtgccaatagttgctttaagaacagttgaactagcagcaatggccaatgccattggcaaccaaattgtgctcataactctatggaccagatcttaagactccaacactgggaaatttgctgtcattctttgatccctgggcttaaatgtctacttcttaatgctatgagctaaatattcaatgttaaaatggacagggggtcatgctccatctcatttatcataagtgaataactgggttattttgaccatagatcaaactccaaaaatttaagcaaagaaataatatgtgtaggttccagaaagagatggggaaaatgtgaaaatacagctaaaataacccacaatttaaattttggctacagagttaatgtcctatttgtaaaccagaattttataatctcaacactgctgagcagataactaatcatattttgaaccaaataattatttgctgtgtgagcctgtagatgtttagcagcattcctgcctgtacttataaatgccacttgtgccaccaacccccggttgtgacaaccaaaaactggcttgactcccaaatccactggagcaaaagtaccttcgattgagaaccactgctctatactctttttttttaggcagagtctcactctgttgcccaggctggagtacagttgtgtgaacaaattcattgcagcctcgacctcttgtgctcaagtgagcttcccacctcagcctcccaagtccctgggactacaggtgcatgccaccatgcctggctagttttttaattttttgcagagacagagagtccccatgttgcctaggctggtcttgaactcctgggttcaagccatcctcctgcctcagcctcccaaagtgctcgcattacaggcgtgagctaccacactcggcctgctgtatactcttgactttagaatgctcataattctaaagaaccatgttgcatcgtgccttctcataaagcctcagccttcaatttcacaccatccaaacccattgaagctcttgagtcccttgacatggtaactcctatccctctcccatcagaccatctcctcatggaggtgacagacaattcaggaaaatctcccattaaatccactcccctaaagccctcttggaagagtaactatatgaactttatacttctctccctcccaactttgtacctactttctcagaggtgcttaaaaaatatcacttctctgaaccccagttctctcttttatcagtttcatgtcttcaaaaatagcaggattatattgccctctgcagatgctactggtgataaagaataaaaattgaaactgactttttatgtaacagcagtgtatcacaaaggaggaaaacaagaaagaagggaattaacaatgattaaacacctaccatgtgccagcctctgcactaagtacctataatattacttcatttaatctgtatagtgaaactttcgagtaaagttttctgagatcaaaagaaagtgcatttctgacattatcttttaaataaatggtcatttcagattgttccgcccactttagtgtaccatttcccaaaagcatccaagaatccttgtgaaaagtgaagacagtctgcaataactctctgtgtgtgtgtgtgtgtgtgtgtgtgtgtgtgtgtgtgtatcacaacttaacccatagttttggaatgtcagtcatctcaccaaaatccggaatgaactatgtcccagtggatcacatattcttgaaagggcagtcagatttctgataagcaactcatatacacgagagcaaaggcaaggttctatctatagccctgtcatgaggcaagctgtctctttttgaaaatgatttagaggcagctggcctctggtctgctagtctgttggtgtctcacttggctattcaacatcagaggcaggaatctctgcccattttcacataatgcacatgtcttcctactggaagatctttctccaggagtggagggttcaggtcaaggtctctgctcacaaaataaagacagaactcagcactatttatatcacaccagaactgactcagcgccattgcccatttaactcacttgtcttgctatttggagatgttctctctcttctggcttttctgccatctgtgacatctctccaggcataccgtaaggagaggacattttgaaggatcactctatttgtttcatcctagaaaagtttatatcagtccaattctgctgctaactggacttcgtctctggcttcttcatttggaaatctacctcttatgctaagtgcccttatatcacctggcggtttgcaaagaggtgagtgtgaatgctccagtaaaaacagctgcctttactaagctttacagcatgtgctcgatattgagctaagtgctttacgtgaattatttcatttaatcctcagaaaatcctctaaaggacaggaagtattataatctccatttagataaaggcaactaattaagataagttaacagctgccaaatttcatacaactagtacatgacgaagttgggatgtgaacccggacccatccaatcccaatgcccaaggatgttccactttatcacaccacctccctgtgagcttctgttgagattatttttttactgcctgatccacaatattattgtcatctttatttggcttggcggttgacaaaatgaatgcatttctagaatcttcaatgacgtgaaaattggattacaaacaaaaccatctctggaactgcctgtttcctgtattttccttttggggaaaaaaaaaaaaaactaaaataatgagctagacgagaattctgatctcagatatgccactacatgctcctgcacaccagagcaatgatgtacctctcgagacttctgtttctttatttgtaaactggtggggttggaattatgaattttaaattcctttctatctccaatacactgtgattttctgatgcagtgggtattactgcctcacaaagggcttacaaaatacactggagaaaacaccagtaatagaaaactctacattcattgctacttaactttgtgctcattcaaatatcttcatagtgtctctctccagagactccaagcacttacttaatttaatatagccctttataaaatgggtcttctctgcaaatctcagcttgaggcatttctctggtacccacacaatacattcgcttttacagaggctttattttttcccctaagaatttcctgttcatttagctacagccagaggtaaagctaacaaatttgtacatctcttcagaggcacccaatttactaaatgtcttttaattggcataggagctcatagaatgtcctctgagaggtcacgttaagagttattttgttaaatacaaaggtatagaggaggtattttcagatggaatctgaaactcaaacggaaattttttagcagcatctcatggaacttctcagttttcttatcacaaatgttctcctgtcagatcttctgtcgtaaatatgaccctgtagactgaacaatggaaatgacagccactgaatccatctctctttctcttttctgcatttaaaattcaagattataattgtagtacaaagtatgattagtaactatcagtgtgaactttggagtccacactaatctcctaaaatttcagtcatccattcaacaatactcatggcttcacccacatgctcacttctgtgtcccttaaatcagtggctgacacataggaagaacccaatgaataataatgctaaattgatatgccaagcactgtgctacaggtaaagcactgaacaaagctgacattgccccaatccttaaaaagtttatagtccggaaataattgtttattcttatatgcatgcgcccacacacgcgtgtgcacacacagacacactcccaagcacatctataatcagtgtattaaaacaaatatcttggcagagtgtggtgggccattcctgtaattccagcatttttggaggccaaggtgggtgatctcttgaacccaggagtttgagaccagcttgggcaacatggtgagaccccatctacaaaaaacacaaaatttggccaggcatggtggtgtgcctgtagtcacagacactcagggagctgaggaaggaggattgcttgagggtgggaggcccagactacggtgagtaccactgcactccagcctgggcaagagagtgagactttgtctcaaaaaaaaaaaaaaaaaaaaaagacatatctttaagagcatgtaaaaggaaaattccacttgatctaaggagttcaaataacactaccataaaaaattgactttctaactaaaatgtgaataaaattttaccaatgattagatacagtggagaagaggcatttagggtataggcaaaaacaaacaaacaaaagatcaaagtgaggtatgggagaaaacacagtctactcaaggctaacagcaggttagccaattgcagatagcaactgggagcacagcagatgaggcagcagggagaggcagggaccaaactatataggactttgtaggtccttttacaaattactaaggatactctactatattgtaaaacaatatgaagttattaaagactttctagctgcaagagggcagtagagcaggagaggcaaacaacaaagacattatctgatttgtatatgcaaaagaccccattggctactctttggtgaatatattgtgagagtggaaagaatgagaattaaaaggcagtcatagaaatcaaagccaaaatagcaatagtgtgatgcgggactcttgctgtagcaacagaactatttgaatagatttaggatgtaattgaagggttaaaagtgagacttggtattgcattttatatagatacaatggagaagaaggaatttgtcaaggaggactcttaggtgtctaacctcagcaattggttcactggttgtggcattttctgaaataaaaaaggagagaactaaatctggggtgagattgtaagtgcttccttctacattttgatttgaaaagctctgagtttattgtccctgtagaaatattgagtacaaacagtggatgtttgtggaataaaaagaaggaaaaggagtcagagttgtgatgaatttgggaatcaccacaacatgtataacaaaatatagtagaaatattgggaggccggggcgggcggatcaactaaggtcgggagtttgagaccagcctgaccaacatggagaaaccctgtttctactaaaaatacaaaattagctggatatggtggtgaatgcctgtaatcccagctactcgggaggctgaggcacgagaatcacttgaacctgggatgcagaagttgctgtgggccaagatcgtgcaccgcacctgggcaacaagagtgaaactctgcctcagaaaaaagccccagatcaaacttgaggctgtttgattcaacctggttagccgaagagagtggctggtagagaatgactagcatgcaacggtgatggagaaatattagccacaaagatacgaggcaaactagggagtatggaatcacaaaaagcaaagaaaaagcaagttttcaggtgagggaaaaatttataactcttgattattcaagtatatagagaagttaaaaatatctacaggtatcataacaagcatgtcacctacaactttagttgaactatgtctgtttatttaagagataagtaaaattgaatttactaagtggaaagtgtggaaatagaagcaatagatacagacaacaattcatagatagatgtttagctgtgaagggttttaaaatgtttatgctaataaagtattaatgagtcaaaatgtactacacatgatctctaaatatcactccacagattatttcttcattacaagcagagtaaaaggcctcctcaatgctaagaggtgcactttctactacaaccaagtgatcaaattttgcatcactcataatgagaccaactgaaataatacacctctggatgacaaaagaaagcatagaatattactcatgtccttttcttgccataatgtttaatcttaatctaatcctgaggaaacaatcacaaagttccaactgggaacccttctccatggcctgggatcttcaagaacgtcaacgtgataaaagtaaaaaatgtgaggaaaatgttctaattaaaagaagcgagagattgcatagtaaacacaatgttggtttgatattttaaaactcagatataaaaaattttggggggtttgttgaataaacttgaacatagattataatgaagtattgtgtctaccttaattttctcaagtgtgatgttgttatgattattgaaagagaatagtctttttctcagaaaataatgctgtggaatttagggatgaaatgtgatactctgcaacttctttcaaagcagttaaaagtaagaaatttaaattgtatttttgtcttcatttattgcatttatagatctcttaatttccttgtcaagattcaagattctatctagcatcaccttttttctgcctgaagaaatttttaaaatatatttcaagttcagctctgctgacaatgtaatctctgaatttttgtttacctaagaaaacctttatttctccataatttttgaaagatactttcactgggtatagaactgtgggcagacagatttttttctttcagcactttaaagacatcactatgttttcttcttacatgcatgatttctgaagggaaatattctttactttttttatttttcggtatatatgtataaattttttttctttattggtaagattttctgtatgtcttgatacttctatttgaatatgacttctgtcttgactggtgttcactgagtttcttaaactccccctgccctttccattttttttttttttttctttgagacagagtctcactctgtcacctaggctggagtacagtggtgcaatctccgctcactgcaacctctgcctcccggattcaagcaattctcctgcctcagcctccctaatagctgggattacaggcaccaaccaccacgcctgattaatttttgtatttttagtagaggcagggtttcaccatgttggccaggctggtcttgaactcctaacctcaaatgatccacccacctcagcctcccaaagtgctgggattacaggcatgagccaccacgcccggcctcccctgcacttttcttactttattcttccaggattccaattacactcagctcttagatgctctgttctgctttattcactctttctctctttgtgttttagtttaggaattccttaatgacatcttcaagtctaccaaatctttcctttgatatgtcaagtctactgataagatgaaggtttcttcatcactgctactatgttttccattcctagatttctacttgatttttaccatctatctattgaaattagcctgctgatgatgcatattgtctgtgttttccagtagagcttcaatatatgaattagagttatttcaaattctctatgtgatagttccaatacctatgtcatatctgattctggttctgttgattgctttgtctcttggtagtttccttccccccactgttttctcatatgcttaataactttttgctgaagctcgacattttgtccaaaagagtggagactaaatagtttctaaacctaagaataggcatgtttttacttctgataggtcgttagtgtggaagtttgagcaatgtagtcagtagttgtgctgggtttgggtttgttatgcttgcactctaccactggcttccacttcctttggttatacttgtgtttagagtgaggactggtttgccagagagtagtctgtttcactcccatctttagggtaatctcttcacactgcaactctctgttagtccatttgcattgcattcctatgtaaaaggaaatcctgaggctgtgcaatttataaagaaaagaagcctattttggctcgtggttctgcaggctgtacaagaagcacggtgccaacatcttctggtgagagtctcaggacacttccactcataggggaaggcaaaatgggagcaggagcatcacatggcaaaagagggagcaagaatgacagggggaaggtatcaggctcgttttaaacaaccaaatcttgcataaactcattgagtgagaacttactcattaccacaaggacagcacaagccattcatgagggatctgccctcaggacccaaactattcccactaggcccacttccaacactaaaggttatatttcagcatgagatttggagatgacaaaacatccaaactatatcaatctcggagtctctacccacacacttttgtaactctcaaagctcttaatcactgttagatgtcactggaggcttttcagcccgggagcgtggtggtaagaggagcattgctgttctaattaagccttggttttaggcgaattatgtccttaggtttcagaaaggtggctgcctccgtgttccagtgtttcccacagctgtaattctgggaagggagtagagttttatttttaatgcttcttatctctagctgcaatggctgttccctagttccctaagacacttcctcctgcagtttaaagcttttctcccaaggagaattaggggagggtgggatacaagcaggacttcttgtctttcctgcagtggctgctgttctcctccccatgttttgtacaatgaggattctaccacagtcatttttttgtgtgtgcatgagcttctggtggggcccaaggaaagagcctattctgggtgcaaatttccctgttatcttgccccaaggttttctacagtgagaatctacaagccagttaaaatttgttttatgcctgcagccaactgaaccacattccttctttactaatttgttaccaggtgagcaaatgctagcttaccctctctccccataggcacatatctttttttaggttttaagttagttggtattcctgcaatcacagctctctgactagttcaagaaaagttatgaatttgcaatttgtccaattcttttttaatgctgagagtgggcataatacttttttattccagctttgttcatcccaagcaaaagttggaggtctctgaaacttaatttcaaatagttcagcaaaaaaaatgaaaagaaagagaaagagtaaatgaaagagaaggagaaagagagagagagacagtgagagaaagatacataaagaaagagcacaaatgtggcaacatatcaagaattaatgaatcaagatgaagtggggatgggtattcataatactttccatttctgtgttgacacacaggcagtgctcaattaattaccttgaatgtaattaagacataatttgctgaatgacagtattattcttgttattagttcccaccaaaatagatgaatcaatttttttccctttctagtttgacattgttaccctaagatactaatcctgctgactctatttttaaaatccaggtttactaaatattttatctacttatctgtcagcaatgtttcaactagaatagaaatgcttttgcataaattcatcactcattgagggatcagctaattggaaagagcattagatatggaattttgaaaaacaggcttaaatgcaagcttattcatttcaccaatatttatggagatcttacagtgttctattgattgtatgagaggtttgggagtgaatagtagctctgctgcctctcagtcccttgcacctgcacacatttatatggtttgagccttggtctccacctctgtgaagtatggataacaacgcctccctcatttgtgagagttaaaatccctgttatatgataaagtgctttgtgaatcataaacaaatgatccaaaagcatattattctaattctcttttagtttcttcctcacttgttcttattttttttacttttttttctttgcatttttgtaatgtccttggccttggtttcttactttattttattatgactgcttacactgttgtagtcatttacaacttcatgttaatcaaaattgtgaatttcggcaaaggcaacagtccctgcctagtgtatgaccttttttcccctttgatcttggcatctgaaagctttttatacattctaattctcttccattttaatagctctgtgaagcagtactattttctttgactgataagatcattgaaggtgacctgattttctctagagatgcacaatgaataaaacacattctccactacacaactcacttactcacatcccatgaagggggaaaaatcctgaggttgctctctctctataaaggtcacagaaaaaggagatgacttctcagatattgtgattatgcatgtatcatcaaattatgcaagctgcttattattccaaatcttaggggtttttttgttatttcatcctgttttacataaaactgagtagcaaaagtggcaaaacaaatatagcatttgtctttgtttgtgtatttttaatgagccgaataacacaaacaccttaattttgagggtgcatcttgttgagacacaatattatagatacctgtttgtacttgtgtgtatgtgtgtctccaggtattacatttatgcagttttcagttggaaaggtgacctctttctacggagtatgtgccctgcacatagggtttatcccttgtgactggtttgtgtgttaaggattcatggcttaaacagctaggttattcatgggtgtggaaaattgatatttgagagcattttattctgctcagtcaggctgattctttataaggaatcaaaacagtgataacatttaccaaaaactactgaatagaatattcaatgtgtatctatgccacacattgtttctttccatacactccatcataaaatacctcctctgcctatcatcgctctgacaacgtcactgccaaacccctatcctcatacactcatcacagaacatctcttcattttgttcagaaactgtgcttttttttcttaatcgttctgcttttcaaagctttattctttctaggcattcaatatatattgaataatttcaaggtatttttatattcattcattctactaatattttcttaactattttcagctactcttctaaacatcttgttcaggaattgtggaagaatctactcactgttttgtcccaatatccaagggagaaaaataaaactagctcaacatccctgtgcatgaacttttagtaactttatttccccactagaactggaatctgatgatgagcatctttgttctccagatttcaaggaggtactccaggtagctgactttccacagagccctagaaagtaaatcatggaggtgaggatactgttctctgaaattaatatagaactatagttacttggtagtttatcttgagcaagtcttgttaattctactgtaattcaaaatggtagtatcatcctaggaaaggatgacaaacatgtagttatagtgagtattctcttggtttaaatcacagcattaatcggcattctgtattaagaaaaaggcaatcatttgcccacattctccttttccttagttttttttttttaatttttagcttcagaaatgtaactcatatacaaagtacgcctatagttataccatgtatcacacatttcatatgagtaaaagaacagaaaattgatgaaacatgcctgaatgcttgtgatataaaattatatttcagttccagctataaaagtgtaatacaattgaaatgtttatcatgcatctatgaatattttttcttgcatgcataatggtgttgcatgaacaatttaatttcttttttgaaaaaagtcatcctagagaggtctattctataccttttcgacagattcatctaaagaccagctctataaatgtccagattgaatgcataaaatgtattgtctcaagtgattattgtttaaaaaaatttaactgtattgttaacttactgaaaagcactggcataattccgcaggcatggcctcttttcttcttatcttcatgtgtgtgctaatgttgtgatctttttaaaatgccaagatgaactgtccggtatacgaagataaaagattttaaaggcaacgcataatgccactgaattcctattgaaatttacagttttcaaagaaatagtattcattctaacatcaaaattattgtcagaaaaatataaacatagtaaaataaaaggcacctgtgaatccgaagctatcatggttcaaactcttctatgaaaacacaatggcactcaaagacttactatggcttaatatctattattaatcaattagtatttttcattgtatgaaaaatttataactaaaattttaaatttaaaaagaaatggattgattagaggccaggtaatcaggctcttggccatgaccatatttttttttttcagtattagttaagtaccaaagtatttcacaaagtccagtattcaattgattgcacaatacacaactagatttcatatttttgtaatccttggcattacttattttctgcacattctggacacattcctacatttttatttaaatggcttttacatcttataaaaagagtactttttggattcaaatcccttattccatttctggcaaccttccaagagaactctagtctgaatcattgcattgattttctgttgctgtataataatattaccacaatcatagtggcttcaaaaaaaaacacatttattatgtcaccttttctgtgagtcagtagtctgggcacagctcatctgagtttttgcttcaagttctcatccgaaagctacaaccaaggggtcactcatgactgggttgtcatgcgatgactcgactagggaagggcctgctttcaaactcatttggttgttggtagaactcagttactgattgttggattgagggcctccattcctagctggctagcggctgaaggccattttcagttccttgcaattagggcctttcctacacagatgcttgcttcattacagtgtgcaatttgagtaggtagtagagatactctctcacaagatggaaggtataatcttatgtacctggtcatggaagtgatatctgtcccattttctgtgttttattggttagaaataaggcacaggttccacctacactcaaaaacaagggatgtaacagggatatgaatgccacgaggctggatcactgggggtcatcctaggatcttcccagcacactttttttgttttacatttggtagtttggtaatttttccaaatgaatactataaaagtgtaatagaagaagtagtatatgtcattgaatgtagttctaacccagaaattacagtgaaggtaacgctcatatgataggatgggcagtttcattattatttgtcttgcctgttaccaagcattctaatgatgtttcattgagaagactgttctttgagattagtatgtatcataaaaatgcctctctttaactaaattgtggatatttgtctatgaagttcaggtatttgttttcataataggctgtatttgaaggacacaaaaatttatataaaaatactaaacaaactgaagcccaaatttgttactagttctagtgcaccaccatgacatattgattacactgaaatacaataatgactctcaatatggacatctgaaaattaataataactatttgattgtcctaggaaatgatctggatagctaaatatagtctgactgaaacttacgtagcccaggcattaagtacatatttgaatgggcaaatcttatgaaataatgcattatttactagaacattttccctactggtattttctactagaagtccaaattagggaatcatatgaggatataaaattaattcaaatatataaaaatattttggctgtgtttacagcattaggaacaagctgtactcattctagcattacgttaatgtacacttggtaggcattagaggaataaacagttctaactacaagaaacagtaaaaaataagatatatatactcataagtcttctcattctgttaagagcagttagtaaagaattatttctaaaatttgtgaaataattattgctcataaaatttttagctaataagaaacttcagatggttcagaaggtaatagaatatgtcctatttggttcaggaaacttaaaattccttctccttaaaagtgttggattaaggcgtttcataatttttgaaaaattttgtatttattggcagtggtttttacacttagagattcttatttcttccacagtgaaattgtttatttaaaaaagatgtttctaaaatatgtgaagagaaaaaatagtgcaaaatattcactttgataccaagaagagctttgattatacagatactctaaaaaggtattaagaacctccaggggttccatttccacagtttgataaccactgcattagcacaaatccttggaagtatgaaacactttgtctgtgtttggtataaaggccactgaatgtgctaatctatgtgaccttggcatgtagtcagcatctgttaatagatttcaggatataaatgagatagtgcatgtaatgtacttacaacaattaatgacacaataaatattatgtgttagaaaagctacatgtagcatagtaattgagagtacggactgaagactgcattggttcaaatccttgctgtgcccctctgtaagcttgaataaattatttaatccctgtacctcacttttcccctttgtaacattgagttattagtaataacaacttgtgagtattatataaatgaaaaacacagtgcgttgatcacattaaacactatgtaatttaaaagatcattgtaaattatttagttcctagagacagatgtattcttaatacattttaggcctttgttactttcagtcatttaacaaatatcaattaattcacctactacatccaaaacaattcaccaaacagtatgaagaatacaaaagggaatataaatgtgatttttgtgatggaagtgtttattgtttaatatagaatataatatattcacatataagtagcatatggaagaaaacgaaagacagcacaagaaattaaattctcagagaagagaaaaaaagtaacttctatgtatttatgaaagtcattttaagaagtattcagaaggttgttagaattgagtcacagagatggctgatgttaccaagggttacttatcattggaaaagagattcataggtacatgtttaaatatggaaatctttcatatcttcagacgttatcgtcagctcaaacccgattttcacagatggcttcacacactgcaactactctctcataattacttatgagagaaaatgacctgtttccctttggccattttgagaaactttcaggaaaaaaaaaaatctttaatttagaataacttaaatattgggccttacagattgactggcaaagtcaaatccaaatgcaagttatttcactactctgcatcccacttaggtgtttttctttcgtgaattatttcctgggagttagggctctttcatcttttatttgcaaagtgaaaagcaaaattgactcatcttaacttctaatttagctttctgaatcggaaagacaacctgaaagtggctgtggggaggagcgctgcttggtctagctggctggagaccttttacagtgtggatggagcccctttctcaatggttaagtggctgccacactcagtagcctttctgaagtcgcttggtcccattctttttatttttttctttttttaataaaggggttaaaagaaaaaaaaaaagaggtaagataaactgcccttgacagtatgattcctttcccttccctctgcccaaatacagatagaaaggaagtctttccatctatataaaggcctatttcatgttaccaaagaggaaaagagaagttgagaaatgcagccaattaggagaaatgagagcaaaacaggtagtacctccgtgtgtcctagcaaatggcccaacacgaggatttttacctattttatccacatagaatggcttgcgaaaagcctttgttgttgttgtttttacaattcatagacttcccactgataaattccaatggtcgattttccccttaaagtgaaaaccttcctttgggaggcaagcaactcaaaaaaaactgcctgatgcgtaatgaagtatgttttttgtaacccacaccagttctatccatacatactttttttttttctttctgacaccttcacctcctgccttacgttcctttgagctatggaagccaatgaggatgaaataattaaagtttgtgcctgctgtacaaaaatcattctccataggctctgtttttatttgatcttttgtagaaaacatagcgtctttatgtacacagttataggcccatggtgtcaggctacaaaggcttcatttcctgctatccagagtcctggtgttattctccaagcataaattctgtagtttccctcctctagcccagcaggtgtctgggtttcatttttggttgttacagttttcatagggaggctggggtggtctgaagtgtcacagcagggatccagcattgcccctacccaaaatttgctacataatttgtgaggccaagggaaaaatgcaaacgcaggacctcttgttcataaatcattaagtgggtgtttttaaacacagtgtgctgtgaagccacacaggtcagatgcccaagaagctggctctgcccctactgtgccagtgcctcctgggcacatggatggcagggaccctgtgtgttgcccttctgtgaaacaagaagtctgtatggttggttgggcaccgtatggttggttgggcagtctgttctttcctgtgcacttcctgtacctcctatggtggtccacacctcgaaagccccacactgcaccaccttccttggaggacaactctattaaattctgcacacccgctacccctgccaaatcttactcttttttttctatttaaatgccatttattcacaccccctgcaaatacatacatgcaaaatccttcataatgacccaatgatgcaagcaaatagtcaagcaatgcttaatagcaattgaaaaaccatatccccacctcaagggtagagaggactgaagtctttatgaactcaatggctagtctgcatccccagaactggaggggaatgcttgcatttcttcatttaagacttctcccctcctcctttccagaatgaactgaaagaattcttacaaggcaccacctcttataaccctgtcccccaaaaggagatttttatattcaaaaacattgtacattcatgtattaaggcttttagaattagcaaggactttaactctttggaatttgcagaagttgataatgcaattatattttttaaaagtttacattgtaattgctttagaaaaaaaattagtgatactgcatatacggaattagccaagcctgtgtacacttgctgtttctgtggtctccatggactggaatttggttaaaaaggcaagtttatcaattgaggtttttaaaaatgcctgctctttcaacaaacccaacaataaataatgaaaaataattaacactgtaatatcaaaagtgaatattgccaaggacaaagataaatgatagccaaaaatacagtgaaaaatctcaatttaaatataggaaaagagaacttggcttctagagaacagcaggtttcctcccaagcctatgctgagtaatatgatatgaaattgttaccactgcttttctattagaaatcttccaattcagttttctttattgacccaattccctggtgtttagggctaggctgcttttttctgtacacatgtgtgattgcttatccgtctagcctaggcttgagttattttatttgattggtaacacagacctggcagaagcttcacctttggcatgcagatgtccacaggtgatgtgaaaagagattgaaaaaggcatttgctgataaaaacaaaacaaaacaaaacaaaacaaaaaaaacaagctcagcatgatttgattgccatctagctacaaagtgtagctagaattgatacagtaggccagaaattataattatatccgccttacaatttcagaacagccatgtgacccaagtttataattgttggtgccataagagacaaaatagctgagtaaaccactcctacaatgtttttgaatataaaaatctccttttgggggaaagggttataagaggtggtgccttgtaagaagtctttcagttcattctggaaaggaggaggggagaagtcttaaatgaagaaatgcatttatacaaaacattatacattgtacattcatgtattaaggcttttagaattagcaaggactttaactctttggaatttgcagaagttgataacgcaattatattttttaaaagtttgtccaattccttcctgaatcctttaaagtgcttaccacattcacttgtacatcctgaatagacttagtatttgtttaataaagggatatatgaaataattttggactgttagagccagaactttagattatatataccttgactggtattacattgcctccttcatgtcgactccatttcattatctgtggatgcttgcatttagtactaactgcaatgagaagcctttgaggccacatctgaacccaatgggaaagaatcctgtgattgaatagtaatgtctgccaaacccaaggaagagaaaaaaatgccaccatctctactataaagtgactctcctccaccagaatgtgttccatcccctctttttacaggcaaacaaattggggatcagagtggcaaagcattctattgcatatcacaaaattagtagcaaaatgatgatatgaatttaggttctcagactctggttgtattagtcagctcagtctgccataacaaaataccacagactggctgtcttaaagaacagacatttacttctcacagtcctggcagctggaagtttgagaccagggtgccaacgcagtgaatctggtaagggctctcattgatttgcagacggcagccttctcactgcatcctcacatggcctttcctgtgtgtttgcacaggagaaagggagagagaaagagaggggagtgggagaaaggtctctgatgtctctttttataagcgcactatcccattcatgaggaattcaccctcatgacctcatctaaacctagttactcctaaagtccccacctccaaataccgtcacatcgggggttaggaattcaacaaatacattttaagagcacataaccattcggtctataacgttagtcacatgcactttatatgtcacaatgtctcttctcctattaggctgactctagttctctttttactgaaaccgccttgctttttgtatcatcgttttaggcttggagaattctaaacagcctctaggaaatatacatggttgagttgtttgacaggttatgaacacattgtgatcaaatgcagtgactgtttataaaatgggtgccttgcagaggagagtttaagcaaagtttaagaattgggaaaatccttaatcacatctctacagaaagaaaaaaagctgtaagagaaagcagaatggtacaggaaatactcctcagagaacagcggtgagggagggataatatgaactacctataaaatatgctcttgaccaaccatatatcaccttcagcctgttctttttgacgcgtgactcactatctagggatccccttctgttggctcacttggcagcctctgagattagttttcccaaagcaatttattacccaggtggtgggtacatgttacataagtccaaaagtcatttctcaccacttttcttgtcttccttttattattcttttaaaatatatgctacttctacttcattattttcaaccatctcagagcatgttgaaagtattgacatgtactttcagcatgaggaaaggaagttactgcagataacataagaagaaatatgtgtttagtctctgtccctggttctaatactgagctcctaaaactcttacaatttccttagtgatgagtgctatgagcatcttttgtcctagtatttgttttttgtccctggttcctgacacagaactctggagctcctgattccagagcttggaatttcctggatcataggagtgtcatttgttctaatgatgtgactcatggtgggctcctggatagcttcagaatgggagctggccactggaaagcccaagctgttagtagaagcttggaactttcagtcccgtctcccatcctccaggaaggggagattaggttaataattaataatgtctatgtgatgaagcctcaacaccagtccctagcctatgaggtttggaaagtttctgggttacaaatgcatccatgtgccaggtgggtggtgcaccccaactccacagggacagaatctcctgcacataggacccttctggatctctccctaggtaccttttcagccagctgtttattcgtatctttgtaaaaacctgtaaatgtgactaaggttacagcaaattatctcatcctagagggaactgttgaaactcctaatttgtagccaagttgagcagaagtgtggacaccctgggtacccaatacttgcaactggcacctgaaatggagggtgttcttgtgggattgaactcctaacctgtgggggctacacttactctaggtagtttagtgtcagaattgaattaaattgtaggacacatccaattggcatttgcagagaactggagaattacttgctgtaaaagaaaaccccatacatgtaatgtcaaaagtgttgtgagtagaataacagctttcttttactctaaattataattttttgaaaaatcactgttacagttcacattctgatcacaataataggtaagcagagcctcattttgacacctacctactttattgcggtgccgtgctctagtatttagtctgtatctcaaataactcttcaatctgcctcgtccttttgatccttttaggtcagtccttcattatctcctgttagaagtctcctaattttctaatggataagctcatctagtggataacaatgggataatattcaaaattcttacatggccagaaagccttcattgattcttttctgtagggtaccaccaattctcacttttctgaagtgcttatctttcccaaggcactaggattttaatttctctacatcttttttacttgctagtgcctcttcctagaatttcttcccttaccgtgtatttctagcaagctactactaatctttcaaaacttaaaattaatatcttctggccaggaagctatttcctgtctagcattctggttgcaggaaactggagcccacatggaccatactatacattatttgcagcatttgtaggcaaaggtgcctcatttgctgcaaatgtataatggaccctgtgctcattgagctccatcttcagtctacagagtccagaactgctttcagaagttctgttcttctggaggtaaataaatggaacctaagtccaaaattatttatacattgtcacagatgcacacctgctgctaggcctcacatgtgcaccccaacaacaaagatagcaatgacaaccacacacacacacacacccctgttgtgctcatatatgtataaatacactcattgtacagaaagccttaaaactgcccttgaatatgaaaataagatatttctcttttatttttgtcctcccttatccagcttagaattagtctaccttcaatgcatccattattgcttcctcaacttagctcacccacacagcaattaaactccacgtatttgaacaactcaaaaattccatgtgtgcaagaggctaagtgcataagaatcctagggcctagatgacaagaattactaaagaaacgtagcccactccttctcactcttttgcagttttgtatgttatatgtacattagtatgttacatgtacattaatttgcctgaagttgctgtgttggcttaatggaacaccattgccacctgctagccatattgagctattaaagtcctgcaattaaccaaattaagcgcaggttaacacaatcaggttttgctgtgctattgttttaaataacttttacgtatttaaatttagagtgcacagtgtgacacagcttgccatttaatgactcagcatgcatacagtaacctcagctaaccagcattaagtggaagtattatgtcttggcactgaagaatatagactgacatcaaaaataagagtttcaaggctcagttccaccatttgttagttatatgatctttgataagtcacttaacctgtctagactcacattatttaaaaaggtaaaaatagaataatagtagtgccttcttcatagggttgatataaccattaatgaaataagaaatttgaaatgcttacgtgataactaccatatggtcacaatcaatggatgttcctgcatattatttctctagcgttattacacctttcttctgattgccaaatatgtaaattcaactgtttctctgggcctccattttctcatgaactctatggtttaatttataaatatgttccaatgtagtttcatttgttttataaaatacagtccactacaggtagtgctccatttgttcaaccttatttgtatatgatgcagtccactctgtgaacatcagatttcaatcatcattgccttcccactgcactcacttttataaagtcaaagcataatttatagtaaataaaatacagtgatcttaagtgttcagatcaatacgttttaagaattgtatataccatgaaactgccatccaaaacaagatatgaaacgttttcttgtatgtaggaaatgcctcatggcttttatctatgttttttttccccaaagcatgtgttatccttatgcaggccctatgctaatctctgcatcatgtccattttagttcacgcaaccaaagtagacatgacacattgcaattctgatcacctctctttttctcacaaatccagtagaaattataaagaagaaaaagcaacaattaatccagaaatgctatttagtcaattgaagatcaacacattctaggtgagcgctgccccaagaatgtttaaagggagaaatcttttaaaataaaatgcaactataacattattgatatttttaaagggagacaacaggatatctcttagagaaatggaagtacctgtacagggcatcatgttctcagactcctcacttcagaatctgattcttagctctgtggacttgggagactgggttttcttagcattctcagagtggatcagatctttatggagaaaaacttgcaaagaaaatttagaaaacatttacatataaatcagaaaaatgatatatttacttacattaatatattaatatgctaataatgtattattgtaatctgctgttttcttttttcatttaccatatacttacatctcttatctaggattccctgttctcaacctttagttcattatcaccctcctctcctcacaaaggagacttttgagaccactgccaatgaaattttgatactgcatttgtattgtttatctgtatatatctgtttatgtatttctgtgccttatacatggaaagtaacattttctttcatttctcccaataccccagagccaattttcacctccttgggggtgatgtcaactccattgagaacatgtatcttattccttttttcctgctacctggcagcatgagatgttatattaatcctgtctttttattttctgtacttttgatgctttgacatctagggacttgctgactctggaaagactgccctttccaaagttaggcaattcttagagattaaaaaaaaagactccccttccagcatccttttcatatgcctttaataggcaaatcaaacaatctactacccacatcccaaccatctcctttactgatcctttacactccacgccaggttcagcttgtcctaattattccggggccaggttccagacaactaaagacagcctctgcaccccagaatctgaagagatgatccaactagccatttctaagccttcttacattgtattcttttccatggaaacctctatacaggctcttgcctatgtttttctccactttctctgcctctaaactgagcctggtgattcctctgaaaccctgcatggtgggtcctgccccctcctcttgggacctgtgaataataaaccatcttttcaatggtaatcttctcctgatttcttgggttcatgatacctgaatagtaataaaacctaaatttaaaaatacctatgtatcagggagttggttggccagtatggaatatgaataatcttgagagatatttgttagagttttgatgaagacttgtaaattccccctgttccttagaaagagtgctgtgaaaacactaccaaactcttgttctttttacttttacttttcttttctgggtctatacagacatctttatagttaattgactttttagtaaagagtaactgattaaactcatagcctttgtttaggctccacctgattctgccttcttagtttaccttttgaatgaaactgagtgtctccaaacattttcaggcatatatttatagtcaactcttgtggctattttgacaggtggttgacctcattcattatgtattgaatcttactattctcacctttagtataatcttatttctacatttttgggacacatcactgaaaccttctgtgttccatacgagacctgtaccagatatctctgcagccaaagagaagttttttttttatttttattttttcatgagctaacacaaggcttgcacaaaactcagcagcaagtaattcctttcttgtccagtatgaaaaagtgctgtctttgtcataaagcaaaaagagacaatgaaaggttaggttcttattgccccatctcattattgttaatgcaaaactagactaatttgcttgtggttatggaaatacctcctttaaccttggtgactgaatcagaaagaatttgttttggagatgggcattgcttaacagcatttggcatttgctcaggctgagcattcatcgtgagagtaagagccttctttccttctttagtgtagtaatctctgcagaaatatcacatgaaatatggtgcagaaaaccttcagcatagtggctgggatagaggcagtgtgctttgagtaaggctcttcagttggggcctgcattttctctggagccaagatacttctgacctcagcaaatggcttaactgctctgataaaaagtggatgataatgataacacttccttcttttcagatccataagaagaagagatttttttgtttttgtttttgtttttgtttcatctcctgctgtatgcttggtctctaaaagtgactggcagagggaagacaataaatatttgttgttgaatgaatgaagtgttatgatgagggttaactgacattataatgcaaagctcttggaccaagacctgacttatcataggccctcgaaagatattccttccaaaaacaatgacagcaaaaacaaaataaatgcttcatactcaataaagtgtctggtgatgggtttataggaaatttagtaattttaatattaaaaactaccatttacatcatctgattatttattcgccaaatatgtatcaagcaatcactaaataccatgcattattgcaggtcttggagatttagaggtaaacaaaaatagccacaagtaaaagctgtccacctataaaactttctgcccagcctagcgcaggttagagttcccatatgtctatcagtgatcaatagctgtgggagaagaaacctgtagaacactgaaaaaaataaagcattcagatcattaacttttttattaatcttttgccatttgtggatctgtcagcttctctaaaactcttgagatacaaaagcattatctctgagacaagagataattcccaagctctcctcttgattgcccacgtttgcctgagagaatttctcaaccagttgtttcaggttatagacataattggctattagtcattgcagtgccattgttcattgacatacctctcagcatcatctctcacccatctgcaaagcaaggtcctggtttctgattaatctttggctggtcattgaggatactgaagcagctcctggttaattagaccattttgtctctaacctcatccattctctggatgtaataatagggatagaggtggcagcaattgtaagcacagccctgaaaacttgctaatcggcctttgtgatttgccaggggtgccattgtttaaattgttaaagccaaattgttgtgagaggcagtaagtgggcatttttatctccaagtcaattacacacatttagtgaaacctaaggagctcataaattaaaagtaaataagtaaataggaaagcagcatctacaacacttagtgatgtaagtcacacacatacacaccacatacagggtgataaaatagcaaaatgtgcacttatgtggagaggaagcccacgtagtgataaggggtgagggctcctgagtttaccagctgtgtgaacttgggcaagtaaccgctctctgaaccttcttatctgttaaatggaagtaatattaaagcctacagggacatcaaaaggattaaattacattaatattttatgttatttcattaaataagattttataaactatctcaaagtctgctctattacgtgtgctaattatctggtagttactattattctagaaaagcatcctatcccccctaactcatgcaaagaaacaatgaacgtttccaatacttcacattaaaaaaattactttgacagtatccacaggaaatcaggtaaaaagcaaagacagacaagcttagctctttccactggactttgtgagatgtgtctagttgtactagagttcaggcgagcattctaagagatgctggagggcagaaaatgaagtgaacttcattctatgaagcacttgagacttgtctttcccagtatttccccatcatctctcaaagaactgcctattaataaaaaacaaacaaaaaaaacttattccttggtatgctaccaaaaaaaatattcttcattcaagtaagtttggaaaccactgagtattacatttccctgtgaagaatcataatcattattttggtgttaaaaggcctgagaaatcaggaaaagctctaataaaaggaataaaaagaatagctttgaatcctttaacctaatttttcaaaaataccccacacaacatgtgttaccacacaaattgcattttgaaaaaatgctggccaggcacagtggctcatgcctgtaatctcagggctttgggtggccaaggcaggtggatcacctgaggttagggattcgagaccaacctgaccaacatggtgaaacccgatctctactaaaaatacaaaattagccagtcatgggggtgcatgcttgtaatccctgctattcaggaggctgaggcaggagaattgcttgagcccgggagatggagtttgcagtgagccaaggttgcaacattgcactccagcctgggcaacaagaacgaaactgtctcaaacaaaaaaaaaaaagaaagaaagaaaagaaaaaatgctgagctacaacatagtaggttgaagagtgtcctccaaagcatccgcacccactcagaaactaagagtgcgatcttatttagaaacagagtcttcgcatatgtaatttgttaaaaatcttgtaatttgttaaaacctggattttgactgggccttaaattcagtggctgatgtctctatgagaaaagaataggacacacagattcagagaagatggtgacgtgaagatggagacagagattgaaatcatgcatctacaagtcaaacaatgccaaggattgctggcaaccaccaaaagaaaccagaacgtcatgggatggtttttccttcagagcctccagaaggaaccaaccctgctgacacctcggtttcaggctgtagacttctagactcctgaaccatgagagacaatatatgcttttttttttttttttttcctgagacaaggtctccctctgtcactcagtctggagagcagtgacaccatcacagctctctgctgcctcagccacctcaggtccaggtgattctctcacctcagcctccctagtagctgggactacaggtgtatgccaccatgcccagctaatttttgtaatttttatagagacagggtctcaccatgttgccaaagctggtctcaaactcctaggctcaagcagtccccccaccttggccccccaaagtgctggaattacaggtgtgagccaccacacccagccaaatttgttgttttaagccacctagtttgccaaaattggttgcagcagcactaggaaactaattcatatttagtatttttaaatggctatttgaaatgtaaaaaaaaatgccatgaaatatattgcaattaaaaactttgttctctctgctgcctatttgttttggttccattttttggcaatttgaggtagaggaattggaacacagacgggaggagataagaagcactctctgctaagtgagtgattaagagctcactcatggctcaaaaggaaactctccattatattttctattatcacttgtgttcttgtcaatataagtacttgccacttgtgaatcattttggcgtttgcaaaaactttcttaaacagtcaatttcttccattctaccaccaaaagaaacaaataaaataaacaatagacaaatgcaatagcaatgtttactaaaattaagtttttcactctgcttagctttgaaatctgtatggaaaattaagataaaggcctacattttcatagataaagcggtagaaaactttgtttttagacatatatatatgtcttttttttagacatatatatatattttttaagatgaagtctcgctctgttgctgaggctgtcactgcaatgttcacctcctgggtttaagtgactctcctgcttcagtctcatgagtaggtgggattacaagtgtgtgccaccacgcctggctaatttttgtaccgttagtagagatggggtttcaccatgttgaccagactggtctcgaactccttgcctcaagatatctgccctcctcagcttcccaaactgccaggactacaggcgtaagccaccgtgcctggctcagcatgtatttttaattcagctctttggagagctgcatctactgagcactgcgtgggcttagtctcactgtgtagttgaatcttggtggatggaggccatctgtggtacctctaaagctacagtaagaacagccaatgccatggcatcaaaggaagccagaggcatttggaccttttggggtctggcaggcaaataaagaaaagactagatttggcctgagtctagtttcttctcatctggacactagctcatagctcataactgggctctcttttttaagctccataaatgcaagcatgacatgcatatgtgtatacagaatttggacatgttttccaaattgtaaatgtgatcacagccttaagtaaaatttatgtctcccaaagccctcaggattagttcctcattctttaaggaggctcaaaataacttcatgtcactttggttatctctctagccccatttcttgtcaactttttccttaagaagaataacttgacttctctaaatactcctttatttctctcagggcatatgcatttacttaccctatactctttcttctttctttccctttgtttctttcgttctttttttctttttttttttttcccaaggtctgattttatcgcccaggctggagtactgtgacacaatctaggctcactgcaacctctgcctcctgggctcaagccatcctcccacctcagcctcctgagtagagtagctgggactacaggcaccactgtgcccagctaacattttgtgtgtgtgtgtgtgtgtgtgtgtgtgtgtgtgtgtgtgtgtgtgtattttttgtagagacagggtttcactatgctgcccaggctggtctcaaactcctgagttcaagtgaaccactcaccttggcctcccaaagtgctgggattacaggagtaagccgccatgctcagcccctattctctttctaaaagaatccatttgctctttttttccctatgattgggttagcatcatggcttccaatgtttgactgaatggttttaaattctaccctccatgaaacgggaaaattagcttttttttctcatggagttttgttgagatttgaatcagataataaatgccaagttactacatataacagagagttgtcaaaaatatcatcactctcatttttcatatcccagcttaactatcattggaactgaaaaacactccctgaacctcacaagattcgattagataaaattagctgtaactattagaacaaccccaacatcaattcccttatatccagtagttccacttctagaaaagtttgctaagaaagtaattctaaatttaggaaaaacttttattattgcattatttataatagaaaacaaaaatatggagctacccaaacattttcacttcatttagacttatcagtcttgtgatggattgttagggaccttctgaatcatattattccattaaaaataaaaattcacaaggacaaattaatagcatagaaattcctatgttatattgttaaccgaataacagcagggattaaaaattgatgggatagtatagaaaaaaaaatcctggaattacaggtgcaaatatcttaacagaattattttgtaatgtaataattgggtattttttctctatttttctgagtcttgcaaatattccataataagcatccattacatttataacggcataaaataataaccttaatctttaaaaaatgctagtggagtaaatgaaacttttcctgcattttcttgccagttcatgtcgctggggagtgtcacttatttctcttgtctgtttccctatggtgaaaaacatagaaacatgttgataaagaacacaaagaaagaatgcatgactaggaatgaggagaaggaaaagcttcatgcatactcagctgtaacatgtttgggccgggcgcggtggctcacgcctgtaatcccagcacttcggaaggccgaggcgggcggatcacgagctcaggatatcaagaccatcctggctaacacggtgaaaccgcgtctctactaaaaatacaagaaatcagccgggcgtggtggcgggcgcctgtagtcccagctactcgggaggctgaggcgggagaatggcgggaaccccggggggcggagcttgcagtgagccaagatggcgccaccgccctccagcctgggcgacagagccagactccgtctcaaaaaataaataaataaataaataaataaataaataaataaataaatacaaataaaataaaataaaatttttacaaagtcaatgtaacaactcagggaaactatttgtcttcaaacattgaagtaagaaagacaggaacccaaattcagaaccagctgaaccttgaaggaataaacagtaaatgtcaagggcttttctcacacagggaatgaaccggttttcctgctcataaaagaaaacaaaaatattgagtatgagtctgaaaaatatgaacttcctcatgtttgtcatctccataaactatccctgtcattttatctttttactgagaggaagataatttagcaaaatgaagcacgggctgctatttcattttcttattacatatttgaattcagtctagtataattatggtgtttatgaagtttaaactgatgtagcaagagagtaataggaagaataagtgatcatccactctcaacatgataaggagcatttcttgataagaaagttgactttaccaagtacaggaaatatgtaagaggttttatcagacaataattttaatttatgagatgctttcattgtgttccactaagaaaatatacatttatttctaaataagttagttttaaagcaaagtgagaacaacagtagcaaaaatgtctcacagttacagacacaggcaaaacaaaaacaaaaatacctgcccccatctgtgagaaaagagctcacaaagaaccaggaaattataaatgagcagatttgcccttggctgtaggcaagatccctgagacagtaataagaaatgaggttaccaaacatccagagagatatgagctgataaaacttaatcaggctagtttcacaaagggcaaatcttttctgacgaatttggtggcatttttgcatggcacatggggcaggagaagtacgtgacaggaatgcgggatagaattcaactgaagaaggtagaaagccatggatgatacacatgaaaatgaggtacggtcttagctttccgaagaagagcacttgggagacgtttagcccaaatgcgttgatttcatgaagatatttatgttgacaataaacatgaagcgtggttgatggactggcatgcttagcagtgaaaccacggtagcaaaattatgtctgttatcatcaaataatgcacgcttggggtgcgtatgtatgtttgccattccagattttttttagagtattctcatcagttatttgcagtcatgcactgcataataacattttggtcaatgaccgactcccccctatgagatggtggtaacttaggattataataccttttctatgtatagatatgtttcgatacacaaatactccccattgtgttacagttgtctgcagtactcagtacagtaacatgctggctgtgcaggtttgtagcctagaagcaataggctgtgtaccatacagcctaggtgtgtagcaggctatactgtctaggtttgtgtaagtgcactctgtgatattcccacaatgacaaaattgcctaatgacacatttcgcagaatgcatttccatggttaagccactcatgactgtatttactttttccaaatgtttatgttattagtatatatagagagagccaatgacatttcagagagacacactcttatctcaaagaggaaccaatgggccacactgcaatatctcaatgataataataggttttacagcatttctagcatctttactctgagacatttttaaaaaacgcttttagttgttttgtgtacttgacagtaggctgttatttttcaaaggttaatgttgaagtgttctaaaattgggaaagtaatagggtcaaatacccagaagttcaaaagaaagaatctgagtttcctgcttagttggtccctcagcgtcaatgtacaaataggcttgtctctttcatcttaaaaagataaataatccaaactgaaatacatacatacaaacaatttctctacctcctgctgttgtttctgctcacctctcccttctctttgctgtctgacttctttatagagcaacctgtacaccattccatagttttatttcagttcccagtttatctcaagcttggcctttatgtctcaattcatcttgatttgagagtgaaatttctcccaaagaagaaacaaggactttctgatgatcaacattagtgccttattgctgttgctcttgtttttcacggttactctctaacatatataactcttaacatgtgtaactaatataactcttaattacatcctccttgttaaaaactctcctgttttggcctcccatatgatggatggggtaggcagaataatggcccccaagatgtcaatattctaatccctggaacatgtgaatctgttagattacaagacaaagggaaattacggttaaaaatggaattgaggttgctaataaagagattattttggattagctggggaggcctttgaagtagaagagggaggtagaaaaagggccagaggaaaatgtaactatggaggaatagtagagtaatttaatgtgagaaggactcaacatgctgttcctgattttaaagatagagaaaggtgtccacaatccgaggaacgtgggcagtctctagaagtcgtataaggcaaggaaacagatttcactccagagcctctaggaaatgcagccctgatgacatcttgatttgagctcactgagacccattttggaattcaaacctacagaactataagatagtaaaattgtgttgttttacaccattgagtttgaggtaatttgttacggcaacaatagaaaaatagtacaatggtgttctggcaaaatagtctcaacttctcatgcagatcttcctcagaacattgggctgttttctttcttttgtcaattccctagatgttgacagtccttggttttcatccttagctttctttttattcagttccatgctgttgctgccttttacaaagcaatgccatcaaactcagtctctttccccaaccagattcctgcttgtagctacctatctacatctacaagtccctcacaaaatccaaatttaacatgctttatgatagtttttaaaaaggcaaaatcatcaatttcaaagaaatgtaaatgaacacatgaaagattttctttaactcactgatcaatgaagggaccagtaaaatgttgcaacttgttcaaagaagaatccaaagtaccacacatgtgtaggtgataaggaatgctaaaataaatgtataaatagatgcagaacaggcttaccatgggtaaattggatggtatgtgaattatattttaagaaagctgttacaaaagcaaacaagcaaaaagtttggcttattcattagggaaaaataggaaaaaaatcacctgcatttcattggacacagtttatttgcatttcaatgaccaaaagtcatttgcattcttaatagttttctcctctttacattgttgcaaagtagttaagagtcattgaaaggcagggttaatcttataatctgcaatctgcaagagtacctaattgcagggtactctgcaatctttccatgtccatattgaaattttcgcaagttttcctgatatgtcctatcacatatctctaatccaaatactttctcattctcctgaagatcatttcacacatacatccctcttaaacctcccatacttcccctcctatcatctgtctcagctgatgatcttcctacttcccaaggaaataagagaaaaaaacagaagataattttaacttgctttccaccccacatgcatcagtgtattttccatctgtctccacttactctgccttccctcctgttactgtggatggaagctttctttctaaggccaaccactgcactgtgaactcagtgcctccctgtcaccaccagggtgtcactcaaggtattgtcttctccctctcctgtatcatcatgttcttatgcaactgcatcatgcccagaatcatgtcaatataatgtagtatcccatctcaaccaaatgcaccattgaccccatgtctttctgtagtacaaacctatttctctagacccttttatgagaaactccttagaattttttctttttcaaattcactgtcttcaattcctctctttacatactccatatcctcactccattcaggatgtacactccactcagcaactcttgctaggtccttagtaacctcttccacattgctaaatgcagtggaatgttttttactcatcttatttgcctagcttccctatttgtcaaagctgaccattcagcttctttaattttagattctagtccatcactctcataggacactcctacaacattggctattgttcctcagtccctttactggttcctcctcaccagtgtgatctttagttgttgctgtgtcttcaggatgggtttggggtctttgtttgtttgttttgctttgtatacactcaatccgatgatcttcaaatgcatataccttcagttcataattatctccagaactccagattcatctattggatgccaccttagatatttcagtagaaagtctaacagaaacctcaaactcaacatttataaaaccaaagtctttgtcctcctcccaacccccagcacaagccagctgttctacttgagtgttttctctccccagaaaatggaaaacctatccctccatttccttaggctgaatacctgatactcattcatgatttccaaatttttctccaacatattacaaatctcattgctttaatatacaaaaaaagatctagaatccaattattatacatctataccacaaatactttggtcccagccaccattattttcccttaaattatatcaatgctttcagtctcaggggtttgacgcttgctgttcctctgcctagaaatttttctcagtgcatgttttattatccacttttcttttgatctctgttcagatgtcaccagaccagtgatgccttccttcactgccttttataaaataacacctgacttcagcatttctagctcccttaccctttatttctctccatagcactcacaacaatctcatataacttctgtttgtttgttcatttatcttatgcctccctcaattagaatacaaacgctgtcacagactcaaagttatctgttttgttcattgctgtattttcaggctctaagatggttctcgcacatagtaatcccacaaataaatgattgttcagtaaatgaataaaaaataaattaaatttatatctcctctctcatcttctttcattctcactgctcctcatctttctcttctcctcttcctttaacagctaaggacttcaacatacatgcattcttccattcatccctaatagctaactcagagtaatctctaatgctgtctttgcctctttcctcacatcaaatcatttataatattttgttggtattgtgcctacatactccaaaaaagctctcacatcattcttgtcctctttattcctactgacaatgcccaattatctcagtggtttcaaacgtttgataaataatctccttgatctgtggtttctctttccctatccttcctcccgtgagtcatggatctaaacatatcataatcttgcttaaaactgaaaacacttccatgttttctaactgtttacaggtcaaattcaaacctctgtcatatcatttaaggtccttcaaaactgttctaaatctgccattccatctttttatttcatgactctcctaccttccagactagttatattcttttgaatgacaggtattttcatatctttattcaagcttttcttcttcttaaaacttccttactgtaactcctgtttcaatgccattcttattttcattcttttacacatagttcaaatgttgcctcttttggcattcttccaaaacctctaggtagaattaattgcttccttctctgggctcctttaaaattatatttatacttttggtgtagtacttatcctgtaatattgtagttcgttaattgttttcttattggcttccctttctggagtataaatcatagtgatttacggtatgagttctggagtcagtttgcctagactcaaaattgagcctcaccaccctttagctatttgatattgaacaagttatttccattctctaaacctcattttctcatctttaaaatggaaatattaaaatctgcctcgcagagttcttgaaaggaccaaataagataattcatattacaagtttaacttgattcctggcacttactatgctcccaaattattatttgagtgtcagcttcttgaatgtaatccacttatttatttttgcattgtcagtgcataaagaaggttcaacacagagttagagctaataaaagttggtcgagtttacttatgttggatttatcactgtgtgctggcaatatctagataagcaatgatgtagaattttattttggtctggctttaacctaaagagatcaacagaatgtgaaatatatgctaatgaactcttcttattataatttactttatgatctgcatgccacttccaatatggcatatacattttaggcaggtttaatgcttaatctcaaatcacaaggtcaccatagatgtctgactggactgaaatacttcatatttcatatttgaatactggatcttcaactttataccatgtgtataccattagttcattctgctagagtaacataaagataaccagaatgattccattatgtgaaaagcagctttcacattaagaattgtcttctcaaatgtctactgcatgtaagaaataacaagcatggccactgtcaggtgactgtgcagcttctcttcttcacatctttggtgttacctagagtaagaggccactgagtgtccagtccttagacacagtctagctttgcatcttgtgaagtgagtgctgatttcaagtatggcttgaatctaactgatgcttgatgttcaagcgttattgaacatatacttttgaaataattccaaatacatttgttgaaagtattattatcaaatgattattacaatgaaaatttatttttattacaatttaaaagacaacaattcaaaaatcagtctcccatcccagcccttaaatactgagcaacatcagtgtctccagttgttggttggacaggtaaaactgtgagccccagcaccatcaaaatcagtatctttatacctgaattagtattttttcctaatacaagcattcctcttttctttattcctctattttgaaaaacaacaaatatctgagcaatctttaatgtttccttttcctttaatcatgctcccacattcagttaactggcaaatcaccttttacctttgctttcaattcttgctcccaccaccttagtaagatgtatctctctacttagactagtataagaatttcataactatttttaaaactctagctttatcatctttatttttgaacatagctgacaaagtttacttttttccttttttctttctcctatgaagtaagtctgacatatcttcactgcataaaacccttcaaaagataaacatcaacaggcagtgggatctcagttcagagcttgatcttttgacttaaagctccggtctgcctctagttcttaagtaggacacttgacctctctagaattacttttctgttttattttttttctgtaaattaggtaaacatttctctaagtattttttctattttaaaattttgtgacttgacaggaagtttaaagaaaattggtaaaagataaatacgtgtggtaaggggagggagaaggaagaaagaagggaagtgaagggaagggaaggaaagggaaggaaaaaggaaagaaaaaaaaaaggcttaactctttatagaacctgcattccaagaaagatattaagtgagtttagtctagcttaagctctacaggttaaagagtatgagtttgaaaaactaaggtagaagcttggtaatagaagaaaaataaagccagggagggtagagcttttatagtactgaaagtatgcagaactcaagtggatgtataatttgtgtcactctggacttggagtcaaacctggatttgaatgccagctctggactattaatagggatgtgattttgagctaattatttaatgtctttaagttttagtcaggttcaactacatcatttgcagaccccagtacaaaaggaacatgtgagccccttgttcaaaaggcagaaaaaaattgccattaaaggcattaaaatataaaatgttttcttacttccctggtatctttcttgatctggaatgatgttttttatttgctttttaatggcactttccttttgggcatgggaatactttctcagcgaccctcacatgacctgggggccttgccccaccattcagtgtaaatgtgactcactgctgacccactgacttccaggttctccctttcatcagctgcctaaccaatatgcagtgccccagctcatagccccaactcacactaatggaaaatcctcaaaggctttgcaacatttgtgcaaattagacttctgcggtagaagatattctggaggttccaggagccacggtggggaaatatattgggagcaacaaaattctaacacagaaagatctcaggtactttatatctgggtgtgatcttggagctctctagtcttatccctgggtgaaacctgaaatttacccaggctcatacaatgtgattcaggtagaaccaaaaataatatgacttttagttctgtgttcttttagatacaggctttctaatgtatgtgagtttcccttgtgatttcctctaaaagcccaggttgtctgcacttttgtagttctggagaggaaaagcagccaaacactggtctctttctatggtttatttaaagctatctttctcaaggctgttttagttgtaagaaacagaaaccatacaattagtggttcatgtaacctagaggcagatctcactagaaattgaaaccaaagatctaaaaattcagggaataaagcctctctcctctaaattactcattctctccatcattctgttcccccccaccctctctctctatcatctacttatctcaatttctgcctttgtgtagactggtgttctctacctcctcatgagttttatggacgatggatattataaaagttatgaacatcctcatctctgctcaagcaaccagcagagactagcatctcttaatattatatctaaattcttgggagagagaaacaccagagcccaagaagaacatattcacttctcatccagtcagccatggcccaaggaatggcctaaagcagattgaacatgcctttaaggatctccacagtttaagagctacttctccatgaaatggttcatgggccattcagaaatgccagaatgtcactgcattcgaataaaaagttctcagtatttagggaataataatgaacgttagataccagtaggttagatgtaatattgcagtcagatcatggaattaactttttaattccatagaagataatggaggaagaaaggtagggcagaaccctttatgcattttcaacaatattgtacaattttcatataattattacttagaaacatttatttttcagtgtctacctattccaaagttcttgccttactgccaaataaaacttgttttttttttttttttttgagataaggtcttgaacttctgggctcaagcaatctgcccgtcttggcctcccaaagtgtggggattacaggtgtgagccaccatgcccagcctctctaataaaacattttgtagagagtaccattataatcattggtgattacaatgtatagtagtatgtatacacatatagtttttatatgtgtgtgtatatatatacacatacatgtgtgtgtatatatatacatgtgtgtatatatatacatatgtgtgtgtatatatatacacacacacatatatatgtgtatacacatacacatacagtagtatgtgtcttcaatacaattactcactgattgtagcagtggctcaaaaataccaacaccattctttttcccaaatacattcttaaagcacaagtatttgaaaatgcattttgatttcttgtttttgatatcatattgtcacatgttttcagctgttcctatacagaaaaccaacattgttcttgctttctgattgtatagacaaaacaataaagacttgctgttatttcatcatttcattacagtatgagaaaaatctaacaatttaccaaaagatattaaacaattagttgaaactagactttttacttatcaagtggtataaattcaagctcctaaaaagttgataacaaatataaatgaaaaaaaggaatgatatcaactgactgatgataattcaacaagacctaacttctgtgtctttcaaaatgacctaaagttacttagaaaaatgtctttaagtttctcatctatcaaatgggaacagaaatgtgcatctcacaaaaggcatcacagggatttaatttggaaactgctgtatgtatatattttttgaaaaccactaatcattctcacaagtataagatattattaagccaagttatacccccaatttggactacatgaagtttaaaccagacttttctctgagtgaaagtaaaggaaagcaaatgaattagcatttgttgtgtgcttgttttgtgcctggcataatgtatgttgcttaatatgcattatttcaaccaggttttctttttttgtgtaggaggtagggggttggaaactttaaagagattttatggagatctgcaaaaaagtcattcatattcccaccatcaaaaattaagttaccatctcagcgtatttatttcccatctcttttcttcattttttaaaaaatctgatgtttctttaatataacgcatttttattttaatcattcaaactatgaaatattatgcaaagaaaataaaaaacctatctccaataaaactttctctaaaaataaaaattattaatattgggtaaaattatagccatctttctatatatataaatacagaaaagatatactgtattcatgtatagatagataatagcatagaagaatacaaatattttataaaaatgagatcataccatagacgttacttttaacgtcaagattaaattttattttagaaaacagaataaaacaaagtaaaaatgataaataatttgaacttctaataaatgatttgagacaaaaaaattttttaaatgatttctctaaggttaaaagatacaatgaatgatacaaagaggtcagagtgcctttgtttgtaaatacaataatattatatgtatatatgtgtacatgtatgtatctatagactttttgctgtgaaagatgatactagcgctcatactagctaattatattccctcattcacttctcatttttctattttgttgtttatcttatcgaggttgtagcatttatattctgttctataactaaaactagcagagttcttaagtgtaagtttgtgtttgaaagtattctgtgtgtatcccattattcctctttcattctcaagatctgcatattgattcatatttaattgaatggatttcattgttaagtgatctctttaagaataatcatctgttatttttcatattagcttttttatattagtttttttaatgttcaaattgttcaaatgtgtttgttggatgtcttttttttttttttttttttttttgagacggagttttgctcttgttgcccaggctggagtgcaatggcgtaatctcagctcactgcaacctctgcctcctgagttcaagcgattctcctgcctcagcctccctagtagctgggattacaggcgcccaccaccacgcccagctaattttttatatttttagtagagatggggtttcactatgttggccaggctggtctcaaactcctaacctcaggcgatccacccacctccacctcccaaagtgctgggattacatgtgtgagccactgtgcccggctcagatgccattatatttgaaagatatattggtgataatactaaagtcatccttccatttggaatatttacagacttttcttcattgacttctggtataaaatggtactgtttaaaatcccagcttattctgagttttcttttttactctgtgtatgtatgtgtgtgtgatggggtcttgctctatcacccaggctatagtacagcagtgtgatcatagttcactgcagcctcaaatccctgggctcaagtgattctctcacttcgtctcccaagtagctgggactacaagcacccaccactgctaatttttcttttctttttgtttttggtagagacagggtctccctatagtacccaggctcggtctcaaactcttagcctcaagtgatccttctgtcttgatctctcaaagtgcagggattacaggcatgagcccctgtgcccatcctttcacttttacttagcttgctatttctgtccagtcttcttaaagaagcttcctcttgatgttcttcaaatattagtcacttaatcagcaaacgctttggtgttgagtattcactctttcaaatatttctggaacatgttctttccatttatagtaacttttcttaatggtatttactgagacatgtgtttgattctataactcggtgacatcaaggatcttaatgttgaatcatctttatctatgtttctaatccattaccttctcctcattgttttattatctgtgcttttttcacattatgtgagataattacaatcatctcaaaacattatagcagtaatgtgactttcagtgggtatctgttttgttgcttgcctattccaattgatttatttgttatttattgatgttgcctgggttacagtttgcatccttaggttcatggtctccaaatttatctggttctattgtctgtgtatttttttcatattgacattgttatattatttttaaaaactcatgctcttattctatagcataaaactgttttgaggaattccccaggttttcttgagttatgttttcttttagattgagtattttccctgtcttggtcatgccatgttttactcttttattgctgcaatatatttgcatagttactattccatttcttttcatattgttcatgcttgagaaactgtgtacagaaaattcattttacttaatggggaaatatattttttgaattttatttttattatatctgggaacaattttttttctccttcttagctccagtttggagacaggatttatggcgagtacccacattttgtagcctgagagaatgatggggccaaggaaagttcagcctttttaggatacctgggtgcttctctctatcctaagatttctttttcaatgaattgtagccagattattattggaagagacttcagtatacttcattggaagatgtagcacttttctaatgggcttcagaggcttcacccctgagtgcatgggcatgacattattaattggttaaacagagtcagctttactatccatatttccccactttacttttttttttttcctagaagcccttttcattgctcttcagccagaaagaggtaaaagaaaaagataagacctttccatctgtgtacatacaaatctgcttatctccagatttagaagttataatgagaattctcagaatgctgttatttcaccagtaaatcctatagggtgtgaggacgacattaggaaatcaagaactccttcccttctctgagcctgaccagactgcttttactccacagttgtttttggtttttttctttaagtaattttgtcaggatatgttccttttcttttcaggcattgttaatttctgtttgtctgttatttgtacttacaacgtctcacacatttcattaggcactgatactgatataagaaaactcactcaaacatcttcaatccacttgctcgatcatcatttacaggaacactaaaatatatgacatagcatcctcctttaacagctgagaaatcagagaacaagagtggtgaagtaaattgtccagcactggggagccagtaattgaccaggctagaattaaaacctctatctatctacacttctaggtcactgaggaaaggtgcctaaattacaattttaagatgaggttaataaaagaacttattttacccaattgcaaatattttagaagactaatatgatggaagcagatctgagtggatggtgaaaacaatggagagggaatcaggaagccaaagtttaatttcttgctctctcttaagacagatgttaaatttggaaaagatgattcaacttcctgggtttcaatttccttctctttaataataatgatggatgatgatgatgatgctgatgattgtcataatttgatgactatatatctactcattgtgaggcacaatgtgacatattttataaacaatatattattaaatctcaaaacaaccatctgatatacacattgcatctattttaataacaaggacacagaagattgcttaaatcccctgaggcccatttgattccagagcacacgttcttaaccagtagctctatggtctttccaaccaagaagtctgacctgagtggtctgtaaaagatcttccagctttgaggttctctagtgctgtggttggtatagaaggaaatgactatgggttaacataggagaagcaagctcacacatcactcaagtacaattattagagttacagactggacttcaaattaagtcctaacatgatcaggtttacgcttgatgttgtgcattgcactggaggggagaaaacataatttcttttatttccctttttaggtttttagttgagacaccctcctacaaacaaaaatcaaattaacaaaagaaaagcagaaatgtattaacacatgctggacccatcatgccgagagacatcaattcaaaagtatttttctcaaggcagtggcttggggtgatgtttcaataatattttatcaaaatgccataaattctgcatagtaacaaggcaaaggaaagaacagttttagtcctttaaaaggtgagaaaatgtgagaggatagtgaaatctgttctcagattcctctggtgcctgctggtgccttctctgggctgataacaagtgctgtctccagtaaggaagcatggatgtcctgccatcaagcaaacagaggctgaggccgggtattctcctgccttttcagtgcctttaactcaacaatcctcaatatttggggaagaaatattttggtttctttcaagacattaaaaaataaaaaccacagaatttcaccttacacatgagtactaagctcttcctcatcctcttccccttccctttctttcatagcaatttagtccaaatgccatgaattggagctgagtgaggtaggcatccatgtgcatgtggaagaggagagccacagcagtccagcctgaggtgctggaacctgagagaggcgagagaggcatccatgcagggcaggggttaggacagtggtgacttggtgtgagtggcagagcccaagtaaggtgagaaggccatacctgtggtggggtggcctggcagagggtatcagagcctgaggaaggggaagagggttccattgttaggggagggtgttgaaggcagaagcctggagtctggtgttggagccaaggagaaggagggtggtttctgggggaaagagagctcccgtgtgatctgaaagatgtgagaaagcgagaaagctatccatgtaggaatatgtctgtgtaccaagtgtcagagcccgagtggggtgaaggaggacatccacactggaggcagaccctaaacagggtcagaatctgagtgaggtgaggagggaggaatcacccagctagtggtgtcagggcaggtataggagtaaaactgggagtggacatcaggacctgagcagggggaagaggacgctgacagtgatacgagactagtcacatacaggggaagtgagcaaatgcataaatatgtcaaagataatgggcaccagggttctcacagcctaaatgggagttgcaaatataaacagaggacaactgtaaatcaccataaatgaacacatcacacacgtataaaatctacgcacacacacaaatttgctgagaggctctgggcaagagcacctcaaaaaaaaatgagtacggtgagcatcctcatgatggcttctaaataccaatctctaataaaggaagccaggttgttttgttttgttttgtttttgtttttaacaacaacaacaaaaatggctactttgctggcagagcaggtgaaatacaagatgatcctggaactctctcttgtatcagaaaggaagaattcaaagaagggtaaggacatgccaaaggcaagccatttgaaagcatcgaataaatagcaaatgtattataactcatttaccaaaataagaaaccttggattcacaccgataaaacagatcatcctcatagaaatatatgaataaaaagtttaaatgtccagtgaggcatatttgcattgtctaaaatccctagccacaaaacactaattataaagaaaaaaaagatacttacttttatactggagaagtctgacaggtaccaccttagtcaaatgattatttaacttcaagagcaatgggacagatagaagtcttaaccttctacctgacagaacgcagcataaagagcacagcatcctgaatcgaattgtaatgaaagtggtttattacctccaatggtgtatccagtgaaggaggagaggatagagggaaagagggcaagacaatgggatcagtgtacttgctggctgggagaagccttttttatagtgatttttaaagccaatttttactgcttttattattatttttgaacatctttatagacccttttattatatgtgcccttggcatatagctcctaccaatacagggaagagtctgtgacttgccattgatacctgactattcagacaagcccaaatgaggtgaaactttaccacataactgccttgtgatctaaggtgttaaagtcagggaaatcaaggaaagactgtggaattgttgcagattgaaatagactaaagagacataattaagagaggccatgcatggtggatcatgcctgtaatcccagcacattgggaggctgaggtgaatggaatgcttgagcccagaattttaagacaagcctggcaacatggtgaaacaccatctctacaagaaaacaaaaattaacctggcatggtggcaaaaattaacccaggagggctaggtgggaggttcacctgagcccaggaggttgaggctgcagtgagctgtgattgtgccactgcaattcagcctgtgcaacagaatgacaatctgtctcaaaaaataaaaagaaaataaaaaagaaaaaaaatatcaactggattcttttggtgtaaaagattttattgggggccagacacagtggcttaatcctgtaatcccagcactttgggaggctgaggtgggagaatggcttgaggtcaggagtttgagaccagcttgagcaacagaaggtgactccatatagccaggcatggtggcaggcacctgtagttctaactacttgggaggctgagatgggaggatcacttgagcccaggagttagaggcttctgtgagctatgatcacactactgcactccagcttgggtgacagagtgagacactgtctctacaacaaaaatgaaacaacaaaaaatagaattttattagaaaaaatgggaaatgggacctgaagattagctgcttagagctgaatcaatgttaatttcttgatattgttggttttgggggtgttatgccctttgtttgttggaaatataaactaatttatttgggtaataggggattggtttacaagagaaaaaaattctttgtccatttttgtaatactttttgtgaatttgagattgttttaaaataaaataattttaaatatgtatattgaattgatatttaatatagacttgcattcaaaacagggccacttttttttcatgtgatttattcttttcttttcccaggtgatggtcttttaagccgtcctatttttactcaggagccacatgatgtcatttttcctttggatttatcaaaatctgaggtcatcctgaattgtgctgctaatggttacccttcgcctcattataggtaaaatcctacctgtgggcaccacactattttgttcttcctcactgaaccaaaacatacacaaaataaagtgttttataaaatgtcctaatttgtagtgtacagctcaaggaatttctctacgggtatgcagccatgtgacaatcactcagataaagatataggcatttccagtaccccagggtattccctcatgccgctttccaggcaataattaaccccctacccaccagctccaggtaaccgtacttatgtctctgtcttattgattaggtctgcttagaacatttattcttgagattggtgccatgcattgccttattgtggtcagaaatgagagagagagagaagagagataggggagagagagaagagaaagacaggaagcaagtaacacaggaagccaggaagaaaagaaagataaaaggaaagaaaaaaatgaagagaaaggaaaaaaaaagatttgtttcctcaatttgaaagactaaaatgtaagctcattttgcatttcccacccctgcctcaatgcggaactgcagcctcagttgctgcatatgcaatgattatgaaaatgttctataaggaatgaatccagatggatatctagatttatttcatcagataaaattatgtgacttcactggtgggtcacatcacccaaaaatactgattttagaaaaatatgttgaagacagctatgtaccctctaaggcagaaagggaatttttattctgggcaaataagaaaaaaaaacctatatttgtttctcacatattatttgtggaattctagggagaaagggtcagtaagtttttgttcttatttatcaagttgtagcaaaggcagaatttgcttcatattgtgggtggaatttacaaatttaaaaatatatgcatacgtaaatattcataggtaaatactacagatatttagttagtagaaacttcatatgtagtgttaatacaggaaaagaaaatacatattaaacttttgtagctttgggttttaaaacctttttttaagtcttgttttacagatgtgaagttgatatgacacacacaaagagtaacaacttcagtgtattttggcaaaataagctggtttagcctgattttattttgcagtaaaaatacactcttgatgtgcatagttatttagatcctaaaattgtctagattaatgagttaaatgacttaaatgcacttaattagctaaatgacttcaaagctaaaggcaattctaccttatcttgaatttttttgagctaacttcagtgtcttctttttacaacaaaggagctgaaaaaccatgtcttctcattccacagactaaagcttccttgtctttatcatacccaaaccagtgaaactcatctgtcaggggaagatccttcactttgcaaatttgggacactcaattcagagtttgttgatttgttagtttttcttaaatgatgagctgtcctattagtttaatatatggttaaatatatgaaaatttgattaatacatttagtgagatcacctaatacttaaagtagtaattttatgtttgagagctaactaggttgatcctaggggttagtagagaaagaatataagaattcctataacattttttgaaagtttgctgaatataagacagacacataaatacataaattacatatttatataaaaaatctattggcttttaacagttagaaggatataaaataggttctcaagataatttgctaattagttttatctgtgaaaaaatagaatgaaggcaacagttttcaatgttgttaaatggcttttatttctaagatccttgtaagctaaaaggctaaagacaagtaatttatgtgcttatttccagcccccataacctggtttggctcatttcttttttttttaacttttaagttcaggggtacatatgcaggtttgttatatagataaacttgtgacatgggggtttgttgtacaaattatttcatcatccaggcactaaccctggtgcttattagttatttttcctgatcctctctctcctcccatcctccatcctccagcaggccccagtcgttgttccccttactcatagacaagaaactatggaaagagagtgagaaaagaattaagtttttaatgcttaaatgtcagactcaggcccaactttattgataataaagcaaaggacagaggtatttcagataacgtgcattaccaacaaaatgtaaaagttcagttttaatatgaccctttctaacttaaattttattttttaaaaagcctcacaactatattcaccttagatggtgtgtgtgtgcatgtgtgtcttagaaggaaagccttcacaattcacagattctaacgttatttgaggttacctgggtatagtgtaaagcaacataaaagaatccttgacttaaagttatcatttctagtcacagctctatcaatccattggtgactttggaataatcatttttctctcctggcgtcatcttccttattcataaaatgaggctgggtttgattttaagatgtgttttctttcttttagtaaattccatacagcaaatgaaatctcagggaaaataagcaatattaaaagcaaactttttgaaagagcttaagcttgcccatgaaaaaggattaccctttattctttcaaagatcacataacacatgagaatatgaagtccagccctgaagccctgcaaagggaagagaaatgggctacccaaagatggtgctttggaaggattgcttatacctggaaagtctaggaaaatcatgtagcaatgaacttagttctacctcagaatatatatttgatttggaaaaatgaaataacatacacataaattatttctaaatagaatatactctctatcagaaaaaaggatttctgacaatcttctctctacctggtcaccagaggagactcctttctgtaatttagtctactctaccctagtcatgaacacaaccttaagtctagagaagctctaggcctctaagaaaaaactataatagtagtgactctgcccttctgttctttttattcatttcccgcaactttatccttttaacaatcctgtgagataagcagaatatacattattgcacacatcgtataatttgtgaaatgacttctggagaaatcagaaggcttgttcaagtatatgcagcaaaggaacgtcaaagctaggactaggattctttccacaggggtcacagactcaaattcagtgtacatcacaatcacccagagagacttaaaatttagattttggtgttctctgtcagaggtctggggatgggctcagaaataagccaggcagagagagacaaatatcatctgatctcactcatatatggaatctaaaaaaagttgatttcatagaatcaactcatagaagtagagtgtagaatggaggttaccagaggctgagtcagggaggggcaggaagggaaaggggacaggtgggtcaaagggtgagaagtgacctttagacaggaggaataagttctgggattcatttggacagtagagggattatactcaatgataatgtattgtatatttcaaaggagctggaagagaagattttgaatgctctcaccacagacaaatgatagatttttgaggtaatgaatatgctcattactctgatttgatcattacaaaatgcatacatgtatgaaaacatcacattactccctataaatatgtgcaatcattatttgtcaattaaaaataaataaaactcaaaaaaaaagaaacacattctttcagcaaatataccatgtaattctaaagcacagcctaattttgaaaaacaccaacaggcacaagcgcgcacacatgcacacacacacacaaacacacacatattacggaaggacagccaacaaacacagcccacaaccattattctttttttgtttttgtttttgagacagtcttgctctgtcagccaggttggagttcagtgatgcaattttgactcactgcaacctctgtctcccagactcaagcaattctcctgcctcagcctcccgagtagctgggattacaggcgtgtgccactatgcccggctaatttttgtatttttttaatagagactgggtttcaccatgctggccaggctggtcttgaactcccgacctcaggtaatcagcctgcctcggccttccaaagtgctgggattacaggcgtgaaccaccgcacctagcccagccattattcttgacacaggactgaactacttaaaagtgaaggatgtttcccaacaaagggtcgagattttagttcacatccattatgttttctggaactaatatgatattaattcagatgctaaaagcaatcatttaaaacacatttcctaggttgcatcataggaagacacttgtcagtatgcaattctatcagaaatgtgtgcatgacaatcatttgaattcattaatactgtttctccattgatttagacatattaattaggacaaagcccacaccaggagttgaacccctgatctatatgtacagtttaataatcattgtaccgtagtgatcagaatgattatggggatactgtgaaaaattcatttgctgccgctaagccaacaactttgaatttgtgttgaaaaacaattactgagcttaattaggagcatgtaatgatgacagcggttatttcagtgattgattccaaaattaaaaggagctggcaaactaaatatggtatatcctatgctttgaaaacgatagggaacatggaagtctaaagagcaaattatcaaaaactatattagagtgctggcaaggagaatattggtgtcttgagacaggcctaaagaaagaaaagttttgaagggttttattattgttttttttttttttcacttttttcttaccctaatattgaaaacgagcagtctctacaaattcctctagaaaaaaatgatcgcagaaaatctaggcaaatgaaatgtactctttaactgctgtctttcaacttccaggtgtgcaggaaatggctaaataatttcaaagttaacagagttggttcaaaacctttgattgatttgacatctgatccatcacatctcatctttaacatggtagaggattacctaaattcatatttcttttctactttggtaggcatttgtcagattctccccatgggatgtttgaagacgcgcccgaagaagtcaatgacatttgaattaattctgtatttttagtagaggcggggttttgccatgttgcccaggctcgtctcaaactcctggcctcaagctatctgcccaccacggcctcccaaagtgctgggattacaggcatgagtttctgcacccaacctctttgaattaattatgtaaaatgtcattttttaaaaaattaaccactcccaccaaaatatttttaatatgattttggtataaaggggagaatcatagcaaagctggcataaaccctaaaaaacacagtttggaaactggctatattccataggaaaagatcattcacttgttttcctagatgactgtgatggggttcaggacataccacctcaaaatatggcaccttggcatttgagaaaatagcagaagcaggaagatcattctcaccttcccctcactcttcttctctgaagcaggtcataaaacctttattccagaggtatcatttctatatccagaggaaagaaacacccttttcctcctcaaagacacagagaaatcaagaagaattggaacaaaaggccttgctaacttcccgccagtttcttaccattagatcataccctctttttacaatcatacttctgcaggactgtctactcttcatcaaaactagcattaaaaacacacaggttttcctgttttttaggattttttttctgaaggctttcatgtcatggaatatttatattaaataaaattatatgtttttctgttattaatcttcctttccttttagagacctcagccatgaacttagcaatgagtgagaaaagatatttttctacatgcacaactgtttgtcattattcaatagttttaagtgtttattttaaaaaatggtctatgtgactatacacagcctgtgccctaggaatgtatctcattagatatatacgattcatgcttcaaaatatttggggattttgatggagttgggagtttcaaggtaggaaaagtgagtctggttagagataataatcaggtattcatttgtcttaaaaatgaccaaataaaatttctaaaactagttatgaatctttgaaagtaaatataactctaagactcttcagctagttaattcatgtactaaagaattgttgactaatagctaagccaagagaatttttgcttctcaaaataaaaacctctcaaacagcatttgctttgctaaagtataattttagtttggcatttctaagtaccattgaaatattttcaacatgattaattttccaagtaacatactaacagaggtaatcatgttctaaagtagtcaggttattattgttttgttatcagccctgaattggcgttgtaaaattatgcttgccgctttcaatatacgcttcttgaattcctatctttaaatcattttgacattcaattttgtgctaccagttgtggatgttcaggtaaggtatatgttatttgaaaagtcactaaaggaataggttggccagtattattgactgactgtctaatttttatttctcatgttgagagttctgtttcctctttgtatacatttgggtgaatgtaacttataaagagtacatctttcaaataatctagttactgatctcaccaaacccaccaagacagctacctttggtaaaactggtaggattacctccacatgtaatcatgttttttggtgttttttatagttgcaggaattagaactacatgttttttaagacaaagattgattgactctgtatattataagcactttattttttttttccttgaaggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatgtgagtttggggtaaattttgtaatctttgtctctgaaaatataatattcttctgatacacacattttaaaaatctagctttgccaatgatatatttgagaatgaatatgactttatgggcttttgacaatgttcattttgtgaatctagattcttgggtataatagaaacctgcttctaaaaaaagaataaaaaaaacagggaaaagatcaatgttattatattttgtgaattatttttagaaacatttctaaaagtttcagacataaatattaagataaagatgtatgatatagcattctttttctttttcttttgcattggatattaatgcaatgtggagagcacaggaagaaaaagctgagggcagagaggtcatctgggggaggtgggcgttctcccaagaaaagcgatcatgcacccgtagtttgatgtaggtggaaataaagtggttgccaaaggcaggctttatattaactgtaacaatgtccagctgcatcacataaatgtcatccaagtaattaccctggtgacatttggggacattagcagatgaacaatagacatactgcgtctaatatcctttatatatagtgtttccagggactgaaatgtttcatactggattcagcaaaagccttgcttgagagtaattatatctgttgatgtggataaagtagaaggcttgcatttctccctttgcaccaaccattatgtcccagaggatctagccaaggaaccaaaaagtgagctgctatacctgcagggctcatagaaatgtctatactgtctgttactttgaaaaagtaattgttctgaaattttattaacaaatacatgaccaaaactcaccttgtgaaactacttcagtcatcagtagatacatgaattaataactgggtctgtttctcattgcaagtcttgtgttccaaagattattctacaccagagatcccttgatctacacagagttctctttatgttgaccattttggggatggccttgcttctgattttacatacaccacatacacatacacacatgcacacacatatacatatatacagatatacacacataaatatgttgctaactgtatccaaatgtatttgtatctatggaagtaagaagtgaacgtggaagtttattaacctaaatagaaggtgggaaagggccagtggctactttcgaacataggataaaaatatttataacacttgatttcttcatttcagctaagactatcacctggaaaaataatagggaacaaaataacataaaaacttatgttatagaaataaagaattgttccagactttgaacgattctgccacagtaattgtttatttctcctgcttggataggagatgaccctacaacatacacatgatatgaatcagattccataatcataaatttgactctttggtaaaggaaactccatacagcatatttatttgctataccctcgagtttctctacagttatgattctatctactctcgaaaacagttgaatgtctacatctcaaatcaatgcactctttgatataaccatagatttcttctcctttgttctgtactttttaacaaaaatatgttttaaaatgtcctacattattatatcataccttctttctgctttaaaaatttcttgcaacgagaagtttctctagttaaaacttattttgtttatgccatatcagaataaaagtctcaattaagaagaaattatatgctttcatctggctaaatgggacaaatcaatttttctgtccttattgactttcccatcttatcataaaattttccattttggggcagaaggtgtatgactgttgatcttgaaaagcatttctattacctttaatgcagaaagtaagatggcctatatccattaactaatctttcttctgcaaagttaaaggatcttaggctctaagagcttgcaaaagcaaggaccacaacatggtggtggtgtcatgtctgaaatatttctcattgtatccggggagacatgtgcgagagtgtggaaacagagagtaaagggtataaatgccagtccccaaccaaatggaaagttcctaaagtgcatgaactgtaccttcatcttaattataattcctcacaacctccttcataaatttttaacaatatcaattgtgatagaaaaggcctttggtaggataaccacagcagataaatgctgagattttgggaaacagagaggtgtgagttcaaattctttttgtcaaatatctagtggtatgaaattaggtcttttcttaacaacgttaagcttctgttaagaaatctatacgatgaggatacagcagtagccaccacataggacagtgacatggagtcactgagaaaatgaaggtcaagtccctgatccattatggaccctagggaaatgacagctctaattctttctttcactattattacctatctcaacttagacagacatctatatatttcaaaccacttgagtttcttatggaaactctcctagtttagtttacatttgaaaacttcctaaaggctagtttcttgttcttttcttttcatgtcaaatataatacatgtgctttgacatatattatttcacttgaattggacaacagctgtaggaggcagttgctatcattgcccccattttacagattagaagcctgaggctcactgatattggggctttcttaaagtatgttgttagagaaaagttggaacttgtgtatagacaaagaagacttcagactctaaaactcatgcacttcatgtcacagtattgagtccttctcaaacactgaccacacagttcatgtgggccttctttctttgtttcacttgctggcacagtaattgtctaaataataaactgtatcttcaggacagaatgggtcaaataagcctggtagtagaggctggtgattccttgtccacatccgcttttgcaagtgatgtgccaacccccagctatgaatacccacagatatccctttttgcatttcatgccccaaacctctccatgggatcaggctgaaaccagacaacagctgcaacaccttaattagcttcttcacttgctgtttccttcttccctccctgcctttctcctaagaggatatcctcaataaatcatatgcacttgaatccttgcctcaggctctgcttctaaggaatccaaagcgagacagagattaaacatttaatatgagattgccgatctacttactgacagaaaaaagcgggtgcagaagccccactcccatgaactcccatagataagaacaagctatgcatcagaataaaaatggatcaactcccttgcttcctgtccgttggcagtccattgtaaaatgtcactttgaccttcagaatgaatggccttatgaacaacctttcagaatctaccctgtccatggcagaaacgctgcagggacatacctctagataattgatggcttttgtttgtcacttttatcctggtattcagtaatccaaaagcacactttgagtttattttagacacagactgtaacactctgcttcattatgaatcgtctcatcatgaaaccatcctgaaatgtggcctgtatataaaaactacctgttgtgaaacatactcctaaatcaaatctgtctttaaccaactatgtaacttagacaagtcattcagttctctggatttagctaaagtatattttgaattatttgattacaaaagtctctttcagctattgtcatataatctgtccttccaaatactcaggtagatcctattttaagtatctctttcttccccaacccaaactctaccctaaaacaaattcagcaggagtctagtcaccaaaggcttctgttatcatcctggcattcttgaatgataaaactagtttgacttccaaaatcacttgtagctgctttcaatttcttttatttatcaaagcttttggtggtaaaggttgaacttagacctcttccttttgtatgtatgtatgttaatgaattactctgtacttgtgtgagagaacattgcatctgtcattgctgtttaaaatgtcatccttgagaaaatgagataggtgttttgaaagaaacccatgatatcactcagatgtaatttttaaatgcccttataatatataactctaccaatgaaaagataaacatttatgataaaaggtagtcatgaatggggctttttgatcctacattatttaatgtgtaatcacagctagcatttcaaataagtttgctccattattgcaaaaggaaaggcagctgggctggagcctcctaattgacccttcatttattcatcctccaagcaaccggagaacacctaatttatacccatcaagtactacactaggtcctaaagattaaatggtagataagaaacagctacttcctgtctcaacagaacagacaggggaaacctttaataaaattaaaaataagaaaaggaaaataaaggaaagtgctaacgcctacaaagtattatgtggcaggcattgttccaaactctttatgtaaattagctccattgatcctcacaataaccctctgagagtatcatgatcttcactttcagataagcagattgaggcacagaagaatgaactagcctgcctaaaatcacacaccgtatgtgggagagtctgttttcaaatccagacagagtgaagagtcctaccacctactgcactgtcccaaaacatcaagtgaagtgagaaaggtgaaattgacctataacagagtggagctcaaagtgagaagtagtgaagtttgtctgaattggagaaaaggcaagggaagcctttcaaaggaaatggggcttgcattgaaccttgacatgttagtttgtattctggacagagaaagtggtagagaaagtacaggtcggaagaacagtaagaggaaatgcagatgtgtgaacaatcttcaagtatcgaagaaagtgtggggaggtgggcaaaagacctgagaactgaaatgcagaaagctagggatcagaaatgactggttttctaggttgagactgaaaactaatttggagccacttataagtagtcctttatatccgggcctaatctgcaaacaataggataatttagagatattatgagatgccaaagaaacatgcaaaaatccatcatagtacaatattccacactcagtatgacactgtgtacggtgttaatttatggttaaatgccagtattgcccatttcatatagggttactatgaggaccaaatatattatgtggaaagcagagggcaagggcaactgatagactggtatgagttgaagatggtgagctaggcaggggtctggccatacaaatactaagaggccaagttttgtattttactgcttatcctaagagcaatggaaccgttctgaataatgttaaggatgttgaagttgtttataaaatgtagtttgaagccaggcgcggtggctcacgcctgtaatcccagcactttgggaggccgaggcgggcggatcacaaggtcaggagtttgagaccagcctggccaacatagtgaaaccacgtctctataaaaaatacaaaaaattagccgggtgtggtggtgtgcacctgtaatcccagctactcgggaggctgaggcaggagaatcgcgtgaacccgggaggcagaggttgcagtgagctgagatcgtgccagtacactccagtctgggcaacagaacgagactctgtctcaaaaaaaaaaaaaaaaaaaaaaaagtagtttgaaataccacatactatttccttaaatatgttagtctgacatattaatgatattattaatattatcaaaaccatagcacacatacttagggggcatcccaaacctcagtttttatcatatacaatggagtgaacgaattcttgcaccacatcacaggattgattttaaatggttcaaggttaaaatgcagtaagaatgcattttaaagggctataaacatgtaggcatttacaatcatcatagttttttccagaggaatgcaaagggttttacacctgccatgccattcatctttattctatacctgtaagctattcttaaccatgttttacaggtgaagacattaaaaggcaggacaactatgttacttgcccaaggtcaactaacctacagcagacccagaatttctaacatttccttcttgaaacaactttttaaatttatatttattttgtagacagaggaagtaaatcagaattctcatgaatttaatgccatattcaaagaaaaacaaaaaaggtaaagtcgtaacataaaggtctttgactccttgcagaaggattctaagatatttgtgtatttaaaggtgataaatatttttatttctatcttttgaccagggtcttataagcaagaacaaaaaccctcacatttagaaataaattttaagagtttccaaatttctttaaaattctttcatatataagaaatataaaagcagttatatgtgctcccgatgatatggtgataaagtgcatttatatcagaaaaagaaattaagacccagcagaagaagctttaaaaataacacttaaaaatgcttttggaaattgtaaagtctccgataattgcgaagtgcgtattaagtgggtaatgcatacctaattataaatgaaaatgctaaatggcttttaaccttttttctacatcagaaaagaactaactgaacaaaagccatgaagaaatattttttctttaatttcttaaattaaaaaagttggtaaattagtattgattttttcagtatcatttgcaaatagcataagcaatgttacaatggatttaatattctcaatttgtcttaatgaaataacagcataaccaccaattgttatcatatcaaggagaaaactttgtctttgcttttaaaaataattcagatcttaaacaaatagactgtaagcagttgcgtggttaaattatagcaagccactgttatatttatatttaaaatcaacagggaagtagattattcaatgctttagcctcattttttcccacactatcgctgctggaaatctatttatgtgtcttatcagaaatggtactttttcaaaattcaggccttctcccactgcctacttctacttatattcagcaggagctagtctttttagttcatttgaataaaattgtgcaggctaagagttgggatgggagaggaaaatataagaaagtaggggatccattctatcaaaactgggagtttctgatttacaaaactgagacagatgcacaagctgaaatgcttgtttattactcatgttatttgacaaactgtttcaaggaatttatgaacatagcacatagagattttgcttctaagatttataaaattggttcaaattacagtgacattttttgcattaaaggatcaaatatttctattgtttatttatatataaataaatatataatacatataaagagcatttataagtaataatgtgtatataattatctgaatttatatccaatattgtctaaaaagtaaatcagattcaggtgtttaaatagcaaatacaggagagaagatggcggataagcagcaagactagcttgcagctcctgctgggagggatagagcagcatgtggagactcacatcatactttgccccagaaactaccccaggaacataccaggaaagccgagagaatccacaaaccctttgaaagaactggatcaccgctgcaggctccctgagatgcagaaaaactgtgagtcggcttgctttctcaatagggaggctggtggtctggggcaggttctcagccctggtcactagctgtctggaaatagactcagtgctgctgggggcgggtggggcatggtgggagtgagactggcctttaggactcacgctgtgtgggggtggggtgaggcctgtgactgcgttttccctcacttccctggtgaactgtatgactcagcagaggcagccataatccccctgggaatataactccatcggactgggaactgtacccccatccctcacagcagctgcagcaagccccacccaaggagaggctgagctcagacacaccttatccctatcccagtctggtggtctttctctatgtgtcctggtagccaaagacaaaagtcataatgtcttgaaagctctatcgccctgcccaccacctgagaaacctgaatacttttgcatcctccgtataggaccacagctgatgcactcccgaagcgccatctcctgactggaggccaaccaacacaaaaccagcgctaaacaaaaacgcaaccaaggaccctcacagagttcacttcactcccctactacctccaccagagcaggtggtggtatccacagctgcaagacctaaagatggatcacattacaggactctgcagacactcctcagtatcaatcagagcctggtagctccactgggtgccagatccagaaaagcaaagcaatcactacagttcagttctcaggaagccccattcctaggggaagcgggagaacaccgaaacaagggagcaccccatgggacaaaagactctgaagagcagcccttgaatcccagatattccctctgacataatgtacccgaatgagaagaaaccagagagacaataatgataatatgacaaaataaggttcttcaactcccccaaaagattatgccagctcacctgcaatggatccaagccaagatgaaacttctgaattgccaggaaaataattcagaaggttaattattaagctaatcaagaaggcaccagagaccaggcgcggtggctcacgcctgtaatcccagcactttgggaggctgaggcgggtggatcacaaggtcaggagatcaagaccatcctggctaacatggtgaaaccctgtctctactaaaaaatacataaaattagccaagcgtggtggtgggcgcctgtagtgccagctacttggaaggctgaggtaggagaatggcgtgaacctgggaggcagagcttgcagtgagctgtgatcacgccactgcactccagcctgggcaacagtgcgagactctgtttcaaaaagaaaaaaaaagaagccaccaaaaaaaggtgaagtccagcttaaagaaattaaaaacattatacagaaaattaaaggaaaattcttcagtgaaatagatagtataaataaaaaacaatcacaagttctggaaatctaggacacagagtaatgtaaaatgcattggaaagtctaagcaatagaatcaaacaagcagaagaaagaacttcagagctctaagacaaggctttcaaattaacccagtccatcaaagacaaacaataataataataataattcttaaaaaatgagcaaagcttccaagaagtttgagactacattaaatacccaaacctaagaataattggtgttcccgaggaagaagagaaatctaacaatttggaaaatatgtctgagagaataatccaggaaaacttcctcagctttgctagagatctagacatccaaatacaagaagctcaaagaacatatgggaaattcatcacaaaaagataatcacctaggcatatagtcattaggttatctaaagttgagacaaaggaaagactcttaatagctatgagacaaaagcatcaggtaacctataaaggaaaacctatcagattaacagaagatttcttagcaggaaccctacaagctaaaagggattgggattctatttttagcctccttaaacaaaacaactattagtcaagaattttgtatccagttaaagtaagcttcataaatgaaggaaagacacagtcttttccagacaaataaatgctgggagaatttgccactaccaagccaacacaagaacagctaaaaagagctctaaatctgaaacaaatcttcaaaatacacaaaaatagaacctccttgaagcacacatctcacagaacctatataacaataacacaatgtttaaaaaaaaagaaaagaaaacagaaaacaaaacaaaaaaaaaccacaaggtattcaggcaacaaaatagcacggtgaatagaatagtacctcacatctcaatactaacatagaaagtgaatggcctaaatgcttcacttaaaaaatacggaatggcagaataaacgagaattctccaataaagtctctgctgtcttcacgagactcaactaacacagaagaactcaaatttacttatagtaaaggggtggaaaaagatattccgtgcaaatggacaccaaaagcaagcaggagtagctattcttctatcagacaaaacatacttcaaagcaacagcagtttaaacaaacaaagagggacattatataatgataaaaggattagtccaacaggaaaatatcacagttctaaatatatatgcacctaacactggtgctcccaaatttataaaacaattactactatacctaagaaatgagatagatggcaacacaataatagtggaggactttaacactccactgacagcactagacaagtcatcaagacagaaagtcaacaaagaaacaatggacttaaactatattctagaacaaatgaacttaacagatatttacagaaaattctatccaacaactgcagaatacacattctattcatcagcacatggaacattctccaacatagaccatacgataggccacaaaataagtctcaggaaatttaagaaaatcgaaattatatcaagtactctctcagaccacagtgaaataaaattggaaatcaactccaaaaggatccttcaaaaccaggcaaatacatggaaattaaataatctgctcctgaatgatcaaacaaaaagctgcctctttgaaaagataaataaaattgatagactgttagtgagattaaccaagaaaagaagagagaagatccaaataaactctattagaaatgaagcgggagatattacaactgatatcacagaaatacaaaagattattgaaggctactatgaacaccttcacatgcataaactagaaaacctagaggagatggataaattcctggaaatatacaactctcctagattaaaccagtaagatatagaactggaacaagatagggatgcccactttcactccttctattcaacatagtactggaagtcctagccagagcattcagaaaagagaaagaaataaagcgtgtccaaattgataaaaaagaagtcaaactgtctctgtttgctgacgttacgattgtatacctaaaaagccctaaagattcatccaaaaatcttctggaactggtaaatgaattcaccaaagtttccagatacaaaattaaagtacacaaatcggtagctctgctgcctaccaacagtgaccaagctgaaaatcaaatcaagaactccacccctttcacaatatctgcaaaaacaaacaaacaaacacttaggaatatatctaatcaaggatgtgaaagacctctacaaggaaaactatgaaacactgctgaaagaaatcatagatgacacaaacaaatagaaacacatcccatgctcatggttggggagaatcaatattgtgaaaatgaccacactgccaaaagcaatctacaaagtcagtgcaattcccatcaagatagcaccatcattcttctcagaactagcaaaaacaatcctaaaatttacatggaaccaaaaaagagcccacacagccaaagcaagactaagcaaaaagaacacactgggaggcatcacgttacctgacttcacctttttctctgaggccatagtcaccaaagcaacatggtactgttacaaaaataggcacatagaccaatggaacagaatagagaacccagaaataaagccaaaaacttgcagtcaactgatcctcaacaaagcaaacaaaaatatgcagtgtggaaaggacatcctattcaacaaatggtgctgggatcattgaaaagcccagtgtagaagaatgaaactggatcctcatctctcaccttaaaaaaaatcaactcaagatatatcaaagactaaatataagacctgaaaccataaagataatggaaaataacattggaacaacacttccagacattggcttaggcaaagatttcatgaccaagaacacaaagcaaacacaacaaaaacaaagataaatacatgggacttaattaaactaaaaagcttctgcacagccaaagaaataatcatgagagtttacagacaacccacagagtgggaaaagatcttcacaatctatttatccaacgaatgactgatatcgagaatctacaaggaactcaaacaaatcagcaagaaaaaaacaaacaatcccattaaaaagtgggctaaggacatgaatagacaattctcaaagaagatatacaaatggcaagcaagcacaaatgggaaaatgcttaacattgccaattatcagaaaaatgtaaatcaaaaccacaatgcaatacgacctccctcctgcaagaattgccataatcaaaaactcaaaaaataatagacattggcatggatgtggtgaaaagggaacagttttacactgttggtgggaatgtaaactagtacaatcactatggaaaacagtgttggagattccttaaaggactaaaagtagatctaccgtttgatccagcaatcccactacttggtgtctacccagaggaaaagaagttattatactaaaaaaaaaaaaagaaaaaaaagaaaaaaatttcatgtgtgtccgtgtgaagagaccaccaaacagactttgtgtgagcaacatggctgtttatttcacatgggtgaaataaacccatgcaccttcacgtgggtgcaggcgggctgagtctgaaaagagagtcagtgaagggagataggggtggggctgttttataggatttgggaaggtgatggaaaattacagtcaaagggggttgttctctggtgggcatgggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggcctgggctcagaggcctgacattcctgccttcttatattaataagacaaataaaacaaaatagtgttgaagtgttggggtggtgaaaatttttgggggtggtatggagagagaacgggcgatgtttctcagggctgcttcaagcgggattaggggcagtgtgggaacctagagtgggagagactaagctgaagggaggtcttgtggtgaggggtgatattgtgcggatgttagaagaaacatttgtcgtatagaatgattggtgatggcctggatatggttttggatgaattgagaagctaaacggaagatacaaggtccgaattaaaaggaggagaaaaatgggtattaaaggactaagaattgggaggacccaggacatccaattagagagtgcccaagggggttcagcataattacttgcttggttggcaagtttttgggctctatccttgagtttttttatgttgtcatacaccaggccagattgatttaggtaaaaacaacactcctcatttaagaatatgcagagtcctcctttttcagcagtaagtcagtcaaggcctcggcggttttggaggacaactgcagctaaagagtcaacttgggcctggaggactgataaagtttgtgattttgaaggcctctaaaagtattaaagcagcagcagccgctgcacgcagacatgagggctaggctaaaacagtaaggtcaagttgtttggacagaaaggctacagggtgtggtcctggctcttgtgtaagaattccgaccatgctaaccatgcctaggaaggaaaggagttgttgttttgtagaaggtgctggggtttgagagatcagtcggacacgattggcagggaaagcacgtgtgtttttatgagaattatgctgagataggtaacagatgaggaagaaatttgggcttgattgaagtaatgggggctgtctgtgaagctttgcagcagtacagccttggtaatttgctgagcctaatgggtgtcagggtcagtctaagtgaaagcaaagagaggctgggacgaggggtgcaggggaatagtgaaaaaagcatctttaagatggagaacagaatagtgagttgtggaggaatggattgaggacaaaagagtgtaggggttgggcaccacagggtggatggcaaaacaatttggttgataaggcgcagatcctgaactaatctgtaagacttgtccggtttttggacaggtaaaatgggggaattgtaaggagagtttataggttttagaagcccatgctgtagcaggcaagtgataacaggctttaatcctttgaaagcgtgctgtgggatgggatatgggcgttgagcggggtaagggtgattagattttaacgggatggtaatgggcatgtgatcagttgccagggaaggagtagagatgtcccatacttgtgggttaaggtggggggatatgagaggaagacgcgaaggaggctttgggttggggagaagggcggcaatgagacacagctgtaatccaggaatagtcagggaagcagataatttggttaaaatatctcggcctaataagggaactgggcaggtggggataactaaaaaagagtccataaaagagtgctgtccaagttggtaccagagtgggggagttttcaggggttttgaagcctggccgtcaatacccacaacagttatggaggcaagggaaacaggcccttgaaaagaaggtaatgtggagtgggtagcctccgtattgattaagaaggggacggacttaccttccactgtgagagttacccaaagctcggcgtccgtgatggtctacggggcttccaaggcaatcaggcagcgtcagtcttcagctgctaagccgagaagatctgggaaggagtcagtcagagagccttgggccagagttccaggggctctgggagtggctgccaggtgagttgaacagtccgattttcagtgggttcctgcacagatgggacgcggcttacgaggaatcctgagctgcgggcattccttggcctggtggccagatttctggcacttgtagcaagctcctggggaaggaggttctgggggaacgcctggctgctgcggttcaggtgtttggaagttcttgtgtgctggagatgtggctggggtttgtgtcacagtggaggcaaggaattgcaacttttttctattattgtacaccttgaagacgaggttaattaaatcctgttgtggggtttgagggccggaatttaatttttggagttttatttaatgtcgggagcagattgcgtaataaaatgtattttgagaataagacggccttttgaccttttagggtctagggctgtaaagtggctcagggttgctgccgagcgagccatgaactgggctggatttttatatttgatgaaaaagagcctaaacgctatctgatttgggataaagaaaaagaagcattaaccttgactatgcctttggctccagccaccttttaaagagtaaattgctcggcaggtggggaagagctagtcacagaacgaaactgtaagccagaccgggtgtgaggaggggaggctgaggaagtattgggacttagctgggtctggcaatgagcagcttggggaggacgggaaaggtcagatgggtctgtagaaaaggaagactgggaagactcagcgatgcttggggttgggaccaaggggacaggcgggagggaaagaaggaggatctgggaggaatcgcattgggaacagaggctagggagggaacgaagtgtgaaaaatgcctggacgtaaggcacctcagaccatttgcccatttttcgacaaaaattatttaggtcttgtaggatggagaaatcgaacgtgccgttttctggccatttagagccattgtcaagtttgtactggggccaagcggtgttgcagaagaaaataaggtgtttaggttttaggtcaggtgtgtgttgaagaggttttaagttcttgagcacacaggctaagggagaagaaggaggaatggagggtggaaggtggcccatagtgaaggaagcaaacccagagaaaagagagcgtagagacacggagggaaggggtttgggggttcttgcctcctagaaaagtgggacttgccgctgagggtgaaggagaaggggttgaggggtacttggccctgccccaggaaagcgggacttgccgctgagggtgaaggagaaggggttgaggggtacttggccctgccccaggaaagcgggacttgccgctgagggtgaaggagaaggggttgaggggtacttggccctgccccaggaaagtggagaagaggtagagaggtaggaacaaagagcaggaggacgggggattgatctcccaagggatgtcccccgatccgagtcacagcaccaaatttcatgcgtgtctgtgtgaagagaccgccaaacaggctttgtgtgagcaataaagctgtttatttcacctgggtgcaggtgggctgagtccgaaaagagagtcagcgaagggagataggggtggggctgttttataggatttgggaaggtgatggaaaattacagtcaaagggggttgttctctggtgggcaggggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggtctgggctcagaggcctgacaaaaaatctttgcacacacgtgtttatattagcacaatttgcaatagcaaaatatggaaaccaacccaaatgcccatcaatcaacaagtagggtaaagaaaatgtgatatatatatatatatatatatatatatatatatatatacacacacacatatatatataacatatatatatatatatacacacacatatatatataacatatatatatatatatatatatatatatatatatatatatagcatggaatactactcagccataaaaaggaatgaaataatggcattcacagcaacctagatggaattggagactattattgtaagtgaagtaactcaggaatggaaaatcaaacatcatacgttcttattcatatgtgggagctaagctatgtgtacacaaagcataagaatgatacaatggattttggggattgggggaaagggtgggggttggtgagggataaaagattacatattgggtacagtgtacgtggctcaggtgacgggtacgccaaaatctcagaaatcaccactaaaaagcttattcatgtaaccaaacaccacctgtttcccaaaaacctattgaaataaaaaaaggaatataaataaataaataacattattggaacaataagaaagccaaaaacaaacaaataaacagcaaatacaaataataaagagttttgatggaaatccattgaaatgttaattatgttttaaagcaggagtgtccaatcttttggcttccctgggctacagtggaagaagaattgtcttgggccacatataaaatacacaaatttttagctgatgagctaaaaaaaaaattgcaaaaaaatctcataacgttttaagaaaatgtatgaatttttgttgggccacattcaaagccatcctgggttgcatgcagcctgagggctgtaggttggacaagcttgttttaaggtattaatttatgctcttcttttccctagaagtataatatatacagaaaagtacaaaaaacatgagcagatagatcaatgaagtattgttaagccagatccaggaatagatatttccaacacccccagaaggtccgcccattatatccccttctagttatgacatcctccttctgcctcaaagatgagccatatcttgacttgtgaatttgtaattattattgctttttaattttatatgaataaaatcatgcaatatataatatattgcttcaagtctggcttattagccaactatgtttctgagatccttttatattgttgtaggtagctgtagttcatttttctgatcacatataatattttattgtatgaatataatgcagtttatgtggaacttttactgttattggaaaattgtattatttctaagtgcattcttctatgattattcttgcacatatcttttgggagatctgtgtaaatatttctctgttgtatataccagaaatcagaattatcgggaaattgggcatgcatatgacaattttaaaagataacaccaaattgttgtctatagtgattttattaatttgtactctttccagtaatgtttttttctatattcttgacaatatttgatatgatcagtctttttaaaaattttagccttttgcagggggatagtaaaaagtatctcattttggtttagcttctgtttcctgatcactaatgaaattgggcactttttaaaattattattggctatttggaaacctccctccctccccttggtttctaggaataacttaattcatttttccatattttaattgtgttgtctttgttttcattagtgattgattctagagaagagcacaatgttgcttttttgtgtaggaaaccgcttctactgtgtcgcttgccttttcactctcttaatcatgtcttttgataaacagaaaaatttaaatttaacatagttcaatctattggtctttttctttttgagatgttttttgtaaaaagtttaagaactgttttccttccttgcgatcatattttcctgttatcttctatagtgtattttgtccttcgtatttaaattataatgcacctgcattttatttatttattcatttattttcatggtgtaaaattggttcaatatacaatttttttctatagggatccaattgagccagaacatatatgaaagatgcagtcctttctttgctgttctacagtgccattcctaaagggaattaaatctgcatgcctgcttgagcctgctattgacctcttttttctctcttcctttgttgtatttgtaaatgccatattctagtaattactgcagtcttacaataagtcttaatatctgatagctattaaaatagactatatggtttaaaaaaaaaagaggcttgaattgtaagtgaaaccaaaggagaataaaatccaaagagaaccagaggagaataaaaattcatgccatgagatccaatccattatgaaaattgagctttaaaaagctttagaattagtgaccaaggcaaagagcggtacatatctttcattggataaaaatataacaactgtttctgtgagtataatcaccctgagtataaaaagcccgagggaagcttctcctgtgaacctgcatcaagagcagtgggtgattccgtggattatagtcccctcacagacatgcaatgctggcttttttatggtagcttcctatagcatatctcaaaaataatagctaccatgtattaggtatctattaagccttttacataacatttgttaaaaaaaaaattcccaaactatgtgcctggtttgctaccactatagccaatgtcactgggcatctcactattctctgactgtagctgttacaagagcatcaatagattctctaaaatgcagacaatagaaaggagttgctaaatttgtcaaattttaagtgaatctactgcttattttgttggtatgttgggtggctcttcttggtggaaggctcacaacctgtaactgactccagagcttctgcttaccaatttcagaaaactaggtttcgagtatttcctttgagcattccttcatgtgcttttatgaggctaactctccttccctatttccaagatggatactttgggaaggtaacatattctagttctcaaattgatgtaagtacatttatgttactttcttctctatttttgtagcagtgagggaataatgggaatttatacaaataaaccacatgagtatttcaagttctgtgatgttgatcacattctctgtgatgtatgctttagttgtatcttcctcaaagtaagtaccaaccttcctacagttatttctaattaaacaggataatctagtttaatcctcaaaactaccatgtaaaatagaagctactattataatttcaattttatatataaggaaaattaagttcagagaagtgaagtaatgtgcccaaggacatcaagaaatagtgaagttgggcctgtaatctcagcactttaggaggccaaggtgggtggattgcgtgagttcaggagtttgagactaggttggccaacatggtgaaactctgtctccactaaaaatacaaaaattagccaggtgtggtggtgggcgcctgtaatcccagctacttgggaggctgatgcaggaggatcgcttgaacccgagaggcggaggttgcagtgagctgagatcgtgccattgcactccagcctgggcgacatgagtgaaactccattgcactccagcctggacaacaagagagaaactccatctcaaaaaaaaaagaataaataaatagtgaagctaggatttgatgccagacattctgacatcttaaccgcttccttaatcattcaactaatgcttgtcaaatttaatgtgcacaggaatcacttggagatcttattaaatgcaaattctgattcagtaggtctaaagtgaggcccaagattctacatgtttaacaagatcacaggtaacactgatggtgctgccctggacagatatcagacggtgggtagcaaacagtctcaaaatgaaccttaggttaatgtctaaagacaatcaaatagcattaccataggggtcaacacaaggtgatagaaggaatagctctattatgatgtaaagaaatcttagggaaaaacaaatggtaattggtatttcccaccactaagatggtcattcaactatccatttatgcatccaaacaatgcatatttattaagcacctaccatatgtgtcaaacataagtgcaagcagtaagtaaaataaggtctattttctgtatttatacatctgccaaagtataaatgcagactcactttttaaaaaaggaattatatgaatgccattggaataaagcaccaggaaaaaaatgtgcttgagcattaaccaaagtaataggttttcaaactgtatttccttgccagaaatactatcctcctaggcagtgtttctactcatgacagaaaatgcaaataaggaagagtctccatctatagacgtgatttaacaagtcaattgcaggtgtttttcctcctttttgagaattgtgcggttgagagatctactttcacatacatattaatgagttgttttgcataaatcaattctatttttatgaatggagattatataaccctcctgtaattcttccagaaatcccatccaaacaagctactagagttcttagtagggtatgtcccttgagcacaaaggattttattttaattatttcatccatttttaagcaaaagtaatcaaatataaacaactgtgctggaggctgcaccctctgccagctgcctctcagccttctgaaaggctctgtttttgtgttgtttctgttttgtttttttgttgttttttgttttttgtttttgtacttttctcagtactcatttagaaagcaatcctattgtttttatttaaaaaggtgtaaaatgtagctgattcaaactttaaaatttatgatattcctctttggcaagtctagctgactatgggccctgaatattattattgctataaatattaaaattaataaaagcttatatgtgtccagtaagccaaaatatgggaaaacatttcctgagcttgcttaaattttcacagcaagtgaatggcagagccaggactttaaacctcggtctaatggacaacagaaatcaggcttcaaacacaacactggcatttcaaagcatgtcccaggtggcagatgtcctaaagaagcatctcacttctacctgtggttccagttagctcactctatcctccaccttctttccatagttaacaggggaaaatgtcagagtctgtgatgcactggataaaattgtcctcccctgagctccacgttttcacagctggagtgaagaaggtgtcttggcaagattcccacaaacacacactcaaaacacacatcctcactcccatatttgccttgacatcaccatctctgcttttacgaggtcttgactcctgtgtacataaggcagcaagcctggaattcttaggtcacccctcattgcccaaaccttcatctacatagagctctgaatgttcccgtatctgaacccacttcccaatcctccgcagcttgtgaaattcttccttgggcctcctaaaaccaaaatcaataattagcaaaatctttgcacacttaaagttttccctgaaagtccccctgactgtgttgcttcaactgacatttggcttccatctgaagatgcttctcctctctggctgaactgctgattcttttctccaatacccctcttaccacaggtctgtcagtagggatagagtcgtcccatctcctccgtgccatttccagatgatccctcctccctcatatctaattcctttgccattaaaatcatgccattagcccgcactactcataacttctctttgttgcaatcatattctcatcccctaaactccaacatttcttgaagattttacctattagctcactgtcattctctgcataatactcctgtcgaatatcttggccatttcagcctttggtgaatttggtattcagtactcaatatcctgatttgccagtttcttgacttctttcgttctgttgcccttgtttatcgacccatcttagccaatagccacgctgctaagatgactcttttaagactttgtcaatgtctaaagttgccagttccacccataatctgattttcaaccttcccaaatttgactgtctgactcactctctccagtccatggactccagcaatactttgactctgctagatcctataattcacgaatcctaacaactactcctgtccttctcctgcttcgtcttgtcattccctctatactgagacaaaggcaaaaaacacttcttctcattaacttttaactcacttgctcatcacttgcacatcaatgattcactttcactttcccccttatttcattcatctggtgaaatctaagccatgatgaaatccaaaccaaaattttaatctagtgaaaaatccaactatgacacctgctttcactttccaattaatgaccaccgacatcagtggtccattcagtgggccattaatgttgcctgacattaagtcaccatgaagctcaaagatgttactgtattgccggcatcttcagtctagaaaggccctctgtaggtggaaaaaagtatgagctagtatttttctcctataaaagtcaactaaatcatcctcacatacctcaaacaacattttcctgaccctttaatataatttatgttataaactgcttgatacttagttctgattcaggtctgactcattgcctagtccctgagccaggatggactttggctgtacttgagatgtcaaggtaatctggcactctgactaactagatgtgtttcagttgcttacctctagagttatttccccaaaataattccaatgaaacgttaaaacacacaacaaaggcagcctctttctttttccaatcccatctatcacataccattggatttctgttttgctacaaagtcctgaaggttttggccttttatttttatctcacaacctaggcccacttcttaaacattgcctagcttgcctttcccttttaaaatctgccaacaatcactttctctgttgaaattatctcttcctacatccaactgtgggaagaacagccttttcattgtgctgttctctgaggacaagaatagaagcacattttttaattcttatttttgtgtgacttttttctgcttagtagttaccagtttttactacaattgtgattcctgacaatatataacatttagaaaataaggaaaagctattaataatatcacctgagccagagacaaccactgttaacattagtagattcttctaaaattttttcttatacaaatcataaacacagatggatgaatatttgttaattgtggataactatttcactttacggaaataatacaacaaacactttaaaacattttccctactagtcattttagaggatattttaacaaaaataataaaatacggagaacaattaagatttcagaattttcaaagtttgcatattcatgatctgttttttaaaattcaggtctcctgactaagatgcttattttactgcagagaaataagcttttgtggataccacactcaaggggaaagacaggcttattctcgaagcaaatagagggtccttcctgccaatatgacctagagaaacagacaaatagtgagaagatgcatctccgagaaccttcaggctgggccactgtaaatccggttggatttgactcaacccagggcataagtaatgttctcagggcatttccttaacgaagactccctattgaaagaaggtatagcatgaacaatgtcgggaagtcagaatgcttaatttctgcattttcttcctctgaactgctaagattgtatttagagacaggtagagtcctatgtgcgtgttctaatctagttaatttacttcaatcatcctcttttattttgccagcaggcaaagccccttcagaatacctaattattattccagactcctgtcttagttttcatcagaggacttgtatatttcattagcttcagtccttgtaccacctctccttaccaagcccagcattgtgacaccatgtcctttacccttgtgtttttgaaagcaaaagaagaaacgcatacatttttattattcattcttttatctcactagtcttgttctgcgaaaatttgagatctcaatagatagtgaaacagtctttcacccttttccatggaataaatagttattggtgtttatatactctataattattatatgttgataaatggttatgtaatagctgcatacagggaggaaaagtccttgcaggtaattttgtctgctaattacatataaattggttaagcagtcatgcgtattgatgacatcgttttcaactgatttgacttctcaaaattactaaacttctacctggtcatctaaggcaggacaatttttccccaggatgaggggttggagggcagtggtttcagcaggtattagattctcataaggagtgcacaacctagatccctcgtatgcgcagttcacaatagggttcacactcctataaggatctaacaccgctgttgatctgacaggaggcagaattcaggcggtaacactctctcacctgccactcacctcacctcctgctgtgcagtcagatttctaactgtctatggcccagcactgcagcccagtggttggggactgctgatctaaggaataatctcagtctttgtctctctttatccaaaacaaccataagtctattatataaaaataatgtatgtatgtatacattttgcatgtgcttacatgtctctgcgcacacacataaatttatataaatgggattgttctagtaaccgacatttttctttaaaatttttaagttataaaaaatttcaaacatacagaaatgtctataaaaatattataaacagatttttatttaaatgtgtgttaatgtttttgcatttttgcttcagatcttttttaaagacataaaatataccaatactgccaattttcatctcgtgctttctttccctcccttcccagaagtaaccgctttcctgaagttggtgataattttttgaagtatggcttgaaatttttattgtctttgtttataatatttatataaatgtcatcagagtacaatttctttggcacctttttcactctacattcagtttttgaaattcagccatatttctacgtgtttacttattttaaatgttgtgtagtatttcattggattaatgaaagaagtttacttcgtttcaacgaaggaatgagaataaaatttaatcctgttttttcaggaacaatacactataaaggtatttttatttatatccatcaatttcacttatttttattgagctattatcatgtgtcagactctatcatgtgtggaagttacagtgctgataaaacaaacacatccttgcctgccatgagtctacgaaagcagtaggagagggatcacataaatatgtacagcataaaaaatgtaataaatagtctgaggagactctgagagactaaaatgaaaaagttatttattggaggctcaagaaagcaggattcaagatggatgaaatttccaatgaaggaaaattaaggttcatcaaaattagttatctgttagagttttttgtatctaatgccacagtaatgtgctgaaacaaagcatgaaaaaaacccatgatgtccagcagtaaacatttatttttggtcacgaatttttggtttactcggtggttcctctggtcttcttggggttcagttttacattggtggtcacatatgcagttacgttaatcttgctgggctaattcattacgtattgttggcccaggctggggcaactgcagtgatttatttcttctgcacatggcctctcatgctccagcctgctactccaggcttttaccatggtagctgggtggggatccaagagcaaggggatagaaggctacacagctacttgaggcatatgctcagaaccaatatattgtcacttctgctgcattttgtttgcaaagtcagaccagattgaggaatggtgaaagagactatgcctctgatggaagatgctgcaaagtcattgcaatagggtacaggaaggtgaaaaattaggactaagttgtaatcactctcccatggtgatatgaggaatggggtaagaatattccatagacggaaacaccacgtttaaagcctatgaaattggaaggggctacgtaagacatttgaaaatggaaaaaaaaaaagaaagaaagaaagaaagaaaggaattgtggagcctattgaggaaaaaagggaatggtgtcagtaaaagctggagaaattggcagggaccatattatgctggcattattgctaacactcaggattttgaattgtatcctaggaacagtagagctccatacaattttaagaaatgtattatttaattgatgacgttacctaatttattacatgatttaatcgattatatataatctaagtttaaaattatttttattatttcttagagtcaaggtctcactctattgcccagcttgagtgcagtggcaccatcacaacctactgcagcttcaaactcctgggctcaagcaatcgttttgcttcagcctcctgagtagtagctgggtccacaagcttgcaccaccatgactggctaattttttattttattttattttagttttagttttattgttttttgagacagagtctcgctctgtcatccaggcttgagtacagtggagagatcaagactaaccacaatggggatccacctaagctcaagaaatccactcagctcagtctcccaagcagctgggaatacaggcgtgtgccaccatatccggctaatttttaagatttttttgtagagacaaggtctccctatgttgcccacgctagttttgaactcctgggttcaaatgatccttctgtcgtggtctcctaaagtgctgcgattacaggcatgagccaccaagcctattatagaatgtaatttttaattaaagttatttgctttatctgtattaaaatatcttaagaattataattttctaagttatgaaataatctgggagcctattgagtcattaagatgttagacgtgaaagtgtgggtgagaggtagcaatggagactaagaaaactgagatatgattgagaaattttggatgttaaaccaataatatttgctatgaggtgggatgtgggttttgagaaagaggatagtatcaaatatcgccaaatggataattgatatttattatttactttgatgaggaagacttgaagaactactttgaataaagaattaagagttcaatttcagagatgtcctgaggttggatataagggtctggattgccaacagaaagtctgtgctaaccatatgaatttgagaattatctacatataaatgttacttgaagccttgggagtagttgaagtcaccaggagtaaatttttcaatcaagaagaaaagaagacaaaaaataaatcccaaataattccaattattagacatcagggaatataaatagatatgttcatggttttaaatggctacatatcatctgattatatgtctttaccataattattctaaataaatgtctcttattggactttgttaggcttcattagacagtaataaaataactatctattatatacttctttactcatttgccaattatatccgaacagtagatactgggaagttgaattgctgggaaaagtaggttatacattttaaatgtgaatgcatcttgattaacaacctttgaaaaatggttatgccaaatgatactttcaacagcaccacccgaatatgctattacatcaatccctcttgatattatgtattgcttaatatgtacccttagcaatctgatgggtgacaaattcttgttgttttcatttggatgtctaggtttatttgtaaaatcaaacttttcttatctgtttattggcaatttaaaattattttgtaaatttcctaaattgggtctttgcctagttttctgttgaaggattcaaattcatttccaggaattattttaaatatgttaatatttttcttttacaaattatgtgaaatgttcctatttttattttaacttggctagttgtgtttttatgatacagaaattttagcaaagaaattgttttgtaattcaatttctctctcattttctttataatgctttttgtggcacatgcagaaacattatttaagccctatgattgtaaaaactatttttggtcagcactcttataatttcattaattccttcgaggccttcgattcaccttgaattttttgtaatgagcctgaggtaaacacccaaccttgcttccccacccctgccctatgaaatttccccaattccatttaataagtagttcagtgttgacagagcccattttctacttcaaatccaagaggttttctgctgtggaggcagtacaatatagtagttaagagtaaagttcccaattactctaaataattttcccttcacacccctcccggcagggtagaacactagctggtgagagcgagctattctacaaagctcaaagctacaccgaagggtcatatttctcctctagagaaagcccatttaacaacaaaagacaaacttttaaaatggcagcactgcctagatactaatggtttctgatgccttattcttcctgtaaataggtcagatataaaggtttagaagtcagcattaagaccaaatgcagcatctaaactagagaaagtgagtgaggaactgccttgaagtccattctatcaatttcattttaacctgatttatttggctatatgtttgccccctctgcatttcctatatcagctccatcacaaatcagtcccctccaagttgtattggaaaagcaatatatgtgattgagatattgttaacaacaaagccaattctggtcccagagctgttagattgtgattgataaaacttaatattttgaagggaggaagaaaaaaaacctattattccagttcttttatttgtagtgtgggtgaagttccttttatctcctctactttcattgtagcagtatgactgaaattccaataaattattgaatgcaatatccagatgtccagatgattttttggtgctgctgctacttcttagtgagcaagacaaaagatagttgaggttctgcaaaaagtgtcaaagcttagcaataaaataagatttcattgaacagaaactaatggaatcactcaatttatttccctttcactgttgtaatgcagggaaatcttgcttcatacgagtcacaaagcttgagtgtgcagtggcctggctctggcattgcatggtttgtgtgtgagggattggaatacctttaataaaaaagcgtggggtgaagcagcttagtctttcaaataaaagaagtttcagtgtctgggcatcatggctgtttaaaagtcaactttttcaactttttctcctcgtgtcacctttttaatattcttggggtccctgaagacctatatctccagttcatcttggcatacttaggttcaggttttatctgctccatggggacagctacctttttcttagagtgcttccattttcttttctcagatgcactttgtagctgtgtcatagattagccaagcatgcctgattgagatattaatctgaaggagtgttggttaagagacagaccagtggtcagcaaaccttttctgtaaagagccagatagtaaatatgtttgattttccggccaatgtctctgctgttattgggtgaaagcagccacccataaacccattaatgtggctgtgttccaataaaactttattcacaaaacagacagtgagtaggatttagctcatgggttgcagtctgcagagcactggagttcactcagaatactttatagatgtgtcctaccaatgatgactgttaacatttattaagcatttgctaaaaattctccttagataatctcatttctcatattatttactaaaactaaagtgtgggtactatttataaccatgtttatagataaataactgaagaagacagaacaagtaatttactagtacatggtagaagggcatttgaactcaggctcactctagggcccaagcttctaaccactctgccataatgcttttctcattaattaatagaaatgcaaatgctgtgaaaatccattttgttaagatatttttgtctaagtaagttttttttgtttttaattaatgacgtgtcacatatgtttcagcttactattcacaggacactagattactattattatttaaatgtaattatttaatttctattttgggaagattaaccatgaatttactggcagtggaaaaacacaaaggactaaatacaagatgcataaagtcagcatgaagagatgaaaacagacagggatgtgaacttacatgagttgagtctttaaattctggctctgtcctttacaatgtatgactttgcatgttacattctgagccttaattttctcattcatgaaactagaaaaacactagctctatatctacatcaaaattattttgagaatctattaaattacctaatgtagacatgcttgtatagatgtatccatgtataataatatttgcagtatactatatgtaattatatacatacacacacatacatacaaacacacaatagtatatattagtcatttttatttagaggaataaagaaattctgtgtttaaatgatatgttaaaactgctttgaatttggatcaaaatttagagtagattttcacaggttctgaggcataaagagttcttaagggtcatgtaggccatgcctctgtcttcaggaagagatatccttaagccaatgcagatgagatcctgtctatttcttttagagaaacaatttagtgaaagtgcctataaaccatttgctgatagaaagacaacctcttgaatacaaattgactccctgattgcaagtgactttgtgatgacaagcaagagaacttttcacaaacacagaatatcaaaaacattttttgtttgtttgttttcgggagtcaattgcctgtgtgcctgtggcttccggatgggggttccgattcaaaacatccagaggctccatcagtacttactatgcaacataacacctcttagtgtctagaggtgagtcttaatattttataccattaactgtgtagtcccaaagatagattcagggcagatgtttgatgtttggtttgctgagtaccatagcgagtttctctgcctatctttgacatttttgtagcagtaaccacatcacccttcttaatcactggtgctttagataataattccctcaaataaaacaaaaactgaggtgattttataacacattatgatatggtttggctgtgtccctgcccaaatctcatcttgaattgcagttctcataatctccacctgttgggggagggatcctgtgggaggtaattgaatcatgggggcggttaccctcatgctgttctcttgataatgagttctcacgagatctgataatttaaaggggcttttctccttttgcttggtacctctacctgatgccgccgtgtaaagaaggacgtgtatgcttccccttctgccatgactgtaagtttcctgaggcctccccagacatgctgaactgtgagccaattaaacctctttcctttataaattacccagtgtcaggtatgtctgtattagcagtgtgtgaacaaagtaatacacattatattctctcctttttgaagaaaaaattaagaaactggctgttcaaacttaatgtgaagtatcagagaactctatgtgcgatggggaaaaaaaaattagagaaacattggtttgccaccagtggaaactaaccagtcttgtctgtttagttcattgttgcattttcagctgctagagcagtacggggcacattttagttacttaataaatttggcagatgagacttcctttaaatgtctacagcacaatctctttggctttctgtgaaagcagatctcatggcgaagacatggactatgtagtgtatttaggtggtattctcagaagtatggtgaaggagtaggtaaatagatagcaaaaggagaaaacccaaaaactgatgaagaataaggtaattaattggttgtcattgtgggcaattgtggctcagtacagctgagtgccccctacagctatcaagcacatctcattattagcccagcataggccaaggaaactgggacatttactcattaccttctgtacctcattggttaaggatcagtcctcaggacttcaatttctggtaacctggcctgctttctatgtagacaagtatgtgtctgtggaataaaaaataatttctcagagcattctcaggcagagcaacccaaatggaggcagcaaaccctctaacgtaactgtcccccaatgtgacaggtaacttcctaaatgggttgaacagatatatgggatatggggcacctacagtggctgctacaatcatactttaaaagaactataacacttttggtttcccatgtgacagtcataatgtgagaaaattcaagaaattagcttgatatttacattttatcacataattttaatttaaaaggtcacatgtaataagacaagaggaggtgtaaaagttcagagatagcagttccggaatttcacattttttcccgtatacttggccctagtatttctatgagtaaataggttagtttttagttgttcttggtaaattactggatatgcgactggactgcacttatgctatccttcaaataaatgaaaaacccaattgagacaactggacagtgatctcctggattaattattatactgaagatgataattacagtttctgcctgtcttataaataagcagtcctcagttgccaaatgggcaacctcttttctgcagttacagatgtgcggcattaaacatctcaaaaatccgaagtaagagtcacaagaggacttcatggtaggctcaggggcagagaagcttatgcagtgttgtggctaggataagccaaagcaatatgcagtctgagatgttatgggggcatgaactataagtaaaaacaaggagactgatcagctgggaagacagtggagcagatattcatgcaaagcagagttaacagagactgggacacctgtagataaaggaacctagagagggaggaagagaataattggcaggtgtggcaagtgtccttcctgttcccagatatgcctcctgcactttgttggtctaagatttctcttgatcctttttaactccacccccgctttagtttatactactttaagtgaatttcatttcctggcatgtaaagagacctggcgcaaacaatgaacacacaataatcattgtagcagaaattgaaatgaactagaaaatcaaccagttggtcgtttaggccttatggcattgtgctaaagactataggtcatactttttgggatttgaatctttgttctattaattagtaaccagttcagtgaccttttggcaagttttttgaacatttctgggatttagcatttcatgtgtaaaatatatgtaataataataaatatttactgtacaatatgcttgtatagtacccacatatatagtataaattttatgaagattaaatgtaaatataaataaatccaagaagataattggtataataaaaagaaaaataactaaaaaataaataaatgtaataattaaatctacatatcgtttaaatcaactccaagtctttgtaagagttataagttatttagggccatttgacatgtagtttttaaacaagttacttatttcatttaagtctcacaacagtcaaataatatacctattttcagaacattttatagatccattcacccattcctcttttcagcaaatgttcttgagtgccctttgtgtattagacactgagcatattcagagaaattgaaaaaaaatgaaaagtaccattttaaatgtctcacagcttataaatccaagcacttcattcaagcacagatttatctgactccaaagcccaaacattttccttcaactatgtgaacactctttttatgtgaaataagcaagctttccatctgtttgagggtttttctgtctcccctgggccccagtctcttataacctaattttggaagtgacaagccataatttgaccagactcagttggttgtgcagactaatgctgacacaatgcggcaatacacaaagtggtggatattggaagcgagttcattcggggccgttttgcagcctagctaccacatgtttccaggtcgatcctagcctcttctctaagaaacctttaatcagacaaatttggtcttttgctctcttcaattcctaaaggaaatattgtagactatgtttgtagtattttgtatgcattcactcgctttagaggtataattatttcttaatttattaaacatgttcttgttgaatacctgctttttgcaaacactgaactcgcgggaaaacaaggtccctgttttcgtgaagcttatggtctatttagagcacactgaaataaagtaaatcaataatcattgctgacagtgactgggcctttggggaaaaatacagagtgatagggaactgctacgttagattggttagccaagggagggttcactatgtggtagtagcaagtaggctgagatctaaatgtcaaaaagaatctagaatgcaaagatctgggggtaagttttcaagcagaagaaacaagaagaccaagggccatcgggggaagaaactcattatgttccgaaaaacaggaaaataaaatggcagctgtatttggaatgttctgaacacaggtgaaaggatggggtaaacagggccatatcatatggggctttaagtaatttagtaaactatttaaagtcatctttatttctctgggttgactgatcattaatcaaatattttttgagtacctactgtgggccagcacttactggtactgcaaaggtaaacctgtacacattttgtggaaaggcgctgatacaaacaaacggtggcagccaagtagggttattttttgaaaagattttataaatacatgagttagtgaacaaactctacatttaaattactgttatagcaaattataatgcaatgcaagcagttcacctctttgtaaacttattgaatcagccaacatgtcctgaaccacctgtctttgaggagcagccacatagagagaggttgagtggttgatgtcatttgggactaaaagttccagtttcagctttgactgtaacctataacttaaaccagcttcatctgtatttttaaaattatttttaaattttatttttaattaactaataataattgtatagatttatagggtaaaatgtggtattttgatgtatctttagattatggaatggttaaatcaagctaattaaatttgtcaccccacatacttgtcattttttgtggtaaaaacatttaaaatctactcttctagaaattttggagtatacaatacattattatttattatttttaccactctgtgcaatagatcactaaagctttttcttcctgtttcactgaaacttcgcactgtttgactaacatttccccatttcctatgcacccctctcccccagcctctggtaaccaccattctactctctacttacatgaatttaacttttttgattccttgtatgagtgagatcatttggtatttgtcattctgttgctggcttattttacttagcataatgtcctccaggttcatccatgttgccacaaatgaccgaatttcctttttttttttttttttttggctggatagggatagtattttattgtgtatatatgccacatttttgttatctattcacctgatgatggacacttaacttgcttccatgtcattgcattcaccagaatgcagatatctctttggcatactgatttcaatttctttggatatatacaagaagtgggattgctagatcatgtggtaattctatcattagttgtctcagctagcactctctgcctcttcacctctaaatgaaacctagtcactgttctctggaaaaatcagtgtccaggtaattccagtgtaacccaatgaacagacatttccatgactacttctggctccaacttttgctgaagtcccattctctgctctgggtcttacagttttccctccttctccatcctggttcttactcaagagtagaaatgttttcttaattctgtccctcacacaacacacttgataaacacatgtctatagatttttgtttgtaacaaaatgtttgtagacatttaggggaggagtattggcaaaagaaaacacaaattactataagcagaaaagactatttctaagagtccttcagcattctatatcttgattttctttttgtttctgttctctcccctccaccaaatccttcatcatggcaaatgcagtcagaccactttggttgtctcaaagatgtcttgtctcctgatatgccatgtcctctggagctcagatggcccgttttcctcaacaaggtttttcagctttagcctgaaacacaaaaaacctttgtgttttttgaaatatcaatgtactgtctgtactatgttttatttttcccaaattgctttgattttttaatgagtaaatttgtttgaaaaaacatatttattaccactgtatctagaaagccagtgtcattcatcacaaatagaacaaaactttaaaaggcaatacatagttatataaagttaaaggtgtttttttttttgcataacacctaagtgcgtcacccatacaaccagtgatatctctcccacacattggtaatgtctcttctgcttatctctcagggttactatcaacattaaaaatgatgacagaaatgaaaatgctttggaaaaaagtgagattttatttaatagtctctctttccctccctccctttatctaaaccataatgcatgcaagggtccttatcactgaacctaattctccttagtgctgagctggagaaagctacaaagaaaatgccgattgcagctgtgattccaaagaccttgcttggactaagaaaattcaacggaaaaatgtcagtatttaccatcaaccctgcagtcactctcccgaattccagttgtggaagttcttgcaaaccgaaaccagtaggataaaaatctctggtaaactcagagcttatgtccatgggaagtctttaaaaaaatgttcttgcttcacgcttcttgtataaacaggagcattaagacctttacccaggagctctgtcccattacctccaaaactcggccttttgtattttacataggttgcaaattttgcaatctaactttctgattaaaccatcacaatgaataaaagggcttattaagggctctgtctatgaaggaccatagcaggtataatggttcgcataaaccactctttccaagtgacctcgggcctcactccattgaaatcactctcctttactctaatgagagtcacacatgtgaatcaagagggagctataaatgcagttgttcttggaagggcacaggtgcacctaatttgccaccaaaaccaacaccttcagccccctttgctgatgacctggcccaggagtgaattacaagtgagcttctggccagactccctcagacctctgggaagccagtggtcagcctggcccttttttttttttttttttttttttggagacagagtctctctctgtaacctgcgacccccaggttcaagcaattcttctgcctcagcctcccaggtagctgggactacaggcacacactgccacgccccactaattttttggatagcctgaactttcttgttacctaccacctgctaagacttaagtacaaggtcaggatgtacttcccccagtgacagggcagactctgtttgcttgctcttggataaaaagaaactgtttgcagccctctttttcctctccttcctcactttttttccctctcccaccattgagcagggaaagtggtatcctgaatagctgaaaatgaatcagagctgggtagtagtccctattcaataaaaggcctccttttatttttttagttatgtggtcttgagcacattgcttaacctttctgagcactggtgtgtatatttatgaaatgggagtcatatggggtacctacaactcattttgtttataaagttcaggaattgggaaggtctcagtaattaagaggtccccggctcctgtaccaggaagcccctctcacggtacacctctatagctcttagctgttgccatcaaatatttaaccaaaatctaataaacacttgatattggagaaaaattggaatgctgatatccaagtaggaagtaagaaggtcttttaagagtttatagtgtcgaatccatttacggtccaagttaaaatttctctttgggaaagataaaataatatttataaaaattaacaagtggagagaaagtgagttgttttttggcgtcctgggaataatgaattcaacaagctgatctttggatgagtcactttagtgtctgcaatggcaatggaatatacacgtttcttttgccattcagggcttcctcagcagaaacctcacatttctttctgaaaaaaaaaacacgtcccttgatgacaccactgatgacaccttgatgactttcccacatgaggatgatttacctgaagatttggccttttctggatactcccctttttgcctttgaacaatatttatatcacatattaatcccaagaagcacaaattgccccaaagaaatctctttagagattattgactacaaaggttttggcactgtcctccctgcagaacaaaaggtgagaaaatgaacatttgccaaaaggcaaagcccaagactatgagaagcagggcagcctaggatttttctggctattgtatgtccacccaagaggtcactgctgcctccagctgggctgtgtagcttcctaggcagtgagggtcactaaccatcagtctaacaacttgtgtcaagttggagaaacattctctggcataaaatagagagtgggctgggcgcggtggctcacgcttgtaatcccagcactttgggaggccgaggcgggcggatcacgaggtcaggagatcgagaccatcctggttaatgtggtgaaaccccgtctctactaaaaatataaaaaattagccaggcgcggtggcaggtgcctgtagtcccagctacttgggaggctgaggcaggagaatggcgtgaacccgggaggaggagcttgcagtgagccgagattgagccactgcactccagcctgggcgacagagcgagactccgtctcaaaaaaaaaaaaaaaaaatacagtgtgatgtggcagttcttggaataaaattcacatatttttgactttaggtctcctttttgtttttttccattcattcatgagcatttaagctgccaccgaataggcacagaagtaagtcctgactcagtcttcaagaaaatatgtctcgttacatcatccgacactgagatgaaagctgaaaaaaaagccagtttaaaagttcaagctgggattggtggcacacacctgtaatcctagctactcagaaggctaaggcaggaggattgcatgagcccagagatttgaggttacagtgagctatgatcaagccactgcactccagccgaggcaagagagtgagaccctgtctcaaaagttataaaataaataaaataaaaataaaaattcaaaacatcctaattttgttgatgtgccctcgtatcatcagtaatgtgattaaagtccctcacatcatatattttgtacttaacatcttctacacactttaattgtattatgtcattttttttcctctgaggcaggtactattgttagctagcttattttaaaagtgaagaaaactgaggtagaaagatactaaataatctgccctaaatcaatagctagtgcatgcacggccaagctagcatttgaatatagatagtctgaccctaaacttgcatttttgatcattttgttccatcactaagccttttaaggaattcgttagtgggttatttaatctattttgcatgctacctacatcaccttcctttcaggaacaccaaaggccagttgccttttactagttaagtaatctggcatctcaatgtatcctatgcagttccataattgtgttctgtttctctcatctacttttaaatgtagggaatatgccagcttagtaagaagcgagtttgagtctagcccacatctagcacttgtatatttatttttgtcataagtgtcactgttcttaccaccatttgtcaggcaaatgtgtctattatagaaaatcaaatccagtctgacatgtatattatcatagaccaattacctaattgatatttcatattggtttacttgtttaatttatgaaatgtttacctccctgaaaacttaagtgctgggctgttagggaaaaacatgcattatgtgctccttactattatcctatctattttttcataaaaaaaaatgcttctcagtgaattcattatattcccagaaaaacaagaaacaacgcatttttttctctacttatatataaatttttacgaaaattcttttacacccccaaaagtgaggaattttaacttggactgtaaatggatttgacaccaggagctcttaaaataacttcttacttcctacttggatattagcattccaaatgtatgaccagttctaagatttagctattgcctcttttacagcgtttgacaataacattgtgcttgattaggttatgtcgtgttgtgttactgagttatgctaggaaacataataatatcatgaacaccatgactgagtatatagcatccagaaaacgatggtggaaaatgaaactggtttcagtagagatatttctctgtgccaattaataaaggcatgggaaaattagttactatagaactaaaacaaaatcactcaagaaataggaaatagcaacatgaacaattttggtattattcataactggtcctcttcaaagaagagaagcatggagagatacaaatttagaataacctcactataatgttttgagattcttaagagtattttaatactgaaagttgcatatatcatatctgggagttctgtgagacttatgcagatttggggatttgttttcttggtgtctttcaccatttctcttttgctgggcagagtactggcatttctttgccccgcaaaatgtttttgccgtaggccaaaacaaaatacataccttcaacatgggaaccgcatcgtgaaggtgaacaagtgctccaacatcttgtttactccagaaccagctttcagtgctaaaacttcttcagaaggattctcaaaggggggaaatagtatttggttgacggaaaccagaaagcagggtaaaataaatcatagagtttaaaattagacctaacgtctttgaagtgaccaataattgaaattgcttctgaggtgtgaaaagagagaaaaggtctgtctgggtgactttctagatagagaggcagtatggtctggtggttaagcgaatgcactctcgagccacaatatttgtttctttactttgtctttgtttgtttgtttgttcttgctttttgagacaaagtctgactctgtcacccaggctagagtgtggagtgcagttgtgcgatcttggctcactgcaacctctgcttcctgaatagctgggaccacaggtacatgccaccacattagactattttttatatttttagtagagacagggtttcaccatgttgcccgggctggtgtccaactcctggtctcatgtgatccgcccaccttggtgtcccaaattgctgggattacaggctggagccatggcgccttgtctagaaacacagcatctggaattaaattttatttcctttacttattacctgtttgaacccatacagatcaatcaatttctggtgtgacagcaggagcagagagagctgaacatcttggcagatgaaagcagcgggacattttcctcctgctcctgaaagagaggattgtagtagggaagttatagaagagagaaggcagacgcaagtaagaggagtaactaaagggcctttaggagccatatacccaatatttcattctaaggtgttcgagctgcatatgaatatatcagtaaggctgacacaggctcaaaatctggtagtggtgatgcaccacacctctgttgtatgtgctggtgggcggtgcatagctctctatgttggtcaaaataaggggctacattctatgttcacatgcagatacagggagagatgtaagggtggagataaatcgagaaatataaagagaggtacaaataaggattcagaggattcaggacatcagaaacagagccacttctagaaactacaaattcttgggggagagaaagcacctttacccctccgctagcaatttgtacaactttttggaaaagcattaggcttttgatggtttgaccatggagtattagtttatgttaattttgtaaattataagtggcaaggagaccccaggtaacatctggagagcagtgttttagtgtgaaccgtggaaccagagggatatggttttaatgtatccccacccaaatcccacattaaattgtagttgccataatccccacatgtcatgggagggacccagtgggaggtaattgaatcatgggggcaggttttacccatgctgttctcctgttagtgaataagtctcacaagatctaatggttttataaagggcagttcccctgcatacactgtcttgcctgccgccatgtaagacatgcctttgctcctccttcaccttccaccatgattatagggcctcctgagccatgtggagctgtgagtccattaaaactctttttctttatgaattatccagtctcaggtatttcttcatagcagtatgaaaattgactaatactcaaactctctttttcaaccttatctggacacatagaaattgggtcaactttggtcagtggccagtcatctgtgaacctcaatttcctccttcgctaaatgaaagtgacaatggtacaggtgattgtgaggattacaggtggttctgaggattcaatgagtgtacttatcagagcatctgacatataatggctattctccatatattaaaaaatgaaagaacaaagaaaaaatttaaaacattgcaatgaaataattcatacatagtaaatgggaaaaaatatatatcattattcagatttttaacaactcagctgagtgtactatgtcctactgtaagcatgcccatttttctggtgaatattttccctatctccagcttttcaggtgctgtcttcttggtcctgatcaatggaccctgggtacccatagccttccttcaagcttatgagacttggcaaaccactggcctccttctgtgtcaggggctggcactgtcaagtgcatcgtctgattgtgatcctcaggccttggcagcaaatgtacagttttcttgctttaattaggctgagattcattcctacacgtggcagctgcaaagatatattctcttacaattagatgttacaatacttgtattgcctgaaccttaattttaagtacattttggtggcccttgtccctcccttgcaccttggttgctccaagagagagcatatggcccagtaattctttaaagctcattttatgggccattctcaggcacttcctgctggcctttggaacagagccttattcgtgactgcatttttgcttatactcctgccaaatgcttcctccaaaaccagcaatcaaaccacaggacatgataagccatggccatcagaatggcttaatgagagcaacctcaacaatcaaggtcattaacagcaaccagcactgcaggatttgtatcccgtgcacaagggcagcctgggcaggtcacctttgtggtctatgagaatatctccaaatattatagaatttgagaccatctcagagaacgatctcattctaagcaattttcttttaagcaaaaatggataggacaaaaatagaaactggtggttctctctggcctctccttgtagaagaataaatctagagtttttaaaggtcttacagagcaaagaaaatattcgctggatgcttgtatggctacctaattcagtcacccttgcctcagaaaatgatctgaattaaatcttgtttccagctagcagaagggtatttgaaatacagattggatctgtacaatagaccttgttcaaagcatatccacatgagatggtacatagtttaaataaggcagacttatatcttgtctatgatctgtgtgctattaaacagttttaaaacgtgaattattaattaaaacctgtgaactactaacattttggaatgactgttttgatagctaacaggacttgtgtgacttttgagaggcgttgatttcctttcatgtcagctaatagaaatcccattgtaatcataaaaggcacagagaaattatgtcacaagcggatgctatttaagtggaagtgaacacagaatatattaaagtatcagtgttcttatcagcagtgtcttataatgacttctgattaacactgaaaagatgattgatgttcctaggattgtggagcactgacaatgtgacactgagagaattcaatccaaagcttgttaatttcatagaatcattcaatttctcattactcctttttgacagtgtttgtttttgtgaccattacaatatagtcacaatttaatggggcctttcaaaaacaatagtaagaaaaaaaccttaaaattgtcacctatgatgattattactagaaacagaaacaatgatttcaatatattaattttttttgttttaaaataaagcttattaggctgatttttattcaggagtcatatttaaactgatacaagccaaagtcatagaggactcccaagtcaaggcaatagttcacatcaacagcgccaacatatgtaggctgatttagttttttcatggccaaagaagaaaggaagcatatttgatgtaaattcctgtatgagaaacatggtaggcatgccaggtcctaaattagtataaagctaatgactgctgattgagagcaggtggagaacgggaagggggtgtagttgaggatcagtagagtttatcttaatacttttgttattaaatacttttgttattaaaagtatagaaaatataagactttctcaatttacatatcagatctggtgaatctatcttattgaactcatactttacatggattgaaaagcaatgtttacaaaaagaacactgatatgggaagtaatgtagttagcagagataaactgcggatgtttcaaataaaatcatctacctccaaaaattttactggaactagcatgtgatatttaacttgtatttttagattagtgtatctgaactttgtatcagtcagaggaaaatgtatggttggccctaaccactcagaatgtcataatcatagtaattaccactacccagtagtagtaattaccaatattctaggcttcagtcaagacactttaaattcatcattttatttaatccccataacaaccctgctaaacataggtgtgtttattggatcttttatcttcccaaatgaccacccaacgcccccacccaaatcagtttgattgaaaaatttgaaaccagcaccaaaaactttctcatctaacccagcaaaaactctgcagtccatcttttacaagcacatataagttttgttttaatttctctttccttacaaaggccgatccttccatgtgggttctcattatcacccttcaggctttacaaggaccttattttatctgtgtcctgaatcgtcagtctctttccttacttgatcattgatttcagcatagtggcctcaccctccaaaccttttggtattcttcctaaatctcatctcttactcatagccaactctaaagagttctcatgactgtgatctccatgtccttatctgctatctactatccacttctcgattcatattggctttttccccaaactctactgaaacttttcttggcaagatcacatatgaccaacattgttttgtcttttatgttcacgtattattcacctctagctttttacacacaccctctctctcatatctgtggttctctacctctaaatatggagattttcaaggttaactcctagacaactgtccaccaatttgctcgtgccaaaagtttaagagtcaccccatcaggtttacattcatacctatgacttcaaatatggtgtatatgcttataaatcccattcttagccctaagcttgttttcctgccactagatggtgccatttgggggtgatgggagacagtgacagatcatcaggcattaggttatcacaaggagtgtgcaacttggatccctcacatgcgcggttcacaatagggtttgtgttcctatgagaatctaatgccactgctgatctaacagggggcagagctcaggaggtaatgtgattgacagggagtggctgtaaataaaatgaagctttgttcgcttgcctgccactcatctcctgctgcgtggttttgggattggagatccctgttttatagtatttgtaatattgtcgcttagatagctcatggataatacaaatttaatagatccaaaatgaaattcttgaattcctctaaacaataccaataatttgttccaattagaccatagtaaggttgttaaaaaataagcaaaactaaaaaaactacaatgtgtaatctttagaagactttaaaagataaagacagatgtaagtaaagatgggtaatctctactttcacatctcccatccattcctctaagataaccaatgtgtatttttttaaaaattcattctgtaactttatgccaatctaacaggatgcttatattagttttttactgttgttttcttccacagtaggataatggtgtatcaatatttagtgactttttaaagaacatgacactaagaatgttccgagtcaaaccatttagatttgacgtattctttctaattttcaatgacatgactttctatgcatgttccaggtatgattcaacgatgtgcgctgctgtattattagattatttccaatccattttatttgtattttaaatttaaaccaaatgtattgtacgtacatagctcacgatatgctgcttgctactgtgcttgctctgaaaccttgcccattatgcactaacaacactggcttctattcagtacaacaaaacgtccctacattttttatatccagaaatttagtacggttttttcattctggaagcagttctttccctctgccttaccatcattgcatggctgtctctttctcatctgtcagatcagtgctctcttcttatcttttacagggtatcttagggtaaaaagttaaactgatgcgacagagaccccaaaacaaatgcctcaaacaagatagaaatttacttatatgtaatataatgatctaaagttgacgttccagattagctatgtttctgctccagctagtcactcaaatacccgggtgaatggtggctcttttgcattcagcaagtggctttcaagacctcccatatcattggcaatttggcaatttaggtgggtgtggtggtaggtggatcaggaacatcaaaatttgtggagatttcctctcaaacatagtaagtgaaagtttcattcatcatttttgcttgccatatttagctgcaaagaaatctgggaaatgtgatctctggttagacaagcatgtttgataacaagtctattattatgggagaaggaagaatagatcttggtagacaatttcagtctacactcaaggacacttaccacaatttgtaaatgatgtattcattttaaaaacaatcttctggtcttcccattagatagtaagcacaataaaggtaaaatacctgcctgttttattgttttattcacaaataaaccttctcccctgaatactacttctgtcttttagtaggttttctttttttttttttttttttttttttttttttgagaccgattctggctctgtctctcaggctggagtacagtggcgcaatctcggctcattgcaacctctgcctcctgggttcaagcaattctcatgcctcagcctcctgacatagctggaattacaggcgtgtgccaccatgcctggctaatttttgtaattttagtagagatggggttttgccatattggccaagctggtctcaaactcctggccacaagcaacttgcctgactcagcctcccaaagtgctgggattacaggagtgagccaccacacccagattagtaggttaattcattaaataactaattgaatgaatgaaaggattttacaggtaaagaaactgaggctcaaagaagttaaacaatttaggagaatgggtgaccattcttcaggaaggtggaaagatttatacctcagatggcttaacaagatagctagtaagcactctttcaactctgaatttctgtgattctgttatgcaggaaatcaccacattccaaataagatcatgagcctgctttgtaaaggaataaatcaagagaaaattgaaaatacactttttgtctcattggttctgtcacacagaactctttccctcacaccattacatcctaaattctcatagatgccagtcacactttaaaatggcaaccattaatctaagatgttggaagactgcagcaaacttgtgacatacctttctaaaatcacaccttccttggacagacaaagtaaatatgtgttgggcttcacagatttcctgctaggctacactgtctggaagaataaaagcaaacagatagtgagtattgtctttatcacatactgtgtttaattaaaaagaaagaaagaaacacaagattttgcaagataataataagtgcagttaaattgattgtcaactaagtcttctggtcagcaaagtatgagattaattccccttaataataaaaacattcttgagattcttctttaaaatatttattctgcaaagtaactaattataaatctgcttttctttgttttccaagatattgaagactttgaaactaaaacaagaagcacagtatctgtccgagaaggtcaaggtgtggtgcttctctgtggcccaccgccacattttggaggtatgatggggtgatttgggtcatatcatcaatgcggtcacttggagagtgatgtgagcacatcaggtcttaggctcagtgatcaccttttatcaaatcaaagaaattgtgactctcgtcaagtgcatctactgcatacaaatagttctatatctaaacattttcttttaaaaatattcgttcaagcagccacacagcaaatatgtttttaaggagatacatcatggcattgtacgtagtgtgagtgccagggctttttagagaaactgaccgcagctgtaattcggtgctgtgacaggcaaacttcatgacaaggggacaatttatttaccccactttgaggcttggttttctcatctataaaatagagacattaactgtttgtttgtttgtttgttcagttttgttgtaaatgttaaatgagctaataaatgtaaattgagtagtgtaataactaatactttagtaagtaaagaaagttaagattgttactacgtttttatttttgggctctatggagaagcaaattccaactaacactcctcttggcaatgtcacattaattaccggaagggatagatcaccattaactggaagcaaattctgtatagcaccaaatcagaatgtctcctggcaatggtaaaaatcaagcaataaatgccagcctctactttggaagactctggcttggtcagtggactggcccgttgtcagggatccaaactacttactgattctcatcctcttgggaatggattttctcaaatttcacatgatgtggtaaatttagtcgtgattctcaactcacagtgaacctgaaggaggcagtgtgaaaacatccatggagtcatttggtacaaaccaatatcacactatattatagaaagcttaataacagcaaggacttacacagcacagacccaaggactttaacatgtattagattcttaaattttcacaaaaacttataagagatatatgagtataattattgttttacaggctcagtacactatagagaaatagaaagatgttaattaactggtccaaggtcacgcagctggcaggcaatgaagccaatattcaaatccaggaagtctggttcccagaccctcagctcttaactatcactgcagttgttataattgatttccactctggaatgggagaacttttaaaatacaaaggacagatgtttaaaaataaaatttaagcaatttacttttaatgttaaaccaaatcttatttatgagccttgagaaacttgaaagcgtttttccattattatttttacacaacctcatgaattgccatgaccaaaagaaaagaaagctaattcaaagttaacaatatcttattcggtattattagagagtattatggcattatattcacctgatatgatagggaagagttgcaatgcttttaatgctatattgagataaaataatattgtttcagaacacacaataattgctgaggctcttttggtgcttattttttaacggtatagaagattattttccggcaccataatctaagatgacaaaatatgcaaaatggtatcagtttgtcctgtcagtctatgtcattttatgctcttacgatgttattcaaatattcttgacactactgaaaattgttttcaactttgtttaatcgggaataaaagaaatgtaaaatatttgtaaatgaatcagttccatatgtaaaaaaatttaaaaaattaaaaggcagccagacaggagacgcttgtccttgttaccttgtcacctatcaccattaaaggatatgtggatcttttagtgtgtgaggccctcattgtaacagcgcccgtggggtcgatgccataaaattaagtcacacatttacaaaaactgccttaaattaagacctttgtaactgaataatcttgctgcatgggagtaatggcaaacttgtgtaataccaatttttttttttttttttttttttgtgatagcatctcgctctgtctcccaggctggagtgcagtggctcgatcttggctcactgcaacctctgcctcctgggttcaagcgattctcctacctcagcctactgagtagctgggattacatttgcacacaaccacacccagctaatttctgtatttttagtagagacgggttttcgccatgttggccaggctggtctcaaactcctaacctcaggtgatctgcccacctcggcctcccaaagtgctgggattacaggcatgagtcaccgcacctggtccgagatttaatttatgttacaagtagcatctcatcatgattccaagcatatttgtcggctgaatcatgtttcttgctgttaaggtccctgtttccttgataactggctgttaagggacactctcaacttgtagaggctgctgaatttcttgccatgagcatttgtccaatgtcaaagccaggaacagagaatctgtctcacatttagtccctcgaacatttcaaatttctttagtcaggaagagccccatctcttgtgagggctcacctgatacagatcatgcccacaaaagctgaagtcagtttctttaaatcaacctgtgccatctaatcttatctaatcatggatatgatctctcatcctgctacaagtcgcactcacactcagatgaagagaattatacaagggcacgggtcgttgaaggtcatcttgggattttgccctacaatatgtttctcaaatattatttcttctatttccaatctccctaaaggctccatatttcctaccacacatggctctcacagagaaacgtcctagaaatatattcatgggggcagacggagttaacagagcactgtaaagtaaatgtcggcgtggccaaattattttttaaatctcgtgtgtaagtattaaacaaagcttctcataaagaaaagtagcacagactccacagagatagaaggccataaaagttgacttttttttttttttttttgagacggagtctccttctgttgcctaagctggagtgcagtggccccatctctgctcaccactacctccgcctcccagattcaagggattctcctgcctcagcttcccgagtagctggaaccacaggcacgtgccaccatgaacacctaatttttgtatttttagtagaggcggggtttcacttctgacctcgtgatctgcccgcctcggcctcccaaagtgctgggattacaggcgtgagccatcgggcgcagcaaaggctgaaattttacatcaaatttttgataacttagttctgttgtctttttcaacataaacagtcagcaagaatgagtctcacagggagttcggcagcaagggagaaatcatgttaaacttgatattatcagaatatcctgaattctttatgctttctttttagtgtattcacataaattatacaaaacttttttttaataaggcaggcctatcaaatatattttagtgtgatatatataggtatacacacacacacacacacacacacacataactttataggagagtaagaaaaagtatcgacatggctaaattttataaatttacccagcaaagaatggctccatgttttaaaaacaaaacagaaaagtgtctagatggtttttccatgtaaatgattggtcacaaccccatgaaacagagtaatcaacagaaaccaaataaacaggtacttttatagagctgtcctttcttctgcgtaaacgaaaggagggctgactccagcataggccttctgtggatgctttccacccagttttgaagcacagatgcaaatgtcctgctcctctagaaaggaagggttttacacggaaaggttattctagcagagaaggcatcacagtgcaaaagaaaaataacctaagcaataatgccaggacacagttcaagacgctctattttatcatttcaaaatgtggaagcagaataggcaccattctctgtaatctgagtggaggagtatatttctcttttaatcctattccccaatcagagatgggttttgtgattgtaactgaatctctgtccttaggactagactcagtccttgttcccatatttccaaaaaatcttatctgtaaaatatttccgagaaatgtaggtttcacgaagttttgtaaggacagcacagagaggactgcaatgcacatctgattacaaaacttcactaagattcctgttaaacgtctccttcattcctcctaaacgctctctcactggtaggctgtgacttcccacatctttccaacaatctccaacaattccctcgagtatctattataattcttccctatttggacacctatctcagaagaattcagtactcctttagcttctcagtgcttggcagaacgaaatttactagttggccaaacaaaaatattttatttctttcactatgtccctgcagggttctaaggtcatccctcagttcatgcaacagaaagagacaacacaaaactctttttttttgagagggagtctcgccctgttgcccaggctggagtgcagaggtgccatattggctcactgcaatctccacctccctggttcaagcgattctcctgcctcagcctcctgtgtagctgggactacaggtgcatgccaccacacccagctaattttttatatttttagtagagacagggtgggtctccaactcctggcctcatgtgatccgcctgcctcggcttcccaaagtcctgggatcaccggtgtgagccactgctcccagcccacaaaacttatttagtatttattttatttatttttggggagcaggatgttaccgtgcctttggctgaactttgagctgtatgcagagaggtctttccaccatggattctcactcacctccaaagtgagcttttgttaaatttcagtcactcgtcacaaaaaatgtcggcacaaactatctgcaacagagctgaaggcagaatttcctttaaattttggaacagatataacgcccttgaaaccaaaactgaagaaggaatatgaaaacaagcaatcaataaacttccatggacccagtgagttagtccagcctcataggaaatcttatttaaaaatgacagaatgaagcaacgatacatgttatctacaataattaaacccccccttcactatgtagtaatagtttcactttatccaaagtaaagaacactctttcccttcattggttggatatgaaactctcggcggggctcagtggctcacacctgtaatcccagcactttgggaggccaaggtgggcagatcacctgaggtcaggagttcgagaccagcctggccaacatggtgaaaccccgtctgtcctaaaaatacaaaaattagccgggtgtggtggcaggcgcctgtaatcccagctactctggggctgaggcaggagaatcacttgactctgggaggcggaggttgcagtgagccaagatcatgcctttgcactccagcctgggggacaagagtgagatttcatctcaaaaagcaaacaaacaaacaaacaaaaaagaaactaagtcccgagctcataaaaattataggtttaaaatttgatttagaggaaatgttccattctctcctcagatgcaactttcaggttggtagaacagttgaattgatgccaaaagtttggatcatctgtgtctgtagcaggaagatagcacgactgtctgagcccactgtttgtatttgcatcagtaaagatgttgacaattccacttaaattaaaagtcattccaagcaaaggctcacaattgtgttatcaaataaagaggaaaattatgtagagaaaaaagtgctaaaacttaacatccccttcctccagttggtgtgcttgctgtttctggcgtaaatgaaagtgcttttgtcttagtgggtaggtcaaattggcagtggatatgttactctgaggctctctgaaagtgtaaaaggcagacaggcccaatagttgcctcttggtataataataatagtaacgataataaccgtattattgaacttgtacactgggtattcactcaacaaatatttattatgtagttactaagtgccactcgtttttctgcattttagtgataaagtggaaaagagagacaaagtttttagctccatgaatcttataataaagaaatataaagcatgacaggtggtaataaaagccagaagaaaaataaaaggagataggaaatagtagatgttgctattgtatattctaaggtaaaagaaggtttcactgctatttgagcagagaactaaagaagtgagggagtgagacacattaagtaaaggcagttcaggtggaggaaatagcatgtcaaagaacctgtggggaaaccacgtctagcatgttgggagaacggcactgaggtcagcataggtgaattaaaatgaacagacaggagagtaaatgaggacacacagccttactttcagacattttagggactttgccttctcctgggagtaagatgaaaattcactggtttatattcagaagagtgacatgctttctctgactttcatttgtaaaaatttactctggatagtagaccacagaggggcaagaacataagcagttaaaaagtgattgtgttaattcaggtgagagagaatggtgacttggaccaggtggattgctgtagacagatagataattaccagtcttcagtatgtatttataaggtataagtaaaataatttcctgaaagattgaatgtgggttataagagaaggagaaaagtaaaagataactccaaggatttgggaccgagcaactggaaaatggagtatcatttattggggtggagttgatgaagggatagcaggtttaaggatggagtaaatcaggaatttgttttaggagatgttaatgttcagatgccagttagatacaagggtgaaagtttctagcaggcagctggattatatgtttagggcaaaagctctggtttgaagagctaaatttggaactcaccttatataagtaatatttaatactacataattggataagataatgaatacttactatgtactaggcactaaacttagcatttgcaatacttcaacgcatttaacattttccgggaagatatctcaattttacaaattgagtattgtgttaaaattgttagtgttagctaacaactatagttaactaaactcaactaactataacatagcttggccaagatcttgtctctggaattcgaaagatcctgtctaaacatcagtgcatttattccactccctaattttctctggcataatctggtccagaagagacacttaaaagtttttaaataatacaaggagataacaagagttctttactctactggagactatgtaaacaacacacagagaggtctactgatttgcctaaaattagtgtacagtgttagaaccaggaagctcatggctcttcccactcttcatagctggccaaagtcagctctctagaaagtttatttctttaagtcccatgctgcacattccttccctccactttcagactccattcactcttagaaagactattttccttgctttccagcacatcaaacagaactctcctgttgcagcctgttaccatgtgtagaagtcaggattttccaacactggtacactttgtggcagtagggccagatgttggggagataggaagtaattctttttttctctttttattatcatactttaagttctgggccacatgtgaagaaagtgcaggtttgttacataggtgtacacgtgccatggtggtttgctgcacccatcaaccggccatctacattaggtttttctcctaatgctatccctcccttagccccccaacccccagtaggccccagtgtgtgatgggcccctccctgtgtccatgtgttctcattgttcaactctcacttatgagtgaaaacctgcggtgtttggttttctgttcttgtgttagtttgctgaaaatgatggtttcgagcttcatccatgtccctgcaaaggacatgaactcatccttttttatggctgcatagtattccatggtgtatatgtgccacattttaaagaaaatgtgacagtctatcattgatagatagatagacataatatccagtctatcattgatgggcatttgtggtggttccaagtctttgctatttcaatattaaccttaaatgtaaacaggctaaatgtcccaattaaaagacacagactggcaaattggataaagagtcaaggctcctccgtgtgctgtattcagtatctcacatggagacccatctcacatgcaaagacacataggagacccacctcatgtgcaaagacacacataggctcaaaataaagggaaggaggaatatttaccaagcaaaaggaaagcagaaaaaagcaggggttgcaatcctagtcactgataaaacagactttaaaccaacaaagatcaaaagagacaaagaaggtcattacataatggtaaagggatcaatgcaacaggaagagctaactatcctaaatatatatgcacccaatacaggagcacccagattcataaagcacgttcttagagtcttacaaagaaacttagactcccacacaataatagtgggagactttaacaccccactgtcaatattagatcaacaagacagaaaattaacaacgatattcaggacttgaactcagctctgcaccaagcagatctaatagacatctacgggagtaattctttattggaagaactgctctgcacgttgttaagatgtttagtaatatccctggcttttacttactagatgccaatcgcactgcctcctccaattgtgggaaaatttgtctccagatattgccagataacttctagagggcaaaactatccttagttgaaaaccactggtacagcccatctcttacattcactgtattaagttcacccataaaagatggaaattgggaagaaaaagagaagtctagtcctcatatatttgtatcctatgacttgcttggtctccctaagaattggaggtttcctagcaattcactcagaagctggctatgagataagagtcggtaggactggctttgcaaagtacaagtcaaaaagagcccactgacaaaataagatgtggtaaagaagccagccaaaacccaccaaaaccaagatggtgaaaaaagctatctctaatcatccacactgctcattatatgctaattataatgcattaaggtgctaaaagacactcccaccagcgccatgacagtttacaaatgccatggcaacttctagaagctacccaatatggtctaaaagtgtgaggaaccttcagtcctgggaattctcctcctctttcccagaaaactaatgaatgttcctccccatgtttagcatatgagcaaggaataaccacgaaaatagccagctctgaagtagccactgttacttattcctctactttcctcataaacttgctttcactttacagtgttggctcggtcttgaatcccttcctgtgagaagccagtaactcatgtggcctcccaggctgaaccccagttttggggtttgccttgagacagctgtgttttcgttccttctccaagtaggtttggccaatgtacaaccagttctatagttatttggaacttagcaatattaggaacccatgagacctttatttaactgtcattcataggccgtaaagaaccaccatctccttgattccaaacagtagatgtgtaaatcagaagggatccaataaaatccaggtgatcaagcagtaattgtggaacgaatgggaattcaaataggagtggattttaaagtgttaggcacgtttctggattacatcgtaaacttcctcagcctaatatcaatgacttcagtccagaaaaggaattattcttcttggattaggtttttgccactgagctagcataaccatgattgaccacccaagagtcagtcacatttaaccctggagcactacacaaggtttgcagtaaagtacacacattctggaatattccaaaggggggatttacccagtaaatctgaacactatacttcaagttctttattctactcatttattttctgcctcaggaaacatgctatcaattttgagatctgttctaaagtgccaatagaagttgtcagtatcaatgtttatcatgatgcttctctttcacatgagatatttttcctctaataaaaattacatgctatataatgggtataattgcatatatctttcttgtttgtattttaaatattacagtacaagatatagggctgtaaaagatgtcaaaacataatcacactctggggaaaagaggatttgttgtatgcttgagagagcagcagatagagtcttcaattgcttactgcagatctgccatttctaataataataaaattgtagaggacgaagtcattgtgaaactacaaaaaaatgcttcaggaaggaccaattatcattcagctctaatgctactgctgactcatcacagggaaaatgcatcacaaccgttaataaccgataaatgtcatagatggtggagaaaatatttaaaaattcaatggtttcaacctaaatggctcatgaattatacatttaattaagaaaagccaaatgggaaggtttttaaacttccagtttggaaggttttttttttctttccccattgaaagatacacagattaagcacagcagtggctgatgctggaacaaaatagataaaagcccccagtgcaggctggctcttcagatgactgggaggagccagcccatggggagaagggagcagggcagggtgagaaatactatgacagcaaagacttgcagctttacatcttcaccaattcagagggcacaaaagggcacctggattgtactcccagagctgctgctagctctattcccctctgcttcttcacttgtaaaaatgaagtggttgggctggcaagtctcgcaaatccttgccatcccagacgttttatgaatgtataaactaagagacagccttttctccagactccaacacaccactcaaacgcaaatatacaaggtggtccaccattcaaaatccaggcgtttcccttcccagtgtgatgatgcagaggagactgagttttatcttttgttttgttttgtttttttgggttttttttttttttttgagacagagtctcgctctgtggcccaggctggagggcaggggcgcgatctcagctcactgcaaactccaactcccgggttcccgccattctcctgcctcagtctccccagcagctgggactacaggtgcccaacaccacgcccagctaatgttttgtgtttttggtagagacggggtttcaccgtgttagccaggatggtctcgatctcctgacctcgtgatccgcccgcctcggcctcccaaagtgctgggattgcaggcgtgagccaatgcgcccggcgagttttatcatttttatcaatgatttccaaagggtagctccagaccccccagtgtcattgtcacctaggagcttgttagcaatgcagatttcctggctcctccccagacttactgaatcacagagtctgagggtggagcccagcggcttgtggtttagcaagtctaccaaggggttctgatgcatggtgaagttttagaacctctgcttcagagaggcccatttaagagggaaaattcaagtttttatatctgttctactccctgctaatattagcaataagtactttacagtaatttcacatggcagtttaacttatttatctatgaagttcttaagaaattggacgcaggacaggaaatgttaatgggggagggaatggacagtgaggaacatttgtcttagaatgtgagtaaggttggttacttgtggagcttgggagttttgaaggaaggctaaaggtgaggaggacgagctaaggagaggacatgaacatagaaaaagaggatcaattgtaaagacattgaaaagtagaaagctattgttatgggaaaggggttcagatccggactccatgagagggttcttggatcttgtacaagaaagaattcagggcgtgcccatagattaaaatgaaagcaagtttattaggaaagtaaaggaataacagaatggctactccatagacatagcagccctgagggctgctggttttccatttttatggttatttcttaattatgtgcaaaataatcattatatacctcctggttttagaccatatagggtaactttctgatgctaccatggcatttataaattgtcgtggcgctaatgggagtgtagcagtgaggacagccagaggtcactctcattgttatcttggtgttggtgggttttagctggcttctttactgaatctgttttatcagtaaggtctttacgatctgtatcttgtgctgacctcctatctcatcctgtgacttaaaatgccttaactttctgcaaatacagcccagtaggtttcagcctcattttacacagcccgtattcaagatggagttgctctggttcaaaggcctctgacagtattattagggaaagagcaaagatctggcatctgaaggatctaggttcaagccctgctcctcccacatgttatgaatacaattttgggaaattacctttatactgttagttcttgcacccttagcctcataaagcagttgctggcatgatgaaataagtttttttctgaatttattattaatctttatgtaatcttccctatttctggattagattcttccagcagcttctaaatatctcactattaaagaaggacacaccacatgtaggaatagattggcaagttctagcagctaaggtaaaaatgaattcaccaggggagagaggaaaattacagtctcaggtcccaagattacaggttgaagaatacaaagatttcttgggcactagtggcaaactgtaatttttgttaagtgaaaggggtgacattggatttcagagagctaaagcgtatttctctccacaaataggcattgaataaggatccgtaagctgagacatggccctgggaatttgctcaagattgtctttgtttcacaaaaaggttcaaaagatgaggagtcaatgacaacaggggaatctgaactacattctttccttcctctttatattgaagaaaaatttactctctagatgactctgatttcaaacaaaaacctttgagcatctctttggtggagacagcaacaggcttagaagtgaggcagcaaaggacgtcagtaaagaaactgaagcaagagaccacatggtatgatgaaagactccaatagagacttgcaaaagaaaataaagactcaatacatgagaacagcacgagcatctcaaagcatttttcaaaaattaaaagcaaattgcatttatgcatacttgatccaaaagtatagactcttagggagatcaaaggaatgttgaggctgaaggaaaccattcgtagaagcttaggtttaacccccatccatcgtcaaaacaatttttttttgctacatcccgagtagtgttcatccatactctgcttgatcatgtctaatgataaagaactcactacctagtagatcatccactgctatccttctcaaatttagactgttcttcattatattaaatctaacagcattctgtcacctccagcagccacgagtcctacttttgccttctggacattgatagagagggttttatttaactttttatgcgtgtggcagctcttcaatgtaaacagacagctgtaatatgcttccagaatctttttttccagaggcaaaatcaaagttttatcactatgttttgtgactggcttttgctacattttattttttatctcttgataaacttgatatttttaattcctctttcaataatgggtgctccgaacaaaatatttcagtcaattgcatgcgtcatttggagggtgtcgaaaacacagatcccatgatacctggctcagatagaataaataaaactaaattgctaagaattgagttagctatttgtattttaacaagcttctttagtgattctaatgtacatcaggtgtgggaatcagtgcctgcataaaacataaaacatccatttgaacggttcagagtaagaataagaaatgttatccaccctgtttttacaagttgcagctcattctagtgtttagcctttctgacactcttcttatcctgttgattctttcttccatttacacaaaaaatgcatagcaatttaaaattataatacgacagaaacacattacaaagagagtaaaagccttttgtatttccctccactcactctgagaaaaccactgtatacatctccaggtttttaaatgtaagaatttgcataaacatatcacacacacacacacacaaagttcccacactcataacatgctttttacctaacaatgctgcttaggttttttttcccacatgacactacttttatggtttaatgacactttttgcattttctcacttcatgcgcaagtagcatttactgtgctcctgctgttcctggtctcatctttactttatttcttctccattcctgggaacgatatcagggttctgtctgcagagacaaatttctttttactgacatcatttataaattgttgtgagaaattaattattttgctcctccccactattaatagattaactttttccttctttctctttccttccttccacattttctttctccttttttcctttatttcttccttcctaaaatctcattcctttaagtatggttcatgcttcatgcattttttttttctcgatggaagggatgacaaaatgacaatattccctcattcccattttcaagagtttgtctctatagatcagatttaagtccaaaatagctgtcagtttgttttgccaccttttacttttgggaatttaaatttagtaaggttagtgaagaatgtttcaggtggtctcttcccagctgaggaagcctaccggaacatatcagaaataattagcttcttttgtctctgccatgtcttgcttccgtgccagtttttaatgtaagtacagttggcaaatagcaactcagctctctgtttggacaagaggctccaagatgcataaactactcccctgtgaactataattcaaaagtgtatgagggtccatccaactgaagactttttttgagttagttgcagtatattccccttctccaccctgagtacctatatactccacctattttggggatctcctttggaccagctatattcttctacttccctagacatagttctactctacctagtttccgcagtacacctaatgtcttagcttcaggaagaattatattcaccaagctttaatacatatgaatatttgcttttgctcaaagatttctggctaaaacgaaagaaattgacagcacatgatttttgtgaggttatgggacaactggaactctcaaatattgctggtggaagtataaactgatacaaccactttaaaaaattcttttgtcatttcttataaagttacacttacatctacattatggcttactcctaggaatctaaccaagaaaaataaaaatgtatacagacagtcttagacaaggatgcttatttccacctaatacataatgacctcaatctggaaataatccaaatgctcatcaacaggaaggtgtccaatcaaattatggtatattcataaaatgaaatactatccacaatataatggaagaaagggcttatagtcatgaaaacaataggtgaaccttaaaattatgttaaatgaaagaattcagacataaaatagtacattctgtttgttttatgatgacatacaaatgacagcagaaataatctatgatgatagaaatccagtagtggttgcagcagtagaaaaaaacaggggaggatttctgaagacctggaaatcttcctcattttacttggggaaggatggttacagggggtatataatggtcacaagtgattaaacggaacacaagttctgtgcattttaacatatgctcattatgtcatttatacagttacccacaagatttccagagatggactgattgatgttcagtaaaaacaatgtgtgccctgtttcatgtttatgctcttgatagttactcggagaaatgcttgtcgactcctccgtcacttggatagctctagtttatcgtgccggtttcaaaatggaattccttcttagaagtcttttctgatgacacatcattctaggctccttctctgggctccctataatgcctttgtcaaagcatatgttatccttcattgagattactcacattattggcaattagcagtaactggtgtgacctttatagggcacaggttttgtttggttttacactaagacctaaaactgtcacagaatagctgcttaaaattatgtaataatcaggccagtgcagtggctcatgcctgtaatcctagcactttgggaggctaaggcaggagaatgacttgagctcaggagttggagaccagctggggcaacatagtgagaccccatctctttaaaaataaaaaagaaattatgtaatgatcaaatgagtgaacttcaaggtctgtggtagacttcttgaactgaaatttttaagttaaatttttaacaagtacctgtaagtatgtttaattcttctgataatgcactgagaaacactgctttgaagcagcataagtttttcctaaggaattcagtgtacatttggaacagttattattttatacgtcttatggtatttcttaataaactcatccacttatttccataacatcctattgttatatccttaatcccaaaaagtcaatgatggggaaagtgcccacataatttatcgtccaatctgagctatatttcaatataagggaatattacaattacaccagatgacagctatcaactgagcaaatagaggcacaattttctcctaattatggggaagtaagacaaagaattttcagatatgaatgaatgcagtaaggacagtatggttttgttttgttttgttttgtttcttgtttttcagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtaagataatgagttatcttgggaatgtactttatctttggcccttaaagcctgggaagattcgtaaagctttctgcttccttcttgtttggtggagccaaattacgagtttaggttcaattcacaaatatgtaaaccagaaatataacagaaaattatctaattcacccacatggtgcagtagacatggttctgggtataccaagccatctcctttctggcattgaaacagcttgtcttttttttgcttaaagactgttttgtaaaaacaaaaacgatgttccggggagttggcgtgtgtgtatgtgtgcacgtgtgggtgctgccaaacatataactgaatcaatatatttttaatgaacatatgttgcagctactttttaatggccccttttttccatatttgccctttttttgttgttcaccctttatttacgtggctggcaaaatggagggaaaagttcatatccaaggaaagcaaagcaaaccaacattaattatgagcattccagagaagaatgaaacacaagatttatactaattatattcctccaaggaacataattcacactagtctctgacgagctttgtagcttagtcaagtcatggctggtacaagatttagagagccagaaagtttaaggaagtcattgaagtggagaaattctctagttgtttttttaattaaatgttcacagtgggattcatacaggtagaaaatttgttggtgcattttatgattgtattcaggacttgaaatgcaatacctcgtggagtttttctcccctctgaagagttgaagaaaagcaagaatataatgctaatgaagcataacagaattgtggaacaagtcccatagaaggagttcttataatagagcttttataatcactaaccacccaaatgtatttgcaaggtcttcactaagatttcagcaaccattagacttattcctaagtccaatttatctccttcaatgaatactactatttatgaccagaagaattcatgagccaacaatatacttggagattctaccatgtttttcctttttttgtttcctgtctactctgagtttctgcttcttgccttcttaattccttccttcttctatcccctctattcccttgaatacatttacaggaaaaatagagcagaagtattatatataatataaaaatcaaacctattttaaaagtgagcaggtaggaaatatcagatgtcaagaaagtgaaaaagaataaaacctaccaacttagttgaatgaagtagtactcactaccttctcaccataacctctttgaatgtttataatgatcaagtcttaaaaattaagtatttttatttcatatatattttgtaatttttactttttctgcaattatattgaccaccaacaatgtatttattttagaaatgtattactctgtcgtttggtacatagattaaaaatgatcaaagtatttaaataatcttgagatgtcactgattaaattaattaagttaatgagaatagcctacagatatatttctgttacaactcctctggtaggcagtgtatttacaataggttataccatcatcttatcttggcacatatccccaattccttggattgaaagttttaaaacttaaaacaaattcgtataggtatacagcaaacttagcggcaaaaccttattgtactaatatgtgaatatttacatttttatctcaattaatgtgatgcctttatatgttctgctgcagaactactgttattttggactaagacctactgcagtggacttctaccagtgttagctgaaaacatcccgttgttgttgtttttttctttttttttttttttattaatcagatctggctctctgagttccctgaaaggtagataaatgtggatgtcactagaaaagtgtcttttttgaaaacacagaagcattttagaatctatatgtatccaattcttaactgaaaaccctaactcttattaagaagaaataatcaggttttggttaatgaagcatttacttcatagaaaacttctattctccagaaatgctgctagctcttttgatatttaacaggtgtgatgggggaatatgaaccaaagattgaagtgcgttttcctgaaactatacaagctgcaaaggattcatctgtaaaactggaatgttttgcccttggaaagtaaggtttttgtttttgtttttgttttcctggttgcattaatttttttttattaaaaacctttttgttattcatatattgctctaaggtaaattaccaagtagatttcaaatgctgggcaacagtggaactttctgatttgaatttaaacaaacatgtctaatactgagacaatgaccaggcctgtaactgaaaatgatcagggctgcaattcttccctacaggtgctgatatttccttagtttaagcataatgagacccatttaggcagcacattgcaagggaataagtgcactcgtataagatgatgggcaagtcactaaaccttccacatatccttcactccatcttgtcctacatccagaaatacattgcctggagtatttccttgcttaattaaccaacaattctgataaataaaaaaccactgcttgtttccaaaataagactaattaaagtccattgttcatagtgggtaattagaattgagcccaaccttccctgatagtggaggcattttgttttactcagataagtatttattaggaacaggtttggaatacttttaagccaggaaaatacctacatttttgcatgggatatctagaacccctctttgctttttggaggtatacaaatttcatttttgtgcctataaacaccagaaaaaaagaaggagacagatagactagactgtcattttcaaatgttaatatgcatgtgagttacctggggacatggttaaattcatattctgactctagaggtctagggtgatgtttgattcctccatttctaaaaagctcccatatattagtcatgcttcttgtaaacagaacatactttgaatagtaaaagacttgactgactcagaggtaagctcggagggcttacctctaaatccaaagtctattcctaatgtggccctcacatttagaaatagtgacttagtctccaaattctagaaaacatccttaaatgtctcagtcatattattaagttaaacatactcagcaatccaaataatggtggttactaaatcttagtttgttttctatagatggagttttgcatatctttgaatgaaatttctcagaatagtcatttctcatggatttaagagaccgtattttattttcatagagtatgggtctcatagcatttatcaaataaataattattgattgattaaatgattcttaagaaagtgacaaataggggctttacatcagtttttaattgtctgccttttaagacataatgaactttcaccattttcaggctttttcagaagttaaggtttataaaaatattaaatgtcatcaaattctttgataattagataattaattttaaaagaaaaccaatgaaagagagtatctgaaaagaatattaatagcttatttaatcatatttggcatcaggaaatatagattcctgaaattaaaaaatggtcttccacaataaaataattgaaaatgttgaggctatttctcaagaatctaatgaaaataatttcatttgctaagcacctataactaagcatttatgatacaatatatataattgtcataatcttgcagggcaagttacgttttcattacatatgagaaactgaagctcagattggagaagtaacctgttcaatcttatgtttctattcagaggaagcaagcaattcaaacccaggcccacctgattttaaattctgaatttaggaacttctaagtaaatagtaagagaactgcttttgaaatcctgggagacagattcaattcccaattttctgaagagttatttgattgttagcaaacgtgcttataatctctatgaattaccatattttcatctgaaaggagttatgatgattccaccttgtatgtttgttgtgaagattagaatggataatacatgttaaaacattaagacttggcatttatgtaataaatgctcactgaattattctaaaaccaaaatccaaatttcattctacttttttttttgagacggagtcttgctctgttgctcaggctggagtgcagtggcttgatctcagctcactgcaagctctgccacccgggttcccgccattctcctgcctcagcctcccaagtagctgggactacaggtgcccgccaccacgctaagctaattgtaatttttttttggtatttttagtagagatggggtttcagcacgttagccaggatggtctcgatctgctgacctcgtgatccgcccgactcagccttcctaagtgctgggatgacaggcgtgagccactgcgccgaccgcattctgcttttatataagcaatgtttgaattagtgaggatgcccaagggagagtaggtgtctcagagggggtatgaattctcatctttcccagcccagtcctgttctctctgtctcaggattgatgacagtataagagagaaaggagcaattagggtcagttcaggaaggaaggaaggaaggaaggaaggaaggaaggaaggaaggaaaaagaaaagaaagagaaagaaagaaagaaagataaagaaagagagagaaagaaagagaaagaaaaagaaagaaagaaagaaagaaagaaagaaagaaagaaagaaagaaagagagaaagaaaggaagaaaaggagagataacatgatcaatatagtctttgaactgctcacataccagtttcttaaatttatttatttttatattattcaaacctatagaaaagttgaaagagtaacacacggacatcatatactctatctgaattgaccaagtgtaaacctgtgctacattccctttctctctctctctccccctctctctctttctttctccacacacaaatatatttaaccagatacatggtaagatctaatcaggaaaaatgaagcttgggatatatgaggtatgtggaataatttaaaaataaataaagcagtgtcttattttctattaactccatggtgatggaaataatcaacgtattattaaattgcaaaaggtaaaatttataatacaggagtccctaaacttttttttttttttttttttttttttttttgagacggagtctaactctgtcgcccaggctggagtgcaatggcacgatctcggctcactgcaacctccgcgtccccggttcaagtgattctcctgcctcagcctccagagtagctggaattacaggcacctgccaccacacccagctaatttttgtatttatagtagaggcggagtttcactgtgttggccaggcttgtctctaactcctgacctcctgctccacccatcttggcctcccaaagtgctggtattacaagcgtgagccactgtgcccggctcctaaacttttgacaaaaattaaactagcaatatttgacccagaaaaatttgagttggaaaattaatagtttaaaaaactctcaaaatgtaaaatctgatgtgtatgtacaaaagaaaccccctgataaataaatcatgttggttaagtttatgcaggaaataaccgttgaacatgaaataatgttaaatgggaataggaaaataatataaattaccaaaccatacctcatagaaaattgtcaaggaaattcttgatttaatagagtacactccctaaattgttatctaacaaaattaatcaatgttgagattatgtttattaaatgaaggcattaatatagaattgaaataccttgtggtaaaaatggaaagtctgaagcatctgctcggtcaaagcggtagcgttaagatgccctgtataacaatcttacattttgtgtagttggagtgcagatacatttctcatttcttcaaaacaacgaaatgtatgtgaaaatactttgactactttggaaaacttacaaatgtgagttactaccaaaaagaattttatatatgcttgccaatagttttcagaaaacaaattaaattatctttgacacattgcaaacatactgaaaatgcctttgagtccattataaattaaggtatttagcaaatgccatattgtcttctaaatatataaaattaacaagcataaaaggcgacacactcactagaagattaattatgttataggtatataattaacaatctgaaaataaaaagtcaaacgtcttatcttcaaaattataaatctgtatttgtaagtttgttgccaagtgtttttataaagtctattgtttattataaatcatattctctaacatctcttcataaaaatattgctgtgcagcatttggttttagtcatttttttccccaaatgtggggactcccttttactaatccttctaaatcttcctgtctactttgtgatgtactttactcttttgtaagatgttgcataacctcaaaactgagaaaagctagttgacttgaggaataaaatcaaatatttttttcttattacattactattcattgactgctatttaagctatagactacacatttattagactaagatgtatatattttaatagatgggggaaagagagagagaagagggaggaaggaaatcaataggtgggtagaaggaaaaagaaatgaaaatatagaaagaccagctccagtgccagatcttattacattttttatttttaggtcataagagagcttctgatataaaaattggcttttgttaaatgtttgtttaatgtaccccatacatgtgctcacataactaggaaatatcaccccctatcactgggaatattttttctcttgaggttgtagattatttttgttatttatttatcttgctttgttttctctgaaattcctgagtctatggtttggtgtttgtcattatttttgaaaactattcaggcatgattacttcaaacatttatttgtttgtttttttctccttttagtatttgttttacattatcttttatgccatttgtaatctcccttctgtccaagttcttaatctttttaaaatttttatttttatctttgcatctcagtttgggaggttctattgatactgcttgtcattcatttacttccccccttagctatgttcagtctactggtgagcccatcaaagccatccctcatttgtgttataacttattttatttccagcatttccttttgatcctttcttagagttttcttctctgtgcttacattatccatttgttcttgtatgctgttcacttttttattatagcacttaatatattaattatagtaattcaaaattacagtctgataactgttcaattttaaatcctcagcctgatagtcctaaaagtttcattgtatttgagtctagttatcatggttgttttgtctcttcagactgttttttagcaggctttgcacttttttttgaatcctggtcattattatatcagattaaaggaacttcaataactaaacttttagcgtgaggttttatgtttttctagctagggttagactgtaattactgttggctctagctgtggtatcagaggttaaattttagctagtacctttgcttttatctccactcttgcccttgggtttccctagagactctttcctaaatagcatctaaagcttgccgttatttcagctgtaattctctgcactgtaattatataggagccctaaataagtcctcgcttgctaattctatcatctcagttatttgtgggtctgtttctattggctgctttttctcctagtcacagttctcatttttttgcttgtttggatatctagtaatttaagattgaatagtagacaccataaatgtcttgttgttgaatgctaaattgtggtgtatttattaaaaagctttttgaactttattttgataggcagttgttatactactgtgaatcctcgagttttctgtggttattaaggctggtttactactaaaatgaaatccccaactgaatgcttcaaatgttcaccaagtttttcttctctggcatagtggagctctcatgtcttccaggcctatttgagctctgaaaattattctttgcccagcctcatgtgacactcctatgcagatcttcagagcacattatttgagtaatgccattctttctaacactgtgctctgcaattccagccacttcagcctctccaaatcttatctttgtcttctcagcttagtgacacagtactttactacttatgtctcccctacctactccctgatctggatggaaagcatctctacacagaaaataagggctaccaaaaccttacttcatttatttcccctctttcaggatcatacttttgtgttgccaattgttcaagttccagaaagaggttttttttttccatatatttgtctagtttttcactgtttttgaaatactaattacggaggtaaatacagtgaggcttagataaattaagtgacttaaccaatgtaagttgcataagttgcatatctgggattcaaatctacatctcatagattctgacttcaaaactcatgcttataacactttcatatttatattgaattaacttctaagtatctgacttacttaatcctccatgtgcagatgtagtatgaccctcaattatgtaaatattttacaagaaaaaggcttgaaagaattcagcaaaatgttaaaaaatgctttatctagggaatggaattatagatatatttcccatttatattatctataataactaatattccagcaacaagtaagttttaattttatatattaaaaataacccttggccgggcgcagtggctcacgcctgtaatcccagcactttgggaggccgaggtgggtggatcacgaggtcaggagttcaagaccagcctggccaagaaggtgaaacccccttatctacaaaaaatacaaaaaattagccgggtgcagtggcagacacctgtaatcccagctcgggaggctgaggcaggagaattgcttgaactcagagggtggaagttgcagtgagctgagatcgtgctgctgcactccagcctaaagacagaatgagactctgtcaaaaaaaaaaaaaaaaacaaaattcaaaagataaacttgtaaaaattcaagctgtgttttaatgagaagaaaaaagtgttttcaaaaacatcaaaaatcaggtttatacaccttattattttatagatgatgatggcaatgtacaccatttctaaaagtctggtatacctgattaggtagcactcagaaaacatagcttctgtcacggataccatcatgcagacagaatgtataaaaagtgaggtctagagaagaacaggtgaagtgtttactcatataatctaacaatcttaaaccactataagctagtgtgagtatagaataattaagacaaagcttcaagtaattgtcttaactttaattgctatgactttggggatatgtaactgacttcctttgttggagtttcagagctgacatgatcacagctttcaactctcagctttgtctcatttgtttaacatggtggactcttaattatgaaagctgcaaattaattgtattgtgaaataccctgagaagctccttgtataggtgctatgcaaatgtagtatgattgactgatagatatgtacgtctcctttgaaaaaaatatgggctcttgctgagtgaagaaattaaactgatatcccccataactctattctactgcttttataaacaaccaaacatattttcctttttttaaaaaaatcttaatttagtaccttttctgtcagtgttctggaatgtaaataacattagtagcagcactgaacgttcctgtgtgttctgaagccttcacacagaggactatatttatgtgtacatgtataacttatttttttttctaatttatgaagctaaagatacccagcttggctattaatgtcaagcaacaaatctgaagtctcaccatgatgttgttaggtgttccagaattttcaggtgacagaggagctatttcttatagtgtttgcttttcgtcttactaatgtggacatcattgcagattatactgcagaaagatttttcaagtcacttaagatgaaaataacatttttaaatcaagctaggcacactgaaatttttcagttccttagcgattatttttggtttattgaattaatcactcaggtatcttaatgattttgaaactggatgtctaaaaaattgtttaccttttgtttcccctcattgagttgagcagatagagaacagaatctcttcctaggcatagtttaccccattcactccagaaatgtatactgaaacctaatctttagattcttgctaatggctttttctataacacgatattatcaataacttttttttaacatgacgtggtattgcttggcataaaataatcaagtaaactctatagaacactcacctctgttgaccatgctcacaaatctgagaactaaaaaatcttcaagccaattattcagaaattgaaagataacattaaacccactacactctcacataaacaagcgctcaacctagcaataaataatttatcagtgaatttactagcatttgaaggcaaatggtatgctgaaaagtgtggactttaagttcaaatagagcaggattggagtcttaacttcacttgtcaatagctggatgactttggtcagttttcttatctgtataaggaaggcaaaaatgatagagagagaataaatagatacagcagaatgtttgtaaggactggaaatactattaagctcacttactaaatttcctgacccataataggcattaaatagtaactactttattaatcctgggaattgtcaaagctgctttgactgaggaggtaaaaaggaacatgtaagaaggagcgaagtggtttctgtattatatttttgtgttaagggacttccccagaagaatagatttatcattttaaattctgttcaatctttctaagagttactgacgtttcctcactcactcatttgacaaattgagcacaaattattcattcacttagcaaatatgtattgaatacctcattccatcattaattccttcatttcttcatttaggtagtcagtcaggagggattctccaaaggacagacacttggccctgggagataaagaagattacataaaggccccggggaggttgcaggctaatgaaaataagattgatgtaacaatgtgcaatcacacattctcttgggatcagctctttccttccagactttcagtgaaggaagagtcaaggatcctcactttgggagctttactgattatctttttcccacgctgccctttatcaaatagagactggagagggtcactgtcatttctttagcagagctaattttaggctattatttaagggtttcttgtatttctgagaaatggaaaattatttcttccttttttcccctctgttcataaatacattttttaactaatggattttaaagaatagttttagaacagaaatattgaacggatagtacagagaggtccaatataacccccccacacacaatttcccttgttactaacatcttacgttattatgatgcatttgttacaattaaccagccaatactgatgtctgattattataaagtccatattttattcaaatttatttggtatttatgcccttctattccaagattccatccagaataccatattacatcgagttttcttgtctcattagtcttctcttgtctgtagcagaatctcagacatttcttgtgtttgatgtccctgacagttttgaggggtggtggtcagtttattgtaggctgcccctctgttagaatgtgtctgtatttgtcataattagactggggttacaagttttggagaggaagaacataaaggtaaggaacaattttcattacatatcaaggttaactttatcataatgatttatgacagatgatgctggccttgattacctggctgaaatactttttatcagggttctccactgtaaaattactcttttctcccactccatactgactctttggaaatgggtgactatgtgtagtccacatttgatgaatagagtgttgtgcttcaccttctgcagaataatgagactatagaattcttctacctgtgaaatgtgtcacttcttcctcatttattaatatttaataatttacttctgtcagtactgactcacatataattattttagactttgggttgtaattctgtgctactttgtttattttgctgctcaaattgttttagcttttgccattgggagacttttaagttggatcttgtgccctttgttatgcactcatcaatgtatggggtgttttgtgtgtgtgtgtgtgtgtgtgtgtgtgtgtgtgtgcacctgttagcactttcttatttactggcattaaagatgttccaggttcatcttgtatgtttcatgccctagtcatagaagcagtcatgtctccaaggatagggtcttgttattgaagaatgacatcagaaaccaatatctgggtactaggtgtgcttgttgctgctggagtgtcatttatttaggcgctctcagatgacagagaaaagaagtatgtgtgtctatactaattattatgtacatatatctataagtatttctacatacagctatttgtattatgttaaattaaacatatgatcttgttgttgtctccgactctaatccattaccacatggatcactctgctctcctccacttactgatcagtacctttccactccacacagtgctgtcccattttgcaataccaccagtaataaattagaattttgatttctcttaatctacaccagcatttgatattgtgtgtgtttttgttttgttttgttttttagccattcttacaggtgtatagtggtatttccttgttgttttaattggtaattctctaacggcaaaggatgtgaacatcttttaatgtgattatttgctatctatttatcttctttagtaagacgtctgcttatatcttttctacatttttaattggtatgtttattttcttattgatgagctttaagaattctttgcatattttgaacataagccttttatcagatatgcgttttgccaatattttctcccagtctgtgacttgtctttgcatttccttaacaatgtccttaacaaagcacaaggtttttattttaatgatgtgcaggttatcaattttttttccaataaacggtgtttttggcattaaatacaaaaactcatcactatatccaaggttacctagatattctcctctgtcatcttctagagctattatagctttatgttttgcattttcattgatggtccattttgcattaatttttgtgaaagatatgacttctgggtctattcattttataacatatggacttccaatcgttccagtatctgttaaaaagacaaatttttctccactgtattgcgtttgctcctttgtcaaagatatgctgactgtatttgtataggtctattaccgggatctcttttgttccattgctctgtctattcttttgccattaccacattgcctcaattactgtagctttacggtaaatcctgaagtcaggtaatgtcagtactccaactttattcttcttcttcagcattgtgttggctattttgttttgttttgctttccttgtctttccatacaaacttagaatcattttgtctatatccatgaaatagcaattggggttttgattgggattgacttaaatctattgatcaagttgggaagacttgacacactgacagtgttgagtcttttcatccatgaacacagactatttctccgcttatttcgatctcttttaattgattttatgagattgtatagttttctgcatgtaaattctgaaatactattttatataaaccctagaatttcatgttttagtgctaatataaatggcattgtatgttaattgtggaattcaaattccatttgttaactactggtataaacaaaagttaactgactttgatatattaacattgtatcttgttgccttgctataagcacttattagtgctggagttattttttgttaattcttggggatttttcattgctgcctgggaacaagtattatttccttcttttcaatctatatacattttttttgccttttcttgtattattgcaccagctaggatttccaatacaatgatgacagtgagtgataagagtaaacatgcttgcctttttccgctatccaaaatgaaagcatccaatttctcaccattaagtaggatgctagtgctacattttttggcagacatttttatcaagttggggagcttcctctccattcctagttcattgagaatttttattttggataggtgttgcatttttccaaatgctttttttggcaccagttgatatgatcatgtgatttttcttctattcattagtggatttcatgaattaattttctaatattgaaccatcagtcctgcatacccaagacaagtcctattttgttgtggtgcataagtctttttaattgttgctggacacaatttgctaatatttgttgaggatttttccatttgtattaatgaaagatactggtctgcagttttactttcttgaaatgtctttatcttattttggcattatggtaatttggcctcatagagtgaatttaaaaatattctctctgcttccattttctagaagagattatgtacataaagaagaaatgtatgtacatcaagaaaaaatagaggccaggcgcagtggctcatgcctgtaatcccaggactttgggaggctgaggcgggcagatcgcctgaggtcaggagtttgagactagcctgcccaatatggagaaaccccatctctactaaaaatacaaaatcagctgggtgtggtggtgcacacctgtaatcccagctactcaggtggctgaagcaggagaatcgcttgaacccgggaggcagaagttgctgtgagctgagattgtgccattgcagttcccaaaggacaaaaacgagcaggagaaccagagttctagaagtgaatttgaaatgagagctgagggcaggcaa

SEQ ID NO: 49 - DNA, 187193 bp, Homo sapiens
gctgacacaattcagaatctgactttgttactgattggacttaaagaaggtcatgagtagatctgagtggttcaaaggaggaactatattctatgccttgtttttctgcatcatttcaaatattctcatcctgaccaaacattcaagctaatgcttcattcagcctaacataaatattacctgacagtgatccatttctcacaattctcatttcccatccagcagtttctctgatactgagtactcacacaaagctgactcttactcatataggtatgtactctagatgtgtagaagagttaatatcccacaggacaaactttgaccaatatgtggggtggccacacagtctcactggctcaggattgatttcagctataccagttttttcagttactattattaatactttctcctttcactctggttattgtcctgttttacataatggggtatatggtcaccttgttactaaggtatcggagccaatagatagatgcttcttccatgcttaattcaggtggaaagccctgagaggcatttgatacactttaaagatgtctctatactattgaacacgtattcctatatggtgttgaaaaactcaatacatccttttattggcttttccttgctccatttttaactcacactgtgattactgttttctgagatcacgttttgaaatgagtggctaacgtgacaaaaggcaaaaactctttgactgaagctccgctcttgggagaacccagactaagtcagcttggtttcaataagtgataatattgtatcgactagttatggttccatagaaaatcatttcaaaattcagtggcttaagacaagaagaattgatttctctcccatgtatacaagatggatgagggtaaggtcatctaggctgtgcttagttgggcagctctgatgtttactgagatctttggatcaacaggaatagctctgttccaagtacttttcatcctccatggattgcagtttagccaaagtgagtttttctatggtaatagcagaggtaacaagaaggtaagaagaaacacaaacgacaattaaagcctaggcttatagccagcacgttgtgacttctagtcacatgttattggtcaaagcaagtcacatgtttaagccccaaatcaaggggcagagaagtatactccatctatgatcaggcaatggcaagagtgtatgtgcagggaaaggtgaggaattgagactaataaatcaatctaccatatgattataaaagaaatatcagtatatttcctgtgaaagaaaagcctatgacgtatttctggtaatgatgctagtaggccaataggtaaattctatttaatgggaactaatgactctcatgttttctatgtctaaacatcaaagaaacacaacacaacaatttttacacttcataaattacaaacaaacaaaaatggaggagacagaaaagttatttaagagactacactcttgatgcatagtaagattttagagggtatggcttctgacctcttcattatgcctgggaaataagatacagtaataattattacatgtggaacatctctcaatcttcagagttgaaaaaaattagagtagaagaggaatagcattaatgaaatacatttattttcactggggcccaagcaatgtattctataatttagaaagatcacaatgggctttatggtaaaaaatacctctaaaataataagccttgcagagcaattggcactcattaaaattcagtgttggaagcagcaggtggcaggcagtttcatggaacaattttgcagtgtccttccagggttgaagcaaaacaattcatgtcataagataccaggtcttacccagtccccattttaagttgccgtaagtaacagttcctctatttttatatgaatagattcaaggatcttaaattgaatgtattacaatagctttctaaaatatacattttcctaccatgtggtagaaggtgaatatatgcatttcacttactattttccctttgaaaaggaatacgtttcacggcaaaatgttgttacttgtttttccagagggaagtgaaatttgaatatctgtaaaattacacatatgtggtataagtgaaaaaaattgttttgggggcaaaagactaaggaaattgttatcaccctcccttcaatgcactttttcctgagggaaagtaaacgttgatatgtgcagtggatttctcttcatgacactctaatccctaccactccctcaccaaaaaggaaaagaaaaggcaagagaaaaaaaaatgatttccatttcctgggaccatttaatattttctattctttaccaaagcaccgtggaggtttgagacaaataattacattcagaccattttcatgaaaacaagcagttctttgaagaatgtcggacttaactatctaattaattgttaaatcttggcagttatagcctaaaacgttacatatttaagagaaactttttactataccttcaacactagaaataaccataaaattatagcacttattttcgccttctatttgatataccaatggacatagcaggggactcttgacaagaggtttagaatacaaatgctggggttaggtggacttggattcacatccccgtttatctttttaccgttgtgtgatcttggcaaaaacctcaattgctagtcaaaggtgataggaatatctgcctcatagggttgttaccaggactaagtgagattttggatttggtgtctagctcacaggaagcactcagaagattatagaagattattcatattttggtaatattagaagtgtctgtggtgaatagaagaaaagtatgttatagaaaatatttttttaaacaatggttatttagaaaagttgtacataccaatgggcataacaaacaaaccaaagcaataaataacaccgagacaatattactcatgttggtatatgacagatctttaaaataattgtgcatgttcaataaattattatgtgttaatctttgcttttaatttatttggagaaaaaactgtcattacaggtttcttcacaacaaggcaattatttaagagcaatagtcaataatattttcctgtaggaggcagaagtagatcagggttttgtggagcctgaagtttatagcattttgaatgcccacttcaagagttggcagtgaagagcaacccaagtatttcactggaaagtatcaggaaaagtacagacattggatttttccccctctttggtaaggagagaagaggaaatagcagctataggaagaggctccccttggggccttgagggattaaaaaaaaaaaaaaaaaaaaaaaggcagtgcttcctggttcactgaagtggattttactggcaaagaaactttgccacagcattccttcagagaaattctacttgtgagcttctgcctaatgtcggcgtccgccaagtgatgcaattccactggaatgtgtgcaactgaactgttgggatcaatgcctttgcaaacctcagaaggaaaacatatattcagtacaaatgttagctgctacactaaatacaaatgggacaagctaccctataaaaagacaacgccaattttttttcagtcaagctgaatgatgtttataagaaaggcatctaaaacagtgagaaaaagtgttaatattctagtatatacaggaaaacaaaaaccagaaagaaaggagaaatgctgaaaataattcatgtcaaggagatgtaaacatatttaaaaggattcttaagatgttatataatcataaaaacaaaatccactagagatatttatatatgtagtgtgtatatgtgtgtgtgtgtttgtgtgtgtgtgtgtagcctttatcgatgaaacagtttagcagcagaatatatagtacaaagcttcttgaaagataattgctccatttgaaaaatatttctgggaaatatttaagataccgctcacagaacttgacatgtcaagtagacaaaatgtgagaaagagtatagcgatttgaataataaaacaatattagtctagattcttgagtcaagctgcttaggttttattcttcccccactgtcacccagttggatgttcttgggcaatttagttaaactttttatgttccaattttcttgttggttagattttgcaaataatatcaaacccatcaggttgttataaggattgaataaattgctaatgccaatgtaatgctgaagacactacctgacacataatttgagttatagaagttgcctatcaatatgttcatcatcgtcttcatcattgtccagaaaaaatataaatgaataaaactaactcagatctataagaaactaaaatgtctaaacataaattgagattagagaggtgattgtttcactaaaatcaataataataataatgtacacaacaatattttggtagaatgatagacttattgattttattttttcaaagcctttaagagaatctacagtctgtcatcatttaattcattaaaaatcaactttattgaggtatactttacatgaaatgacatatacccatttgtctaggttgataagatttgtccaatacatatacccttgtaatcactgccacaatcaaaaacagaatgtttttattacccgaaacattccctgttgcccatttgcaatttatctctttctccttatccctaaacaaacattctgttttctgtcagtatagaattgcttttttttttttgatatctttctcttagcataatagctgtggaattaatccaagttgtgaatatcagtaatttctggctttttattgctaacttgtattacaattatgcattcaccacaatttgtttatccattaacctgttgatggacatcagtgttgtttccaacttttggctgttataaaaaaaatttgctataaaatttccttgcaaaaatttctgtggacatatgctttcatttcttttgggtgaatacataagagcggggtttctcagtaatattactttaagagtgccagcttgttttacgaagtaattgtagcactttatatttctaccagcaaggtatgagttccaattgtcccacatactcaaaatcttttggaattttcaatgtttttattttattttattttattattattatcattattattttgagatggtgctcactctgttgtccaggctggtgcacagtggcacaaacacggcttaccacagcctccatctcccgggctcaggtgatgctcccaccttaacctcctgactagctaggactacaggcacctgtcaccacgcctggctaattttttgtatttgttgtagagatggggtttcaccatgttgcccaggttggtctcaagctcctgggcttcagctgtctgcccaccgtgtcctcccaaaatgctagcattacagctgtgagccaccagtcccagactgaattttcagtggttttcatttgagcctgtttgattagtgtctagtagctgtgtcttgcggttttgattggcatttttaaaataatgatgttgagcatcattttaatgggcttaaatgtcatttggatatctttgctaaaaatgttcatttttttttcattttctaatgggttgcttatttttttgttattgaggtgtaaaaatttcttaatgatatatttcaaaaatcagtctttttaaatttaatgaagtccaatatttctatttattctttatgttctgtgtttttatgtgtgtgtatgcacatgagttttaagaaatctttgcttaatcctaggactcatacattttctttcagaagtttttttttttttcaacttttattttaagttcggggtacatgtgcaggatacgcaggttttacgtaggtaaacgagtgccatggtggtttactgcacagatcatcacatcacctgggtattaagcccaacattcattagctattcttcctgatactctccctcctcccacccgccacgatgggtaccaagatgtgtgttgttccccctccatgtgtccatgtgttctcatcatgcagctcccacttataagtgagaatatgtggtgtttggttttcttccagaaaatttaatgctgtacctttaagtgtgtgacctatttcacgttagctttttgtgtgtggtacgaggtaaggattaaggttaacttttttacaaatgaatattcatttgttcaagcaccatttcttgaattatgatgcctttatcattgaattacctgataactctgtctaaaatccattcacctaaaatcggcacatatccattagcacaatatccattgaattacctgatacctttgtctaaaatccactgtatatgtgctgatctgtttttgaacacttaattatgttttgttgacctatcctgccaacatcacaccgtctttatcgctctattactagtagtaaattgtaaaaatcacaggatatgtctgccaactttgtttatcattcgattttactttcttggttaattttattgctacataaattttagcctcatttgatgattgctacaagaaaatctcctgatattttcactgagattattttaaagctaaaaacctattgggagataattgacttcttaaaaatattgagtgtttttgacccatgaatgtggcatatttctttacttatttaggtcttaattaattttccttagtaattctgtgtagcctgtagtgtacagaccttgttttagatccttgatacccacacctcctcccccagtgtttaaaaattaataaaatgagaagatatcagcaaagggatctgagaaggagcaggtagtaaacgagaagaaaatttaagaaattaagcaaaagcaatgcttaaaggaggagtacttggtaaactgtattacttgtgagtgatacatcaagtaaaattaggactaagttgaccattgcattattctatgcgtaatttaatattgactatgaccagaaacacttatgtggaacagtggggacaaaagactaatcaaagcagattcaagataaaatgagaaaagatgaatggagacagtaagtacagagaattccttcaaggtgttttactataaacagaagcaaggaaatgcagtagtagacagaggaagacggtatgttaaaggggtgctgatttttaaaatgggccaactagcagcaaatctctttgttgtgatgctacagaaggtagggagagttgatgattccacagagagagacaagtgggtagaatggtcccttgagtagaagactatctaaagcacaggtggatggcttggtctaaggagggagcacggttcacctcaagtaacaagatgaagggagagtctgtggtcacaggggccaagtatgtgactagatgtagtgacaggagcttattgaagttttcttctggttcttattcctttttgggtaaaatagaaagcaaagcaatcagctgtccttgaatatgagtcagactgttggagatttgagtaaagggatattctttaagcttgaatgaatttctttccacaaaaaaaaaataaagcctactacataatgattatttttcttaaaactctgcagaaaaagtcatcttggcatttttacaaataaaatatatttttattcctacagagcaagaaatacttctattttttttaaaaaaaaaaaaaagaggcaataaaaacagatattctttctataaaattattagtctagtttgccttcttatgaattgggagaaacaatagggtagcccattttgagtttaccttgtgttaggaagcatcatctcctttctaaagcctcttataatgttggttagaccctgtgaagaaatccataggacatagtcataaaatgtagtcatagaaaccttcttgctcatcagatgaaagtaaactgaggccaagaaatatcttttgacttatttccatttgatttggggatttcattttctcagtatccacttactttaagatgctaagagtataatttctttgtatgccaacatgaaaataagtccaaactatcattcttttctcatgttatagttatgtttgtatgcactagagtctcagtgtgcatgtatgtgtaattcctattccttagttttcatccttcaagcagttagtcccttcaaaacccgatgacaagacccaaacatattaaaaagtttagttggagggcccagggtgaaacacaaaaacaattcttcttcttacagagctcttaggcaaacacatagacacttgttctctgcctctggaattacaaatatgttactcggaaagcagcaatactcttttggacttgtttgacttcactttctttacctgtctttaagaagcctcatacacacatttaaaaaatacaacttataaaggttttagtgatagtgcatacaatcatttgattttatttcccttttctcttcaccttcactaataggagttactggcatgcttcaaaaagcttacatttgaatactgtctaaatcagtgcagacccttgaccagcttaatctttgcttgcaaatgacaatgcagtgaaaccagaggaagaaaaaaattacttcctttcctgttggaaacctaataagtagttagtctgacccagttttcaataagagagattttctgatgacccgacaggagtgactatctccagtcaaagaaagaggagggtgaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtaagatctgtaagtacaaaattgtgctgtgtctgctgcaatgagaatattgctgggcaagctgcagcttttcttcctttcaatgtctttgtattagcataacaggtaaaagctggggttgggggagaagtcactgctttattgatgctgtgtttctatgatgctgatgtttaaaatgcatttattccttgtgtgggagaaatgtattgaatctgtattccgggaggttaggatcaaaccagggaaagaaagactacaggtatatttctcagtgtttcactagtctttgctgcagtaaaactaatgggcaagacgggatgacagtgctaattctgggactttcagatggctacacgccctttctgtaacggcagatgggaaaatgtgatcgctaaatgttttttgtcttttttttttttttaatcaaagggatgaggggtggggtttgcagttctcaccggatgatttaaaagaatggttataaagtttcctaggggagaatttggtaaggggagcaaagcaagactggaggtcatatgggctcaccaaattttgtctggcattttgctttatacccagcttctagataacagcctctggagtttcctttaccatttacaccagttaagttgtcagtattaaggttcttataatactttatgaaaactttcagaagttgatgacttgggaacaaaacttttaagagctctgagattagccacgtataacccattatgttaatgggatactgtaacattggggtttggggggaaaattggaattcatagtttttgcttctccaaatgaaaactacttatgtttaaataatcagcatcctgactatgtcctctgagaaacattcacagaatgactaaatagaagttatactgagaaaaaatagagtgaacagtagaatcacacagaatcaatttggaaaatgaggtattcataattttatctacagtggcaatgttttctgaagatgtctgtaaaagaagaagcatatgctgaatattgaattgcttgttttgagcaattttcatttatctgatgggtttatcatctttttatttttgttgttgaaggtttcaccaatttatgtgcattgtattttataaggaaagaaatgtttaagcagactctttttccctcctccttcacacacatgtgtaaacatacgcatgttcacaaaacaaacataaacatacaaaaatacttacacaatttgtgtaaaaaaaaagaaatacagaagcatttcatctttgatgtttcagtggggtttctttttctttttttaagcaataatcatggctgtgcagtccaaagatttcaaatatataaatgtggaaacttttatataaagctttatgtgaggttatataaatgcataacttatcacatcttagcaaaaaagtcaatcatttataaatgacttcattgcattacttcctttgaatatttgtagtgaaggaccagaatttttttttagaatttttatgtagctttccttaatgaaaacaaattcacttgtttacttagaaaaggatcacatattttctctgagtttagaaccccctctaaaaaaaatcaattatgttgtgaaaaggatgtgtggtatattaaattgattgcatacttctgggttttttttttagtaagtaaaaatgctcagtagtataatagtaaatttgtaccttttaaattcttttatgtgaggagaaggaatacaaaatatttgcttatttattcactgtttattttaataacatattaattggaatgcagaagtataagttctacctattaaaaatgactcaaactatacataaaagttcaaaagggaaaacccatcacctgtaaataacaatcatgaaatttggcgactatcattggagacatactggtgcctaaattcagataagatgagagataaatacttttgtaagaatggtttcttactatacaccttttaaaaaataaataataaatatttagataatatagtcaataatagatactcttctgtaagaatgagatcttatcctacacttaaaaaaaaacagaaatattggccgcgcgcggtggttcacacctataatcccagcactttgggaggccgaggcgggcggatcacgaggtcaagagattgagaccatcctggccaacatggtgaaaccccatttctactaaaaatacaaaaattagctgggcgttttggcgtgtgcctgtagtcacagctactcaggaagctgaggcaggagaatcacttgaccccgggaggcggagcttgcagtgagcagagatcgcgccattgccctccagcctgggtgacagagtgaaactccatctcaaacaaacaaacaaacaaacagaaaacagaaaacagaaacattgagtttaatttttgattttagattttaattaaactgaaaaaagagaagttgaaacaacattgaagaaattgttaaatttcatgtatagatttctctccaatggagatattatgtccagaataatacccttacagttaagaccaaaaattttgaaaatagaaatagtttgaagatttttttggatgcacgtttaaatagtaaacaaacttttataacccttgttatgatagttaaatgcatttgcaatgtgacttgtcatcaactccacccataccacctcaatttaaactacatcagttttacattactgagtacatacattctggctgaattcccatggtctcagtttaaacttatttcaaatttgtaaggaattatcctttatcaacaggcttttactacccaattcaccatttctgtgttctttattttcaattattttttgggttgttagatttcagtaagtagtacctctccaccaaagaaatagtcataggtgctatattttctatgagtttgcatcttgaacatgtatttcttttgccttagacatgcaagatacgttatctttcttggatcaagcttaattttttcttttggaaatgtgtaaatgtttaaacatttttggagacccttcctgtactgaaagttgttttgcaacatttttaggtctgtctgcaatttccgtcattgaatgtgacttgctttttttctgataaatgcctacatgattcttttgttgtgtgtgtgtgtgtgagtgtgtgtatgggtgtttgcttttacagaatattcctggatttgttccattttcattaactttttttgaggtttgccccattaatttaagattcttttattttaggatttgttgtactatttcttttttgtcccttaactgggcgtggccaaattgtggttatcttgcttctttcttttcttcaggatcaccaattttgtacatgttgtatctcatttgtctactttccacatctttcatatccaaatttcttttcaattttaattgacaaattggttatcttctttatttgagaaccacttgttctcttgtttgccacttgaatgaatagtatagcttgcaataaacctattaaggcacaaccttctgtattgtgatcttgtaaatacatgtttccttctcttaacactctagcaatttcctcagctggcaggtttttgggcaatctgtatcctcctgaaagtaagagaaaaagaaagtactgatcggttttctctgatgtcccccaaaggtccatgatttttagtatttggctacagtggaaatgggcttcaagtcgtgttttggggttttgtccactaacattttcactgaagacggagggtttttgcttcgttttttatctgcaccacgaccactgccaccttttatatttctctttattgtttctgtgggacaatagaggacatttaaaaatctctttatttaaggagttttaaatagcaatctttcagtttggaggaattctttgaatgaaaattttattagaatgttgttattctcagtattcatattgaaaagagctgttctagttaagactgagttcatctgcatgatgtgttgtagtattaaacatttattacggtaaaggcgtaacacaggacatagtagaggaaaaacagagccattgggcatgccttctgataatgtcccctattagtttatattgatgaagtctgtggcctacttaactattttgcaatgagtcctaaggtaatttacagaaacgttacatcatagtaacatgaatcaaaatctgtagactcaaatcctttttgaaagtatactgagtagaaaacttatatgtattaggtttacaattaaatgaataaatgaatgaataaataactgaatttccctatatttcaaatccttaaaagaggcaataaaagaacatgatgtgtcgtatgaagtattataaaaaacgaatgatcttactaaaaagcaaatagcaatttctcagtgtcaataaaatgatagtgagagcaagattcaggaggcaagctcttgagctgaagtgccgcccattgtagatttccttccctatatctagcacagaatagctctgtggtcttaggcaagtttcttagcctctttgtacttcagtttccccattcatagtggagataatattagtattgactttacagtattttcaagagaattcagcaggtaaatatgtaaaaaatcttggaagaaagcctggcaattaagaagcactctatgtgttagttgtttagttattgttatattattattgctattataacatttatatatgagccttaggatcaattgggtaaaaataatataaaacaatgaaaagactaaaattataattatcatctaatcaattgtattgggtatttaatagagaattaaatttggagtgtaaatcataagtggatattaaaatagagctcaggaaaaatggtgagaagatatagagatgctggtctctggatccaactagattaaaaatagaaatggtatttctgtatacaccaagcaattggacatgatcaagaaaaagggtatatttgcgggggggggagggatagcattgggagatatacctaatgctagatgacgagttagtgggtgcagtgcaccagcatgtcacatgtatacatatgtaactaacctgcacattgtgcacatgtaccctaaaacttaaagtataataatactaataataaaataaaaataaaaaaaagagaaagggtatatttgattttttgattataaaagcaatgaacagaaaagcacgagaacaaataagccagaatttctttcttcaaagaaaaacatcacaaatacttgtacatttctttcctgttgttttatgttgttgttgttctttttttatgataatgccttaatcaagtaatgtatgcacctggaaacaacaacaataaaatttgaaattatagagaaaacaataaaataaaaaataaagacctttccatgatttcctgtcttatttcacagagatattttctatagtttattttattgtaatgttttccttctggccaccattatacatttgaataatatatttgacttctattgcagaatctataaactcaacatcatgtctgctgactccatttttttaaagatgggcagtttttcctattttcacactttcacaagacaattttaggtgttacataagtctttgaattcttttggcagtaatgcacacacacacacacacacacacacacacacacatatatatatatatatatatatatatatagtgggaaattttaagtattcaggtaaggattaaatttaataatgaccaattcccacccccagaattaccaaatgctaaattttattggagatttaacatcttcagtattcataaaatgaaaatactaatacaatatataataagggcctacgttgtaactctacctagtccattcctcattctacattaccatgaattgtatatttacatataattgttatatatgtatgcctatataaaatattattttaaaatattatggaaatagtatattgaaagcaaacttatttaacttgtgtaactcattccatattagactatttagactcattcttataaataaacacatttcgccgggctcagtggctcacgcctgtaatcccagcactttgggaggccgaggcgggcggatcacgaggtcaggagatcgagaccatcctggctaacacggtgaaaccccgtctctaccaaaaatacaaaaaattagcagggtgtggtggcgggcgcctgtagtcccagctactggggaggctgaggcgggagaatggcgggaacccggggggcggagcttgcagtgagccgagattgagccattacactccagcctgggtgacagagccagactctgtctcaaaaaattaattaattaatttaaataaataaatacagttctaggatatatttcaccttatgtgttttatattcttattattcattcccttattgagggatatttaatttattgaaaatattcactattgcagtgttctattatcacatacattgaaaacttatacacattaagtgagattttcattaagaatatcaagtccgtgctgcatgtcaacaatttcatgtttgttatttctggtctcagaattcctatgtttcaacaaatgtacttaattcatccgcacctactatgatgttgatgaagttggacttatttcttacttcttacttcatattcaaccaaagtgttttttagtaaacagtcttttattggtttgaggaaatattctttattcattttttcaacttttattagttaaaaatggtatactccctttatcgtattttagtaaataactattttaacataaaatgtacttttatattttcaaataaagactaaagatagtgtatatatcttcttcataaacaggacaatgacttgtttaaatttactctgagatatttctcccagtgctcatatttgcactatttatttttaaactgcccccaatatttttgtcaaggtttttttagacttatgacgtgatttcctgagttctttatttaccatattcttgctatttatgtgcatctcctagattctcttcttgtgctctgaagaccattttaaggtcattcaaaaattgttttaaactcccttaaaatttatttgttgaaaatcgcttatgttagtcacattctaaaataatactgtagttcatcagagcactctatgtggaagatacttttctctcaacaatttttgcatattctgttccatgatcttctggaatataattttgctcatgaggggactgtttatgatgtaattatcacacttttgaataaatattcgtcttttcactcggacagattttaagaatttctctttgtcattgatttcttcaagttcactgcaatgtatgtagttgtggagttgtttcaaatttatctcatttaggcctctgcaagctcctaaatctttcttccattctgaaaaattctcagctattatatatttcaatcttgcgtcttttaaatccctttattttctccttcaggaatgctcattcattatttctaggcttctgtctttgatttctttgcatttctttcattttctagtgttgcagtcagtgtaatttctaccaatctgtattttatacttttattttttaaaaaacagttttaatttctataatttatattgctcttttaaaaattatcctgctattctgcttgttcttaatagtttctctcccattcttaagctctcaaaaaaatttcagtaagtttattttagattgtgattgttttactattttaatttttagagtcaaatttctttattacttatgtctgctggatttccctcatggtggttcattcttcctggtgctcataatttttttatgacaaattcaccttcaacagatgttgttttctatgggagaccaaccttgtttgagttgtgtatgcttttgcatagcatcgcattgctattgattctacagtggctctacaaatatctctggttctggactattttatatgtgaattttttggcttcaaattatattaccatatagacagaatgaatttgggccctacaaccaagcatagtacacattctgggttctgattgcctttttcggattcttttttctaccagatcaccaagtttccataaggtcagctatgtaatgcaaaggacccctttttgggaggttattccaactttacaatctccttgccagtctgagtttctctccatttggtgcctctgagggcttacctctttaacatttaacctcggctatgtgtacttcttaaagagttttatacttacatagcatttacatgtgtttgtagtggaaaagaaatccctcttcacgttgcatggtgccgtgtacttccctatacttccatgttggctggacttgttcccatccgctttccatcatttagaaagtcatcaaactctcacttgctggtattttatttttatcaggtactcttatggtttcatggagttattttgtaataggcaatggaacatttgctaatttttttctggaaacattgtcaagtctcaggtatataatctaataagaaatggttaatgtcaattgtatatgtctttccattggctccacaaacattactgtaacaaattaaagtgcttgttttagtccaatgacagaatatgttagggagctctagaatttagttagaaaagcaagccagtggatgttattagtttatatattctttgggagtggcagctctattaattccttaagtttaatggtatgcaaattcttaaaatctagaggcaattattcaaaaactttgttagcacagcaattcctagtgacacagtacaagctgaatgctaaacggaccatatttttaagatgatttctgctgaataaaagtgagaatattggatgggtccttttaaaatccttttttaaaagtcttcttttaaggcgggaaggagagatcaaataagatatttggtgaagtttctagtaatttatcattcatgcatgtaagaggccaacatgaatgagctctcaaaagaatgtagacattttattttcaatgccttttttgcatattgtttcaaggtttatttggtttcccatatttgtatgtctaatgtggttgtgtaaggagctctatatggagaccgctgagctatctttctaaatagcaggagtgcaatatacttgctggaatagagcttttagtgaaagaacatgattttcctctctggcatctatcagggtctcccaatcactaaagcacagtaaatgaaagagaaactcagaaatcaggtgtgccgctaattttctatcaacagagttaagaataaattaagaacagtcctgccgggcgcggtggctcccgcctgtaatcccagcactttgggaggccgaggtgggcggatcaccaggtcaggagatcgagaccatcctggctaacacggtgaaaccccgtctctactaaaaatacaaaaatgagccgggcgtggtggcggcgcctgtagtcccagctactcgggaggctgaggcaggagaatggcgggaacccggggggcggagcttgcagtgagcagagatggcgccaccgccctccagcctgggcgacagggcgagactccgtctcaaaaaataaataaatacataaataagaaatagacatgcattaaaataataggtaggctatataatacacagaaaacatttatacaaaattaatgtccaggccgggagctgtggctcacgcctgtaatcccagcacttttggaggccgaggcgggcggatcacgagatcaggagatcgagaccatcctggctaacacggtgaaaccccgtctctaccaaaaatacaagaaattagccgggcgtggtggcggcgcctgtggtcccagctactcgggaggctgaggcaggagaatggcgggaacccgggaggcggagcttgcagtgagccaagatggcgccaccgcactccagcctgggcgacagagccagactccgtctcaaaaaataaaaataaaaaaaaaagaaagtccttaaagttgtgctgagatgaaaaagtttctgttattctagacttgatagaacacacttgtttaaagtggaacatgaaggtgttttctaggcatttaatgtcgttagtcaattcctaaacatgctcagttgtgaatctgtgttgctgacaggtagaattttgacagccctatatataaatttaccacaaaagtatatgctgaaaatggttctattagaattagccggtgcttataaaatataattttttcagagttgccgactttccttttttgttgtccctttgtgcagactgtgcctatgcggtttgtagaaaagagaaggaagttttctatctgctttctttagggcacttaggtggcaaaagtattatttttactgacttcactcttattctgtcttttgtcatgcagatgtacggagtgattttgcaataaacagaaacaactttctcatagaaaaagagagactggagtttaaaggaaaataatctattcgttatgcgtagttcaacataggaagccaaacagcagtttttaagaaattacacacacaagacacaatgcctgagccaattgcttttaccattagggggctccttttacttatgaggcaaaagtcatttttccaaagaaacatggaacaaaaattcattttctgccagtgaagtttcaagattcacatatatctttaggtatccaaaaataatgttagtctttgagtattagcccccggatgttattttcttttatgattttttttctacatgaaacggtcttcaattcgtacaaaaattctagttaattctgataaataatttaacgtactaaattaccaatattaataatatttttattcaacaatatatattagtaataattccacaaatattggctgaatacttactatgtaatagatgctatttcaggcactagtgatgcaactatgaacaagacagagaagagttctgctcctgtaaaattcacatctgatgcgtattcttgaattcaatgaagtatacaactctaccaggtggaaaggggggctaacattgttaattttcggtctcacctgacaaatgagcattagaagccattaaattatttaattccaagatgattattttagtaaagtaaacttgcatagtgagatgcaccaaaaagactaaataaaaagaaacatatatttactaagaataataattattcctctgtttttatagagagtgagatattctgggtttttcagaggattaacaaaaataggatctcacattatacacatgtttatggaatttcctaatcacagacccaactctttccctgaaaggtattcattttcgtcaagtgaatagtaccagtggatttactaagaaggtaaaatttgttcaaaatttgcaaactacactaaattattgaataaccttggtaaattagtacgtatataacaagtgaaggaaaattaataaccaacagaatatcatttaatacatttttccagttataaaatcatatatgtttattattacaaaatttggagaagacaaaatatgcatagattgttattctattactctgcatgtggcatcctttcagtcatcttgtatatgtgtgtacgtgtgtgcgtgtgtgtgcatttaaaatacaaaattgaaattaatgcatatgttctgctttatagcttgtttttattaattaacatcttataaacattctcaagtatcattaaatattctcctaatgctgaaggatttttcaccagatgggtgttccctttttactcaaaccaataacctattgttagatatttatcttttacacaatttattgaacaatgctatggtacatatccttgtacctgaatcttttaatatgtgtctgattatttcttaaaaacaaattcctagtagtacaatttgcatgtcaaattgtgggtttttaaaaatgtgagtgtgtatattactaaattgtcctttaggaagacaactccctctgtacttgcaggcaggtgagtgctctttgtgaccatccttgttaatactaaatattattaattgtaaatactctccgattggattacaaaacaaatacacagataacagtatttcagtattgctctatattacattttttggaaaatgcatgcctgaatgaatatttcatgagtgtttgaaccattcatatctgctcattttgctgaagtcagcctctgtcctttgtttattcttttgatattttacattttttcttatgctcaggaagttcatcagatatcggtgagataacttgtaattttcacttttcttcaagtttataagacatttaacttattacattttaagtgtgaaaccttgaaaaatgttttataaattatttgaacctcagttttcaaatgtacacagtgcagccggtaatacctgacctggctttcacaaactcagaatggtcagataaaaactgaaatagttaatgtttctaaatgtatttttatagctacaagtgatataaagttattgttctagtcttattaaagataaatcagtgtttgtccctaattgcacatctggtcataagcaagtctacaacttaaagtttcctaaatataggtccagtgttatcaactttttacctccggcacctagcattgtctggcctgtggtgtgtgatcattaagtgcctgcttaatgaatgtagattctaagtatactagagaaacataaattaaatacatctgtgctcattccaagtatgctattacagtgtcatctaaatctaatggtgaacaaaatagcacatattaagatgatattaatgttaaacttcaatttatgcctctgcccttggtaaccatgataatccactccatgatgaagcagtcaggaaatgtaagtagttatttatttcatcactacaaattgtatttgagacctgtgttttggaggtaatctatattgtgggctcttcaggaatttggtatgttaggaaaattcaggactgcataaggggaacaggaataggtttgagggtaaaaggaaattgtaatcatccctgaattaaaaaataatttatatgttacagacaggtaaagtatacacaaggtgtgtgatattttcttcttcaaaaaccctccccaaatgtgagatatataacttgcttttccagatagtcagaacaagaaagaacttcttatttttgttttagcttgcatttacgttgccataacacattatgttaatatttgatgttatttgactttggcagaacataatgaaataaggtgtttgactttgccaaagagagtttttggaacaaacctgtgtttgatttagatctgaggccaggtgttcaagacgagcctaggcaacaaagtgagacccctgtctgtaatacacacacacacacacacacacgcacaatctctctctctctcaaactttggcatatttagtaataaatattaaagccatgaaacaaacatattttacttatagcttagaataatcacctttataaatttcttaagtgatttgtagtacactgtggacttgactgttacttttatatcaggttataagtaatgttggctagacgtctatccaatgaactttccctttcacttcacatattctctgggctcatggttagccagaacaatttagaagccaaaaacataaccaaaattatcacatgtatttttactgcatggtgggattattttgttttattgacatatatcattttggtcaataataataataacaataaaacagcgttgagttactcaaatattagttggggctcttcagagaaatagaacgaatagtgccacattatctatctatctatctctctaaatatatgaattttccctttctccattttctgttttattaagggtctcaatggattacatgatacctacattggaaatggtaatctactttactgagtcccctgactcaaatgctagttttatctggaaacaccctcacagacacgtccaaaatattatttaatatgggcaaaccatagcctagtcaagttgacacataaatgtaatgatcacaatgatactagtaagagaaattcagttgaccttgctgataaataggtatttttcacacaaaagccagaaaatgatcataaaatatgtcatatggtttaaaattataattgttgagtacccatttcaaaatatgattgttcatttgaagaataaattttaagttggttcaattctatagataattatgacatgactgaatatttattcatggcaaatccaagagcattcatttgcaattgccattcatgtagatgtcaaagatgccactttttattgcacatattgtgagagggtaaaacaaataacctttcctccttaaaattagattgctcattaaatgtgtcattaatcatattttagactccaaaagatcaaagtaaaatggctctgaattttaaattttccagggtgacaaaagctgaacagtttattaatgtttgaccatgctccaggtgtggtggctaatttctgaagatgatgttcctctcctttcaattgcctttcagctctcatggtaggtgctaatgtgtataattagcatgatttcagagttgtgacctgaacgacagaccaatatctataagggttgtggtccagccaggttagaataataccaaattgatatgcaattaattgagcttgcaaagaggttactgaaaggagttaggtctaaattgcagtttcaaaataaatcacccgaaattatttaagagtataactgggactccccaaaagttacctccatctgaaaggtttagatttggaatctccagttgtgatgataaatataattataattaaggctctgggtgttaatgtcagtgttatgcagaaaattaccctagacatagatagctcccagcatctacatcccgttttcaattttatttctaataaaaaaatttaatccatttgaggtgacaaaattccttagagaataaatgttttttaaccttgggtagtagaataaaatatagagacaatgacatatatcaaactcatggtattagaagttgtgtatcccttatccaaaatgcttgagaccaaaaatgttttagagtttgaaattttctgaattttggaatattcgcatatatataatgagatatcttggggattgggacccaagtgtaaaaacaaaattcatttgtattttatataagctttatacatataacctgaatgcatttctatatggtatttttaataattttgagcaggaaacaaagttttgactacattttgactgtgatgtgtcacatgaggtcaggtgtggaatttttcagtttggagtcctgttggtgctcaaaaaattgtagatcttgaagcgtttcagattttggatattgagctcttgagtgctcaaactgtaatatcattgagctgtttagaattaagtttgtattaattagaatagtttctacatgtttggtgtaaaaagtgcttgttatatttaaggctctaaggagtctttgccagatttgatttgtatttgcacttttaattttgtaaataaataactgattttagacttacccgtttaagttgaaaagtactgtatataaaaattaactaactttttagaaaaagttttgaaatatttaaaagaagttaagatttactattttgtaagggtaaatacaagaattaaattcttaggtttttcttgttaaggacctactgttgatttgtcagactgtttagacactttaagagaacataataattcaattttagaattaccatttaaaatatttaaagcaattgtagtaaagtaagtcaaaagtcctgattgtttatgtgtgtttagtctgttcaacatgaaataattgaattttaattgtggcaaaagagaagaaagtttttcttgttttaataagattataaaaagaataacagacatataaatgaggctaaaaattttaagggggaaacagcgtttgcatttgaaattataataaatttgatattatgatccccgatgagcactggggctctaaggggattcaagggacttgcccgagactacagagcaggaattcacatacagattttcatatacgaatgcagtggctgtggtttccacattcattctcaaaaactcaatgtacctttttggagatgcatgcaaaattgtagaggaaaagaaagtaatatttagaatatagtttctaatcttttattgttaatcttcttgtttacaatttaccaaggcaaaaaagaaacacttttaaaatgtcaaaataatataaatattatctaccattgtttttctattcccagtttaatagacaagtttctctgtgtggcaataatttttaactctaaacagagccagtagctcctctattactttggactttttaaaagatatagttattttgagtttgcattcacacatattctaacttagaacacacaaaaatttacattatttattttctcttaacatatttgcaaagatttagttatatctgcaaaaatgatatattttttattcttctatttttacccaagttgttgatgatcttctgagatccatctgaacagaaaaggaagagacacatacttctatttatatacacactcatattttgtgtgtgtatacaaccttattagcttcttgacaaagaaactaaagagatttaatttttaaatgcttcttcccatactctatccttttattataatttttaagtctttaattatttttacatatctcttctatatacaggtctttatagctgggtccctactgctgactcagttttgaactacccatcgatcttatcttaaaattgttgtctagttagtggagcatttatttatcagcttttccatttgcttgaatattttacatggccaaatatatatctgaccaatgtccttctttaggaacagtgctttatgtttttcacatctgatatttacatcaggtgcattcaaaaggcagtgaaccaagtcctataaaaacagatagaagaatcacttttaagtattaatgtcagaagaagagaattgctttttgatttaggaaatgtaaatagtcaatcttattaaaagattgactttaaaacatatccaactctgctaaacaatggaagaatctaatctttttttgattgaagaaaccacataaaacaggtataccatcatggggaaggtaggtactttctgtattactgtcaaaagacaaaaattgcctcttgacttaggattccataaacttttatggaggtgtgcatggctggaagacatcaataccatgcattgttccttggatggtgggctaggcacatattctaacctttgaacatttctaaaatagtatctttcaaagctggcaaatttggggaaaaagaaattccttatacagacgaagcttgaaggaaggtgatgtatgttgtaatgggtttgctaagattttcacttaatattcagcagccctgagaagttttcttatcttctactctaagtcagtactttgaaaaaaaaaatatgaggagcaggtttgacaatgttgtcaggattgtgattgagatgaagctagaacgatgtgcagttgaagtcctcccaggtcctgattcaaatctacatctgatttcatgacctctgctgcattcctctgtcatgagaagagcagggactcttagtccgatgacagaatcaaccttaccctttggttaattagaaggggcagtagtaaagaactcgaattttagagccaggcacacctggatttgaatacttgtcagatgaaccacttactacatgattggccagagacatacactttgatttcactggcctcatttttcctatgtgtaaaattgagaaataatagttgtcccacctcatatgattgtatggaggattaagtgagattattgaatctaaaagtcttagcacaatgtctgacatacagcaactagtagtgaatttcagccagtgtagcattattgaaattattatgaataagggactattgtagatgttatgcggaaagcagtagtcccctggggccatatagtgaaccccagtgctatttagctcatttctattgtctacgcattatatacagttcaaattagtaacaatcacaacaagaacaaccatcaattgatatagtttcaggcactttctttagtactttaggctaacgtatttaattctcataaaaacctcaaaggatatgtggtatcattccccatcttatagaaaagtaaaatgagattcagagatgtaaagtaaatcggttaaatagaaaaaacagttgttagattgtagagtcagaattcaaaaccaggcaggcttttgccaaaattaacgcattttaccaccacattcttaattcccaaacagagcaccaagcaccctaggatgcaacagtgaactcagagaaggatcataggatgtaattaaatattctggtgaaacagtgatgctcaacatctgtcaattactgagtgtgaggtagtttcatttcaacacatatcttattatatttctttcaatatcatatatttattaaagctgggtttccagcggatgttgtggtaaaaaggaaatactgtgtgaaatcagtgtagaacaggaaatgaggctgggcaatcttattccaagttttgaaaagttgtgccgtgcccagtggtagtatgcttgttgtaagtagaagtgggtacttaagaataaaataagaatgctatttttcctctaatatatacatattatatttttaaagcatcctgtaagtcacttgaatataacttctttgagccaaaatacttaaaaatggaactattatgtagttattttgccctaggggtgccataaaaatgattgatccactaaggagatcatgatacgaataagctggggaacctctgaactatattattcagtttatcagggaaatatgtaaaacttaaggatcagttcatcaaacctcattaaccacctgttacttctcaagtacttagagattcctttctaaaagagctcacagcatagtaagaaagatagacactgtgttagtcagggtcctccagagagacagaatcagttaagtatgtgtatagctattatgacagaagtttattagaaaaattgagactctcgattatgcagactgaaaagtcccaggacaggccttttgcaagatggagcccttgggatgctggtagcctggctcagtctaagttcaaatgcccccaaaccagggaagcccatggtttaactcagtccaaagccaaaaacctgagaacctggagtgcttctgtgtaactccaaaagctggagtttcaatgtcggaggcaggagactagtgtagcccagctctggaggcagagaccaattcaccttttctgtttttgttccatccaggcccccagctgataggattgtgcccacccactttgaggacagatcttccccttagttcactcagactcacatgctaatttcttctggaaatgtccttgcagacacgcccaaaaataatgcttcactagttccctaggtattatttaatccgatcagattgatccctaaaattaaccatcacagacacaacgtgcatactgaaatatagtgtgtgaaccaaatttccaaggggccagactcccaggcaggtcacataaatattcaaaaggccatagcattaagaagtgagaggaagttgtattggggagaaaagcaaacataagaaattttccagaagagatgaatgaaagaggtccaaatgcatgctatttatagaataatgagtatggtaataatggagcccccactaattacactatcacttattaaatacttgttacgttccaggcaatgcattaggcactgggttgtagagatgaaagtcagagtgactttcctcaggctctgacgtctcttgaggagtctgacaagaaaaaagtacattcaggcaaatgataagagatgagactggaaagcatggctgtggtagaagtaatatattgcctgtaacttctaaagaggccagggacttttagaataattaacacaaggtctaattactttggattaactagtaaccaaatgcattcacaaatattgatgttattcaaatttgcttcatcttactaaaaaagatgctgtatttgtgtattcttctgccaaataaatgagaggcatatgtatatttttccagaatcatgacttattcagtttatggactaattattggttgagaagataagtaaataacaaattatcatatgaaaaatgtgagactgggagtaattaatgcaataaaatagattgctcaatatgcgaacaacttcattgtaaattctaggaaaagggcctgatttcagaagaaagataaagtcatcaaaagtcttaaggattaaattaaaagataattttaaacatttactgctgtagtatttaaatttaatgattctggcaatgagactattgaatatatgctgtgttatatgtttaaggggatggactcaggtagttaggatgtgattattactgtcctacgccctctagttaaatcctgatagaattctagttttaactgaagacctctatttaatcataggctgcatcaagttgcagacacaattcatgaatactcatatataatggcatcatgctactaaaacacattagttaaatactctcactcactcaaatggtagaggagaatcatctttctaagatatctctccatgactacagtatgggcacagagcaaggacaatcctgtctcctacatggtcaccattcctttatttattcattcagtagagattttcgtgcacagaggcagctactgtgatagcacaagtattacagaattcaaaagagaaagagatgatttccagctcggcaatcagggaagtctttaagaagtaggtggcattcaactaaagaatacactcttcggttctgtgtggcttgatgagtatacaccattataatcgcagactttggcagaacgggagggttgaaataagataaaagaaaggagaagagcagtggcaaaggcagaatgactggtaacattaattgaagaattctttatttgtattcaccagtgtgggcctctttcctatttagccatcacttgaatgcacgttgtcattagcttgctttactcatcctatgaatcaagccttggagatgttgagaacccagtttctgtgtgtggcagaaaagtaaagagatgaatagaagtaatgacatagaatagcatcctcttgctttttccactattaattctattctgccagcagatatttagcagcttttttgtgttaagtcctatgtggatacaaatttaagaaatgacacattttctttctcaaggggatcacaggtcaataggaacacagggatctgtcaaagatcatgataaatgtaataaataagagaacataaatgtggacatagtaaaatggtagaccagaaaaggcaaaagataattattgatgatggtcaaggaagaatacttcgcaaaagtggtatttttagtctcaagacattgagcaaagacattttttttgctctggtcatcccataaaatgactctcaataatgaatagaacaagaaacaaaaaactaaatttcattttcaatgaaacataggagaaaaaagtcacactaaagtgctttcaaaggaggacaactggaagaagcaagtgaattactgtgcagactcccctagaaggctcagaagctgggcatcttaggaggcagtggtagaaatgcttaaacctaaaatagagggctcatctgaaagtctgtcacttagaccttctttttctctcaacctacgggaggttggaaaatatttgtaggtaaattgagctgcaggagcagcacaatttcagttttaagaccaaaaaaatagcagaaagctgggagtttatatgatccttctgtgtataaggtgaaagacacataaatataaataaatgtaacatatgcacataggctcttaaatacccatgtttagaaattccccagtaaaaaccagagttagccttgataacctaagaagaaagcccacaagtcaacaagccacaatgatgagcacagataaatgaatgtattgctagggttatcacatttgaggagtcctcagtaaaagaaggtaagaccccaactaagtaattactggcattatgaagaaagattaagaacagttccaaaacatcaccattttcttcatagagattttaaagcctttttcaatcataaaagggaagcttaaacaataaacaaaagggccgggtacggtggctcatgcctgtaatcccagcactttgggaggccaaggcaagcggatcacaaggtcaggaatttgagaccagcctggccaatatggtgaaatcccgtgtctactaaaaatccaaaaaaaaattagccgggcatgaaggtgcatgcctgtaatcccaactactcaggaggctgaggcaggagaattgcttgaacccgggaggcagaggttacagtgagctgagatagtgccactgcactcccacatgggcaacagggtgatactctgtctcaaaataaataaataaataaacaaacaaaagaacaccaacagagaataagaaagaatttgaggacgtttcagttatgatagccagactcacaacaaacaaaaaaggcaacaaaacaacacttattacaagaattgtaagataaaattgaataaattatccagaaaggagactggaaataaaaataagttgatgatagtagcagtaacgtcagaatgctaaagaatttttaatcctaaataaaatgatccatatcttggaaccatagtgatacagaggacaccttcagcaaatatgagagtaaaataaaaatcctttttgtattccaaaattatgtaaaatttattccctgtaatcagaaatctgaagacatgctccaaaaatcaggaatacacaaaggaagctaaagacaaggagtgtaaaacaggagagtcaacaaggagaaggattaagggaagtccattaataatagcagtttagcaggcctggagaaaaacaaatgtgtattgtagtagtgtaggaaagggcttcaaagaaataactctagcaaaatcgaaggaatgagtggattatctgacaggaactatcatgaggaaaattgtatcaagacgattttatagagtacttgaatagcaaaaacaaacaaacaaacaaaacctcttctgtagatgccaaaacaataaaagcaatgaaacttacaaataaattattaactcttaaataaaaaagcaaaagttgtttacaatgaaaatgtgatcatactatttgaatcttcagtggacaacatttgtataggcttaagcatgaaagtactgaatatggaatatggatggaaagaaaacctgatatagaattatattggaaaactgagtggagaatagagatacaagagggtcgtattgttacctgttaaaattggatgccaatggagaatgccaagtcatcaaatcttttttttttttttttttttttttgagacagggtcttgctctgtcgcccaggctggagtgcagtggcataatctcagctcactgcaacctctgcttcccaggttcaagcgattctcataactcagtctcccgagtagctgggattacaggcgcctgccaccacgcatggctaatttttgtatttttagtagagacaaggtttcgccatgttggctgggctggtcttgaactcctgacctcaagtgatccacctccctcagtctcgcaaatttccctctgtggcttcacaggcatgagccacagcacccagccggggaatgccaagtcatgaatcaaagtatcaccgtgtcatagacattatttagagatatggaggtaaatgccagggagaataactggaaaatagagtggatgcttacagggaatggcctagggaagagatttatattgcctttgttgttctcaggtttatttggcttcttaaacacacgtgtgcattacttttatataaatataaataattgcttaaaattagaaaaatgaatctctgacaaagatttggagtaccatttggtgtttaccaggtggaccaaggacagaagaacatggtagccagagaggtaagaaaggttaaaaacaaaaatcagaaacagtaagtcctgttcagggaactgcaggtggtttgatatggctgaataattaggaggcagaaaagcaatgtgttatagtggttatgggttcaggctctggaccctatctttctagttttgtttgatcggtatgtgacttactgtgtgaccttactaagttctttaacatctctaagcttttgtatcaatttctatatgtgaaaattgggaactttaatttgtactgcaggaaatgaacctacaacctgttagtatgcatttaagttcacctgcagatactactggagagttccaagcttctctccttcaagttcctgcattgctccctgcatctttgaggttccccagaacttgctaaccaatgcatagggcaaaccagaaatgctgactggaagtagcaacaagtgatttaatgttcccagaggtattcctgaactgatgaagtaaaagagtaggttgataaatataccaggttctccatccctttatacagcaattctaaagtgtatattatatagaacctcagtgggtctacagagaaactgagcttcagttctttgcagtgtgattcacaccattctgcacattttactgaattttctcccttccctgtctcactttctccacactctgatttgtgcttctggtaatcacttcccaaataagcccttgcctcaaggcccgctgttgaagaaaggcaatctaaacaaatacctatgccatgttttcaagaggattaaattatatgctccgtacttagtaaggctaaatatgtaactctgctgcggtggttgttaaatgccagcatacgaggaaagttcatttatgcctgtattatcagttaagttattatcctaaaggtgaagagaagcctttcacaaaatgagttcaatccacaggactcggtgactcactgaacacgtgtggtgaggagcggggctagggaaagatagtgctctgaatgactcacagctttctaacctgtatatgacctgtacggaatagtaatgctcacaagcaagaagcataatagaacaattacagttttatttctaaacaaagcctaaagtcctggtttcataaatgaagaaaataatgctgtctaggtaaacaatttggccaagattcacaattcactgatccaaagtcctaagtcccccaataatgtcctttttctgtaagttttttcaactatcattcatctttattattcttgtctcttgaggtcatgattggtgcacaggtggtcaatataggtaacataattgctgaaagaattaataaagatttatttcctaaatcgatccaattcatgttgttttcttctattcaagtactggtcacttggtctttcatatagtcatgtctctctaattcataatttaatggaaattattttggcaactccagcagacatctgagagataagcatagcttttgtattgttagtgttttctgccagactgaagaccttggtgttaataagatggctgctttccaatacctcttaaaaaaaaaaaaaacaaacaaaacaaaacaaaaaaacaccattttcctctctcctttttcttttatttacaaatgtaatctctgatccatgaattcataaggtgagaacggtgagtggctagctttttatgggaccatacataaagggctaaattcagtgatccatctcccatctttctaactacttagggaaggaatttgaaaagaagtcaatgtggcagatttgaaggagaggctgttggaaagtgtgccacaggcttttttacattctgtcttcgagacaatttgagtctgcattttttaagtgaaactattagtaacgtagtgatttcaggttttttttttttaagttggtagatgtaggtcataataggactataattttatttatttattgatggtctgattttaagcccttagaatattaatgtctaggaacatttgagaaagaataacagaaaaatcgtgtgtgtgtgtgtgtgtgtgtgtgtgtgtggagaatgtctctttggcccagataaactcttcgagctttgacatcttaaaaactctatgattaccatatttttatacatagtcagatacatataggttcatagtcctgagaactggttaaactgagttgtcttattgccagggtctgaggaaatttgaaagagagcatcatagaagacagtgtgttgaacactgttaggctagtaacaaaagaatgagagccacaagactaaaagagaattccacttgtgcgtaaacagaacttcagttactagataagcatggctttttcctcatttttctaccctttcctttattcactttccatcaccccccttagttccctccaaaatatgaaattgtcattgactttattaagatataactcacatataacaaaatgcacacattttatgggtccagttaaatgaatttgaaaaacgtgtatgcccatataaatccctgttcctccctatcaaaatacagaatacttatatcacccaagaaagtactttcacacttttttgaagtcaatcctaccacatttcttgcctacaatgactgatctgattttgatcaccacaaattagtgtttttctgattctagaacgttatataaatggaagcatgtagtacggtgctttatgttggacatttagttcagcacattgtcagtttcatccatgtatttacacaaatcactacctttttcctttttattgctgagtagtattccatatgccacaatttgtttatccattcacctattgatggatgtttggtttttttcaagtttgggcttattatgaatcaaattcctattaacatttaagagcaattctttgggtagatacatgttttcatttgtcttacattctactttagagaggaattgatgggttatatgtgatgtttatcttagtaaatgtttttgaaagtggttgtgtcattttacattcctgccagcaatatacgaaaggtttagctgttctacctcgtcatcagtgtttggcatggtcagtctttttagttttagtcattattctgggtatgaagtgctatatctcattgtagctttaatttgcatttccctaatgacttatctttttatgtacctattgactctacatattttactttgtaaagtgtttatgaaaatattttgcctatttgcttctttttaatattattgttttatatattttagacacaaccttctatcagatatatgtattttgaatattttctctcagcctctgaagagcaggtagtcttaatttttataaagtcaaatttatctatatttttatggttggtcatttttgagtcctaagaaatctttgcttatcccaaggtcacaaatattttctcctatgtttccttccagaattgtatagttttagtttttatgtttactctgtgatctatttaaaattgatttttgtggatagtgtagagtttcatacagatatcttgtttttctgatgtcattttttggaaagatcatattcctggctaaattactttctttattacaaacttggaaaagcctttttaaagcctcttagcttttatctaatggtagagtacataaagtcttctaaagtttgtttggagattagcattattcctttgaatattttctacatttctgattttatttaaaatatgaacatagtagataggacacatactacataatgatcattgtttaataatatagaaagtaaattaatatagccaagtcactgagttgggaagaaagtgtgtgcagttactggcctctttattttctatgtaactccctttcctttttctgtgtcttcatatgtatgtaaatatttcttgagaggtatgtagtactgagctactctattggaacacagagttaaacaaattgacaggatcattattgataggagcttcagggaaaacattgttagaactaatcattacaagttttttgaaattgaatctcttatttataaaaaagcacagaaacatcagtattccatagctcctttataaggtctttgtgttatgaagctcatgttgcaagatggatattgagtagtttgccatattaattttgatttgtatttatttgtaaatatgatttcatcacattaaaacaagagctacaataacagaactttaagtaagagttaaaaatattcaccaccaatctatttctcctaccttactgatttcacttgcctgtattcttttgctaatctttgtatatagtcagaatgtttatataaggataaccatactacagaaatggtttgcctttctgattttttttgaaacatataagattacaaatatttttcatgttgctacacagccttcatatttatccattttaatgactacgaagtagtctagtaagtgatggatagtaagaccatcatttacctattttattactattgttgagtttaggtaggccacacatttttgcttagagctgactccaaacatgagaaaacacatgtgtattgccttttccttctttgtataatttatatttagaatatcagcataattaagtgcttgagaataaagaagctagatttttgtattgaaatcccacctttgccattttccagctatttcactttgggcaggtgttctgatctctctagacctcagttttcttatttgtaaaatagggataataacagtgcctgcctcatatatttttcatgaagattaaatgaattatttttttgcaaatcaattacagcagtaaaatgaatgtaaaaactatataaatgtcttcttaaagttctggttaatggaactagtatattaatttaatttatattgtccctgaatgtatgtgcatatccagatataccacagtatgaccccaaccttgcaggaaatatacatttacaagaaaaaagaaagagagagagaggaaaagaggaagagagaaataaataaaggaaaaaaaggaaagaaagaagggagggcgagagagagggaaggagggaaggaggaaggaaggaaggaagggaggaatgaaggaggaaagaaggggttctcaaccagcggtgatttaaaaacacagtttattgaagtataattcccatgacataaaagtaaccgttgtaaagtggacaattcggttgcatttaatacaggcacgatgttgcacaaccaccactatcctcttggaaaacatttgcatcaatccaaagaaagaagctcttaccaattagtaaatttctccccattttctccctttcactttccaggccgcaacaactaccaatctgtcctctgcctatgtagatttatcagttctggatattttgtataaatggattcatgcaatatatgacctttgtgtccagcttctttcacttagtataatattttcaaggtttatctacgtttcggcgtgtgtcagaacctcattgctctttatggctgaataatattccattttatgtacatatcacaatttgtttgttagttgagcatttgggctgtttccaccatttggctattttgaatgtgctactataagcatgtgtgtacaggtacttgtttgagtgccagttttcagttatttagggtatatacctgggactgaaatgatagggttacaaggtggttctatgtggagttttttggaaaccacaaaacgtttccagtaccacactgttttgattatcatacattcatatttagctttaaaactgggaagtataagtccttcaagtttgttctttttccaagttattttggctattcaggcccttgcaattacatagaaatttgaaaatcagcttttccataaccgttttctaaaaaagccattggaattttaacagggattgccttgaatctgcaatcacatgagtagttaacactgacatcttaaccacattaagcctcctaatccatgaacataagatatctttctatttattagatcttctttaattaatgtcagcaatattttctagttctcagtgtacaagtctttcactttctctgttacatttattcatgggtattttatccttcagaatgctattatacgttgatgtttttttcttaatgtgcttttcagataattgctggcatataggaacataactaatttttgtccttattttttatttgttttttaatttagtttataaaactaatttttatattttgatcttctacctacaactttgctgaatttgtcctttagtagctttttggaagactgagatttttatatgtaagattatgcaatctgcaaatggacatggttttgttatttattttcttcccaatttagataccttttattcagttttcttgcctacttgctctggttagaacttccagtacagtgttgaacagcaatggtgaaggagactattcaagtcttgttcccgatcagagtgggacagatgtcagtcttttaccattgagtatgatgttagttgcaggtttccctccaatgtcctttattttgagaaagtttctttgtagtcctagttttctgaatgtttttatcatgaaagtgttttggactgtgttaaatgattttctgtgcattaattgatatgatcatatgaggttttctctccccttcattctattaagatggggtattcctctgattgtttccttatgttgaaccacccctacattcctgggacaaatcccgattggccataatgtataattcttttaatattctgttggactagaggtgattttggctcccagtttatattagcaatgtcaagatatttttgattgtcataactggaggagggtgctactggcatctggtgcatgaagacaaggatgctcctggatgttctacaacagagaggaaagcgttcctttgtctcacaacaaaggattagccaggccaacgcgccaacaccacccagattgagaaaccctgaattataccaaccctgctactattcttggtataccccacccttatctctctagcctgtcattctgtcttttcccctccatctcctccaaacacataactttgtgtttcagtactccaaccacactgaacctcacttaatttcttctcttagtcaagttacctttggcctattatcttccacacctgtactttttctaatccgaacatcctgtcccataagaatgatataatcgagtttggggactcagggttgggggagattgggagggacctgagagataaaagaacacatattgggtatagtgtacactggtctagtgataggtgctctaaaatctcagacatccctgctaaagaacttatacatgtaacaaaaaaccacctgtatcctaaacattattgaaattttttttaagagaaagaacatcccttccgcttcttcactccccaacatcatcacctggttttacttattatgattcaattttcggccacttcctccatgaagattttctgactttccttagaccaaatgagttacttgtgctgcatttttcccaaacaccagcattgcccatgccatagcacttatcagagtttattaaaatcacgtgttaatttctacaaggtctgggagggtcgtattattgctcctatttgctcactattgtatcttcaagacccagatcagtgccagtcacaaagtagtcattttgttattcttgtttttaagttatagaatgaatacaagaataaatgaataaatcagcctaaatttttctgtatctggaacattcaggaaatgtgatagttaagaaatatgttaatgttttatgtgtgtacacctcagatatgcctgagaaacagaaataaccaatggaaatatttttattttagttatctaaatctttacttatctgtcttggccctaattgactaaaactatatctgattttttaaaaattctcaaatgtttgattcagtatctgtgcagactgagacacagacccaaagctttacagtgtgaatttttaaaactaaatcttgaataaattatcagatacataagcaaaatttggaagggaaatttgggacaaaagaaagcagttcattttagccttttacatcaatgggcttggaacatgacttccaaggaattgctggtgttccctggcagtgcccaatttctgaagaaagaagcaaaatgtaatctgcacacagtcaaatgccagaggcaatgtgagtattatgcaggttcaaaccaggtcagaataaaaatgactactaaccagccattcagcttgtaaaatgatagaagaactagttcttgcttattgcccttaacaaatattaaaaaataagtcagagtgtcagctactagatgcaccaagttttagtgctgctttatgggctagaagtgtttcaagtaagagttggctgtgatgtgaatttctgtaaattaaagcttagctttccacttaatctaatcaaagtaccggtaatatattctaatgatgatatgacaaccacagacatattgagatagtatcattttaggagaaaagatttgagacaaaagccaactccatgttatgatggtgaactagataatgttctgcttttcgggcactgtagttttcagtttgcttttagtttcagtttggctttagtttggatttatatttcacaggatttttcaaattgtattctctctttccaccgttaactataccccaaaacacgctagaatcgtaggaattctcctaggcctaagaatcttctcaagcaatattatttaccccagagtatttttgtctttcccatatgattgtctaaatatttaaatcaatgactgattttgagaaagttgctggttttattagcttattttccttgaaggctttctaagcctccattcctcactggaaaatggaaaggtataccgaaagttgaatcagtatgtgattttcaaaaacatgtatatacatgtattcaaatgtgtcctaattataaatgtttattaaaataaatatgattctactggttaagataaaccagattctctaatttccctcctttgtcttgccatgtagaatggtgagagtccatttggctcagagaatgttcagtttgaccttttccagtcagtttatctaaagcagcagcaatgatttccaatctcattataccccaggtcactgtcttattatcacatttattcccctcttcatacttatcacaatctttgttaattgtaactctgcctattttcctactgtctgtcaccaccatctttagaataagagctccatcatggcagtgagcatgtttgccttgttcaattttgtatcactgacatgaagagctcttagcacactcatcaatcaatatttgttaaatgagcttttcttggctgcagacaccacattttattgactggaaacaatgtcttgagccaagcctgaagagaagagaaagtcataatctttacattcagagttacttcctgtgtcccttcaacgtgattcttccaacatcaccaaggaacttcctacatgattgaagaaaagatagaaagaaagtcatctggagagttaacacatttcccattggtgctgaatattatctcctaatattctgaagatgtcatcaccaggtcaatggaatctcaatatcctaagttatatatagacatctgcatacatatgtacattatatacaaatacaatattatttaatacaaattatataaaagtatacaaattatataaaagtaaatttagtttttatatattttatatgtgctatatataatttatacatgcttctgtaaaagtgtttactatttcatttacgagcaaaatagaaaagttgaaaatgcctgtttttccctactaagggatgtggaaatagggttgcttcaaagacacattctagcacagtttaataataattactcaatcaccacagacaggaaaaagttaatttatttggaaactcaactttatataaatgttactagtatataccaatgacagtattacataatggacaaaaggataaatatttaataagtttgatacttcaggtacagtaagtaaaaatccatttttaattacataaattctttaagtttaaagttacctagtcaaatttatctgtactgatagctgctgtcagaattacatgtaaacgcatagacctctctaagtgattatgttgtattcttctataacaatgagattcagtaaaagccgtaaatgataacactagccaataatttgattcaaccaacacaaccagaagaagcctgtgaagtcaataaaccagttccatgtcttatatacaaaaataataggttgattgaatttttactttctgaatctgttactttgatacttattctagacattaaatatattttgttgattgaatttttgcacactgagaaaatacaatctaaatatagctggagggtcttttctatttttttccaaatttttcaggcctttcattcggccaaagcaacaattgatgtggtattttctaatatctgatacagcttttcaattttgtgtgtgtgtatatatacatgaaacacagattgttcaaggggaacagaagcctatgagatatagaaaccaaaggatatgccttttaaattgagtgagcacagtctttagggcctacagtttcaaagttttgtattagggaatggctgaccacagaaatttttctaaattaagtgcataccaactagaattacacaattggcttccgttttgctacttgaagctcccaccttgagctggtttcactcacttattgttgaattatagagacagttgtaactaaatttgactcttttacctcatccttttgaaattgtgatctttcttccatctccaaatataattttgcagaccatgaccttcaacattacttctgcatcataaatgtgattttggcatcttgttgcagaatgcctactctgaggccttaattctcacatctgatgataccctgaggatgacatgtgaggccaagagggagtgaagcctcatccccactttgtgcttctttattaaccaggtaacagttatagtgttctttgtcatctggtcaacatcactaatttatcctgtgcacaattggaggatcacctagtccaactgcctccccactccacaatttgtcaaagagctaacactcaatgaagcaaagtacattccaaaaatcacacagaaaattaggcatggtacctgcaccaacacttaagtatataaatcaacgattatctagagaagcctggagtgatgggatcattgagtttagaaactaagaacatagctgtgctggttttagagaaataaagtcactattcacctattctattttccttttccttttgagtgccaacatcctcctgcagatgcatatatttatttacagagcaacatgcttgtgttagctgtttgtttctaaagtttttaaaaaaatgacattagaacttccaattttctctttagcaacccaaacacatttaaattataaattgaaatatattgcacttttaatagttcaagctttctgagtactattcagttccataaaaccattttggataggtaacttttttatttcttatcttctctaatcttcacttcaatattggaacaactagatatatgccttcttttgtttgcataatttttctttttagtgtttatgtaaatacatagaaggtaaaaattagtgaactatattcaaggaagggtgttagaatactaatgtagctaatgctgtgcttgggaactacttagggagaaatagattggtttaaaaaggaagttatagaatttaatcaatcttgagagaccagcagcatgctattgtggaactataactttagagaacatctatatgacagtatgatcaccaaaaacttcagcatatgctgccaagataatgtgcatattttaagtgcaagttagagggctccaccttccctttttgcctgtggtctcctgattatagcactcaaagtattgcatctgggtaatcctccattcccaggcgacttgagaaatttgatcccgttggtgtgaccaaaatttccaagtgaaatacagaaattgtaccgtcttcatgcatataggcacaggctggggaaaggtttgggatgacttttggctttgccctttcctgttttgtgacctacagtaaattacccaactttctgcacagtcactttgcattttttcgtaaaatgtgaataataatgcctttctcacacttattttggagattaaacataaatatgaatgtgcaatgaattctaatatgcaaagtgctatatttattaaatataagatgttttctgtaactccagcaagtttccagtgtcaatgttggtatatccaacacttcctacatgacatctgctggaggcacatgtctataactgaaagttaaatgtatgtgacttctacatgaatttaagtatgaatttctatatatttatcaatagttattgatttcacgtctcaagtcatgcttttgaaaactatttacatcaagactctattcatttgtataaaatagtttgttttttaaaaacagtttttcaagacttttataaaataatatccttttgaatagatacatacatatacaggtaaatctagatatatttttaatgttgagtttaagaagtagtttaaaaagcaaatctttaatttttagtgtgatttatctattaaaagtcctgtcttctctatattctctctacttaatgaaaaagccgattgcaaaacaagaagattgattaggggtaataagcttggtattctagtaataaaaatccttgccaaagtccaatctttacacaggacattgactttatttcaaggccaatttctaaccctatatctaaaacatggcaggggtttaatcattgtagcagatgctgtctatgcccttagtgaatctcctaccctcactcccttcacccctaggatttgccactgtaaccctgaaagataacacggtgaaaacctaactaagtatccctgactgaaggctattttctggcctaggaagcgtgctttcctccaagcaagaaaaagcagaagtgcctgagagttaatgctccccagagcaactctcaagcaattatagatggggaattgataaataaatacccatctttctagccccgttgttgagttcctgagcattgttctgcaccaccttccagtggtccccagaggaactgagatccagttgatgacactggcaaatggcttgataacaaaccttcactggcttcattctctttctgagtaacccactatcctagcaatgtttcttgggatcccaactaaacttgcattcaaatccttgattcagaatctattttgggggggatctcaaatgaagacaacaatgtttgatcagtacatcaattgacatgtatgaaaaaatgtgcacatatgcagacaagaaagcttctgcctgtctgtgtcaaaataggaatgatttgtctttctttaacctggtttatagcaactattagaaatggaattcaactaagtgttgcaagaagtccatcatttataaattaagatggaacttacttactgtactttgtctccagagattctttgagtgtaaataacatagacaaaatcatggaatattaagaatggcaaaggaactgagaactctttctcacagctatcaggttgttccagcgaaataacaggcagaccctggagatgttccataaagctggctgctgctaaggtctgctctgatacctgctatgtgataaaagttcctgacacttagcaggagttgatgtcctggtattccacctgcaaatggtaggtctgcagggcacaccaagcacgatgatattcatcctggaaatgtagtgctgagctcagaagtaagtagggtgttaattatccatgactagtcacataaaatcatgtcttatactcagttctggcctggaatgcagggtacacaaagggaggtactcattgataccagcaggagctatatgcaagcttccaaaggaacaattagtccttcagtgcctcattcaaaggctgcttagggggttgctctccttgaccttgagttaatgggagtatgagtgttcaatgaatggagattagccccagaagacagggaagcaaattaaacccctattttgatttgaattgggagtgaataaagtgttcactgctcactaaactcaagtgaagttaacatgcaggaatgaatggagactaacttctctgtgtggcaaggaagacctcaaggcagttagcacctgggaacctccagggatagagctgagacagaggtggtcattcatcattctctggggtgataagagtttttcagtaaatgctgtatcaatgtagataaatcttcctagaaccaataaaaatgccctttgccttttctatcttctgttacaagtaattgctattcaccttgttatgaatatcttgaaagtagtcacagagtacttggagtgcctgcgggatggaaagtttgaaggaaaaatgtagccgtatatcattggcattcatgagaaaattcagattagatgtttgaaaggcaggtccccaggaggcaatagagaaatcaggaacaatattgtgccaaaaataccactctggccaggacatcagggagtttatgtcaggtagagtgaaggaaagcaatttggaaagaaaagatatatgtgcttttctatatgcatttagtttatttatatgcgtacatcctctgaaaaactagtatgttctgggaatcgacaagcagattgggcctgacacttctaaaatatgtaactgtgtttatgtttcttttactctaaaaactctgaataacatcttgtaatatgatcaatactttttcaaactcatgtcttttaaaaatctgtttgcaaccaataagccaaaaatgggatgtgctcaaatatcattttacatttgggaggtcaagtttatgccattggactttacgtgcagattacaaaatattttttctttctaaagacacacctactctggtgtcctaaaaatcagttatctcattgatgacacaccagagatatatgttttttaaaatgtgggctgggtatggtggttgaagcctgtgatcccagctctttgagaagctgaggcaggaggatcatttgagacaaggagtttgagaatagcctgggcaacatagaaagaccctgtttggggcaggaggatcatttgaacccaggggttcaaggttgcagtgagctgtgatcccactactgcattccagcctggataacagagggaaactctgtctaaaaaataaataaataaataaataaataaataaataacgtgaagatgttgtggatgatatcatccttgctgggggtcactttactgcacaaagaatttcacttctttccctcttctagagtgtttgaataacagtcacttgacgacagttagttcagcttaagcctacttacttttcttcattccctttatttaaaaaagtcttatgtgtctgctttcaaggagactctcctgaattctatcaagataacaagaagaacaataactcaaaattattattgcttctgagaggctttttctataatatacctgaaatacatttaaggcactcataagtagcaaccaatcacccactcattcattgaataaatataagttagtgcatcatgtatacaaggacacatacacaagatcctgaaaaatacaccaagcaatatgccgaaaaaggagacgtgccgcaaatattttgtttattcattaaagataaattgattagaagttgaaaggaaagtggaagtacttttaaatgaaggtttaatgaaaatttcgtagaataaggtcatcgaatcttgacaatgataaaaattagagaattccaaggagatggaccaacataaacaaagataagacattcttcaaataacttgatcttttcaatttggttgttttgtacttacttttgtagtaataataataataatagcagctagtatgtattgagagtgcagactgcctataaaatattgttctaagcaggttatatgagtaaacttatcctcaccttaaatgtggaaagtagctaccattattagccccattttactgatgaggaaactaaggcacagaagagttaagtaactcacacaaatccttcacctagtgagagccacaggtcagatttaaacactggcagcctggctgtatagcatggactcagctgtgactgccccctcttgaggcgctcatggagccagtcagtgactttattttcttttccattttcctacagacatgggtagactgacaaagtcaatgctgtcttggatatgtgagctcagggccatgcaagataaactcctagattaggttggtagctatgctctagaattaggacttctgattacatcatgcagggaaaaaggattactgttagggaaacatgtgttctcatattcttctttccttcctcggatcctctaagtctaatcagtagccatcaagactgaagcaaaggcagtatctggagcaacagcctgctgtggatctcactacagcccttcccttcctggatgttttctcaaaagtaccttcacaatcaatcggcctcctgtgctgtaagccagttaatcttttttttcagactaattccaaatacatatatccaggtagctaacaataatactgtgcttcctgtaaataatatggaaagaccactcactgtgaagtcaaaagatctgggtacaaggccccgatcgaccatataacgtctatgtgcttttgatccgttacttgaagtagtgttatattacttggaagtcggcctcctccttttggccacagcatctcgacttttatacttgtcgttactgagttgcctgctctcccatctcaatttggaaatctgagaccagagttgttgctccatttactcaactaatgttgctggtgatagatagtagggctgtcacggagtcctttggattcctggcccagtgttctttccactgagctagtctcctacagtgtgctctgtggaacctaagcccttggggaagctctgcagaaggtactttttcttccctctaaatgtgattttagcatcctgacataatcccctccacactgctagtagcccgtgatactcttgcctagacctggatacaaattaagatcacagttttgtcccaagtcacctacattcagagggtccaaaatgtaaaatgatgcttttaaaagaatatgaagaatttatcctctgtggttacaggaaagttagctaatctccctgaacctgagttttgttttttttgttttttgttttgttttgttttgttttgttttccgggtagtttaaaaaatcaaatgagacaatttatttaagaaagcatctttcacattataaatcagtttacaaaagcagggtactatttatataaacatgaattccagatattggaaggtggcaatgtctgctgttagtaagaatgcaggaagcacacaagcagtgtggaaaaatcttagataatattttagtcccctgcccttggagaaatgtatcatgaggtcagtgggtgaatttctttgcctgcaaattgtatctcctttggatacaatttgcaaagggctgaggaatgaggttggacccccatgccccatagcacaaagtatttctgctcagcagtcatgtattttgcaaaaataacccacccacaacgaagtattgcctgatttaaggttctgcaatttctaaaagccagggcacttaagatactgagatgaaataacattccctgttcccaaatgaataatgcattttctcactcttttttatttttattatttcaaaattcttgcctctcttttgcagagaaatttcccagagttttacagcatcactgttgacaggcaaccacattttcctcccaaggcgactcctatttctgtgaggtcaagattgacaatgggagcacatatcaggggatgggttgatggaagagaaggcaaaaggtccaattgtccaggggctgggtggggaccgtgaaccttagccaacagaaacagaatggaatcagtgtacatcctgctgtcagtgctctgtgattattttcccctttccttctcctaatggataagcttggaagaaagtgcattctttctcaggagagagctcagaactgcagggttttactgtatttattgtgctacatatacatatacacacacacatacataaatacactgtatatacactacatatatatattagtttcaataattctttcctaggtaggtcagaaaattcacattgctatgcattattaaaaagaagttatgaggccaggtgcagtggctcacgcctgtaatcccagcattttgggaggccgcaggcgagtggatcacctgaggtcagtagttcaagacctgcctgaccaacacagtgaaacgagtctctactaaaaatacaaaaattagctgggcacggtggtgagcgcctgtaatcccagctactcgggaggctaaggcaggaaaatcacttgaacctgggaggcggaggttgccgtgagccgagattgcgccactgcactccagcctgggtgacagaaccaaactctgtctcaaaatagaagaagttatgccatcgtgtgtggttagagagtcactgattggcatgaaagcaattaaaacccacccaattttcctgaccacttttataagacagagaaaatttaataagttaatcccttatggatatcttgggctctttgaaatttagagagctctattacatcctttattaattgaccctaaaaaaattaggagcagtctgtgtggtaggtagtatggtcacaagatttacagtgggcaacccaagaacagagattctaagacttactcaaactacattgttagctattgacacgattaggactctaagacctctgttattcttgtccatggctctttccccttgattagactttcccaaagtgtgttctgtgaagcgttcactgttggaaaagcactacagaaaaccgaatcccatgatcatggaagtttgggaaacagtgcaggctatacccctgtcttcaagttctgtaatgtacactggccctggagagatacagaaatcctgcaggaaaggaactgttttgccttatttagccttgcattttgcatattatttagctgcatggtgctttttttaagccccataaacacactgtaggaagccttaccctgtgccatctagctttataacaactcagggtgggagtcctcaatttgcacctctaataagtagaaatgtttctctttcaaatgttcagatttgagcaaaatctcccagagtaagctttcggcaaaattgtaaagtctgtaagattggccatcgggatgaaaaacatggactcaggattctgatgatactggtcaaatgagggatttttctgccacttatcatctgtgtgcactttgtccagttacttagttcctcccagtttcagtctcttcacctgtaaaatgaaagcaataattgtatacctcttatttgactgccgtgaagatgaaatgaggcagtgcatgtaactcctggcatagaatctcgcttctgttgggtatttgaaaaattctattattactattattctcattatcttccttttcagcctacctcctggcaccccattctgtctcttcctcctcctatttttctatcttgtcacacaatcttaaaggactctgcttccagctatcttgcttacctggtatagtgtagagatggtatacacgatgccttccaagactgggcaggtaatatgaaagagtgaagggaactaggtgtgagacaatagggggtgtcccccaaactatggcaaacacttgtgttaaagggccagtcactccggatatttgttgttgttaatgcctttttgttgtacttttaccgcatggaaatatggactagtgatgccaaattttcagataattaatgagaagtcaaatgtttatttttatatgtaattttccaatttttaaacactctttttaagaatctgttagactaccagttgatgacccctggatcaggggatttttagcatcctgttcctatatagtaataaagagctgcaaatttagaagtgtttaagaggtcatctagttgaacttcctacttgatcagaaatattatttataatatactagaaaaggtgtcatttatctattcctagtcagagagaactaagcatctcatggaaaaaaacattacactttgtatgtacaaactcactgaattctcttatgaacctcatgaggtagatgctactttttccattgtaattatcatgtcatccaggctcagaaaactaatttacttcttctaaagtcacaaagctattaagtgtctggtagattttaagaatggaattccagactgtttaggtttcaaagccagtgcacttaaccactggctaaacaattctacttgttaaaatgctcagggctgatattaagctgaaatttgctgccctgaaatgtccactatttggtcccagttttgctctcctgagacacaaataataagtttaatctttcttccacaagacagcccttcaaatatttgaagatgactctcctctgcctgctaaatcctctcttccccaggctaaacatactcatttcttttcactgaccctcataagtcatggctttcagccacttcatcatccttgcactgctccccaggagagtatttcaatttgtcaaagttcctcttaaaccgtgatgctcggaagagaacacaatccctctgtgtagttacacaagtgcaggtcaggatggaactagcacctccctggttttggccaccatgcttttattaatgcaacctaagtcatgccagatttttagcaactatgtaaaaagaaaagcaaacattgaatattggtccaacttcacactatagaattttattctctgctttttttttttccaaacttgaattgaaggaaagccacttttactcactctactcctacccaatatatttaagcaggtcatttttaaaactcaaatacattacttagtatatattcttattaaataccatctttatttatttactgttttggccgatactgatctgttttgttttttctttaatttgacaattatagcaaaacagaagagaaagaaacattttctgtagtgtgaccactttttcttaaatacattaaaaaagggttttttcctctaccactctaatattgctcacagataaatctatttatattttcccaaaaacaaaattttagaaagtgctttgcacacatttctgttttaataggaccttgctatattattgctttgtttagttttttaaaaaatttggaatatatgaagaagcaaaaacactgaaaaaatctgctgcttgccattttacttacatatatgtattatatatctatataattatatgttatatctatttgtatgtatgcatctaccttttcattcttttcattccagatatttccgatttctgctatctgatatactcactatctcttctagctttctgtgattctgaggttaatcaaatattcagtaggattgggctgagaacttaccactagaaacttctctctaggccaacctttagcccaggggtgggaaaactatggccatgaattaattattcttcacctgttttttgcaaataaagtttttattaaaaaaactgccacttccatttgtttatgtcttgagtaagactagttttgcattctaatagtacagtttagtaatggcaacagtgaccaggctggaagtatttgctatctagtcctttatggtcttttacagaaaagatttcccaatctctgctttagtcattagtaagtagtccctgcattctgttattgaattcattgctgagaattgaaactagcataaattcctatccctgtactaaaccgcactgaaagcaaaaataatttagctacttgcttcaggaaattcttgcttctagaggacaaaacttacttttcaagaccaacatcatcatctgtatcaagagcctgaccttcttgtactcatcaaattaaaactattatgccctaatctctacccacatttaatcagctcctcatcttgcaagaacaaccttaaaatcacctaacccaggtcacgaagccctaaaaatattgttttaaaaaaaaacttcagctgaattaaattgaaaggagtttaattgaacaatgaacaattcatcaatcaggcaacccctgattctggggcaaaccccagaatcacagcagatttggagagactccagggatacctcatcatcagaacaaatttgtagaaaataaaagggaagtgacttacagaaatagaaagcgaggtacagaagcagctggattggttacagattggcatttgccttacttgagcacagtttgaacactcagcagcgtatgactggttgaaacatggctgctgggattggccaagactcagctattgtttcaggcacatgttcctaagttagattttcaatcttgtctacctattaagtcaggttactgttggtcctcaaggactcaaatatagaaatatgtatttcttcaggccatttctagtttatattaacaatatcacccacttatttctccttctgagaaagtattacaactatgccaagttgtattctccctgactgtggaaagtctagcaaacttagatttgtccaatgaataagtatttcttgtcacctttttaggaacggaaagtcaacactacaaatcctcaaagctatagcagcgtcactcatccacattcttgtattctgatttatataaatacaaagagcatttctataagatataattacctgcatattgcagatagaaaaacaggtgcacacagaggctggagctatgctttggtgatgtgtgcagtgccccagatcaagaggtcacatagtagggggggaccctcaatcagggatctgccttcaagtcccaggtctcgttctaggtcatggactaaattttatttagttaactatcacctatatatgtaaataatggcaactacttatctcctctaggcctcagtttcctcagctatgaaaatagaaagctgacttctattatctatatagtttctttcaattgtgaaattcactgaaagtatgatttttcagcagtcttaaaactaatttcttcacactagtatctttcagcaagacttcatggcctcaagcaaaaggcatatgagagatactctcttgatgactgagttaagttctacagcttggtttctctgattaaaaaaaaattgtagaaatgattctgactatttccataacaaacatatttgcatttatttcatgctgttaacaacttaacatgtaatcatggctcctctaggaaaagcagtactgcttcttctatgatcacattaaacacgctgtgttacgtctttctactaatctatcatctattatggctgcctattttgagagcttggcataacaattatcataagtgatagcattatattctgaaaacaaagaatttgatggcacaatttatcttgctacttggcctaacttaatggtggtggggtttcctagtctgtactatatttttctcagatcacaaatagttcactttttaatttattattgatttagcttaaaagtaaataactccgtgaatgctaaagttggaaatctgttataaaaattattaaaaatcttctcttccttctggccatggatgtttatcacactgaaatcaaactgtggagctacctgaacaaagtgaatttgagatttttaatttatctggtgtaattaactggtcaactaaaaacaaaagggcaattagtgctgcacacatttgttctgatgatgaacatggcaactgaaaatggatcttgatcttcactatgaaatcctttagtatcaaagcaatgttgctgtaaataaggggagaacgaagcccgtgaggagtcacgcacttgcaacaatgatgtcctgataaactaaatccacaccagtaagacaactagagagagaagttggccaatatttcaaagtaatattcctccttgaccattctactgccctgtacttgaacagcaataaccaaagccttttagtagtagtttctacttttcctgctaccaatgtgagaaaatcatttcatgtactgcaaaagaggtaagaaaaaggtataatttgtaattgacctgaggatttccataaacagtatgtattaatgcacataattctccagcgtccaagtccatgtaacctagatgtatttatagaaattaaaaagcacaatgttgacagaattggacaagaataattttctattttcccccaccatagagtaagatgttttaaattattttagacattctctgtagcttctaagttaggttgggaagtaccaacccttcatgagcacctttcagaagcttattacagagctatgcatgcacatctactctgcctttttattcaagaaattgaccctagttctcactggaaaaaataaagttggaaaactcctctgtaaaagatagataagagaataacagaggtaccatctctgtttaggataactctcattgtctctcaagcctgccggacaaaccaaggtttaacatggcagccaccttccagaattttcctgatgcctgaggtccagccattatttgacttacacatttattcctggtttactggcaattgtgcacatttatagactgacgaatagttttagagccaggagatggagtgagtgacaattttccattcctaaaaaaaaaaaaaaaacatgattattctgaaccaaacaaagaaactcttaatgttgtttgggttaagcataattagcactgtgtataacctcactgtcacagcaataattgctgagttctttcatctgccttctgggatcagaagcaagtcagtgatacatggtgagaagaggtcgtataaaggcagggctcacagtctgcagctacttcaaaatacaggactgcatctttttctactacatagatggtattcttgttgagtacgtatacactgaattagaaaaatacagttggataatcctttaacagaaatcttcacagccaaatatattttagagtttagaattcattaaacgagagatcagcaaaagaaaattccagaagctcgaaagccagaaagggtcagataataaatattttcagctttgcaagccatatggtctctggagcaactattcagccctgcctttgtagcactaaaacagccatagacaatacatcaataaacaggcatgttgggttgcagtgaaattttatttaccaaaaaaaggcaaagagccagatttggtcagcaggctatggtttcctgacccttgttttagcctttagaaaggcaatggggtacgaattcgtatgtatttctatatatttataaatttgtgtgtacaaatttatatgtatttttatttgcatgcatatacatattatagacagatatgtacattaaagatacatataaatttgtgtgtgtgtgtgtatatatatatatatatatatatatatatatatatgtatatgcccaatgaacaatacacttatcatcaaccaacatctctgtttcagcagaaaaatacatcaatatttataataagctgggtaaaaagatctaagcaaccacacattgcttggtgtgtattgcctggggacagttctctgccaccaaataaattttgctaccaagctttcatgtaattttcaactttcagagattctttttaattgcaagaaaagtgattatagacctgtacatactctttccttgaagtgtttgaaattattacttttgtactgagcaatttcatgcaagaaaaagtaaatacacgttagtttatgaaccaagatactcactgctctgggccaaattatcatttaaaagacctcatctaaaacaaaatgctggtgatacatttttgagactctttttaggttctagaagtttctttaagttagatttatatactggttttcctttattacaccattttgcctcaagtgacctgtaggattctaggaacctagaattaattcctgtggctattttgcatgtcagtgactagcagaaattttactcactgaatatttctactcgattctgctgtgagtaaataactacacttttcttaactacattgttgtcattgagccagagtattctccttcctcaggcaatttaaactttcacaaatgaaacttttacaaatggcaacccatgcataaatattagctatttaggctagcagtatagaggaatgccaaataaaacatctttcgggctttggcctcattatagtatgctgataagcaatcagatgataaagggcaacatttgctatgaaattatacactggatggaatcaaaccatcttagaatattagagctggaagaaacttgaaggtgacttctaggtcaaacccttcaattttcaaaggaggaaactgacaatcaatgtgattgtacatgaatcactcaatgttactcagctggttaagagaaagagacaatagtagaagcaaaatctctagattcccaatgtagcctttttctctgtaccaccaggttgttcagctgtcaaatgcaaacctagctcatgcttgctgaatagctatgagctctgcattagacaccacgccgagtattacgagtaagtgttacacatggtgtttatcgtcaaggtaaaatgcaaaacccttggcttttggagtctttggtaagtgcaagccttaagagaaatacattgagtcagtgtgctctagaatctttaagagaaacttcatataaatttgagataaacgatacaggggactgggcactgtggctcacacctgtaaccccagcactttgggaggccaagatggacggatcactggacatcaggagttcaacaccaccctggccaacatggtgaaaccctgtctttactaaaaatacaaaattagccaggtgtagtggagtgtgcctgtaagcccagctactcgggaggctgaggcaggagaatcacttgatcccaaaaggcagaggttggagtgagccaagatcgtgccattgtactccagcctggacaacaagagcaaaactccatctcattaaaaaataataataataaaaaataaaaaataaaaaaagaatgaaggggcttggggcttgtcggattacttaggtagaaggagacaaaaacaaaatacaaacaggactaggcaaaaatttgtcttcttggctcaggtaagatgtttcatgattctacggtactgggtatgattctaggttctttggatgatggaatgaatcacagtaacactcagatacagaaaaagcagaactctgcttcttacagctccaaatgaggcaaagggcacacaggaaattgtacccaggaacagaactacagcaagcggggactgttggaggtagcttgcgaatggaaaatggcatagagatggctaggctttgcaggcctccggaggattgggtattttaaataattttctagcccaaggaagtaggggctgtttttgggtgttagagatttggagatctgtggtatttgggtctatgtgtattataacccaggattattaaagcctaataagggatatatttggggttgagtcttagcaaactgtccatgaaggggaactgaaagtttttagctgtagctgcaaactttcgtcaagataacagttgtgagatataccagatcaacgggtttattatctcttgatgacttaatggagagattatacactttttctgataatattgacagaggtcctggcttcgactgccattggtttcaattaagcaatatgctgaattttttacaaaatattatagccaaagaaatagataactgattgataatgacctggtcatatgcttgtccctggagcaagaaggtggaggcaaataactccccagctgtattgtctgatggtacatagggagatggttcctcaaaagaaagtcacagaccttttatcacaagaaggagacagaattattgggtaaaaaaataatgaatatccgttaaataagtgtaccatgtaatttacgttataagctgaggcttttttgagaaaaagagtctattgataattctgccatgacaattggatacatggaaactgtccagtgaaaacaaagatttatggccatgctaccattgtataggtttttagggagatacagaccctaaggaggaattctatgcaaattaaatgacatctatatagagataatacataatgcacgtgcacaggaagtagatctttgtcactagattggaaatatttagtagtagtctccttggaaaaggaagattagaaacctattgtgcatagtcttgaatatcattccaaagactttggatgtttgtgaaattgaaagtgattaaagtctccattgcataaactggcataattggaccaatctttgttttaggaagaaaattttggtggtaatatttaaatgagtagaaaggacaagagatttaaggcaggaagactattcagagatccaatttttttttaatcttcaaagccactactctatttaaaaccttcattattcctttcttgtactacaaaagtagcctttaattactctgtataattccagtttttactccatctctttcattctccacggtagccagagatataacataaattttgattctgttctgctcaacattctcaattatgatctgaaagtacagcattcatatgcattaacatgacctaaatgtcttgtatatttcagcctctttccctttctccaaccttgtctcatgccgcagttcttctgaatatcaaaccggactttctcatatctttgaacaggcaactcaaggcttgctataggacctgagcccactgtctctcttttgtttaggaagctagtctcatccttccttcatacctattgtaatccctacagctctgctgttttcatcccatgtacacacactctttgcctggcaaagagctactcatatttcaagcctcagctaaaaaatgctaactgaattccaccctataaatctcatacatattacatttttctttaatattatcatatttactacacaaatattttcctgtgtgcgtaaggttttttttgttttgtttctctgtttttgttaaatgtctcacaagagaacagtgcctcaaaggtagaaatgaaggattttaggctcaccattaacaccatagtgcccattgtcttgcaaagaatgtgattatataaagaaacaaacaaataaataaatgcttatgaaaatataattaatgaatgaatagatataacatatgatctaatttatgtaaggcattaaaggctgtggtatcaaaaggaatggaaagatgatgtcagatatgagaacatttgagaaaaacattgactcaatacctatgttgacccctgaatattgtttatttttcctgtgatttttatcctttgattaaatttggaaagcatttaacttaaattttatttaaacgttaagtataatcaatgtttttggtttaagatgaagtaactcatgacagaaagaaatgatttttacaatttaaaaatacatcaagaaataaaaattttattatttattatcatcacacttaaactccatacacttccaataaatatttaaggttgcaagaaaatatgtttccactatgttaaagtttccaaaggatcttatcacttgatatataatagttttatcaaatgtaacctactacatctcttgatagaaaagctgcaaaattataccataaaaaggccatagaaataataaaggcaataatagtggctgtttttgtaaacaatcaaccatagtctgttacaatcatacagttcataataactgagcttaattgtcaagattaattgttgagcttacctacatgagttgttacagaacatggacatagataagtttattctgagcttattctaaatttttatgagtttaggagtttttatgaacctcttattagatttctcttttgggctaaaggccaaactaacattttatcttgatttcatttatcactgcatagcttaaatgtcaaaataaattagagaaaattatgatgcaacccccttaggaaaagcaagtctcgtacctgaaagataacactgctagaaattgatttcttgcagaaattttgcagcacaatattaatttttctcttgtgatattaggacaaataatgttttctaatatttgaggtgtgaattgaaattaagaaaatatgagctgacattactggaactcgcagaacaaatgtatgtgtagaaagcatccatttaggttgctttattttggataataatattaatattaaattgaattaatatgcaacaaaaatatgcttattaaaatattcgtgtttgtacgtttttcatttcatgacaattttgtctttttcagactcttgagatactgactggaagatagactgttttgttccacctgattgtatgggagaaatttttgaccttagaaagtggaaatgaggttgctatggaaactggtaattctgctgccactcataaactcttctgcaggtaaagtgttctattattataagttttgattgataaatatattggcattgtatttctttctatgggtgaagcaattttcaaaatgcacaatttgtatgttatttgaatgactaagtgataatgttttgaaggtaacttctatgactcagacagggaaagtttaatccttaaaaatgtatcaaatgccagttttaaatggaaactaacattattacatttataaattggcaaatatgacatttttatacaatgtaattatgtaatatttaattatataatatactatgacattttaataaaagaatgtaattaaatatttttatcaccaataaacagtgaataattattcttattttcattatagtgaagtctttaaaaaattaaaattaaaatacatatttctctcatgtttagaaattgatatggcaaaaaaatcaaagctatattcatttagaagaaaagatgatatagaatgttacctcagaactagaaataaccttagatatattttctttttaattattttaaaagaatagacaagaacatgttcttttattcaacttgaacatattaatatctgtgtatcagttaacttttgctttgtaataagccacgccaaatgtgagtgtaataaaatatcaaataatcatgtatttagttgacaaatctgtgggttaacaacttacgatgggctcaaatgggtcttcttttggtttttgcctgggtgcactgcaacttcgatgagctgagtcatctgagacatgactagtctagaacattcgtaactgagacaactgtgctgccatggctgtggtccaaatgttaccctctgtgagtctgggttcttttacatggtggctgctcagggttccaagaaaacaaaagacagaagaatgcagcatttcttgatgccaacgcttggaactgctacattgccatttctgtgagttattttgacaattataagtcacaagacaagttcagctttaatagatgtggaatgacactacatctcttgatagaaaagctgcaaaattataccataaaaaggccatagaaataataaaggcaataatcgtggctgtttttgtaaacaaccaaccatagtctgttacaatcatagagttcataattactgagcttaattgtcaagattaattgttgagcttacctacatgagttgttacagagcatggacattgattagatcatatgattatcaaagaagcctctcttctaccataccatgcttcttccccccgactatgtgttgataggtactagtgaagtttcacgtacttataacaaagcagtaatacattgacagacatgcaggaataaacataatttaaaaggcagaaacacagtaattgtaaaggacatatattttatagcaatcctgagaaatagatatgctgatcttaaaatgaatgagaatgctaaaatatgcagaaatcaaacaggagaatcagaaaaccatacaaataaaagcaattttaccactagcaaagctagcagctagaagtgccatagttatatttactcaaagtgattacagtattttgattggtgacacctctaagtctctgtaacaaagatttggggttaaataatagtgtattctttttttggtaatagattaagaaaagacagagaaaactcatcaaggtgcccccaaatcatatatgtgtgaataagaattatattcctacccttaagtttcatcttcctgtcaaaattcaacattaacattttgccctttaaatatgtatattgaattagcataggatctctaaaagaccttttgtgttaaattaaaatgaattattagtctcagaacacgtatcaaatctgagaaatactccagctcttatattaacttttatttatacaaactggatgtgattcaacatgtcctgttgctttattctgatgggagaaatcatcatatacccttggtgcacaatttcattgtgaaagaacagattggatctattaagtagccatagctacttaaatgagataatctaagctaaacattgctccagaggtaaggatgttgataatgacatacacaagacaacactgctttaaatctgtttgttttgttagacgtttcatggtgtgtctccctattcgcagatactattttagtttagaaaattagattgtctgatgatagagttctgtgactatgcatagtgataatatcttgtttttccaaaacatactttttattcattctgaaatgccagcaaatctttcacaattacttactttttccttgctatttgaattattataatttttctaacaggttgatactttaaatctccctagactctaaattaaaacttaaaattttttgacaacctctcccctcattttctaaaaattaactacaacttctagtgcttttactatagtcatggcctcataggcctttacaatgaaacttaatccatacagtcatacatgattgattctgggacacttttaaagttttgagtacttaaaagtttaattgttctattttagtatttttaaaatattagaagaaaatgaaggcccatttaattaggaaatacagttaataattatatactttttaactgtttcattgatatgcatgacaggctaaataatggccccaaaagatatctaggtcctaatacctggaacctgtgagtgctacttgatacagtaaagtggattttgcagatgtgattaagttaaagatcttcagatggggagattaaaatagccctggactatccagattgtaagaaggaggcagagttagacctgacagaggggaaggcaatgaggcagcagagcagagggagacgtgaagatgctgcactgctagacttcaggactgaggaagggatcatgagccatggggtgtgatgaaggaagctctagatgctgggaaaggcagggggacagattctcccctctatctgtggactgagcatggctctgcctgcaccttttttcagccccgtgaatcccattttggacttctgacctccaggactctaagaaaataaatatgtactgttttaagccataacatttttggtaacttttatagaagtcataagaaactgaagtttcttcctcactatgctttaagcttccagatggcagggactatatcttgctggtacttggtagggattcagtaaatatttgttaaatgaatgaattaattaattaccaaaagttaatgttgtttgttctatttatgttatcacagtagaataaatttagtcatataatatcctctggggaactgttagtctggttcattcctttatggttgccagtgtgtattaaagttacagtcataagtttctagaaatagaattgtaataacgttttaaaagttttaaatcatgccgtatttgaaactctgtgagggcaggaaatttcatctggtttatgctttactgattctccatcccctaatacacagattctaaatatttgctaaatgaataaaagaaagcagcttcattcacttcaacaaatatagaaatatattagaaactatgatgtgccaggcaaggagcttgatgttgaccttcaacaataggtccatagtccctgccctcttcaacctgacagtctaaacagggaaaccagcaagtaagtccacttaaactgagattctgccccttgtgacaaaaaagttcttgactaatacagctttaaaaatttggttttgaggttgagttagtaacagaactctgctgggataaatgcttattcactaatgaaaatgaggaaaagagcaaataaaagaattttaagaagtcacaataattcctggaaggaaaaaaaaatcaagaggtttaatatagactaagaacgtttattctcagccctgagttactgaaaaatctacatttcttaaagtagaaaaaatatgttaatgagataatttggataaccaaattaataaacggagaaaaacttataactgtaagtctactttttgtctttgtagacaatgcacagattgttttcatgaggaaatattttatttatttatatatttgtttgtttgtttgtttgtttgttttttgagatggcgtctccctgtgttgcccaggctggagtgcagtggcgtgatatcagctcactgcaacctccacctcctgggttcatacaattctcctgcctcagcctcttgagtagctcagattacaggcacgcaccaccatgctgggctaattttttgtattttagtagagacagggtttcaccatgttgcccaggctggtctcaaactcctgagctcaggcaatccacccacctcagcctcccaaagtgctaggattacaggcatgagacatcacaaccggtccagaaatattttattttttaataaatactgaacaatgtcagtaatgggtagaagctgaaaaaccacgtagggtcaaattttgttgaccctagaatgtcacctgcctaagaaacccaagattaactgatgtgattaactgtcacattttcccacagtgaaaaattctcagaatgcacaagatgattctattttattaaatctttcaccttaccatggcttttatgtacaatttgaaaaatattagacagatttcaaaatttagttccaatctttaaaaatttgataattattaaaaatgtttaataaagacttgatgataataggttgaatcgtgtgctatatctgttcttatgagttaaccagggttagagatagcacaattttatctgcggactattagaagatctgcagtccttaagaagagtgtcagtgagtgtcaatggctgctattataactcaaacataataaacaatagcagaatagtagttacaaggagtgtgattttcctgatactaaatattcatatcatcttaagaatttctgcctaatgtattctcttttaacattcttattttaactaagtactactatttaaatggtagtttataaaacattcacttggttcataaatataaccacttttttgtcatttgtgtttgttttgccatgggttaaggacttttatatgtattttatgaaattacggactgaatacctatttggttagtcctgaagaagtaccagttattcagtatgagacttggttttatcatgaagaagtgcaataattcaagaaagtcaacatagagctagtcacatgtattggcagactagaatcaaagccctccttgagggattctaattattgtgttatgccaacagggcctaatgagctggtttctcctactgtattaattactcttgaagaataaactgagactcaaaattataataagtctttgcagccatcatttttatgtaatgtttgctgacaaatgtggttatattattttcaaaacttctcccaaagtagttgacttttaacactaaaataaagttgtttttagggctgatacccataaagaaagaaaaaatctattttgtcagtatttttacatagcttacttctttataaataacacagcctgaaagtgaatctgggagaaactgtcactctttctaaatactcacagtcaggcacctaggaaaaagggacattggaaagtatttatgattgcttgaatttcactctatttcaaacatagccttttattgaattgagaggcagagcaaacgaactacctgagagagaaaaccagaagaatgaaaatattcactatgaccaagatttcttcaaagacaacgatgtatcacacagcaaatccatgaaaattggcaggtgtaataaacctgctttgctcaaggatcccagaagcacatactggatattcctttgggtcagagtgtgaatgaatattgagtacgtcacaacccacactctgcctacggtcttgtttggatttattgttagcataatagcacctttaagaatggaacaccaggctgtatttttaagccaagtgacatcttcgcaatttctaatagaaatggtccaatttagaaatgctgaaaacaccattttcatgcaatgcttactgataaaggtggttatatgattatcaaaccttcttccaaagtaattgattcttaaaccttaaatgaaattgttaggactgataagaatgtaggaaaaaaaattatgttttgtcagcactggggggaaatgattggtatgcagactggcatactataggaaatgtaggctcttagttgaatggaatgtgagtaattgtgttttcaccatgaagtctttgaaggagagggtcaagtatgctatggaagtaataacaccaggtcatattttcactttaagggtactcaaaaatagctatgctatgacttgaaaatagcatggaaggattcataatatttttcttttcttttctttcttttttttttttgaggtggagttttgctcttgttgcccaggctacagtgcagtggcacaatcttggctcactgcaacctctgcctcccaggttcaagcaattctcctgcctcagcctcccaagtagctgggattacgggcatgcaccaccacacctggctaactttgtatttttagtagagacggggtttctccatgttggtcagactggtctcgaactcccgacctctggtgttccgcccgcctcagcctccctaagtgctgggattacaggcgtgagccaccgcgcccggcccaggattgataacatttttcttcccccgatttaaacaactccagatgcttaaaatcaaactccttgccattccatcaagtcacgaaacaatctggcttcttctgcctacctctttcatctctacttttacttaacttccctttgctcattgcattagagtcacatttttttcttatgctcatcaaaataccaagattgttctctgcttagggtctttgcatgtgctgttcagtcgtgtgaaacactcttcacatctttctatgactggctctttccattatacccatctccaatcagtcacctccatagtctgacgttcccttaggaccttgtctgggtaagtagtagcttatcccactattggtcctagtcactcttgtcaaccttttttactgttttcaatgagctcgtcgctatctggaattaacttatttatacattgtttaccagtgcactttctgcctatacctagaggaatataagttttatgtagttaaaatattgtgagtcgtataagtggctgcatcactgatgcctagtacagtgcctgacgcatggtacgcactcaataaatatttaaaataaatgagcacgttattgacctctcaaaataagaccccaagactgcttagggataaaccaatattcccaaacacctttagcaattgaactggttcttgttagaatctacttttaggcataaatgttttagtcacaatatatcttttgggcttaggattttttttttaatttttaaaaactatgctgtatactgaaagtagaaagctattcctaatttttgaaacgaatacagtttgcttagacacacttgacctaggcaggggtaacttcagtgtggtttgttcagggagtagaacatttaacatacagccagtgctgtttcagtattactgggtagcaaatacacgttgactttgtgtcacaaataatttaaatatttaaacttgtgggctgtattttatctcaagatgtatttttttattcctttttagttctgtcattaccagtcaagttgatccaccattgcctctccccccaagacatttgtaccagcctcctacagtttctctctattttgaggcatcctctgtgtcctttccaagacttagcttattgacacagatgcctatgcagagaaaacttcataaagcacggctgattttgtcattactctatgtcaagacctttacagatcccatctcctataaagttcaaactgtctaatcaagcattcaaattcaatttccttcaacaaatattggaagttctccaattaattcaattctacctgtgtcatgagccatgccttcccttactctccttcatgtatcctttattcaagtcagactgtgctacttgtaagatctctgcactttttaaaaatccccaagtctctccttatatcattgtgatattctgcattgttcttcttcagatccatttccatttattaaaggcaaatccaatctttaacacacttattcgaatgctatgttcattctgattaatcctcccagtaacatattcttccattttctcctgaaaccttgattctgtgaagaagaattttgtcatttccacactctttgcttagaatcaggtcatttctctcaaatatatgctcattctgagaaatatatagtatttacacttgttgaatttgtaactgtagaattcttagtcttaaagggaaaataaaaactcaactcaaatatttgactcgttatacctcataactagtgcattcgagtttataaagcactttatgaatagtgtttcatctgatcttgatagtgggcaaaggaagaaacgatatttgagtctcagactttctttctttctttctttttcttttctttctttctttctctttctttctttcttgctcttgctctttcccttccttccttccttcctttccctccctcccttccttccttccttccttcttctttctttttctttctttttttccagtctcgctctgttgccaaggctgaagtgcaatggcgctatcaaagctcacttactgctggcttgacctcctaggcttaaacaatcctcctacctcagcctcctgagtagctgggactataagcatgcaccatcgtgcctggctaattttttattttttgtagagactgcctctcactgtgttgctcaggctggtcttgacttcttggcccaagcaatcctcctaccttggcctcccaaagtgctgggattacaggcatgagtcactgcaccttgcctctttttttttttatttttaattttaatttttctgtgtacatagtaggtgtatatatttatggggtacatgagatattttgatataggcatgcaatgcataatcgcaatagggaaactggggtatccagtcccttaagcatttatcctttgtgtcacaaacaatctaattatactcttttatttatttatttatttatttatttaatttatttatttatttatgtacttattgtctctgttgcccaggctggagtgcggtggcacgattctggctcactgcaacctctgcctcccaggttcaagcgtttctcctgcctcagccttccaagtagctaggattacaggcatgtgccaccacacctggctaattttgtatatttagtagagacggggcttcaccacgttagctagcctgatcttgaactcctgacctcaggtgatctgcccgccttggtctcccaaagtgctgggattacagatataagccaccacgcctggccctgttattttcaaatgtgcaattaagttattattgactagagtcaccctgttgtgctatcaaatactagcttttattttttctaacttttattttgtactcattaaccatccccacctgtccccctcccgccgtcccagtttccttcctagcctctagtaaccatccttctactctctatctccatgagttcaattgttttcatttttacatcccataagtaagtgagaacatgtgaagtttgtctttctgtgcctgacttagcttaatgacctccagttccatccatgttgtttcaaatggcagaatctggttcttttttatgactgaatagtactccattttgcatacgcaccacattttctttatcaatttatctgttgatggatacttagattgtttccaaattttggctattgtgaatagtgctgcaacaaacatgggcatgcagatatatcttcgatatattgatttcctttattttgggtatatgcccaccagtgggattgctggatcatatgggggccctagttttagtcttagttactggatcatatggtaactctagttttagttttagaggaagcccaaaactgttgttgatagtggttgtactaatttacattctcaccaatggtgtatgatggttccctttacttcacatccttaccagcatttgttattgccagtcttttggatataagccatttcaactggggtgacatgatatctcattgtagttttgattcacatttctctgatgatcagtgacattgagcactttttcatatgcctgtttgctatttttatgtcttcttttgagaaatagctattcaaatcatttgcccattttttaatcgcattattagatttttccctatggagttgtttgagctccttatatattctggttattagtcccttgtcagatgggtagtttacaaatacttccttccattctgttggttgtctcttcacttcattgattgtttccttttctatatagaagcttttaaacttgatatgatcccatttaaagattgtttcttgacacagactcaattttttttggcagcgggcaggattttcctctgtcactcaggctggagtgcagtggcaagatcatagctcactgcaccctcaaatttgtgagcttgaactatcttcccacctccacctcctgactagctgaaactacaggctcataccacaatgcctggctaattttatatatatatacatatatatacacacatatatatgtgtgtatatatgtgtatatatatacacacatatatatacacacacatatatatacacacacatatatatacatacatatatatacacacatatatatacacatatatacacacatatatatacacatatatatacacacacatatatatatatacacacacacatatatatatatacacacacacacacacatatatatatatatagacaaggtcttgctaattcttaaactcctggcctcaagtgatccttttgcttaagactcccaagtaacagactcaaatttatgaaacagttaacctttaaaatctgaaaccaatttaaagggggaaatcacccagggccttgtaagtcatactaaggaactggattgtgttcaaattaccgcctaattaccatagtgggggcttattcatggaggatatgtgccaatcctcccagtggatgcctacaaccatgaacagtcccaagccctatacgcattatgtttcttcagtctgataacagagccagctactaagtgattaaaggtgggtagcatacacagcgggggtgcactggacaaagggatgatttcctttctgggtgggacagactggaatggagcaggatggtgtgggatgactggagatttcatcacactacccagaatgcaatttaaaacttatgacttgtttatttccaaaatttagcgtttaatatttttggaccttggttgagcatggtagctgaaactggggaaactgaaaccacagaaagtaaaactgtggataaggcgggactattatatatagaatttttttttattttggcaaatatactgtcattaattttatttctttttatcttataaaaataaataccttaatatatttatctagtataaattgacagaacaattaatctatataaaaataatctggttctcaaacttaacttcacattggaatcacttgaggacatttaaaaaatactgttactacaatcccacttagaaatttagagttaatttatctgtgttcaatgtaatcattcgtttgtttttctttttccccccctcaagacaaagtcttgctctgtcccccaggctggagtacagtggcgcggtctcagctcactgcaacttctgcctcccaggttcaagcaattctcctgcctcagcctcctgaatagatgggattacaggcatgcgccaccacacctggctaatttttgtatttttagtagggacaaggtttcatcatgttggccaggctggtcttgaactcctgacctcgtgatccatctgccttagcctcccaaagtgctgggattacagacatcagccaccacgcccggccaatcattcagtttttaatttttattaaaatccaaaatatctcagtaagtataatgtgcataaattgtgtcagttcaatgaattttcataaattcaacctacccatgtaagcagcacacaaatcaagatgcaaccatggctggatcccagaagccctttccaatcacagctgagacacagaagggtagccattatctgacttctcatcacacaatttacttttactgtatatatatatatatatatatatacacactacctatatggtcatttagtgtgtattctttcatttctggcttgtttcattcaatatcgggtttgtgagattcatccaagttgttgtgtataatggcaagtttgcttactctcattgctgggtagtacattattccattgtatgaatcttttacagcctgcctttccattctactcatgatggaccttggtgtttttaaaaggacctaagtgcttttaaaagctaagcaaatgattctagtatgctgtttctgaggttgagtatcaccaatgtagtcataaatgtacgtaaaaaaaaaaaaaaagaaaaattaatttgatatcccattaggcttccatagaatttgtggtagtgtttttaaatttgcataattctcatttttatttatctctagttgaaaattaccgacatatttagccagggtgtgctggagctgactcgtagcagctcatgaaagctgagtgttagtttcaggaattttgtaagcaagtcgtttaaacacagctattattaaaaattaaatagacatccaattaaaataattatattcaaaatttcataaatatttaaaattcattacttccaaattattttagaatattttcctattacttatggtcttgaggttgttcatatctattgtatttgtatggtggaaatatcatatcatggaaactactgtgcatttcttcccaaattatgtcatgttattatctggaaatcactcatgggtagtatttacaccacagcaactggcaaaagctacaaagcaggtcctcacttagtgttgatgctgaaagagtttcagtaatggatataatttgtatgacagtgagaaatagtctaagattatattgcatataatgatatatgattatatatatatgatatatatatatatataatgatagcaaatgcttactgggaataaagttagcagcagattgggatacaattccaattgtcaggtcatggttgaactgcaactgaagcttagctagagacataaatattcaataaaacttagcaaaagccttctatgaaaatcaattgacttatggaatttgtaattaattatgatattatatattttattatttttaattgtgggctacacatcacatccattgcattagtaaatttgataataaacatgtgtatatacatatatatacatttatatgcacacaaatatatgtatccacattcttttcagagacatggttgttaaataactgctagcatgctgctctgttgagctatgttttattttttagccatttttattagtggaagtatgccatgttttgcagatttattcggtacaaaaaacaaggtagagaagtaagtaccaagaccccatggtgcccttaggaatatatatatatatatgtatacacacacacacacacacacacacacacacacaaacatatatatgttctgtacatgtatatgtgtgtagatatatattttctatacatgttacattacactaaatgatattgtaattgttttgtctattttagcactaatttagattttgatattttatttttcatacagaattagtactaaattgaagaacaaagataacatatttggactcagttaaaaaaaaatctcaatctgaagatacctaatagtttaccagaaaacagatgaagagtttctttcctccctcataaaaaatcaaacttggtttaccgaaccttgcagctaacaacaggtgctgtctgctcactttgccagaagctcacaatagaacagattgggtacacacagaactaaaaacaacatttgagtaaggaacaaaaccctcccaaatattctgaccagctctataatcagttcttaatattgagcctggaaacaataatgatttctttaatgtcaaaatgggcaaagaaccttgtttgtattgttttgttttgttttacctgtatttgtgcacatgggaatttcagaaagcacttataatcaaacacaaaagtgctacatttggggttgtacagctcagaagggaggggaaaaaaaaccccttcttcttcgtaaaagtcttacagagaatcaccaatcacagagggagaagtgtgttctaatatcaaatctgtgtggctgcaccatcccttcttaattgccaattgtcttttccactttgtcctctttctgtaacattgctaaactgaatctgaggccagggctttaacttgatatatctaagttcatggccatacatttattttacttactcaaacacttagtctctcaaatagaattgatgatttgtcaaatgatttgttgttgcataatgacatagctgtggaagccggatcttgctttatgtttgagaacacatttccagagtccaaaagcacgtgaggattgatggcacagatgggcttgaagaactggtttcagaagtgccatcttctactcaactgccagtttttctgtttatcatctagctagacattctgaccctttgtatcctcccattgcttatatttttacaacgtcaaaatcactccaaatgagaaatgtgggaacagaaaagcaaagcaaagagtattcagaccacagaaaatcatctgtgcctagggactggcctggcagcctcttgttttctgtttgtcccttgaagacaatggaattgtaatccttgtaccaggagatcacaccatcctttccagttctgattacccaatgattctaagatgagaagcgttacacagttttacaatttcttaatagttctgatgaaagaatatatgaggacaacgcagcttgttttagctaaaaggcaatttgggactcttctgtgaattttatttatccatcttatgctattcccttgggtaattatgagtgaattgctctgtgctgtgtttcatcaaactttttctgactgttattttgaaattattatcaagagcatcactgaaggaacatagtcacaaatggataatgcttattaaactgcagtgttatatttgaatgccactattctatggctaaggttgtgctatgccctcatgtgccagccttgaaagctcattaatttgtttggttctgccagtcaggctggagtgcagtgacgcgatcatagctcactacagcctcgaacccctgggctcaagagatcctcctgcctcagcctcccaagtagctgggactgcaggcacatgccaccacacctggctaattttttaaattattactactttacagatgaggttttgctatgctgcccaggatgatctggaactactggcttcaagtgtcttcccacctcagcttccctagttgctgggattacaggcatgagctactgtgcccagcaaagctcattgattagtctgcctgtctgtcaatgcggtcaatcagttaattcagtgagatactcagacactccaaacaaactattaatctgaggagacaacctgaaacacatgattagcagctgatgtcgtaagaacataaacacttagccaatctgtaatcaatggattcatctcaatttaaactactgcttcttttagtggtaaacattgaagagcaggggaaatctgcaccaggaaacaacaagtttcactagactgacaaccttggctgagctagaactatgttttcagaatttctcttccctatccagatctggattagagatgaacaaaaaggaaatttgtgtgagatttggaaggtggaaatgatgctactctgtgaaagctgcatgtaagtttgtctggtgagaaagagacacaggttaacagagagctcgtcctctgtttccttcttcatatccaggttttggcccaactggtggcactactgaccaacattgaccttaggtccactccagttttagaggcaacagttcacaaacgcttccccttcacatgcccattctggcagctgaacttgctggcttccttgcaagatctgacttgaccacctgctccagtgcccaagagggcttgttagcagtatcactgtgatatttcccctctcacttttgtaccatcatcttctcttacaattacataaggtcttcctcctaaaatgaatcctctattttacatgattcacagtagttttgctttcctgattgaaccttaactagtatctgtacagttcaaatttgtcatacatgacaggggaatgatatccaaatcactatactttggtttttcctatgatagctggtgaatatggaggctttggaggggctatagttttcatgtagaatgtgattaggatactgaagaaattcttgacatatattaggactcagaagcctatgcaacttggcataggtattttttgtctcttcctctgtattgtgaagcctccctgtgccatttagtttttaggcagcagttcctgcttaccatccaaaccccttttgaaccttacagaatccccaaaagtcagccttggccttaagtcccacagtactgtgctttacctagggagcatgttaattcatgcataaaaattaaggactcaaggtacattatatcactgtacatctgagtggatttttttgtggcttaaccttgatttttagtgctataacccaaataaagaaaaatgcaagcatgcattggagggtattgggctgtaataaggtaataaagactgtttcagtggtatcatatatagtgctttacagaatatagggtattttcacacctcacctcatttacagttcatgatctctcatgacattattagagggtcagagatgttacatgcttgtccatggttatttgtgtggcttggaggaaccagaaaccaaccaagtgttcatatcctagtgttcatttcactgaaagatctggctttttaatgaagccgttggctcttcccattcccattctcattaccgctcatctaggctgttgcggaagactctgcaatcctcttttctcctattatcagccccactcttcctcccattacaccaataggaaatcataatagttttatgtttctcattttgcaaatgagtttcaatggtccatctgcttggatcaaacgcttcaagtgctgtccctttgctgcagaaccagatagattcttctcaaccttgtattgaagctctagcaggattccaatgagctttttcaaacttttttcctacctttcttctataaagacactttgtgctggccaaactgagtgcatcacccccactacacacacacactcacttctacaaggacttataataataataatcacaacagctacctgcattgaccatttagtagctgctgagtatctcactagttctttatctatattacccaggcaataaccatgagatgtgcattactattgtttccatttgtaatgaagaaatcaaagctgaagaggttaagtgacttactcaagataacatggcaggtcagtaacagaagttgtattttagcacggactgaattttaaaatggcactctcaaactctctgtgccactgcctttcttcgagcactccccatttcttacagtgcctgatccctctgaacacacattttcatttcttccttcccttcaagggccactccaaaatcagtaagtcttccatcatctccacattaccacttacccacagaaagtctccctctcttgaattcctacatctctgagaagatgcatgaggaaagagaagtataacttatgagtcggtaacattcagtgctcatttctcagtgcgttgcttggatcctggcatgcaggggcagctcattggcatcaactgttctaagtactggctaaacaagagacaagctctgaggcatatagtcacaaatatgggcagtaaggagttatcgtgggagtggtgaatgtggaggggctctgagtgggaaatagttcaacctcattttatagatcccacatctaggatacaaatcagttaagccacttgcccaatgtcattcagataacacaagagtacccgggagtgctgagatctgaacccaagtacacatatattcttcctgcattttgccaaacacaaggcaatttctaggcttagtggagttaatgatgagcaaaaaaaaggcacatcctagaagcttctggtcaaatggcagagatgctaagatacagattaaaattttttttaagaaaatacaagtttttaaaattgttttaaaggaatcaaactacacatctcatccagatgacagatgctactggggaaggaagcacagcacttatctatcagtagggctagggagctcttaagctgattaaggacacaggctccgcaattaaagacacctgtggcacatatacaccacagaatactatgcagtcataaaaaagaatgagttcatgtcctttgcagggacatggatgaagctggaagccatcattcttagcagactaatacaggaagagaaaaaccaaacactgcatgttctcactcataagtgggagttgagctatgagaacacatggacacgggaaagggaacatcacacaccagggcctattggggagttgggagcaaggggagggagagcactaggagaaatacctaatgcttgtggggcttaaaacctagatgatggattaataggtgcagcaaaccaccatgacacatgtatacctgtgtaacaaacctgcacgttctgcacatgtatcccagaacttaaaattaaaaaaaaaaaaaagaaacagtggttgtgagagaacagtgcagtagagtggtagggatgaaagacaaattataaatggtggaggagtggggagaataaaacaaaaacaaacaaacaaacaaacaaaaacaccttggttcatacctggcaccttactacttgtgtggcagggcaagctactgaacccctctctgtcttacatactgcatgacaaatgatacacattcaagtcacactagttttcattttttcctatcagttgccaatttcttgtactagagatctttacgggaggtcttacctaggtgttaccttccttttcacctagatgacgtatctgaaatgttgcccagatggggatccatatccaatgtatctttttactctgtctccgaagtacctaacatggctttggtaaatatcttttgtttagctagcaagcacatattaaaataatgaagtgccccgtgagtcacaatgatcatcacaaacagccatacgacatttcctatgcacttttacactcttttaatctcccaggtgattagatatatagcttaaacataccgtaagtccctcaggtgggcaaattgtattggccccattttacagatggggaaaatgagggaagggtaagaagcttgccccaaggtacagagtgagccagtggtggaactgggatttgaatgcaggctgtctcgctcctgaatctaacttcttagctgctagattcaaccgctgttcaacagagtgaagggatgctaacacccaacatatattgagcactcatatgtgctttcaaataattccatgagttaggatctcaaaataatttgacgacataggaaatgtcattctttttttcatttcatttatttattttgagatgaagtctcactctgtcactcaggctggagtgcagtggcacaatctcactgcaacctccgcctcctgggttcaagcacttctacttccctcagcctcccaagtagttggtactagaggtgcacgccaccacgcctgggtagtttttgtatttttagtagagagggaggttccccatgttggccaggttggtctcgatctcctgacctcaggtgatctgcccacctcggcctcccaaagtgctgggactacaggcgtgacacatcgcgcccggcctggaaatgttattaaccctgtgttttaggttgggctcctccagaagccgactttcagaaaaaaatatgaatgaaagtaatttatttaaaagataatccccaaaagccccagtaaatggtaagtgagacagggtgagaaaggatgaggtttgttattgagcagtgcacatctagtatgactgagactctgtatacaggaggtagtgtagaacacacctcagtgtcttatcagaatgtgactaagggaccaggaagctgggacacttgcccgtcactgccctttcatcactggcatcaactgttctaagcactgactaaacaagagacgagctctgagacgtatagtcacaaatatgtgcaataaggagttatcttgggagtgttgaatgttgaggggctctgggtgggaaatattttaacctcattttacagatcccaggtctgggataaatatcagttaagccacctgcccaatgtcactcaggtaacacaagagtacctgggggtgctgagatctgaactcaagcacacatatattcttcctgcattttgcatgttctctctaagcacagagcaatttctaggcttagtggagttaatgatgagcaaaaaaagggacattctagaagcatctggtctaacaacagtgatgctaatatataggttaattttttttaagaaaatacaagttttgaaaactgttttaacggaatcaaactatattgctgatatagagaataactcaggtggacgtgagtgggaagggtgtttaaaaaggcgtattcctggcaagggaaagccaaagtcactcatccgtggagacaaagcaggccagaatgactgatggggatgcagtgagtggcagaggaaggatggtatgaaatgaggaagaaggaagggaaaaggcagacatactagtctcagaggccctagtcatgctttaggatttaattctaaaagcaatgagaatttatcaaagagcatgcaattggcagaggatttgttcttctatttagcctaagaggcctccagattaaatgttctttctaaatacttaaaaaaggtgacatagtctaaaagggagacagcaaaccagctagaggctgtggtcaggtgtggggaaggaggggacattcagcctccttgttgtattcaaccgccttcctcagctctgtcttctcttttctgattctgtccacattccactttaatcctcaatgcttgtgagatgatccagagtttgactgcatatttagcttttcagggatactgcagataatgatgagaattattcatctttcttcagcataaaccgtatttaacgaggggctagaaaaataatataaagaggctttatggtcaagtttcagagctgagttaggaaagtaattccaagtagtagagtttcagcatattttatttcctccttttacttctctaaattttccaaatggatttatactatttttaaaataaaaatggtcaagcctttaaacatttgtgccaattatgtagatagcctgcaaagctgagacacttctcactatgctaatcagataactggctcaggctttctattttatttgataaactttggtcattctgaatttccaaatatcaccaaaaattctgactttgataaataatcaaatatttagctctattgtgtattttcttacaattttcaagtgatatgggtggcccatattatattcaccttaaattttattagaaaaagaatactttcgccggttgcggtggctcatgcctgtaatcccagcactttgtgaggccgaggcgggcggatcacttgaggtcaggagttcaagaccagcctggccaacattgtgaagccctgtctctaccaaaaatacaaaaaaattagccggatgtggtggtgcaagcctgtagccccagctacctaggaggctgagacaagagaattgcttgaacccgtgaggcagaggttgcagtgagctgagatcatgccactgcacaccagcctggatgacagagtaaggctccatctcaaaaaaaaaaaaaaaaaaaaaaaaaaagcaatacttttaatatgcttactcacactattcaaagatctttaattataatcatttaaaaactgtgaggtagaaaggacaataagtgttattctccccaatatacagaccaaaatatgggtaacgtaagctaaagacccacagttagtagcagaacccgttgaaaatcgagtgtctatttaaataacaaacctgggtgtctatttggggataaaacacccaatctctacagccctttgatttcaaaagaactgatatcccaggaagatagagaacttaacataaataagaataaccaaagtgaagcttaaacatttgtacaaaccttgacaatttcattttttgtattgtttgtattacccaagtcttatcacaggggacactgagaaccaaattaagtgtgtcaaaaatcaaaaggaaagatacataagccatctcctctgaattttttcctccttcccttgtttcttccttataaacactgctgggtacttaacttttaaaaacatgggctttgaggaaggacatagctgggtaccaatcccatctctgctctttaagaagttgggttacctctgacaagttacaaaccttgcttagcatctatctctttacctttatattagccacaatacccactccatagagtgggttttatatattactatttgtacagacttgcaagaatgcaaagtgcgtagaaagtgctcgataaacagtaactagtggtgactggggtaggggtagtgccaatagttgctttaagaacagttgaactagcagcaatggccaatgccattggcaaccaaattgtgctcataactctatggaccagatcttaagactccaacactgggaaatttgctgtcattctttgatccctgggcttaaatgtctacttcttaatgctatgagctaaatattcaatgttaaaatggacagggggtcatgctccatctcatttatcataagtgaataactgggttattttgaccatagatcaaactccaaaaatttaagcaaagaaataatatgtgtaggttccagaaagagatggggaaaatgtgaaaatacagctaaaataacccacaatttaaattttggctacagagttaatgtcctatttgtaaaccagaattttataatctcaacactgctgagcagataactaatcatattttgaaccaaataattatttgctgtgtgagcctgtagatgtttagcagcattcctgcctgtacttataaatgccacttgtgccaccaacccccggttgtgacaaccaaaaactggcttgactcccaaatccactggagcaaaagtaccttcgattgagaaccactgctctatactctttttttttaggcagagtctcactctgttgcccaggctggagtacagttgtgtgaacaaattcattgcagcctcgacctcttgtgctcaagtgagcttcccacctcagcctcccaagtccctgggactacaggtgcatgccaccatgcctggctagttttttaattttttgcagagacagagagtccccatgttgcctaggctggtcttgaactcctgggttcaagccatcctcctgcctcagcctcccaaagtgctcgcattacaggcgtgagctaccacactcggcctgctgtatactcttgactttagaatgctcataattctaaagaaccatgttgcatcgtgccttctcataaagcctcagccttcaatttcacaccatccaaacccattgaagctcttgagtcccttgacatggtaactcctatccctctcccatcagaccatctcctcatggaggtgacagacaattcaggaaaatctcccattaaatccactcccctaaagccctcttggaagagtaactatatgaactttatacttctctccctcccaactttgtacctactttctcagaggtgcttaaaaaatatcacttctctgaaccccagttctctcttttatcagtttcatgtcttcaaaaatagcaggattatattgccctctgcagatgctactggtgataaagaataaaaattgaaactgactttttatgtaacagcagtgtatcacaaaggaggaaaacaagaaagaagggaattaacaatgattaaacacctaccatgtgccagcctctgcactaagtacctataatattacttcatttaatctgtatagtgaaactttcgagtaaagttttctgagatcaaaagaaagtgcatttctgacattatcttttaaataaatggtcatttcagattgttccgcccactttagtgtaccatttcccaaaagcatccaagaatccttgtgaaaagtgaagacagtctgcaataactctctgtgtgtgtgtgtgtgtgtgtgtgtgtgtgtgtgtgtgtatcacaacttaacccatagttttggaatgtcagtcatctcaccaaaatccggaatgaactatgtcccagtggatcacatattcttgaaagggcagtcagatttctgataagcaactcatatacacgagagcaaaggcaaggttctatctatagccctgtcatgaggcaagctgtctctttttgaaaatgatttagaggcagctggcctctggtctgctagtctgttggtgtctcacttggctattcaacatcagaggcaggaatctctgcccattttcacataatgcacatgtcttcctactggaagatctttctccaggagtggagggttcaggtcaaggtctctgctcacaaaataaagacagaactcagcactatttatatcacaccagaactgactcagcgccattgcccatttaactcacttgtcttgctatttggagatgttctctctcttctggcttttctgccatctgtgacatctctccaggcataccgtaaggagaggacattttgaaggatcactctatttgtttcatcctagaaaagtttatatcagtccaattctgctgctaactggacttcgtctctggcttcttcatttggaaatctacctcttatgctaagtgcccttatatcacctggcggtttgcaaagaggtgagtgtgaatgctccagtaaaaacagctgcctttactaagctttacagcatgtgctcgatattgagctaagtgctttacgtgaattatttcatttaatcctcagaaaatcctctaaaggacaggaagtattataatctccatttagataaaggcaactaattaagataagttaacagctgccaaatttcatacaactagtacatgacgaagttgggatgtgaacccggacccatccaatcccaatgcccaaggatgttccactttatcacaccacctccctgtgagcttctgttgagattatttttttactgcctgatccacaatattattgtcatctttatttggcttggcggttgacaaaatgaatgcatttctagaatcttcaatgacgtgaaaattggattacaaacaaaaccatctctggaactgcctgtttcctgtattttccttttggggaaaaaaaaaaaaaactaaaataatgagctagacgagaattctgatctcagatatgccactacatgctcctgcacaccagagcaatgatgtacctctcgagacttctgtttctttatttgtaaactggtggggttggaattatgaattttaaattcctttctatctccaatacactgtgattttctgatgcagtgggtattactgcctcacaaagggcttacaaaatacactggagaaaacaccagtaatagaaaactctacattcattgctacttaactttgtgctcattcaaatatcttcatagtgtctctctccagagactccaagcacttacttaatttaatatagccctttataaaatgggtcttctctgcaaatctcagcttgaggcatttctctggtacccacacaatacattcgcttttacagaggctttattttttcccctaagaatttcctgttcatttagctacagccagaggtaaagctaacaaatttgtacatctcttcagaggcacccaatttactaaatgtcttttaattggcataggagctcatagaatgtcctctgagaggtcacgttaagagttattttgttaaatacaaaggtatagaggaggtattttcagatggaatctgaaactcaaacggaaattttttagcagcatctcatggaacttctcagttttcttatcacaaatgttctcctgtcagatcttctgtcgtaaatatgaccctgtagactgaacaatggaaatgacagccactgaatccatctctctttctcttttctgcatttaaaattcaagattataattgtagtacaaagtatgattagtaactatcagtgtgaactttggagtccacactaatctcctaaaatttcagtcatccattcaacaatactcatggcttcacccacatgctcacttctgtgtcccttaaatcagtggctgacacataggaagaacccaatgaataataatgctaaattgatatgccaagcactgtgctacaggtaaagcactgaacaaagctgacattgccccaatccttaaaaagtttatagtccggaaataattgtttattcttatatgcatgcgcccacacacgcgtgtgcacacacagacacactcccaagcacatctataatcagtgtattaaaacaaatatcttggcagagtgtggtgggccattcctgtaattccagcatttttggaggccaaggtgggtgatctcttgaacccaggagtttgagaccagcttgggcaacatggtgagaccccatctacaaaaaacacaaaatttggccaggcatggtggtgtgcctgtagtcacagacactcagggagctgaggaaggaggattgcttgagggtgggaggcccagactacggtgagtaccactgcactccagcctgggcaagagagtgagactttgtctcaaaaaaaaaaaaaaaaaaaaaagacatatctttaagagcatgtaaaaggaaaattccacttgatctaaggagttcaaataacactaccataaaaaattgactttctaactaaaatgtgaataaaattttaccaatgattagatacagtggagaagaggcatttagggtataggcaaaaacaaacaaacaaaagatcaaagtgaggtatgggagaaaacacagtctactcaaggctaacagcaggttagccaattgcagatagcaactgggagcacagcagatgaggcagcagggagaggcagggaccaaactatataggactttgtaggtccttttacaaattactaaggatactctactatattgtaaaacaatatgaagttattaaagactttctagctgcaagagggcagtagagcaggagaggcaaacaacaaagacattatctgatttgtatatgcaaaagaccccattggctactctttggtgaatatattgtgagagtggaaagaatgagaattaaaaggcagtcatagaaatcaaagccaaaatagcaatagtgtgatgcgggactcttgctgtagcaacagaactatttgaatagatttaggatgtaattgaagggttaaaagtgagacttggtattgcattttatatagatacaatggagaagaaggaatttgtcaaggaggactcttaggtgtctaacctcagcaattggttcactggttgtggcattttctgaaataaaaaaggagagaactaaatctggggtgagattgtaagtgcttccttctacattttgatttgaaaagctctgagtttattgtccctgtagaaatattgagtacaaacagtggatgtttgtggaataaaaagaaggaaaaggagtcagagttgtgatgaatttgggaatcaccacaacatgtataacaaaatatagtagaaatattgggaggccggggcgggcggatcaactaaggtcgggagtttgagaccagcctgaccaacatggagaaaccctgtttctactaaaaatacaaaattagctggatatggtggtgaatgcctgtaatcccagctactcgggaggctgaggcacgagaatcacttgaacctgggatgcagaagttgctgtgggccaagatcgtgcaccgcacctgggcaacaagagtgaaactctgcctcagaaaaaagccccagatcaaacttgaggctgtttgattcaacctggttagccgaagagagtggctggtagagaatgactagcatgcaacggtgatggagaaatattagccacaaagatacgaggcaaactagggagtatggaatcacaaaaagcaaagaaaaagcaagttttcaggtgagggaaaaatttataactcttgattattcaagtatatagagaagttaaaaatatctacaggtatcataacaagcatgtcacctacaactttagttgaactatgtctgtttatttaagagataagtaaaattgaatttactaagtggaaagtgtggaaatagaagcaatagatacagacaacaattcatagatagatgtttagctgtgaagggttttaaaatgtttatgctaataaagtattaatgagtcaaaatgtactacacatgatctctaaatatcactccacagattatttcttcattacaagcagagtaaaaggcctcctcaatgctaagaggtgcactttctactacaaccaagtgatcaaattttgcatcactcataatgagaccaactgaaataatacacctctggatgacaaaagaaagcatagaatattactcatgtccttttcttgccataatgtttaatcttaatctaatcctgaggaaacaatcacaaagttccaactgggaacccttctccatggcctgggatcttcaagaacgtcaacgtgataaaagtaaaaaatgtgaggaaaatgttctaattaaaagaagcgagagattgcatagtaaacacaatgttggtttgatattttaaaactcagatataaaaaattttggggggtttgttgaataaacttgaacatagattataatgaagtattgtgtctaccttaattttctcaagtgtgatgttgttatgattattgaaagagaatagtctttttctcagaaaataatgctgtggaatttagggatgaaatgtgatactctgcaacttctttcaaagcagttaaaagtaagaaatttaaattgtatttttgtcttcatttattgcatttatagatctcttaatttccttgtcaagattcaagattctatctagcatcaccttttttctgcctgaagaaatttttaaaatatatttcaagttcagctctgctgacaatgtaatctctgaatttttgtttacctaagaaaacctttatttctccataatttttgaaagatactttcactgggtatagaactgtgggcagacagatttttttctttcagcactttaaagacatcactatgttttcttcttacatgcatgatttctgaagggaaatattctttactttttttatttttcggtatatatgtataaattttttttctttattggtaagattttctgtatgtcttgatacttctatttgaatatgacttctgtcttgactggtgttcactgagtttcttaaactccccctgccctttccattttttttttttttttctttgagacagagtctcactctgtcacctaggctggagtacagtggtgcaatctccgctcactgcaacctctgcctcccggattcaagcaattctcctgcctcagcctccctaatagctgggattacaggcaccaaccaccacgcctgattaatttttgtatttttagtagaggcagggtttcaccatgttggccaggctggtcttgaactcctaacctcaaatgatccacccacctcagcctcccaaagtgctgggattacaggcatgagccaccacgcccggcctcccctgcacttttcttactttattcttccaggattccaattacactcagctcttagatgctctgttctgctttattcactctttctctctttgtgttttagtttaggaattccttaatgacatcttcaagtctaccaaatctttcctttgatatgtcaagtctactgataagatgaaggtttcttcatcactgctactatgttttccattcctagatttctacttgatttttaccatctatctattgaaattagcctgctgatgatgcatattgtctgtgttttccagtagagcttcaatatatgaattagagttatttcaaattctctatgtgatagttccaatacctatgtcatatctgattctggttctgttgattgctttgtctcttggtagtttccttccccccactgttttctcatatgcttaataactttttgctgaagctcgacattttgtccaaaagagtggagactaaatagtttctaaacctaagaataggcatgtttttacttctgataggtcgttagtgtggaagtttgagcaatgtagtcagtagttgtgctgggtttgggtttgttatgcttgcactctaccactggcttccacttcctttggttatacttgtgtttagagtgaggactggtttgccagagagtagtctgtttcactcccatctttagggtaatctcttcacactgcaactctctgttagtccatttgcattgcattcctatgtaaaaggaaatcctgaggctgtgcaatttataaagaaaagaagcctattttggctcgtggttctgcaggctgtacaagaagcacggtgccaacatcttctggtgagagtctcaggacacttccactcataggggaaggcaaaatgggagcaggagcatcacatggcaaaagagggagcaagaatgacagggggaaggtatcaggctcgttttaaacaaccaaatcttgcataaactcattgagtgagaacttactcattaccacaaggacagcacaagccattcatgagggatctgccctcaggacccaaactattcccactaggcccacttccaacactaaaggttatatttcagcatgagatttggagatgacaaaacatccaaactatatcaatctcggagtctctacccacacacttttgtaactctcaaagctcttaatcactgttagatgtcactggaggcttttcagcccgggagcgtggtggtaagaggagcattgctgttctaattaagccttggttttaggcgaattatgtccttaggtttcagaaaggtggctgcctccgtgttccagtgtttcccacagctgtaattctgggaagggagtagagttttatttttaatgcttcttatctctagctgcaatggctgttccctagttccctaagacacttcctcctgcagtttaaagcttttctcccaaggagaattaggggagggtgggatacaagcaggacttcttgtctttcctgcagtggctgctgttctcctccccatgttttgtacaatgaggattctaccacagtcatttttttgtgtgtgcatgagcttctggtggggcccaaggaaagagcctattctgggtgcaaatttccctgttatcttgccccaaggttttctacagtgagaatctacaagccagttaaaatttgttttatgcctgcagccaactgaaccacattccttctttactaatttgttaccaggtgagcaaatgctagcttaccctctctccccataggcacatatctttttttaggttttaagttagttggtattcctgcaatcacagctctctgactagttcaagaaaagttatgaatttgcaatttgtccaattcttttttaatgctgagagtgggcataatacttttttattccagctttgttcatcccaagcaaaagttggaggtctctgaaacttaatttcaaatagttcagcaaaaaaaatgaaaagaaagagaaagagtaaatgaaagagaaggagaaagagagagagagacagtgagagaaagatacataaagaaagagcacaaatgtggcaacatatcaagaattaatgaatcaagatgaagtggggatgggtattcataatactttccatttctgtgttgacacacaggcagtgctcaattaattaccttgaatgtaattaagacataatttgctgaatgacagtattattcttgttattagttcccaccaaaatagatgaatcaatttttttccctttctagtttgacattgttaccctaagatactaatcctgctgactctatttttaaaatccaggtttactaaatattttatctacttatctgtcagcaatgtttcaactagaatagaaatgcttttgcataaattcatcactcattgagggatcagctaattggaaagagcattagatatggaattttgaaaaacaggcttaaatgcaagcttattcatttcaccaatatttatggagatcttacagtgttctattgattgtatgagaggtttgggagtgaatagtagctctgctgcctctcagtcccttgcacctgcacacatttatatggtttgagccttggtctccacctctgtgaagtatggataacaacgcctccctcatttgtgagagttaaaatccctgttatatgataaagtgctttgtgaatcataaacaaatgatccaaaagcatattattctaattctcttttagtttcttcctcacttgttcttattttttttacttttttttctttgcatttttgtaatgtccttggccttggtttcttactttattttattatgactgcttacactgttgtagtcatttacaacttcatgttaatcaaaattgtgaatttcggcaaaggcaacagtccctgcctagtgtatgaccttttttcccctttgatcttggcatctgaaagctttttatacattctaattctcttccattttaatagctctgtgaagcagtactattttctttgactgataagatcattgaaggtgacctgattttctctagagatgcacaatgaataaaacacattctccactacacaactcacttactcacatcccatgaagggggaaaaatcctgaggttgctctctctctataaaggtcacagaaaaaggagatgacttctcagatattgtgattatgcatgtatcatcaaattatgcaagctgcttattattccaaatcttaggggtttttttgttatttcatcctgttttacataaaactgagtagcaaaagtggcaaaacaaatatagcatttgtctttgtttgtgtatttttaatgagccgaataacacaaacaccttaattttgagggtgcatcttgttgagacacaatattatagatacctgtttgtacttgtgtgtatgtgtgtctccaggtattacatttatgcagttttcagttggaaaggtgacctctttctacggagtatgtgccctgcacatagggtttatcccttgtgactggtttgtgtgttaaggattcatggcttaaacagctaggttattcatgggtgtggaaaattgatatttgagagcattttattctgctcagtcaggctgattctttataaggaatcaaaacagtgataacatttaccaaaaactactgaatagaatattcaatgtgtatctatgccacacattgtttctttccatacactccatcataaaatacctcctctgcctatcatcgctctgacaacgtcactgccaaacccctatcctcatacactcatcacagaacatctcttcattttgttcagaaactgtgcttttttttcttaatcgttctgcttttcaaagctttattctttctaggcattcaatatatattgaataatttcaaggtatttttatattcattcattctactaatattttcttaactattttcagctactcttctaaacatcttgttcaggaattgtggaagaatctactcactgttttgtcccaatatccaagggagaaaaataaaactagctcaacatccctgtgcatgaacttttagtaactttatttccccactagaactggaatctgatgatgagcatctttgttctccagatttcaaggaggtactccaggtagctgactttccacagagccctagaaagtaaatcatggaggtgaggatactgttctctgaaattaatatagaactatagttacttggtagtttatcttgagcaagtcttgttaattctactgtaattcaaaatggtagtatcatcctaggaaaggatgacaaacatgtagttatagtgagtattctcttggtttaaatcacagcattaatcggcattctgtattaagaaaaaggcaatcatttgcccacattctccttttccttagttttttttttttaatttttagcttcagaaatgtaactcatatacaaagtacgcctatagttataccatgtatcacacatttcatatgagtaaaagaacagaaaattgatgaaacatgcctgaatgcttgtgatataaaattatatttcagttccagctataaaagtgtaatacaattgaaatgtttatcatgcatctatgaatattttttcttgcatgcataatggtgttgcatgaacaatttaatttcttttttgaaaaaagtcatcctagagaggtctattctataccttttcgacagattcatctaaagaccagctctataaatgtccagattgaatgcataaaatgtattgtctcaagtgattattgtttaaaaaaatttaactgtattgttaacttactgaaaagcactggcataattccgcaggcatggcctcttttcttcttatcttcatgtgtgtgctaatgttgtgatctttttaaaatgccaagatgaactgtccggtatacgaagataaaagattttaaaggcaacgcataatgccactgaattcctattgaaatttacagttttcaaagaaatagtattcattctaacatcaaaattattgtcagaaaaatataaacatagtaaaataaaaggcacctgtgaatccgaagctatcatggttcaaactcttctatgaaaacacaatggcactcaaagacttactatggcttaatatctattattaatcaattagtatttttcattgtatgaaaaatttataactaaaattttaaatttaaaaagaaatggattgattagaggccaggtaatcaggctcttggccatgaccatatttttttttttcagtattagttaagtaccaaagtatttcacaaagtccagtattcaattgattgcacaatacacaactagatttcatatttttgtaatccttggcattacttattttctgcacattctggacacattcctacatttttatttaaatggcttttacatcttataaaaagagtactttttggattcaaatcccttattccatttctggcaaccttccaagagaactctagtctgaatcattgcattgattttctgttgctgtataataatattaccacaatcatagtggcttcaaaaaaaaacacatttattatgtcaccttttctgtgagtcagtagtctgggcacagctcatctgagtttttgcttcaagttctcatccgaaagctacaaccaaggggtcactcatgactgggttgtcatgcgatgactcgactagggaagggcctgctttcaaactcatttggttgttggtagaactcagttactgattgttggattgagggcctccattcctagctggctagcggctgaaggccattttcagttccttgcaattagggcctttcctacacagatgcttgcttcattacagtgtgcaatttgagtaggtagtagagatactctctcacaagatggaaggtataatcttatgtacctggtcatggaagtgatatctgtcccattttctgtgttttattggttagaaataaggcacaggttccacctacactcaaaaacaagggatgtaacagggatatgaatgccacgaggctggatcactgggggtcatcctaggatcttcccagcacactttttttgttttacatttggtagtttggtaatttttccaaatgaatactataaaagtgtaatagaagaagtagtatatgtcattgaatgtagttctaacccagaaattacagtgaaggtaacgctcatatgataggatgggcagtttcattattatttgtcttgcctgttaccaagcattctaatgatgtttcattgagaagactgttctttgagattagtatgtatcataaaaatgcctctctttaactaaattgtggatatttgtctatgaagttcaggtatttgttttcataataggctgtatttgaaggacacaaaaatttatataaaaatactaaacaaactgaagcccaaatttgttactagttctagtgcaccaccatgacatattgattacactgaaatacaataatgactctcaatatggacatctgaaaattaataataactatttgattgtcctaggaaatgatctggatagctaaatatagtctgactgaaacttacgtagcccaggcattaagtacatatttgaatgggcaaatcttatgaaataatgcattatttactagaacattttccctactggtattttctactagaagtccaaattagggaatcatatgaggatataaaattaattcaaatatataaaaatattttggctgtgtttacagcattaggaacaagctgtactcattctagcattacgttaatgtacacttggtaggcattagaggaataaacagttctaactacaagaaacagtaaaaaataagatatatatactcataagtcttctcattctgttaagagcagttagtaaagaattatttctaaaatttgtgaaataattattgctcataaaatttttagctaataagaaacttcagatggttcagaaggtaatagaatatgtcctatttggttcaggaaacttaaaattccttctccttaaaagtgttggattaaggcgtttcataatttttgaaaaattttgtatttattggcagtggtttttacacttagagattcttatttcttccacagtgaaattgtttatttaaaaaagatgtttctaaaatatgtgaagagaaaaaatagtgcaaaatattcactttgataccaagaagagctttgattatacagatactctaaaaaggtattaagaacctccaggggttccatttccacagtttgataaccactgcattagcacaaatccttggaagtatgaaacactttgtctgtgtttggtataaaggccactgaatgtgctaatctatgtgaccttggcatgtagtcagcatctgttaatagatttcaggatataaatgagatagtgcatgtaatgtacttacaacaattaatgacacaataaatattatgtgttagaaaagctacatgtagcatagtaattgagagtacggactgaagactgcattggttcaaatccttgctgtgcccctctgtaagcttgaataaattatttaatccctgtacctcacttttcccctttgtaacattgagttattagtaataacaacttgtgagtattatataaatgaaaaacacagtgcgttgatcacattaaacactatgtaatttaaaagatcattgtaaattatttagttcctagagacagatgtattcttaatacattttaggcctttgttactttcagtcatttaacaaatatcaattaattcacctactacatccaaaacaattcaccaaacagtatgaagaatacaaaagggaatataaatgtgatttttgtgatggaagtgtttattgtttaatatagaatataatatattcacatataagtagcatatggaagaaaacgaaagacagcacaagaaattaaattctcagagaagagaaaaaaagtaacttctatgtatttatgaaagtcattttaagaagtattcagaaggttgttagaattgagtcacagagatggctgatgttaccaagggttacttatcattggaaaagagattcataggtacatgtttaaatatggaaatctttcatatcttcagacgttatcgtcagctcaaacccgattttcacagatggcttcacacactgcaactactctctcataattacttatgagagaaaatgacctgtttccctttggccattttgagaaactttcaggaaaaaaaaaaatctttaatttagaataacttaaatattgggccttacagattgactggcaaagtcaaatccaaatgcaagttatttcactactctgcatcccacttaggtgtttttctttcgtgaattatttcctgggagttagggctctttcatcttttatttgcaaagtgaaaagcaaaattgactcatcttaacttctaatttagctttctgaatcggaaagacaacctgaaagtggctgtggggaggagcgctgcttggtctagctggctggagaccttttacagtgtggatggagcccctttctcaatggttaagtggctgccacactcagtagcctttctgaagtcgcttggtcccattctttttatttttttctttttttaataaaggggttaaaagaaaaaaaaaaagaggtaagataaactgcccttgacagtatgattcctttcccttccctctgcccaaatacagatagaaaggaagtctttccatctatataaaggcctatttcatgttaccaaagaggaaaagagaagttgagaaatgcagccaattaggagaaatgagagcaaaacaggtagtacctccgtgtgtcctagcaaatggcccaacacgaggatttttacctattttatccacatagaatggcttgcgaaaagcctttgttgttgttgtttttacaattcatagacttcccactgataaattccaatggtcgattttccccttaaagtgaaaaccttcctttgggaggcaagcaactcaaaaaaaactgcctgatgcgtaatgaagtatgttttttgtaacccacaccagttctatccatacatactttttttttttctttctgacaccttcacctcctgccttacgttcctttgagctatggaagccaatgaggatgaaataattaaagtttgtgcctgctgtacaaaaatcattctccataggctctgtttttatttgatcttttgtagaaaacatagcgtctttatgtacacagttataggcccatggtgtcaggctacaaaggcttcatttcctgctatccagagtcctggtgttattctccaagcataaattctgtagtttccctcctctagcccagcaggtgtctgggtttcatttttggttgttacagttttcatagggaggctggggtggtctgaagtgtcacagcagggatccagcattgcccctacccaaaatttgctacataatttgtgaggccaagggaaaaatgcaaacgcaggacctcttgttcataaatcattaagtgggtgtttttaaacacagtgtgctgtgaagccacacaggtcagatgcccaagaagctggctctgcccctactgtgccagtgcctcctgggcacatggatggcagggaccctgtgtgttgcccttctgtgaaacaagaagtctgtatggttggttgggcaccgtatggttggttgggcagtctgttctttcctgtgcacttcctgtacctcctatggtggtccacacctcgaaagccccacactgcaccaccttccttggaggacaactctattaaattctgcacacccgctacccctgccaaatcttactcttttttttctatttaaatgccatttattcacaccccctgcaaatacatacatgcaaaatccttcataatgacccaatgatgcaagcaaatagtcaagcaatgcttaatagcaattgaaaaaccatatccccacctcaagggtagagaggactgaagtctttatgaactcaatggctagtctgcatccccagaactggaggggaatgcttgcatttcttcatttaagacttctcccctcctcctttccagaatgaactgaaagaattcttacaaggcaccacctcttataaccctgtcccccaaaaggagatttttatattcaaaaacattgtacattcatgtattaaggcttttagaattagcaaggactttaactctttggaatttgcagaagttgataatgcaattatattttttaaaagtttacattgtaattgctttagaaaaaaaattagtgatactgcatatacggaattagccaagcctgtgtacacttgctgtttctgtggtctccatggactggaatttggttaaaaaggcaagtttatcaattgaggtttttaaaaatgcctgctctttcaacaaacccaacaataaataatgaaaaataattaacactgtaatatcaaaagtgaatattgccaaggacaaagataaatgatagccaaaaatacagtgaaaaatctcaatttaaatataggaaaagagaacttggcttctagagaacagcaggtttcctcccaagcctatgctgagtaatatgatatgaaattgttaccactgcttttctattagaaatcttccaattcagttttctttattgacccaattccctggtgtttagggctaggctgcttttttctgtacacatgtgtgattgcttatccgtctagcctaggcttgagttattttatttgattggtaacacagacctggcagaagcttcacctttggcatgcagatgtccacaggtgatgtgaaaagagattgaaaaaggcatttgctgataaaaacaaaacaaaacaaaacaaaacaaaaaaaacaagctcagcatgatttgattgccatctagctacaaagtgtagctagaattgatacagtaggccagaaattataattatatccgccttacaatttcagaacagccatgtgacccaagtttataattgttggtgccataagagacaaaatagctgagtaaaccactcctacaatgtttttgaatataaaaatctccttttgggggaaagggttataagaggtggtgccttgtaagaagtctttcagttcattctggaaaggaggaggggagaagtcttaaatgaagaaatgcatttatacaaaacattatacattgtacattcatgtattaaggcttttagaattagcaaggactttaactctttggaatttgcagaagttgataacgcaattatattttttaaaagtttgtccaattccttcctgaatcctttaaagtgcttaccacattcacttgtacatcctgaatagacttagtatttgtttaataaagggatatatgaaataattttggactgttagagccagaactttagattatatataccttgactggtattacattgcctccttcatgtcgactccatttcattatctgtggatgcttgcatttagtactaactgcaatgagaagcctttgaggccacatctgaacccaatgggaaagaatcctgtgattgaatagtaatgtctgccaaacccaaggaagagaaaaaaatgccaccatctctactataaagtgactctcctccaccagaatgtgttccatcccctctttttacaggcaaacaaattggggatcagagtggcaaagcattctattgcatatcacaaaattagtagcaaaatgatgatatgaatttaggttctcagactctggttgtattagtcagctcagtctgccataacaaaataccacagactggctgtcttaaagaacagacatttacttctcacagtcctggcagctggaagtttgagaccagggtgccaacgcagtgaatctggtaagggctctcattgatttgcagacggcagccttctcactgcatcctcacatggcctttcctgtgtgtttgcacaggagaaagggagagagaaagagaggggagtgggagaaaggtctctgatgtctctttttataagcgcactatcccattcatgaggaattcaccctcatgacctcatctaaacctagttactcctaaagtccccacctccaaataccgtcacatcgggggttaggaattcaacaaatacattttaagagcacataaccattcggtctataacgttagtcacatgcactttatatgtcacaatgtctcttctcctattaggctgactctagttctctttttactgaaaccgccttgctttttgtatcatcgttttaggcttggagaattctaaacagcctctaggaaatatacatggttgagttgtttgacaggttatgaacacattgtgatcaaatgcagtgactgtttataaaatgggtgccttgcagaggagagtttaagcaaagtttaagaattgggaaaatccttaatcacatctctacagaaagaaaaaaagctgtaagagaaagcagaatggtacaggaaatactcctcagagaacagcggtgagggagggataatatgaactacctataaaatatgctcttgaccaaccatatatcaccttcagcctgttctttttgacgcgtgactcactatctagggatccccttctgttggctcacttggcagcctctgagattagttttcccaaagcaatttattacccaggtggtgggtacatgttacataagtccaaaagtcatttctcaccacttttcttgtcttccttttattattcttttaaaatatatgctacttctacttcattattttcaaccatctcagagcatgttgaaagtattgacatgtactttcagcatgaggaaaggaagttactgcagataacataagaagaaatatgtgtttagtctctgtccctggttctaatactgagctcctaaaactcttacaatttccttagtgatgagtgctatgagcatcttttgtcctagtatttgttttttgtccctggttcctgacacagaactctggagctcctgattccagagcttggaatttcctggatcataggagtgtcatttgttctaatgatgtgactcatggtgggctcctggatagcttcagaatgggagctggccactggaaagcccaagctgttagtagaagcttggaactttcagtcccgtctcccatcctccaggaaggggagattaggttaataattaataatgtctatgtgatgaagcctcaacaccagtccctagcctatgaggtttggaaagtttctgggttacaaatgcatccatgtgccaggtgggtggtgcaccccaactccacagggacagaatctcctgcacataggacccttctggatctctccctaggtaccttttcagccagctgtttattcgtatctttgtaaaaacctgtaaatgtgactaaggttacagcaaattatctcatcctagagggaactgttgaaactcctaatttgtagccaagttgagcagaagtgtggacaccctgggtacccaatacttgcaactggcacctgaaatggagggtgttcttgtgggattgaactcctaacctgtgggggctacacttactctaggtagtttagtgtcagaattgaattaaattgtaggacacatccaattggcatttgcagagaactggagaattacttgctgtaaaagaaaaccccatacatgtaatgtcaaaagtgttgtgagtagaataacagctttcttttactctaaattataattttttgaaaaatcactgttacagttcacattctgatcacaataataggtaagcagagcctcattttgacacctacctactttattgcggtgccgtgctctagtatttagtctgtatctcaaataactcttcaatctgcctcgtccttttgatccttttaggtcagtccttcattatctcctgttagaagtctcctaattttctaatggataagctcatctagtggataacaatgggataatattcaaaattcttacatggccagaaagccttcattgattcttttctgtagggtaccaccaattctcacttttctgaagtgcttatctttcccaaggcactaggattttaatttctctacatcttttttacttgctagtgcctcttcctagaatttcttcccttaccgtgtatttctagcaagctactactaatctttcaaaacttaaaattaatatcttctggccaggaagctatttcctgtctagcattctggttgcaggaaactggagcccacatggaccatactatacattatttgcagcatttgtaggcaaaggtgcctcatttgctgcaaatgtataatggaccctgtgctcattgagctccatcttcagtctacagagtccagaactgctttcagaagttctgttcttctggaggtaaataaatggaacctaagtccaaaattatttatacattgtcacagatgcacacctgctgctaggcctcacatgtgcaccccaacaacaaagatagcaatgacaaccacacacacacacacacccctgttgtgctcatatatgtataaatacactcattgtacagaaagccttaaaactgcccttgaatatgaaaataagatatttctcttttatttttgtcctcccttatccagcttagaattagtctaccttcaatgcatccattattgcttcctcaacttagctcacccacacagcaattaaactccacgtatttgaacaactcaaaaattccatgtgtgcaagaggctaagtgcataagaatcctagggcctagatgacaagaattactaaagaaacgtagcccactccttctcactcttttgcagttttgtatgttatatgtacattagtatgttacatgtacattaatttgcctgaagttgctgtgttggcttaatggaacaccattgccacctgctagccatattgagctattaaagtcctgcaattaaccaaattaagcgcaggttaacacaatcaggttttgctgtgctattgttttaaataacttttacgtatttaaatttagagtgcacagtgtgacacagcttgccatttaatgactcagcatgcatacagtaacctcagctaaccagcattaagtggaagtattatgtcttggcactgaagaatatagactgacatcaaaaataagagtttcaaggctcagttccaccatttgttagttatatgatctttgataagtcacttaacctgtctagactcacattatttaaaaaggtaaaaatagaataatagtagtgccttcttcatagggttgatataaccattaatgaaataagaaatttgaaatgcttacgtgataactaccatatggtcacaatcaatggatgttcctgcatattatttctctagcgttattacacctttcttctgattgccaaatatgtaaattcaactgtttctctgggcctccattttctcatgaactctatggtttaatttataaatatgttccaatgtagtttcatttgttttataaaatacagtccactacaggtagtgctccatttgttcaaccttatttgtatatgatgcagtccactctgtgaacatcagatttcaatcatcattgccttcccactgcactcacttttataaagtcaaagcataatttatagtaaataaaatacagtgatcttaagtgttcagatcaatacgttttaagaattgtatataccatgaaactgccatccaaaacaagatatgaaacgttttcttgtatgtaggaaatgcctcatggcttttatctatgttttttttccccaaagcatgtgttatccttatgcaggccctatgctaatctctgcatcatgtccattttagttcacgcaaccaaagtagacatgacacattgcaattctgatcacctctctttttctcacaaatccagtagaaattataaagaagaaaaagcaacaattaatccagaaatgctatttagtcaattgaagatcaacacattctaggtgagcgctgccccaagaatgtttaaagggagaaatcttttaaaataaaatgcaactataacattattgatatttttaaagggagacaacaggatatctcttagagaaatggaagtacctgtacagggcatcatgttctcagactcctcacttcagaatctgattcttagctctgtggacttgggagactgggttttcttagcattctcagagtggatcagatctttatggagaaaaacttgcaaagaaaatttagaaaacatttacatataaatcagaaaaatgatatatttacttacattaatatattaatatgctaataatgtattattgtaatctgctgttttcttttttcatttaccatatacttacatctcttatctaggattccctgttctcaacctttagttcattatcaccctcctctcctcacaaaggagacttttgagaccactgccaatgaaattttgatactgcatttgtattgtttatctgtatatatctgtttatgtatttctgtgccttatacatggaaagtaacattttctttcatttctcccaataccccagagccaattttcacctccttgggggtgatgtcaactccattgagaacatgtatcttattccttttttcctgctacctggcagcatgagatgttatattaatcctgtctttttattttctgtacttttgatgctttgacatctagggacttgctgactctggaaagactgccctttccaaagttaggcaattcttagagattaaaaaaaaagactccccttccagcatccttttcatatgcctttaataggcaaatcaaacaatctactacccacatcccaaccatctcctttactgatcctttacactccacgccaggttcagcttgtcctaattattccggggccaggttccagacaactaaagacagcctctgcaccccagaatctgaagagatgatccaactagccatttctaagccttcttacattgtattcttttccatggaaacctctatacaggctcttgcctatgtttttctccactttctctgcctctaaactgagcctggtgattcctctgaaaccctgcatggtgggtcctgccccctcctcttgggacctgtgaataataaaccatcttttcaatggtaatcttctcctgatttcttgggttcatgatacctgaatagtaataaaacctaaatttaaaaatacctatgtatcagggagttggttggccagtatggaatatgaataatcttgagagatatttgttagagttttgatgaagacttgtaaattccccctgttccttagaaagagtgctgtgaaaacactaccaaactcttgttctttttacttttacttttcttttctgggtctatacagacatctttatagttaattgactttttagtaaagagtaactgattaaactcatagcctttgtttaggctccacctgattctgccttcttagtttaccttttgaatgaaactgagtgtctccaaacattttcaggcatatatttatagtcaactcttgtggctattttgacaggtggttgacctcattcattatgtattgaatcttactattctcacctttagtataatcttatttctacatttttgggacacatcactgaaaccttctgtgttccatacgagacctgtaccagatatctctgcagccaaagagaagttttttttttatttttattttttcatgagctaacacaaggcttgcacaaaactcagcagcaagtaattcctttcttgtccagtatgaaaaagtgctgtctttgtcataaagcaaaaagagacaatgaaaggttaggttcttattgccccatctcattattgttaatgcaaaactagactaatttgcttgtggttatggaaatacctcctttaaccttggtgactgaatcagaaagaatttgttttggagatgggcattgcttaacagcatttggcatttgctcaggctgagcattcatcgtgagagtaagagccttctttccttctttagtgtagtaatctctgcagaaatatcacatgaaatatggtgcagaaaaccttcagcatagtggctgggatagaggcagtgtgctttgagtaaggctcttcagttggggcctgcattttctctggagccaagatacttctgacctcagcaaatggcttaactgctctgataaaaagtggatgataatgataacacttccttcttttcagatccataagaagaagagatttttttgtttttgtttttgtttttgtttcatctcctgctgtatgcttggtctctaaaagtgactggcagagggaagacaataaatatttgttgttgaatgaatgaagtgttatgatgagggttaactgacattataatgcaaagctcttggaccaagacctgacttatcataggccctcgaaagatattccttccaaaaacaatgacagcaaaaacaaaataaatgcttcatactcaataaagtgtctggtgatgggtttataggaaatttagtaattttaatattaaaaactaccatttacatcatctgattatttattcgccaaatatgtatcaagcaatcactaaataccatgcattattgcaggtcttggagatttagaggtaaacaaaaatagccacaagtaaaagctgtccacctataaaactttctgcccagcctagcgcaggttagagttcccatatgtctatcagtgatcaatagctgtgggagaagaaacctgtagaacactgaaaaaaataaagcattcagatcattaacttttttattaatcttttgccatttgtggatctgtcagcttctctaaaactcttgagatacaaaagcattatctctgagacaagagataattcccaagctctcctcttgattgcccacgtttgcctgagagaatttctcaaccagttgtttcaggttatagacataattggctattagtcattgcagtgccattgttcattgacatacctctcagcatcatctctcacccatctgcaaagcaaggtcctggtttctgattaatctttggctggtcattgaggatactgaagcagctcctggttaattagaccattttgtctctaacctcatccattctctggatgtaataatagggatagaggtggcagcaattgtaagcacagccctgaaaacttgctaatcggcctttgtgatttgccaggggtgccattgtttaaattgttaaagccaaattgttgtgagaggcagtaagtgggcatttttatctccaagtcaattacacacatttagtgaaacctaaggagctcataaattaaaagtaaataagtaaataggaaagcagcatctacaacacttagtgatgtaagtcacacacatacacaccacatacagggtgataaaatagcaaaatgtgcacttatgtggagaggaagcccacgtagtgataaggggtgagggctcctgagtttaccagctgtgtgaacttgggcaagtaaccgctctctgaaccttcttatctgttaaatggaagtaatattaaagcctacagggacatcaaaaggattaaattacattaatattttatgttatttcattaaataagattttataaactatctcaaagtctgctctattacgtgtgctaattatctggtagttactattattctagaaaagcatcctatcccccctaactcatgcaaagaaacaatgaacgtttccaatacttcacattaaaaaaattactttgacagtatccacaggaaatcaggtaaaaagcaaagacagacaagcttagctctttccactggactttgtgagatgtgtctagttgtactagagttcaggcgagcattctaagagatgctggagggcagaaaatgaagtgaacttcattctatgaagcacttgagacttgtctttcccagtatttccccatcatctctcaaagaactgcctattaataaaaaacaaacaaaaaaaacttattccttggtatgctaccaaaaaaaatattcttcattcaagtaagtttggaaaccactgagtattacatttccctgtgaagaatcataatcattattttggtgttaaaaggcctgagaaatcaggaaaagctctaataaaaggaataaaaagaatagctttgaatcctttaacctaatttttcaaaaataccccacacaacatgtgttaccacacaaattgcattttgaaaaaatgctggccaggcacagtggctcatgcctgtaatctcagggctttgggtggccaaggcaggtggatcacctgaggttagggattcgagaccaacctgaccaacatggtgaaacccgatctctactaaaaatacaaaattagccagtcatgggggtgcatgcttgtaatccctgctattcaggaggctgaggcaggagaattgcttgagcccgggagatggagtttgcagtgagccaaggttgcaacattgcactccagcctgggcaacaagaacgaaactgtctcaaacaaaaaaaaaaaagaaagaaagaaaagaaaaaatgctgagctacaacatagtaggttgaagagtgtcctccaaagcatccgcacccactcagaaactaagagtgcgatcttatttagaaacagagtcttcgcatatgtaatttgttaaaaatcttgtaatttgttaaaacctggattttgactgggccttaaattcagtggctgatgtctctatgagaaaagaataggacacacagattcagagaagatggtgacgtgaagatggagacagagattgaaatcatgcatctacaagtcaaacaatgccaaggattgctggcaaccaccaaaagaaaccagaacgtcatgggatggtttttccttcagagcctccagaaggaaccaaccctgctgacacctcggtttcaggctgtagacttctagactcctgaaccatgagagacaatatatgcttttttttttttttttttcctgagacaaggtctccctctgtcactcagtctggagagcagtgacaccatcacagctctctgctgcctcagccacctcaggtccaggtgattctctcacctcagcctccctagtagctgggactacaggtgtatgccaccatgcccagctaatttttgtaatttttatagagacagggtctcaccatgttgccaaagctggtctcaaactcctaggctcaagcagtccccccaccttggccccccaaagtgctggaattacaggtgtgagccaccacacccagccaaatttgttgttttaagccacctagtttgccaaaattggttgcagcagcactaggaaactaattcatatttagtatttttaaatggctatttgaaatgtaaaaaaaaatgccatgaaatatattgcaattaaaaactttgttctctctgctgcctatttgttttggttccattttttggcaatttgaggtagaggaattggaacacagacgggaggagataagaagcactctctgctaagtgagtgattaagagctcactcatggctcaaaaggaaactctccattatattttctattatcacttgtgttcttgtcaatataagtacttgccacttgtgaatcattttggcgtttgcaaaaactttcttaaacagtcaatttcttccattctaccaccaaaagaaacaaataaaataaacaatagacaaatgcaatagcaatgtttactaaaattaagtttttcactctgcttagctttgaaatctgtatggaaaattaagataaaggcctacattttcatagataaagcggtagaaaactttgtttttagacatatatatatgtcttttttttagacatatatatatattttttaagatgaagtctcgctctgttgctgaggctgtcactgcaatgttcacctcctgggtttaagtgactctcctgcttcagtctcatgagtaggtgggattacaagtgtgtgccaccacgcctggctaatttttgtaccgttagtagagatggggtttcaccatgttgaccagactggtctcgaactccttgcctcaagatatctgccctcctcagcttcccaaactgccaggactacaggcgtaagccaccgtgcctggctcagcatgtatttttaattcagctctttggagagctgcatctactgagcactgcgtgggcttagtctcactgtgtagttgaatcttggtggatggaggccatctgtggtacctctaaagctacagtaagaacagccaatgccatggcatcaaaggaagccagaggcatttggaccttttggggtctggcaggcaaataaagaaaagactagatttggcctgagtctagtttcttctcatctggacactagctcatagctcataactgggctctcttttttaagctccataaatgcaagcatgacatgcatatgtgtatacagaatttggacatgttttccaaattgtaaatgtgatcacagccttaagtaaaatttatgtctcccaaagccctcaggattagttcctcattctttaaggaggctcaaaataacttcatgtcactttggttatctctctagccccatttcttgtcaactttttccttaagaagaataacttgacttctctaaatactcctttatttctctcagggcatatgcatttacttaccctatactctttcttctttctttccctttgtttctttcgttctttttttctttttttttttttcccaaggtctgattttatcgcccaggctggagtactgtgacacaatctaggctcactgcaacctctgcctcctgggctcaagccatcctcccacctcagcctcctgagtagagtagctgggactacaggcaccactgtgcccagctaacattttgtgtgtgtgtgtgtgtgtgtgtgtgtgtgtgtgtgtgtgtgtgtgtattttttgtagagacagggtttcactatgctgcccaggctggtctcaaactcctgagttcaagtgaaccactcaccttggcctcccaaagtgctgggattacaggagtaagccgccatgctcagcccctattctctttctaaaagaatccatttgctctttttttccctatgattgggttagcatcatggcttccaatgtttgactgaatggttttaaattctaccctccatgaaacgggaaaattagcttttttttctcatggagttttgttgagatttgaatcagataataaatgccaagttactacatataacagagagttgtcaaaaatatcatcactctcatttttcatatcccagcttaactatcattggaactgaaaaacactccctgaacctcacaagattcgattagataaaattagctgtaactattagaacaaccccaacatcaattcccttatatccagtagttccacttctagaaaagtttgctaagaaagtaattctaaatttaggaaaaacttttattattgcattatttataatagaaaacaaaaatatggagctacccaaacattttcacttcatttagacttatcagtcttgtgatggattgttagggaccttctgaatcatattattccattaaaaataaaaattcacaaggacaaattaatagcatagaaattcctatgttatattgttaaccgaataacagcagggattaaaaattgatgggatagtatagaaaaaaaaatcctggaattacaggtgcaaatatcttaacagaattattttgtaatgtaataattgggtattttttctctatttttctgagtcttgcaaatattccataataagcatccattacatttataacggcataaaataataaccttaatctttaaaaaatgctagtggagtaaatgaaacttttcctgcattttcttgccagttcatgtcgctggggagtgtcacttatttctcttgtctgtttccctatggtgaaaaacatagaaacatgttgataaagaacacaaagaaagaatgcatgactaggaatgaggagaaggaaaagcttcatgcatactcagctgtaacatgtttgggccgggcgcggtggctcacgcctgtaatcccagcacttcggaaggccgaggcgggcggatcacgagctcaggatatcaagaccatcctggctaacacggtgaaaccgcgtctctactaaaaatacaagaaatcagccgggcgtggtggcgggcgcctgtagtcccagctactcgggaggctgaggcgggagaatggcgggaaccccggggggcggagcttgcagtgagccaagatggcgccaccgccctccagcctgggcgacagagccagactccgtctcaaaaaataaataaataaataaataaataaataaataaataaataaatacaaataaaataaaataaaatttttacaaagtcaatgtaacaactcagggaaactatttgtcttcaaacattgaagtaagaaagacaggaacccaaattcagaaccagctgaaccttgaaggaataaacagtaaatgtcaagggcttttctcacacagggaatgaaccggttttcctgctcataaaagaaaacaaaaatattgagtatgagtctgaaaaatatgaacttcctcatgtttgtcatctccataaactatccctgtcattttatctttttactgagaggaagataatttagcaaaatgaagcacgggctgctatttcattttcttattacatatttgaattcagtctagtataattatggtgtttatgaagtttaaactgatgtagcaagagagtaataggaagaataagtgatcatccactctcaacatgataaggagcatttcttgataagaaagttgactttaccaagtacaggaaatatgtaagaggttttatcagacaataattttaatttatgagatgctttcattgtgttccactaagaaaatatacatttatttctaaataagttagttttaaagcaaagtgagaacaacagtagcaaaaatgtctcacagttacagacacaggcaaaacaaaaacaaaaatacctgcccccatctgtgagaaaagagctcacaaagaaccaggaaattataaatgagcagatttgcccttggctgtaggcaagatccctgagacagtaataagaaatgaggttaccaaacatccagagagatatgagctgataaaacttaatcaggctagtttcacaaagggcaaatcttttctgacgaatttggtggcatttttgcatggcacatggggcaggagaagtacgtgacaggaatgcgggatagaattcaactgaagaaggtagaaagccatggatgatacacatgaaaatgaggtacggtcttagctttccgaagaagagcacttgggagacgtttagcccaaatgcgttgatttcatgaagatatttatgttgacaataaacatgaagcgtggttgatggactggcatgcttagcagtgaaaccacggtagcaaaattatgtctgttatcatcaaataatgcacgcttggggtgcgtatgtatgtttgccattccagattttttttagagtattctcatcagttatttgcagtcatgcactgcataataacattttggtcaatgaccgactcccccctatgagatggtggtaacttaggattataataccttttctatgtatagatatgtttcgatacacaaatactccccattgtgttacagttgtctgcagtactcagtacagtaacatgctggctgtgcaggtttgtagcctagaagcaataggctgtgtaccatacagcctaggtgtgtagcaggctatactgtctaggtttgtgtaagtgcactctgtgatattcccacaatgacaaaattgcctaatgacacatttcgcagaatgcatttccatggttaagccactcatgactgtatttactttttccaaatgtttatgttattagtatatatagagagagccaatgacatttcagagagacacactcttatctcaaagaggaaccaatgggccacactgcaatatctcaatgataataataggttttacagcatttctagcatctttactctgagacatttttaaaaaacgcttttagttgttttgtgtacttgacagtaggctgttatttttcaaaggttaatgttgaagtgttctaaaattgggaaagtaatagggtcaaatacccagaagttcaaaagaaagaatctgagtttcctgcttagttggtccctcagcgtcaatgtacaaataggcttgtctctttcatcttaaaaagataaataatccaaactgaaatacatacatacaaacaatttctctacctcctgctgttgtttctgctcacctctcccttctctttgctgtctgacttctttatagagcaacctgtacaccattccatagttttatttcagttcccagtttatctcaagcttggcctttatgtctcaattcatcttgatttgagagtgaaatttctcccaaagaagaaacaaggactttctgatgatcaacattagtgccttattgctgttgctcttgtttttcacggttactctctaacatatataactcttaacatgtgtaactaatataactcttaattacatcctccttgttaaaaactctcctgttttggcctcccatatgatggatggggtaggcagaataatggcccccaagatgtcaatattctaatccctggaacatgtgaatctgttagattacaagacaaagggaaattacggttaaaaatggaattgaggttgctaataaagagattattttggattagctggggaggcctttgaagtagaagagggaggtagaaaaagggccagaggaaaatgtaactatggaggaatagtagagtaatttaatgtgagaaggactcaacatgctgttcctgattttaaagatagagaaaggtgtccacaatccgaggaacgtgggcagtctctagaagtcgtataaggcaaggaaacagatttcactccagagcctctaggaaatgcagccctgatgacatcttgatttgagctcactgagacccattttggaattcaaacctacagaactataagatagtaaaattgtgttgttttacaccattgagtttgaggtaatttgttacggcaacaatagaaaaatagtacaatggtgttctggcaaaatagtctcaacttctcatgcagatcttcctcagaacattgggctgttttctttcttttgtcaattccctagatgttgacagtccttggttttcatccttagctttctttttattcagttccatgctgttgctgccttttacaaagcaatgccatcaaactcagtctctttccccaaccagattcctgcttgtagctacctatctacatctacaagtccctcacaaaatccaaatttaacatgctttatgatagtttttaaaaaggcaaaatcatcaatttcaaagaaatgtaaatgaacacatgaaagattttctttaactcactgatcaatgaagggaccagtaaaatgttgcaacttgttcaaagaagaatccaaagtaccacacatgtgtaggtgataaggaatgctaaaataaatgtataaatagatgcagaacaggcttaccatgggtaaattggatggtatgtgaattatattttaagaaagctgttacaaaagcaaacaagcaaaaagtttggcttattcattagggaaaaataggaaaaaaatcacctgcatttcattggacacagtttatttgcatttcaatgaccaaaagtcatttgcattcttaatagttttctcctctttacattgttgcaaagtagttaagagtcattgaaaggcagggttaatcttataatctgcaatctgcaagagtacctaattgcagggtactctgcaatctttccatgtccatattgaaattttcgcaagttttcctgatatgtcctatcacatatctctaatccaaatactttctcattctcctgaagatcatttcacacatacatccctcttaaacctcccatacttcccctcctatcatctgtctcagctgatgatcttcctacttcccaaggaaataagagaaaaaaacagaagataattttaacttgctttccaccccacatgcatcagtgtattttccatctgtctccacttactctgccttccctcctgttactgtggatggaagctttctttctaaggccaaccactgcactgtgaactcagtgcctccctgtcaccaccagggtgtcactcaaggtattgtcttctccctctcctgtatcatcatgttcttatgcaactgcatcatgcccagaatcatgtcaatataatgtagtatcccatctcaaccaaatgcaccattgaccccatgtctttctgtagtacaaacctatttctctagacccttttatgagaaactccttagaattttttctttttcaaattcactgtcttcaattcctctctttacatactccatatcctcactccattcaggatgtacactccactcagcaactcttgctaggtccttagtaacctcttccacattgctaaatgcagtggaatgttttttactcatcttatttgcctagcttccctatttgtcaaagctgaccattcagcttctttaattttagattctagtccatcactctcataggacactcctacaacattggctattgttcctcagtccctttactggttcctcctcaccagtgtgatctttagttgttgctgtgtcttcaggatgggtttggggtctttgtttgtttgttttgctttgtatacactcaatccgatgatcttcaaatgcatataccttcagttcataattatctccagaactccagattcatctattggatgccaccttagatatttcagtagaaagtctaacagaaacctcaaactcaacatttataaaaccaaagtctttgtcctcctcccaacccccagcacaagccagctgttctacttgagtgttttctctccccagaaaatggaaaacctatccctccatttccttaggctgaatacctgatactcattcatgatttccaaatttttctccaacatattacaaatctcattgctttaatatacaaaaaaagatctagaatccaattattatacatctataccacaaatactttggtcccagccaccattattttcccttaaattatatcaatgctttcagtctcaggggtttgacgcttgctgttcctctgcctagaaatttttctcagtgcatgttttattatccacttttcttttgatctctgttcagatgtcaccagaccagtgatgccttccttcactgccttttataaaataacacctgacttcagcatttctagctcccttaccctttatttctctccatagcactcacaacaatctcatataacttctgtttgtttgttcatttatcttatgcctccctcaattagaatacaaacgctgtcacagactcaaagttatctgttttgttcattgctgtattttcaggctctaagatggttctcgcacatagtaatcccacaaataaatgattgttcagtaaatgaataaaaaataaattaaatttatatctcctctctcatcttctttcattctcactgctcctcatctttctcttctcctcttcctttaacagctaaggacttcaacatacatgcattcttccattcatccctaatagctaactcagagtaatctctaatgctgtctttgcctctttcctcacatcaaatcatttataatattttgttggtattgtgcctacatactccaaaaaagctctcacatcattcttgtcctctttattcctactgacaatgcccaattatctcagtggtttcaaacgtttgataaataatctccttgatctgtggtttctctttccctatccttcctcccgtgagtcatggatctaaacatatcataatcttgcttaaaactgaaaacacttccatgttttctaactgtttacaggtcaaattcaaacctctgtcatatcatttaaggtccttcaaaactgttctaaatctgccattccatctttttatttcatgactctcctaccttccagactagttatattcttttgaatgacaggtattttcatatctttattcaagcttttcttcttcttaaaacttccttactgtaactcctgtttcaatgccattcttattttcattcttttacacatagttcaaatgttgcctcttttggcattcttccaaaacctctaggtagaattaattgcttccttctctgggctcctttaaaattatatttatacttttggtgtagtacttatcctgtaatattgtagttcgttaattgttttcttattggcttccctttctggagtataaatcatagtgatttacggtatgagttctggagtcagtttgcctagactcaaaattgagcctcaccaccctttagctatttgatattgaacaagttatttccattctctaaacctcattttctcatctttaaaatggaaatattaaaatctgcctcgcagagttcttgaaaggaccaaataagataattcatattacaagtttaacttgattcctggcacttactatgctcccaaattattatttgagtgtcagcttcttgaatgtaatccacttatttatttttgcattgtcagtgcataaagaaggttcaacacagagttagagctaataaaagttggtcgagtttacttatgttggatttatcactgtgtgctggcaatatctagataagcaatgatgtagaattttattttggtctggctttaacctaaagagatcaacagaatgtgaaatatatgctaatgaactcttcttattataatttactttatgatctgcatgccacttccaatatggcatatacattttaggcaggtttaatgcttaatctcaaatcacaaggtcaccatagatgtctgactggactgaaatacttcatatttcatatttgaatactggatcttcaactttataccatgtgtataccattagttcattctgctagagtaacataaagataaccagaatgattccattatgtgaaaagcagctttcacattaagaattgtcttctcaaatgtctactgcatgtaagaaataacaagcatggccactgtcaggtgactgtgcagcttctcttcttcacatctttggtgttacctagagtaagaggccactgagtgtccagtccttagacacagtctagctttgcatcttgtgaagtgagtgctgatttcaagtatggcttgaatctaactgatgcttgatgttcaagcgttattgaacatatacttttgaaataattccaaatacatttgttgaaagtattattatcaaatgattattacaatgaaaatttatttttattacaatttaaaagacaacaattcaaaaatcagtctcccatcccagcccttaaatactgagcaacatcagtgtctccagttgttggttggacaggtaaaactgtgagccccagcaccatcaaaatcagtatctttatacctgaattagtattttttcctaatacaagcattcctcttttctttattcctctattttgaaaaacaacaaatatctgagcaatctttaatgtttccttttcctttaatcatgctcccacattcagttaactggcaaatcaccttttacctttgctttcaattcttgctcccaccaccttagtaagatgtatctctctacttagactagtataagaatttcataactatttttaaaactctagctttatcatctttatttttgaacatagctgacaaagtttacttttttccttttttctttctcctatgaagtaagtctgacatatcttcactgcataaaacccttcaaaagataaacatcaacaggcagtgggatctcagttcagagcttgatcttttgacttaaagctccggtctgcctctagttcttaagtaggacacttgacctctctagaattacttttctgttttattttttttctgtaaattaggtaaacatttctctaagtattttttctattttaaaattttgtgacttgacaggaagtttaaagaaaattggtaaaagataaatacgtgtggtaaggggagggagaaggaagaaagaagggaagtgaagggaagggaaggaaagggaaggaaaaaggaaagaaaaaaaaaaggcttaactctttatagaacctgcattccaagaaagatattaagtgagtttagtctagcttaagctctacaggttaaagagtatgagtttgaaaaactaaggtagaagcttggtaatagaagaaaaataaagccagggagggtagagcttttatagtactgaaagtatgcagaactcaagtggatgtataatttgtgtcactctggacttggagtcaaacctggatttgaatgccagctctggactattaatagggatgtgattttgagctaattatttaatgtctttaagttttagtcaggttcaactacatcatttgcagaccccagtacaaaaggaacatgtgagccccttgttcaaaaggcagaaaaaaattgccattaaaggcattaaaatataaaatgttttcttacttccctggtatctttcttgatctggaatgatgttttttatttgctttttaatggcactttccttttgggcatgggaatactttctcagcgaccctcacatgacctgggggccttgccccaccattcagtgtaaatgtgactcactgctgacccactgacttccaggttctccctttcatcagctgcctaaccaatatgcagtgccccagctcatagccccaactcacactaatggaaaatcctcaaaggctttgcaacatttgtgcaaattagacttctgcggtagaagatattctggaggttccaggagccacggtggggaaatatattgggagcaacaaaattctaacacagaaagatctcaggtactttatatctgggtgtgatcttggagctctctagtcttatccctgggtgaaacctgaaatttacccaggctcatacaatgtgattcaggtagaaccaaaaataatatgacttttagttctgtgttcttttagatacaggctttctaatgtatgtgagtttcccttgtgatttcctctaaaagcccaggttgtctgcacttttgtagttctggagaggaaaagcagccaaacactggtctctttctatggtttatttaaagctatctttctcaaggctgttttagttgtaagaaacagaaaccatacaattagtggttcatgtaacctagaggcagatctcactagaaattgaaaccaaagatctaaaaattcagggaataaagcctctctcctctaaattactcattctctccatcattctgttcccccccaccctctctctctatcatctacttatctcaatttctgcctttgtgtagactggtgttctctacctcctcatgagttttatggacgatggatattataaaagttatgaacatcctcatctctgctcaagcaaccagcagagactagcatctcttaatattatatctaaattcttgggagagagaaacaccagagcccaagaagaacatattcacttctcatccagtcagccatggcccaaggaatggcctaaagcagattgaacatgcctttaaggatctccacagtttaagagctacttctccatgaaatggttcatgggccattcagaaatgccagaatgtcactgcattcgaataaaaagttctcagtatttagggaataataatgaacgttagataccagtaggttagatgtaatattgcagtcagatcatggaattaactttttaattccatagaagataatggaggaagaaaggtagggcagaaccctttatgcattttcaacaatattgtacaattttcatataattattacttagaaacatttatttttcagtgtctacctattccaaagttcttgccttactgccaaataaaacttgttttttttttttttttttgagataaggtcttgaacttctgggctcaagcaatctgcccgtcttggcctcccaaagtgtggggattacaggtgtgagccaccatgcccagcctctctaataaaacattttgtagagagtaccattataatcattggtgattacaatgtatagtagtatgtatacacatatagtttttatatgtgtgtgtatatatatacacatacatgtgtgtgtatatatatacatgtgtgtatatatatacatatgtgtgtgtatatatatacacacacacatatatatgtgtatacacatacacatacagtagtatgtgtcttcaatacaattactcactgattgtagcagtggctcaaaaataccaacaccattctttttcccaaatacattcttaaagcacaagtatttgaaaatgcattttgatttcttgtttttgatatcatattgtcacatgttttcagctgttcctatacagaaaaccaacattgttcttgctttctgattgtatagacaaaacaataaagacttgctgttatttcatcatttcattacagtatgagaaaaatctaacaatttaccaaaagatattaaacaattagttgaaactagactttttacttatcaagtggtataaattcaagctcctaaaaagttgataacaaatataaatgaaaaaaaggaatgatatcaactgactgatgataattcaacaagacctaacttctgtgtctttcaaaatgacctaaagttacttagaaaaatgtctttaagtttctcatctatcaaatgggaacagaaatgtgcatctcacaaaaggcatcacagggatttaatttggaaactgctgtatgtatatattttttgaaaaccactaatcattctcacaagtataagatattattaagccaagttatacccccaatttggactacatgaagtttaaaccagacttttctctgagtgaaagtaaaggaaagcaaatgaattagcatttgttgtgtgcttgttttgtgcctggcataatgtatgttgcttaatatgcattatttcaaccaggttttctttttttgtgtaggaggtagggggttggaaactttaaagagattttatggagatctgcaaaaaagtcattcatattcccaccatcaaaaattaagttaccatctcagcgtatttatttcccatctcttttcttcattttttaaaaaatctgatgtttctttaatataacgcatttttattttaatcattcaaactatgaaatattatgcaaagaaaataaaaaacctatctccaataaaactttctctaaaaataaaaattattaatattgggtaaaattatagccatctttctatatatataaatacagaaaagatatactgtattcatgtatagatagataatagcatagaagaatacaaatattttataaaaatgagatcataccatagacgttacttttaacgtcaagattaaattttattttagaaaacagaataaaacaaagtaaaaatgataaataatttgaacttctaataaatgatttgagacaaaaaaattttttaaatgatttctctaaggttaaaagatacaatgaatgatacaaagaggtcagagtgcctttgtttgtaaatacaataatattatatgtatatatgtgtacatgtatgtatctatagactttttgctgtgaaagatgatactagcgctcatactagctaattatattccctcattcacttctcatttttctattttgttgtttatcttatcgaggttgtagcatttatattctgttctataactaaaactagcagagttcttaagtgtaagtttgtgtttgaaagtattctgtgtgtatcccattattcctctttcattctcaagatctgcatattgattcatatttaattgaatggatttcattgttaagtgatctctttaagaataatcatctgttatttttcatattagcttttttatattagtttttttaatgttcaaattgttcaaatgtgtttgttggatgtcttttttttttttttttttttttttgagacggagttttgctcttgttgcccaggctggagtgcaatggcgtaatctcagctcactgcaacctctgcctcctgagttcaagcgattctcctgcctcagcctccctagtagctgggattacaggcgcccaccaccacgcccagctaattttttatatttttagtagagatggggtttcactatgttggccaggctggtctcaaactcctaacctcaggcgatccacccacctccacctcccaaagtgctgggattacatgtgtgagccactgtgcccggctcagatgccattatatttgaaagatatattggtgataatactaaagtcatccttccatttggaatatttacagacttttcttcattgacttctggtataaaatggtactgtttaaaatcccagcttattctgagttttcttttttactctgtgtatgtatgtgtgtgtgatggggtcttgctctatcacccaggctatagtacagcagtgtgatcatagttcactgcagcctcaaatccctgggctcaagtgattctctcacttcgtctcccaagtagctgggactacaagcacccaccactgctaatttttcttttctttttgtttttggtagagacagggtctccctatagtacccaggctcggtctcaaactcttagcctcaagtgatccttctgtcttgatctctcaaagtgcagggattacaggcatgagcccctgtgcccatcctttcacttttacttagcttgctatttctgtccagtcttcttaaagaagcttcctcttgatgttcttcaaatattagtcacttaatcagcaaacgctttggtgttgagtattcactctttcaaatatttctggaacatgttctttccatttatagtaacttttcttaatggtatttactgagacatgtgtttgattctataactcggtgacatcaaggatcttaatgttgaatcatctttatctatgtttctaatccattaccttctcctcattgttttattatctgtgcttttttcacattatgtgagataattacaatcatctcaaaacattatagcagtaatgtgactttcagtgggtatctgttttgttgcttgcctattccaattgatttatttgttatttattgatgttgcctgggttacagtttgcatccttaggttcatggtctccaaatttatctggttctattgtctgtgtatttttttcatattgacattgttatattatttttaaaaactcatgctcttattctatagcataaaactgttttgaggaattccccaggttttcttgagttatgttttcttttagattgagtattttccctgtcttggtcatgccatgttttactcttttattgctgcaatatatttgcatagttactattccatttcttttcatattgttcatgcttgagaaactgtgtacagaaaattcattttacttaatggggaaatatattttttgaattttatttttattatatctgggaacaattttttttctccttcttagctccagtttggagacaggatttatggcgagtacccacattttgtagcctgagagaatgatggggccaaggaaagttcagcctttttaggatacctgggtgcttctctctatcctaagatttctttttcaatgaattgtagccagattattattggaagagacttcagtatacttcattggaagatgtagcacttttctaatgggcttcagaggcttcacccctgagtgcatgggcatgacattattaattggttaaacagagtcagctttactatccatatttccccactttacttttttttttttcctagaagcccttttcattgctcttcagccagaaagaggtaaaagaaaaagataagacctttccatctgtgtacatacaaatctgcttatctccagatttagaagttataatgagaattctcagaatgctgttatttcaccagtaaatcctatagggtgtgaggacgacattaggaaatcaagaactccttcccttctctgagcctgaccagactgcttttactccacagttgtttttggtttttttctttaagtaattttgtcaggatatgttccttttcttttcaggcattgttaatttctgtttgtctgttatttgtacttacaacgtctcacacatttcattaggcactgatactgatataagaaaactcactcaaacatcttcaatccacttgctcgatcatcatttacaggaacactaaaatatatgacatagcatcctcctttaacagctgagaaatcagagaacaagagtggtgaagtaaattgtccagcactggggagccagtaattgaccaggctagaattaaaacctctatctatctacacttctaggtcactgaggaaaggtgcctaaattacaattttaagatgaggttaataaaagaacttattttacccaattgcaaatattttagaagactaatatgatggaagcagatctgagtggatggtgaaaacaatggagagggaatcaggaagccaaagtttaatttcttgctctctcttaagacagatgttaaatttggaaaagatgattcaacttcctgggtttcaatttccttctctttaataataatgatggatgatgatgatgatgctgatgattgtcataatttgatgactatatatctactcattgtgaggcacaatgtgacatattttataaacaatatattattaaatctcaaaacaaccatctgatatacacattgcatctattttaataacaaggacacagaagattgcttaaatcccctgaggcccatttgattccagagcacacgttcttaaccagtagctctatggtctttccaaccaagaagtctgacctgagtggtctgtaaaagatcttccagctttgaggttctctagtgctgtggttggtatagaaggaaatgactatgggttaacataggagaagcaagctcacacatcactcaagtacaattattagagttacagactggacttcaaattaagtcctaacatgatcaggtttacgcttgatgttgtgcattgcactggaggggagaaaacataatttcttttatttccctttttaggtttttagttgagacaccctcctacaaacaaaaatcaaattaacaaaagaaaagcagaaatgtattaacacatgctggacccatcatgccgagagacatcaattcaaaagtatttttctcaaggcagtggcttggggtgatgtttcaataatattttatcaaaatgccataaattctgcatagtaacaaggcaaaggaaagaacagttttagtcctttaaaaggtgagaaaatgtgagaggatagtgaaatctgttctcagattcctctggtgcctgctggtgccttctctgggctgataacaagtgctgtctccagtaaggaagcatggatgtcctgccatcaagcaaacagaggctgaggccgggtattctcctgccttttcagtgcctttaactcaacaatcctcaatatttggggaagaaatattttggtttctttcaagacattaaaaaataaaaaccacagaatttcaccttacacatgagtactaagctcttcctcatcctcttccccttccctttctttcatagcaatttagtccaaatgccatgaattggagctgagtgaggtaggcatccatgtgcatgtggaagaggagagccacagcagtccagcctgaggtgctggaacctgagagaggcgagagaggcatccatgcagggcaggggttaggacagtggtgacttggtgtgagtggcagagcccaagtaaggtgagaaggccatacctgtggtggggtggcctggcagagggtatcagagcctgaggaaggggaagagggttccattgttaggggagggtgttgaaggcagaagcctggagtctggtgttggagccaaggagaaggagggtggtttctgggggaaagagagctcccgtgtgatctgaaagatgtgagaaagcgagaaagctatccatgtaggaatatgtctgtgtaccaagtgtcagagcccgagtggggtgaaggaggacatccacactggaggcagaccctaaacagggtcagaatctgagtgaggtgaggagggaggaatcacccagctagtggtgtcagggcaggtataggagtaaaactgggagtggacatcaggacctgagcagggggaagaggacgctgacagtgatacgagactagtcacatacaggggaagtgagcaaatgcataaatatgtcaaagataatgggcaccagggttctcacagcctaaatgggagttgcaaatataaacagaggacaactgtaaatcaccataaatgaacacatcacacacgtataaaatctacgcacacacacaaatttgctgagaggctctgggcaagagcacctcaaaaaaaaatgagtacggtgagcatcctcatgatggcttctaaataccaatctctaataaaggaagccaggttgttttgttttgttttgtttttgtttttaacaacaacaacaaaaatggctactttgctggcagagcaggtgaaatacaagatgatcctggaactctctcttgtatcagaaaggaagaattcaaagaagggtaaggacatgccaaaggcaagccatttgaaagcatcgaataaatagcaaatgtattataactcatttaccaaaataagaaaccttggattcacaccgataaaacagatcatcctcatagaaatatatgaataaaaagtttaaatgtccagtgaggcatatttgcattgtctaaaatccctagccacaaaacactaattataaagaaaaaaaagatacttacttttatactggagaagtctgacaggtaccaccttagtcaaatgattatttaacttcaagagcaatgggacagatagaagtcttaaccttctacctgacagaacgcagcataaagagcacagcatcctgaatcgaattgtaatgaaagtggtttattacctccaatggtgtatccagtgaaggaggagaggatagagggaaagagggcaagacaatgggatcagtgtacttgctggctgggagaagccttttttatagtgatttttaaagccaatttttactgcttttattattatttttgaacatctttatagacccttttattatatgtgcccttggcatatagctcctaccaatacagggaagagtctgtgacttgccattgatacctgactattcagacaagcccaaatgaggtgaaactttaccacataactgccttgtgatctaaggtgttaaagtcagggaaatcaaggaaagactgtggaattgttgcagattgaaatagactaaagagacataattaagagaggccatgcatggtggatcatgcctgtaatcccagcacattgggaggctgaggtgaatggaatgcttgagcccagaattttaagacaagcctggcaacatggtgaaacaccatctctacaagaaaacaaaaattaacctggcatggtggcaaaaattaacccaggagggctaggtgggaggttcacctgagcccaggaggttgaggctgcagtgagctgtgattgtgccactgcaattcagcctgtgcaacagaatgacaatctgtctcaaaaaataaaaagaaaataaaaaagaaaaaaaatatcaactggattcttttggtgtaaaagattttattgggggccagacacagtggcttaatcctgtaatcccagcactttgggaggctgaggtgggagaatggcttgaggtcaggagtttgagaccagcttgagcaacagaaggtgactccatatagccaggcatggtggcaggcacctgtagttctaactacttgggaggctgagatgggaggatcacttgagcccaggagttagaggcttctgtgagctatgatcacactactgcactccagcttgggtgacagagtgagacactgtctctacaacaaaaatgaaacaacaaaaaatagaattttattagaaaaaatgggaaatgggacctgaagattagctgcttagagctgaatcaatgttaatttcttgatattgttggttttgggggtgttatgccctttgtttgttggaaatataaactaatttatttgggtaataggggattggtttacaagagaaaaaaattctttgtccatttttgtaatactttttgtgaatttgagattgttttaaaataaaataattttaaatatgtatattgaattgatatttaatatagacttgcattcaaaacagggccacttttttttcatgtgatttattcttttcttttcccaggtgatggtcttttaagccgtcctatttttactcaggagccacatgatgtcatttttcctttggatttatcaaaatctgaggtcatcctgaattgtgctgctaatggttacccttcgcctcattataggtaaaatcctacctgtgggcaccacactattttgttcttcctcactgaaccaaaacatacacaaaataaagtgttttataaaatgtcctaatttgtagtgtacagctcaaggaatttctctacgggtatgcagccatgtgacaatcactcagataaagatataggcatttccagtaccccagggtattccctcatgccgctttccaggcaataattaaccccctacccaccagctccaggtaaccgtacttatgtctctgtcttattgattaggtctgcttagaacatttattcttgagattggtgccatgcattgccttattgtggtcagaaatgagagagagagagaagagagataggggagagagagaagagaaagacaggaagcaagtaacacaggaagccaggaagaaaagaaagataaaaggaaagaaaaaaatgaagagaaaggaaaaaaaaagatttgtttcctcaatttgaaagactaaaatgtaagctcattttgcatttcccacccctgcctcaatgcggaactgcagcctcagttgctgcatatgcaatgattatgaaaatgttctataaggaatgaatccagatggatatctagatttatttcatcagataaaattatgtgacttcactggtgggtcacatcacccaaaaatactgattttagaaaaatatgttgaagacagctatgtaccctctaaggcagaaagggaatttttattctgggcaaataagaaaaaaaaacctatatttgtttctcacatattatttgtggaattctagggagaaagggtcagtaagtttttgttcttatttatcaagttgtagcaaaggcagaatttgcttcatattgtgggtggaatttacaaatttaaaaatatatgcatacgtaaatattcataggtaaatactacagatatttagttagtagaaacttcatatgtagtgttaatacaggaaaagaaaatacatattaaacttttgtagctttgggttttaaaacctttttttaagtcttgttttacagatgtgaagttgatatgacacacacaaagagtaacaacttcagtgtattttggcaaaataagctggtttagcctgattttattttgcagtaaaaatacactcttgatgtgcatagttatttagatcctaaaattgtctagattaatgagttaaatgacttaaatgcacttaattagctaaatgacttcaaagctaaaggcaattctaccttatcttgaatttttttgagctaacttcagtgtcttctttttacaacaaaggagctgaaaaaccatgtcttctcattccacagactaaagcttccttgtctttatcatacccaaaccagtgaaactcatctgtcaggggaagatccttcactttgcaaatttgggacactcaattcagagtttgttgatttgttagtttttcttaaatgatgagctgtcctattagtttaatatatggttaaatatatgaaaatttgattaatacatttagtgagatcacctaatacttaaagtagtaattttatgtttgagagctaactaggttgatcctaggggttagtagagaaagaatataagaattcctataacattttttgaaagtttgctgaatataagacagacacataaatacataaattacatatttatataaaaaatctattggcttttaacagttagaaggatataaaataggttctcaagataatttgctaattagttttatctgtgaaaaaatagaatgaaggcaacagttttcaatgttgttaaatggcttttatttctaagatccttgtaagctaaaaggctaaagacaagtaatttatgtgcttatttccagcccccataacctggtttggctcatttcttttttttttaacttttaagttcaggggtacatatgcaggtttgttatatagataaacttgtgacatgggggtttgttgtacaaattatttcatcatccaggcactaaccctggtgcttattagttatttttcctgatcctctctctcctcccatcctccatcctccagcaggccccagtcgttgttccccttactcatagacaagaaactatggaaagagagtgagaaaagaattaagtttttaatgcttaaatgtcagactcaggcccaactttattgataataaagcaaaggacagaggtatttcagataacgtgcattaccaacaaaatgtaaaagttcagttttaatatgaccctttctaacttaaattttattttttaaaaagcctcacaactatattcaccttagatggtgtgtgtgtgcatgtgtgtcttagaaggaaagccttcacaattcacagattctaacgttatttgaggttacctgggtatagtgtaaagcaacataaaagaatccttgacttaaagttatcatttctagtcacagctctatcaatccattggtgactttggaataatcatttttctctcctggcgtcatcttccttattcataaaatgaggctgggtttgattttaagatgtgttttctttcttttagtaaattccatacagcaaatgaaatctcagggaaaataagcaatattaaaagcaaactttttgaaagagcttaagcttgcccatgaaaaaggattaccctttattctttcaaagatcacataacacatgagaatatgaagtccagccctgaagccctgcaaagggaagagaaatgggctacccaaagatggtgctttggaaggattgcttatacctggaaagtctaggaaaatcatgtagcaatgaacttagttctacctcagaatatatatttgatttggaaaaatgaaataacatacacataaattatttctaaatagaatatactctctatcagaaaaaaggatttctgacaatcttctctctacctggtcaccagaggagactcctttctgtaatttagtctactctaccctagtcatgaacacaaccttaagtctagagaagctctaggcctctaagaaaaaactataatagtagtgactctgcccttctgttctttttattcatttcccgcaactttatccttttaacaatcctgtgagataagcagaatatacattattgcacacatcgtataatttgtgaaatgacttctggagaaatcagaaggcttgttcaagtatatgcagcaaaggaacgtcaaagctaggactaggattctttccacaggggtcacagactcaaattcagtgtacatcacaatcacccagagagacttaaaatttagattttggtgttctctgtcagaggtctggggatgggctcagaaataagccaggcagagagagacaaatatcatctgatctcactcatatatggaatctaaaaaaagttgatttcatagaatcaactcatagaagtagagtgtagaatggaggttaccagaggctgagtcagggaggggcaggaagggaaaggggacaggtgggtcaaagggtgagaagtgacctttagacaggaggaataagttctgggattcatttggacagtagagggattatactcaatgataatgtattgtatatttcaaaggagctggaagagaagattttgaatgctctcaccacagacaaatgatagatttttgaggtaatgaatatgctcattactctgatttgatcattacaaaatgcatacatgtatgaaaacatcacattactccctataaatatgtgcaatcattatttgtcaattaaaaataaataaaactcaaaaaaaaagaaacacattctttcagcaaatataccatgtaattctaaagcacagcctaattttgaaaaacaccaacaggcacaagcgcgcacacatgcacacacacacacaaacacacacatattacggaaggacagccaacaaacacagcccacaaccattattctttttttgtttttgtttttgagacagtcttgctctgtcagccaggttggagttcagtgatgcaattttgactcactgcaacctctgtctcccagactcaagcaattctcctgcctcagcctcccgagtagctgggattacaggcgtgtgccactatgcccggctaatttttgtatttttttaatagagactgggtttcaccatgctggccaggctggtcttgaactcccgacctcaggtaatcagcctgcctcggccttccaaagtgctgggattacaggcgtgaaccaccgcacctagcccagccattattcttgacacaggactgaactacttaaaagtgaaggatgtttcccaacaaagggtcgagattttagttcacatccattatgttttctggaactaatatgatattaattcagatgctaaaagcaatcatttaaaacacatttcctaggttgcatcataggaagacacttgtcagtatgcaattctatcagaaatgtgtgcatgacaatcatttgaattcattaatactgtttctccattgatttagacatattaattaggacaaagcccacaccaggagttgaacccctgatctatatgtacagtttaataatcattgtaccgtagtgatcagaatgattatggggatactgtgaaaaattcatttgctgccgctaagccaacaactttgaatttgtgttgaaaaacaattactgagcttaattaggagcatgtaatgatgacagcggttatttcagtgattgattccaaaattaaaaggagctggcaaactaaatatggtatatcctatgctttgaaaacgatagggaacatggaagtctaaagagcaaattatcaaaaactatattagagtgctggcaaggagaatattggtgtcttgagacaggcctaaagaaagaaaagttttgaagggttttattattgttttttttttttttcacttttttcttaccctaatattgaaaacgagcagtctctacaaattcctctagaaaaaaatgatcgcagaaaatctaggcaaatgaaatgtactctttaactgctgtctttcaacttccaggtgtgcaggaaatggctaaataatttcaaagttaacagagttggttcaaaacctttgattgatttgacatctgatccatcacatctcatctttaacatggtagaggattacctaaattcatatttcttttctactttggtaggcatttgtcagattctccccatgggatgtttgaagacgcgcccgaagaagtcaatgacatttgaattaattctgtatttttagtagaggcggggttttgccatgttgcccaggctcgtctcaaactcctggcctcaagctatctgcccaccacggcctcccaaagtgctgggattacaggcatgagtttctgcacccaacctctttgaattaattatgtaaaatgtcattttttaaaaaattaaccactcccaccaaaatatttttaatatgattttggtataaaggggagaatcatagcaaagctggcataaaccctaaaaaacacagtttggaaactggctatattccataggaaaagatcattcacttgttttcctagatgactgtgatggggttcaggacataccacctcaaaatatggcaccttggcatttgagaaaatagcagaagcaggaagatcattctcaccttcccctcactcttcttctctgaagcaggtcataaaacctttattccagaggtatcatttctatatccagaggaaagaaacacccttttcctcctcaaagacacagagaaatcaagaagaattggaacaaaaggccttgctaacttcccgccagtttcttaccattagatcataccctctttttacaatcatacttctgcaggactgtctactcttcatcaaaactagcattaaaaacacacaggttttcctgttttttaggattttttttctgaaggctttcatgtcatggaatatttatattaaataaaattatatgtttttctgttattaatcttcctttccttttagagacctcagccatgaacttagcaatgagtgagaaaagatatttttctacatgcacaactgtttgtcattattcaatagttttaagtgtttattttaaaaaatggtctatgtgactatacacagcctgtgccctaggaatgtatctcattagatatatacgattcatgcttcaaaatatttggggattttgatggagttgggagtttcaaggtaggaaaagtgagtctggttagagataataatcaggtattcatttgtcttaaaaatgaccaaataaaatttctaaaactagttatgaatctttgaaagtaaatataactctaagactcttcagctagttaattcatgtactaaagaattgttgactaatagctaagccaagagaatttttgcttctcaaaataaaaacctctcaaacagcatttgctttgctaaagtataattttagtttggcatttctaagtaccattgaaatattttcaacatgattaattttccaagtaacatactaacagaggtaatcatgttctaaagtagtcaggttattattgttttgttatcagccctgaattggcgttgtaaaattatgcttgccgctttcaatatacgcttcttgaattcctatctttaaatcattttgacattcaattttgtgctaccagttgtggatgttcaggtaaggtatatgttatttgaaaagtcactaaaggaataggttggccagtattattgactgactgtctaatttttatttctcatgttgagagttctgtttcctctttgtatacatttgggtgaatgtaacttataaagagtacatctttcaaataatctagttactgatctcaccaaacccaccaagacagctacctttggtaaaactggtaggattacctccacatgtaatcatgttttttggtgttttttatagttgcaggaattagaactacatgttttttaagacaaagattgattgactctgtatattataagcactttattttttttttccttgaaggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatgtgagtttggggtaaattttgtaatctttgtctctgaaaatataatattcttctgatacacacattttaaaaatctagctttgccaatgatatatttgagaatgaatatgactttatgggcttttgacaatgttcattttgtgaatctagattcttgggtataatagaaacctgcttctaaaaaaagaataaaaaaaacagggaaaagatcaatgttattatattttgtgaattatttttagaaacatttctaaaagtttcagacataaatattaagataaagatgtatgatatagcattctttttctttttcttttgcattggatattaatgcaatgtggagagcacaggaagaaaaagctgagggcagagaggtcatctgggggaggtgggcgttctcccaagaaaagcgatcatgcacccgtagtttgatgtaggtggaaataaagtggttgccaaaggcaggctttatattaactgtaacaatgtccagctgcatcacataaatgtcatccaagtaattaccctggtgacatttggggacattagcagatgaacaatagacatactgcgtctaatatcctttatatatagtgtttccagggactgaaatgtttcatactggattcagcaaaagccttgcttgagagtaattatatctgttgatgtggataaagtagaaggcttgcatttctccctttgcaccaaccattatgtcccagaggatctagccaaggaaccaaaaagtgagctgctatacctgcagggctcatagaaatgtctatactgtctgttactttgaaaaagtaattgttctgaaattttattaacaaatacatgaccaaaactcaccttgtgaaactacttcagtcatcagtagatacatgaattaataactgggtctgtttctcattgcaagtcttgtgttccaaagattattctacaccagagatcccttgatctacacagagttctctttatgttgaccattttggggatggccttgcttctgattttacatacaccacatacacatacacacatgcacacacatatacatatatacagatatacacacataaatatgttgctaactgtatccaaatgtatttgtatctatggaagtaagaagtgaacgtggaagtttattaacctaaatagaaggtgggaaagggccagtggctactttcgaacataggataaaaatatttataacacttgatttcttcatttcagctaagactatcacctggaaaaataatagggaacaaaataacataaaaacttatgttatagaaataaagaattgttccagactttgaacgattctgccacagtaattgtttatttctcctgcttggataggagatgaccctacaacatacacatgatatgaatcagattccataatcataaatttgactctttggtaaaggaaactccatacagcatatttatttgctataccctcgagtttctctacagttatgattctatctactctcgaaaacagttgaatgtctacatctcaaatcaatgcactctttgatataaccatagatttcttctcctttgttctgtactttttaacaaaaatatgttttaaaatgtcctacattattatatcataccttctttctgctttaaaaatttcttgcaacgagaagtttctctagttaaaacttattttgtttatgccatatcagaataaaagtctcaattaagaagaaattatatgctttcatctggctaaatgggacaaatcaatttttctgtccttattgactttcccatcttatcataaaattttccattttggggcagaaggtgtatgactgttgatcttgaaaagcatttctattacctttaatgcagaaagtaagatggcctatatccattaactaatctttcttctgcaaagttaaaggatcttaggctctaagagcttgcaaaagcaaggaccacaacatggtggtggtgtcatgtctgaaatatttctcattgtatccggggagacatgtgcgagagtgtggaaacagagagtaaagggtataaatgccagtccccaaccaaatggaaagttcctaaagtgcatgaactgtaccttcatcttaattataattcctcacaacctccttcataaatttttaacaatatcaattgtgatagaaaaggcctttggtaggataaccacagcagataaatgctgagattttgggaaacagagaggtgtgagttcaaattctttttgtcaaatatctagtggtatgaaattaggtcttttcttaacaacgttaagcttctgttaagaaatctatacgatgaggatacagcagtagccaccacataggacagtgacatggagtcactgagaaaatgaaggtcaagtccctgatccattatggaccctagggaaatgacagctctaattctttctttcactattattacctatctcaacttagacagacatctatatatttcaaaccacttgagtttcttatggaaactctcctagtttagtttacatttgaaaacttcctaaaggctagtttcttgttcttttcttttcatgtcaaatataatacatgtgctttgacatatattatttcacttgaattggacaacagctgtaggaggcagttgctatcattgcccccattttacagattagaagcctgaggctcactgatattggggctttcttaaagtatgttgttagagaaaagttggaacttgtgtatagacaaagaagacttcagactctaaaactcatgcacttcatgtcacagtattgagtccttctcaaacactgaccacacagttcatgtgggccttctttctttgtttcacttgctggcacagtaattgtctaaataataaactgtatcttcaggacagaatgggtcaaataagcctggtagtagaggctggtgattccttgtccacatccgcttttgcaagtgatgtgccaacccccagctatgaatacccacagatatccctttttgcatttcatgccccaaacctctccatgggatcaggctgaaaccagacaacagctgcaacaccttaattagcttcttcacttgctgtttccttcttccctccctgcctttctcctaagaggatatcctcaataaatcatatgcacttgaatccttgcctcaggctctgcttctaaggaatccaaagcgagacagagattaaacatttaatatgagattgccgatctacttactgacagaaaaaagcgggtgcagaagccccactcccatgaactcccatagataagaacaagctatgcatcagaataaaaatggatcaactcccttgcttcctgtccgttggcagtccattgtaaaatgtcactttgaccttcagaatgaatggccttatgaacaacctttcagaatctaccctgtccatggcagaaacgctgcagggacatacctctagataattgatggcttttgtttgtcacttttatcctggtattcagtaatccaaaagcacactttgagtttattttagacacagactgtaacactctgcttcattatgaatcgtctcatcatgaaaccatcctgaaatgtggcctgtatataaaaactacctgttgtgaaacatactcctaaatcaaatctgtctttaaccaactatgtaacttagacaagtcattcagttctctggatttagctaaagtatattttgaattatttgattacaaaagtctctttcagctattgtcatataatctgtccttccaaatactcaggtagatcctattttaagtatctctttcttccccaacccaaactctaccctaaaacaaattcagcaggagtctagtcaccaaaggcttctgttatcatcctggcattcttgaatgataaaactagtttgacttccaaaatcacttgtagctgctttcaatttcttttatttatcaaagcttttggtggtaaaggttgaacttagacctcttccttttgtatgtatgtatgttaatgaattactctgtacttgtgtgagagaacattgcatctgtcattgctgtttaaaatgtcatccttgagaaaatgagataggtgttttgaaagaaacccatgatatcactcagatgtaatttttaaatgcccttataatatataactctaccaatgaaaagataaacatttatgataaaaggtagtcatgaatggggctttttgatcctacattatttaatgtgtaatcacagctagcatttcaaataagtttgctccattattgcaaaaggaaaggcagctgggctggagcctcctaattgacccttcatttattcatcctccaagcaaccggagaacacctaatttatacccatcaagtactacactaggtcctaaagattaaatggtagataagaaacagctacttcctgtctcaacagaacagacaggggaaacctttaataaaattaaaaataagaaaaggaaaataaaggaaagtgctaacgcctacaaagtattatgtggcaggcattgttccaaactctttatgtaaattagctccattgatcctcacaataaccctctgagagtatcatgatcttcactttcagataagcagattgaggcacagaagaatgaactagcctgcctaaaatcacacaccgtatgtgggagagtctgttttcaaatccagacagagtgaagagtcctaccacctactgcactgtcccaaaacatcaagtgaagtgagaaaggtgaaattgacctataacagagtggagctcaaagtgagaagtagtgaagtttgtctgaattggagaaaaggcaagggaagcctttcaaaggaaatggggcttgcattgaaccttgacatgttagtttgtattctggacagagaaagtggtagagaaagtacaggtcggaagaacagtaagaggaaatgcagatgtgtgaacaatcttcaagtatcgaagaaagtgtggggaggtgggcaaaagacctgagaactgaaatgcagaaagctagggatcagaaatgactggttttctaggttgagactgaaaactaatttggagccacttataagtagtcctttatatccgggcctaatctgcaaacaataggataatttagagatattatgagatgccaaagaaacatgcaaaaatccatcatagtacaatattccacactcagtatgacactgtgtacggtgttaatttatggttaaatgccagtattgcccatttcatatagggttactatgaggaccaaatatattatgtggaaagcagagggcaagggcaactgatagactggtatgagttgaagatggtgagctaggcaggggtctggccatacaaatactaagaggccaagttttgtattttactgcttatcctaagagcaatggaaccgttctgaataatgttaaggatgttgaagttgtttataaaatgtagtttgaagccaggcgcggtggctcacgcctgtaatcccagcactttgggaggccgaggcgggcggatcacaaggtcaggagtttgagaccagcctggccaacatagtgaaaccacgtctctataaaaaatacaaaaaattagccgggtgtggtggtgtgcacctgtaatcccagctactcgggaggctgaggcaggagaatcgcgtgaacccgggaggcagaggttgcagtgagctgagatcgtgccagtacactccagtctgggcaacagaacgagactctgtctcaaaaaaaaaaaaaaaaaaaaaaaagtagtttgaaataccacatactatttccttaaatatgttagtctgacatattaatgatattattaatattatcaaaaccatagcacacatacttagggggcatcccaaacctcagtttttatcatatacaatggagtgaacgaattcttgcaccacatcacaggattgattttaaatggttcaaggttaaaatgcagtaagaatgcattttaaagggctataaacatgtaggcatttacaatcatcatagttttttccagaggaatgcaaagggttttacacctgccatgccattcatctttattctatacctgtaagctattcttaaccatgttttacaggtgaagacattaaaaggcaggacaactatgttacttgcccaaggtcaactaacctacagcagacccagaatttctaacatttccttcttgaaacaactttttaaatttatatttattttgtagacagaggaagtaaatcagaattctcatgaatttaatgccatattcaaagaaaaacaaaaaaggtaaagtcgtaacataaaggtctttgactccttgcagaaggattctaagatatttgtgtatttaaaggtgataaatatttttatttctatcttttgaccagggtcttataagcaagaacaaaaaccctcacatttagaaataaattttaagagtttccaaatttctttaaaattctttcatatataagaaatataaaagcagttatatgtgctcccgatgatatggtgataaagtgcatttatatcagaaaaagaaattaagacccagcagaagaagctttaaaaataacacttaaaaatgcttttggaaattgtaaagtctccgataattgcgaagtgcgtattaagtgggtaatgcatacctaattataaatgaaaatgctaaatggcttttaaccttttttctacatcagaaaagaactaactgaacaaaagccatgaagaaatattttttctttaatttcttaaattaaaaaagttggtaaattagtattgattttttcagtatcatttgcaaatagcataagcaatgttacaatggatttaatattctcaatttgtcttaatgaaataacagcataaccaccaattgttatcatatcaaggagaaaactttgtctttgcttttaaaaataattcagatcttaaacaaatagactgtaagcagttgcgtggttaaattatagcaagccactgttatatttatatttaaaatcaacagggaagtagattattcaatgctttagcctcattttttcccacactatcgctgctggaaatctatttatgtgtcttatcagaaatggtactttttcaaaattcaggccttctcccactgcctacttctacttatattcagcaggagctagtctttttagttcatttgaataaaattgtgcaggctaagagttgggatgggagaggaaaatataagaaagtaggggatccattctatcaaaactgggagtttctgatttacaaaactgagacagatgcacaagctgaaatgcttgtttattactcatgttatttgacaaactgtttcaaggaatttatgaacatagcacatagagattttgcttctaagatttataaaattggttcaaattacagtgacattttttgcattaaaggatcaaatatttctattgtttatttatatataaataaatatataatacatataaagagcatttataagtaataatgtgtatataattatctgaatttatatccaatattgtctaaaaagtaaatcagattcaggtgtttaaatagcaaatacaggagagaagatggcggataagcagcaagactagcttgcagctcctgctgggagggatagagcagcatgtggagactcacatcatactttgccccagaaactaccccaggaacataccaggaaagccgagagaatccacaaaccctttgaaagaactggatcaccgctgcaggctccctgagatgcagaaaaactgtgagtcggcttgctttctcaatagggaggctggtggtctggggcaggttctcagccctggtcactagctgtctggaaatagactcagtgctgctgggggcgggtggggcatggtgggagtgagactggcctttaggactcacgctgtgtgggggtggggtgaggcctgtgactgcgttttccctcacttccctggtgaactgtatgactcagcagaggcagccataatccccctgggaatataactccatcggactgggaactgtacccccatccctcacagcagctgcagcaagccccacccaaggagaggctgagctcagacacaccttatccctatcccagtctggtggtctttctctatgtgtcctggtagccaaagacaaaagtcataatgtcttgaaagctctatcgccctgcccaccacctgagaaacctgaatacttttgcatcctccgtataggaccacagctgatgcactcccgaagcgccatctcctgactggaggccaaccaacacaaaaccagcgctaaacaaaaacgcaaccaaggaccctcacagagttcacttcactcccctactacctccaccagagcaggtggtggtatccacagctgcaagacctaaagatggatcacattacaggactctgcagacactcctcagtatcaatcagagcctggtagctccactgggtgccagatccagaaaagcaaagcaatcactacagttcagttctcaggaagccccattcctaggggaagcgggagaacaccgaaacaagggagcaccccatgggacaaaagactctgaagagcagcccttgaatcccagatattccctctgacataatgtacccgaatgagaagaaaccagagagacaataatgataatatgacaaaataaggttcttcaactcccccaaaagattatgccagctcacctgcaatggatccaagccaagatgaaacttctgaattgccaggaaaataattcagaaggttaattattaagctaatcaagaaggcaccagagaccaggcgcggtggctcacgcctgtaatcccagcactttgggaggctgaggcgggtggatcacaaggtcaggagatcaagaccatcctggctaacatggtgaaaccctgtctctactaaaaaatacataaaattagccaagcgtggtggtgggcgcctgtagtgccagctacttggaaggctgaggtaggagaatggcgtgaacctgggaggcagagcttgcagtgagctgtgatcacgccactgcactccagcctgggcaacagtgcgagactctgtttcaaaaagaaaaaaaaagaagccaccaaaaaaaggtgaagtccagcttaaagaaattaaaaacattatacagaaaattaaaggaaaattcttcagtgaaatagatagtataaataaaaaacaatcacaagttctggaaatctaggacacagagtaatgtaaaatgcattggaaagtctaagcaatagaatcaaacaagcagaagaaagaacttcagagctctaagacaaggctttcaaattaacccagtccatcaaagacaaacaataataataataataattcttaaaaaatgagcaaagcttccaagaagtttgagactacattaaatacccaaacctaagaataattggtgttcccgaggaagaagagaaatctaacaatttggaaaatatgtctgagagaataatccaggaaaacttcctcagctttgctagagatctagacatccaaatacaagaagctcaaagaacatatgggaaattcatcacaaaaagataatcacctaggcatatagtcattaggttatctaaagttgagacaaaggaaagactcttaatagctatgagacaaaagcatcaggtaacctataaaggaaaacctatcagattaacagaagatttcttagcaggaaccctacaagctaaaagggattgggattctatttttagcctccttaaacaaaacaactattagtcaagaattttgtatccagttaaagtaagcttcataaatgaaggaaagacacagtcttttccagacaaataaatgctgggagaatttgccactaccaagccaacacaagaacagctaaaaagagctctaaatctgaaacaaatcttcaaaatacacaaaaatagaacctccttgaagcacacatctcacagaacctatataacaataacacaatgtttaaaaaaaaagaaaagaaaacagaaaacaaaacaaaaaaaaaccacaaggtattcaggcaacaaaatagcacggtgaatagaatagtacctcacatctcaatactaacatagaaagtgaatggcctaaatgcttcacttaaaaaatacggaatggcagaataaacgagaattctccaataaagtctctgctgtcttcacgagactcaactaacacagaagaactcaaatttacttatagtaaaggggtggaaaaagatattccgtgcaaatggacaccaaaagcaagcaggagtagctattcttctatcagacaaaacatacttcaaagcaacagcagtttaaacaaacaaagagggacattatataatgataaaaggattagtccaacaggaaaatatcacagttctaaatatatatgcacctaacactggtgctcccaaatttataaaacaattactactatacctaagaaatgagatagatggcaacacaataatagtggaggactttaacactccactgacagcactagacaagtcatcaagacagaaagtcaacaaagaaacaatggacttaaactatattctagaacaaatgaacttaacagatatttacagaaaattctatccaacaactgcagaatacacattctattcatcagcacatggaacattctccaacatagaccatacgataggccacaaaataagtctcaggaaatttaagaaaatcgaaattatatcaagtactctctcagaccacagtgaaataaaattggaaatcaactccaaaaggatccttcaaaaccaggcaaatacatggaaattaaataatctgctcctgaatgatcaaacaaaaagctgcctctttgaaaagataaataaaattgatagactgttagtgagattaaccaagaaaagaagagagaagatccaaataaactctattagaaatgaagcgggagatattacaactgatatcacagaaatacaaaagattattgaaggctactatgaacaccttcacatgcataaactagaaaacctagaggagatggataaattcctggaaatatacaactctcctagattaaaccagtaagatatagaactggaacaagatagggatgcccactttcactccttctattcaacatagtactggaagtcctagccagagcattcagaaaagagaaagaaataaagcgtgtccaaattgataaaaaagaagtcaaactgtctctgtttgctgacgttacgattgtatacctaaaaagccctaaagattcatccaaaaatcttctggaactggtaaatgaattcaccaaagtttccagatacaaaattaaagtacacaaatcggtagctctgctgcctaccaacagtgaccaagctgaaaatcaaatcaagaactccacccctttcacaatatctgcaaaaacaaacaaacaaacacttaggaatatatctaatcaaggatgtgaaagacctctacaaggaaaactatgaaacactgctgaaagaaatcatagatgacacaaacaaatagaaacacatcccatgctcatggttggggagaatcaatattgtgaaaatgaccacactgccaaaagcaatctacaaagtcagtgcaattcccatcaagatagcaccatcattcttctcagaactagcaaaaacaatcctaaaatttacatggaaccaaaaaagagcccacacagccaaagcaagactaagcaaaaagaacacactgggaggcatcacgttacctgacttcacctttttctctgaggccatagtcaccaaagcaacatggtactgttacaaaaataggcacatagaccaatggaacagaatagagaacccagaaataaagccaaaaacttgcagtcaactgatcctcaacaaagcaaacaaaaatatgcagtgtggaaaggacatcctattcaacaaatggtgctgggatcattgaaaagcccagtgtagaagaatgaaactggatcctcatctctcaccttaaaaaaaatcaactcaagatatatcaaagactaaatataagacctgaaaccataaagataatggaaaataacattggaacaacacttccagacattggcttaggcaaagatttcatgaccaagaacacaaagcaaacacaacaaaaacaaagataaatacatgggacttaattaaactaaaaagcttctgcacagccaaagaaataatcatgagagtttacagacaacccacagagtgggaaaagatcttcacaatctatttatccaacgaatgactgatatcgagaatctacaaggaactcaaacaaatcagcaagaaaaaaacaaacaatcccattaaaaagtgggctaaggacatgaatagacaattctcaaagaagatatacaaatggcaagcaagcacaaatgggaaaatgcttaacattgccaattatcagaaaaatgtaaatcaaaaccacaatgcaatacgacctccctcctgcaagaattgccataatcaaaaactcaaaaaataatagacattggcatggatgtggtgaaaagggaacagttttacactgttggtgggaatgtaaactagtacaatcactatggaaaacagtgttggagattccttaaaggactaaaagtagatctaccgtttgatccagcaatcccactacttggtgtctacccagaggaaaagaagttattatactaaaaaaaaaaaaagaaaaaaaagaaaaaaatttcatgtgtgtccgtgtgaagagaccaccaaacagactttgtgtgagcaacatggctgtttatttcacatgggtgaaataaacccatgcaccttcacgtgggtgcaggcgggctgagtctgaaaagagagtcagtgaagggagataggggtggggctgttttataggatttgggaaggtgatggaaaattacagtcaaagggggttgttctctggtgggcatgggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggcctgggctcagaggcctgacattcctgccttcttatattaataagacaaataaaacaaaatagtgttgaagtgttggggtggtgaaaatttttgggggtggtatggagagagaacgggcgatgtttctcagggctgcttcaagcgggattaggggcagtgtgggaacctagagtgggagagactaagctgaagggaggtcttgtggtgaggggtgatattgtgcggatgttagaagaaacatttgtcgtatagaatgattggtgatggcctggatatggttttggatgaattgagaagctaaacggaagatacaaggtccgaattaaaaggaggagaaaaatgggtattaaaggactaagaattgggaggacccaggacatccaattagagagtgcccaagggggttcagcataattacttgcttggttggcaagtttttgggctctatccttgagtttttttatgttgtcatacaccaggccagattgatttaggtaaaaacaacactcctcatttaagaatatgcagagtcctcctttttcagcagtaagtcagtcaaggcctcggcggttttggaggacaactgcagctaaagagtcaacttgggcctggaggactgataaagtttgtgattttgaaggcctctaaaagtattaaagcagcagcagccgctgcacgcagacatgagggctaggctaaaacagtaaggtcaagttgtttggacagaaaggctacagggtgtggtcctggctcttgtgtaagaattccgaccatgctaaccatgcctaggaaggaaaggagttgttgttttgtagaaggtgctggggtttgagagatcagtcggacacgattggcagggaaagcacgtgtgtttttatgagaattatgctgagataggtaacagatgaggaagaaatttgggcttgattgaagtaatgggggctgtctgtgaagctttgcagcagtacagccttggtaatttgctgagcctaatgggtgtcagggtcagtctaagtgaaagcaaagagaggctgggacgaggggtgcaggggaatagtgaaaaaagcatctttaagatggagaacagaatagtgagttgtggaggaatggattgaggacaaaagagtgtaggggttgggcaccacagggtggatggcaaaacaatttggttgataaggcgcagatcctgaactaatctgtaagacttgtccggtttttggacaggtaaaatgggggaattgtaaggagagtttataggttttagaagcccatgctgtagcaggcaagtgataacaggctttaatcctttgaaagcgtgctgtgggatgggatatgggcgttgagcggggtaagggtgattagattttaacgggatggtaatgggcatgtgatcagttgccagggaaggagtagagatgtcccatacttgtgggttaaggtggggggatatgagaggaagacgcgaaggaggctttgggttggggagaagggcggcaatgagacacagctgtaatccaggaatagtcagggaagcagataatttggttaaaatatctcggcctaataagggaactgggcaggtggggataactaaaaaagagtccataaaagagtgctgtccaagttggtaccagagtgggggagttttcaggggttttgaagcctggccgtcaatacccacaacagttatggaggcaagggaaacaggcccttgaaaagaaggtaatgtggagtgggtagcctccgtattgattaagaaggggacggacttaccttccactgtgagagttacccaaagctcggcgtccgtgatggtctacggggcttccaaggcaatcaggcagcgtcagtcttcagctgctaagccgagaagatctgggaaggagtcagtcagagagccttgggccagagttccaggggctctgggagtggctgccaggtgagttgaacagtccgattttcagtgggttcctgcacagatgggacgcggcttacgaggaatcctgagctgcgggcattccttggcctggtggccagatttctggcacttgtagcaagctcctggggaaggaggttctgggggaacgcctggctgctgcggttcaggtgtttggaagttcttgtgtgctggagatgtggctggggtttgtgtcacagtggaggcaaggaattgcaacttttttctattattgtacaccttgaagacgaggttaattaaatcctgttgtggggtttgagggccggaatttaatttttggagttttatttaatgtcgggagcagattgcgtaataaaatgtattttgagaataagacggccttttgaccttttagggtctagggctgtaaagtggctcagggttgctgccgagcgagccatgaactgggctggatttttatatttgatgaaaaagagcctaaacgctatctgatttgggataaagaaaaagaagcattaaccttgactatgcctttggctccagccaccttttaaagagtaaattgctcggcaggtggggaagagctagtcacagaacgaaactgtaagccagaccgggtgtgaggaggggaggctgaggaagtattgggacttagctgggtctggcaatgagcagcttggggaggacgggaaaggtcagatgggtctgtagaaaaggaagactgggaagactcagcgatgcttggggttgggaccaaggggacaggcgggagggaaagaaggaggatctgggaggaatcgcattgggaacagaggctagggagggaacgaagtgtgaaaaatgcctggacgtaaggcacctcagaccatttgcccatttttcgacaaaaattatttaggtcttgtaggatggagaaatcgaacgtgccgttttctggccatttagagccattgtcaagtttgtactggggccaagcggtgttgcagaagaaaataaggtgtttaggttttaggtcaggtgtgtgttgaagaggttttaagttcttgagcacacaggctaagggagaagaaggaggaatggagggtggaaggtggcccatagtgaaggaagcaaacccagagaaaagagagcgtagagacacggagggaaggggtttgggggttcttgcctcctagaaaagtgggacttgccgctgagggtgaaggagaaggggttgaggggtacttggccctgccccaggaaagcgggacttgccgctgagggtgaaggagaaggggttgaggggtacttggccctgccccaggaaagcgggacttgccgctgagggtgaaggagaaggggttgaggggtacttggccctgccccaggaaagtggagaagaggtagagaggtaggaacaaagagcaggaggacgggggattgatctcccaagggatgtcccccgatccgagtcacagcaccaaatttcatgcgtgtctgtgtgaagagaccgccaaacaggctttgtgtgagcaataaagctgtttatttcacctgggtgcaggtgggctgagtccgaaaagagagtcagcgaagggagataggggtggggctgttttataggatttgggaaggtgatggaaaattacagtcaaagggggttgttctctggtgggcaggggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggtctgggctcagaggcctgacaaaaaatctttgcacacacgtgtttatattagcacaatttgcaatagcaaaatatggaaaccaacccaaatgcccatcaatcaacaagtagggtaaagaaaatgtgatatatatatatatatatatatatatatatatatatatacacacacacatatatatataacatatatatatatatatacacacacatatatatataacatatatatatatatatatatatatatatatatatatatatagcatggaatactactcagccataaaaaggaatgaaataatggcattcacagcaacctagatggaattggagactattattgtaagtgaagtaactcaggaatggaaaatcaaacatcatacgttcttattcatatgtgggagctaagctatgtgtacacaaagcataagaatgatacaatggattttggggattgggggaaagggtgggggttggtgagggataaaagattacatattgggtacagtgtacgtggctcaggtgacgggtacgccaaaatctcagaaatcaccactaaaaagcttattcatgtaaccaaacaccacctgtttcccaaaaacctattgaaataaaaaaaggaatataaataaataaataacattattggaacaataagaaagccaaaaacaaacaaataaacagcaaatacaaataataaagagttttgatggaaatccattgaaatgttaattatgttttaaagcaggagtgtccaatcttttggcttccctgggctacagtggaagaagaattgtcttgggccacatataaaatacacaaatttttagctgatgagctaaaaaaaaaattgcaaaaaaatctcataacgttttaagaaaatgtatgaatttttgttgggccacattcaaagccatcctgggttgcatgcagcctgagggctgtaggttggacaagcttgttttaaggtattaatttatgctcttcttttccctagaagtataatatatacagaaaagtacaaaaaacatgagcagatagatcaatgaagtattgttaagccagatccaggaatagatatttccaacacccccagaaggtccgcccattatatccccttctagttatgacatcctccttctgcctcaaagatgagccatatcttgacttgtgaatttgtaattattattgctttttaattttatatgaataaaatcatgcaatatataatatattgcttcaagtctggcttattagccaactatgtttctgagatccttttatattgttgtaggtagctgtagttcatttttctgatcacatataatattttattgtatgaatataatgcagtttatgtggaacttttactgttattggaaaattgtattatttctaagtgcattcttctatgattattcttgcacatatcttttgggagatctgtgtaaatatttctctgttgtatataccagaaatcagaattatcgggaaattgggcatgcatatgacaattttaaaagataacaccaaattgttgtctatagtgattttattaatttgtactctttccagtaatgtttttttctatattcttgacaatatttgatatgatcagtctttttaaaaattttagccttttgcagggggatagtaaaaagtatctcattttggtttagcttctgtttcctgatcactaatgaaattgggcactttttaaaattattattggctatttggaaacctccctccctccccttggtttctaggaataacttaattcatttttccatattttaattgtgttgtctttgttttcattagtgattgattctagagaagagcacaatgttgcttttttgtgtaggaaaccgcttctactgtgtcgcttgccttttcactctcttaatcatgtcttttgataaacagaaaaatttaaatttaacatagttcaatctattggtctttttctttttgagatgttttttgtaaaaagtttaagaactgttttccttccttgcgatcatattttcctgttatcttctatagtgtattttgtccttcgtatttaaattataatgcacctgcattttatttatttattcatttattttcatggtgtaaaattggttcaatatacaatttttttctatagggatccaattgagccagaacatatatgaaagatgcagtcctttctttgctgttctacagtgccattcctaaagggaattaaatctgcatgcctgcttgagcctgctattgacctcttttttctctcttcctttgttgtatttgtaaatgccatattctagtaattactgcagtcttacaataagtcttaatatctgatagctattaaaatagactatatggtttaaaaaaaaaagaggcttgaattgtaagtgaaaccaaaggagaataaaatccaaagagaaccagaggagaataaaaattcatgccatgagatccaatccattatgaaaattgagctttaaaaagctttagaattagtgaccaaggcaaagagcggtacatatctttcattggataaaaatataacaactgtttctgtgagtataatcaccctgagtataaaaagcccgagggaagcttctcctgtgaacctgcatcaagagcagtgggtgattccgtggattatagtcccctcacagacatgcaatgctggcttttttatggtagcttcctatagcatatctcaaaaataatagctaccatgtattaggtatctattaagccttttacataacatttgttaaaaaaaaaattcccaaactatgtgcctggtttgctaccactatagccaatgtcactgggcatctcactattctctgactgtagctgttacaagagcatcaatagattctctaaaatgcagacaatagaaaggagttgctaaatttgtcaaattttaagtgaatctactgcttattttgttggtatgttgggtggctcttcttggtggaaggctcacaacctgtaactgactccagagcttctgcttaccaatttcagaaaactaggtttcgagtatttcctttgagcattccttcatgtgcttttatgaggctaactctccttccctatttccaagatggatactttgggaaggtaacatattctagttctcaaattgatgtaagtacatttatgttactttcttctctatttttgtagcagtgagggaataatgggaatttatacaaataaaccacatgagtatttcaagttctgtgatgttgatcacattctctgtgatgtatgctttagttgtatcttcctcaaagtaagtaccaaccttcctacagttatttctaattaaacaggataatctagtttaatcctcaaaactaccatgtaaaatagaagctactattataatttcaattttatatataaggaaaattaagttcagagaagtgaagtaatgtgcccaaggacatcaagaaatagtgaagttgggcctgtaatctcagcactttaggaggccaaggtgggtggattgcgtgagttcaggagtttgagactaggttggccaacatggtgaaactctgtctccactaaaaatacaaaaattagccaggtgtggtggtgggcgcctgtaatcccagctacttgggaggctgatgcaggaggatcgcttgaacccgagaggcggaggttgcagtgagctgagatcgtgccattgcactccagcctgggcgacatgagtgaaactccattgcactccagcctggacaacaagagagaaactccatctcaaaaaaaaaagaataaataaatagtgaagctaggatttgatgccagacattctgacatcttaaccgcttccttaatcattcaactaatgcttgtcaaatttaatgtgcacaggaatcacttggagatcttattaaatgcaaattctgattcagtaggtctaaagtgaggcccaagattctacatgtttaacaagatcacaggtaacactgatggtgctgccctggacagatatcagacggtgggtagcaaacagtctcaaaatgaaccttaggttaatgtctaaagacaatcaaatagcattaccataggggtcaacacaaggtgatagaaggaatagctctattatgatgtaaagaaatcttagggaaaaacaaatggtaattggtatttcccaccactaagatggtcattcaactatccatttatgcatccaaacaatgcatatttattaagcacctaccatatgtgtcaaacataagtgcaagcagtaagtaaaataaggtctattttctgtatttatacatctgccaaagtataaatgcagactcactttttaaaaaaggaattatatgaatgccattggaataaagcaccaggaaaaaaatgtgcttgagcattaaccaaagtaataggttttcaaactgtatttccttgccagaaatactatcctcctaggcagtgtttctactcatgacagaaaatgcaaataaggaagagtctccatctatagacgtgatttaacaagtcaattgcaggtgtttttcctcctttttgagaattgtgcggttgagagatctactttcacatacatattaatgagttgttttgcataaatcaattctatttttatgaatggagattatataaccctcctgtaattcttccagaaatcccatccaaacaagctactagagttcttagtagggtatgtcccttgagcacaaaggattttattttaattatttcatccatttttaagcaaaagtaatcaaatataaacaactgtgctggaggctgcaccctctgccagctgcctctcagccttctgaaaggctctgtttttgtgttgtttctgttttgtttttttgttgttttttgttttttgtttttgtacttttctcagtactcatttagaaagcaatcctattgtttttatttaaaaaggtgtaaaatgtagctgattcaaactttaaaatttatgatattcctctttggcaagtctagctgactatgggccctgaatattattattgctataaatattaaaattaataaaagcttatatgtgtccagtaagccaaaatatgggaaaacatttcctgagcttgcttaaattttcacagcaagtgaatggcagagccaggactttaaacctcggtctaatggacaacagaaatcaggcttcaaacacaacactggcatttcaaagcatgtcccaggtggcagatgtcctaaagaagcatctcacttctacctgtggttccagttagctcactctatcctccaccttctttccatagttaacaggggaaaatgtcagagtctgtgatgcactggataaaattgtcctcccctgagctccacgttttcacagctggagtgaagaaggtgtcttggcaagattcccacaaacacacactcaaaacacacatcctcactcccatatttgccttgacatcaccatctctgcttttacgaggtcttgactcctgtgtacataaggcagcaagcctggaattcttaggtcacccctcattgcccaaaccttcatctacatagagctctgaatgttcccgtatctgaacccacttcccaatcctccgcagcttgtgaaattcttccttgggcctcctaaaaccaaaatcaataattagcaaaatctttgcacacttaaagttttccctgaaagtccccctgactgtgttgcttcaactgacatttggcttccatctgaagatgcttctcctctctggctgaactgctgattcttttctccaatacccctcttaccacaggtctgtcagtagggatagagtcgtcccatctcctccgtgccatttccagatgatccctcctccctcatatctaattcctttgccattaaaatcatgccattagcccgcactactcataacttctctttgttgcaatcatattctcatcccctaaactccaacatttcttgaagattttacctattagctcactgtcattctctgcataatactcctgtcgaatatcttggccatttcagcctttggtgaatttggtattcagtactcaatatcctgatttgccagtttcttgacttctttcgttctgttgcccttgtttatcgacccatcttagccaatagccacgctgctaagatgactcttttaagactttgtcaatgtctaaagttgccagttccacccataatctgattttcaaccttcccaaatttgactgtctgactcactctctccagtccatggactccagcaatactttgactctgctagatcctataattcacgaatcctaacaactactcctgtccttctcctgcttcgtcttgtcattccctctatactgagacaaaggcaaaaaacacttcttctcattaacttttaactcacttgctcatcacttgcacatcaatgattcactttcactttcccccttatttcattcatctggtgaaatctaagccatgatgaaatccaaaccaaaattttaatctagtgaaaaatccaactatgacacctgctttcactttccaattaatgaccaccgacatcagtggtccattcagtgggccattaatgttgcctgacattaagtcaccatgaagctcaaagatgttactgtattgccggcatcttcagtctagaaaggccctctgtaggtggaaaaaagtatgagctagtatttttctcctataaaagtcaactaaatcatcctcacatacctcaaacaacattttcctgaccctttaatataatttatgttataaactgcttgatacttagttctgattcaggtctgactcattgcctagtccctgagccaggatggactttggctgtacttgagatgtcaaggtaatctggcactctgactaactagatgtgtttcagttgcttacctctagagttatttccccaaaataattccaatgaaacgttaaaacacacaacaaaggcagcctctttctttttccaatcccatctatcacataccattggatttctgttttgctacaaagtcctgaaggttttggccttttatttttatctcacaacctaggcccacttcttaaacattgcctagcttgcctttcccttttaaaatctgccaacaatcactttctctgttgaaattatctcttcctacatccaactgtgggaagaacagccttttcattgtgctgttctctgaggacaagaatagaagcacattttttaattcttatttttgtgtgacttttttctgcttagtagttaccagtttttactacaattgtgattcctgacaatatataacatttagaaaataaggaaaagctattaataatatcacctgagccagagacaaccactgttaacattagtagattcttctaaaattttttcttatacaaatcataaacacagatggatgaatatttgttaattgtggataactatttcactttacggaaataatacaacaaacactttaaaacattttccctactagtcattttagaggatattttaacaaaaataataaaatacggagaacaattaagatttcagaattttcaaagtttgcatattcatgatctgttttttaaaattcaggtctcctgactaagatgcttattttactgcagagaaataagcttttgtggataccacactcaaggggaaagacaggcttattctcgaagcaaatagagggtccttcctgccaatatgacctagagaaacagacaaatagtgagaagatgcatctccgagaaccttcaggctgggccactgtaaatccggttggatttgactcaacccagggcataagtaatgttctcagggcatttccttaacgaagactccctattgaaagaaggtatagcatgaacaatgtcgggaagtcagaatgcttaatttctgcattttcttcctctgaactgctaagattgtatttagagacaggtagagtcctatgtgcgtgttctaatctagttaatttacttcaatcatcctcttttattttgccagcaggcaaagccccttcagaatacctaattattattccagactcctgtcttagttttcatcagaggacttgtatatttcattagcttcagtccttgtaccacctctccttaccaagcccagcattgtgacaccatgtcctttacccttgtgtttttgaaagcaaaagaagaaacgcatacatttttattattcattcttttatctcactagtcttgttctgcgaaaatttgagatctcaatagatagtgaaacagtctttcacccttttccatggaataaatagttattggtgtttatatactctataattattatatgttgataaatggttatgtaatagctgcatacagggaggaaaagtccttgcaggtaattttgtctgctaattacatataaattggttaagcagtcatgcgtattgatgacatcgttttcaactgatttgacttctcaaaattactaaacttctacctggtcatctaaggcaggacaatttttccccaggatgaggggttggagggcagtggtttcagcaggtattagattctcataaggagtgcacaacctagatccctcgtatgcgcagttcacaatagggttcacactcctataaggatctaacaccgctgttgatctgacaggaggcagaattcaggcggtaacactctctcacctgccactcacctcacctcctgctgtgcagtcagatttctaactgtctatggcccagcactgcagcccagtggttggggactgctgatctaaggaataatctcagtctttgtctctctttatccaaaacaaccataagtctattatataaaaataatgtatgtatgtatacattttgcatgtgcttacatgtctctgcgcacacacataaatttatataaatgggattgttctagtaaccgacatttttctttaaaatttttaagttataaaaaatttcaaacatacagaaatgtctataaaaatattataaacagatttttatttaaatgtgtgttaatgtttttgcatttttgcttcagatcttttttaaagacataaaatataccaatactgccaattttcatctcgtgctttctttccctcccttcccagaagtaaccgctttcctgaagttggtgataattttttgaagtatggcttgaaatttttattgtctttgtttataatatttatataaatgtcatcagagtacaatttctttggcacctttttcactctacattcagtttttgaaattcagccatatttctacgtgtttacttattttaaatgttgtgtagtatttcattggattaatgaaagaagtttacttcgtttcaacgaaggaatgagaataaaatttaatcctgttttttcaggaacaatacactataaaggtatttttatttatatccatcaatttcacttatttttattgagctattatcatgtgtcagactctatcatgtgtggaagttacagtgctgataaaacaaacacatccttgcctgccatgagtctacgaaagcagtaggagagggatcacataaatatgtacagcataaaaaatgtaataaatagtctgaggagactctgagagactaaaatgaaaaagttatttattggaggctcaagaaagcaggattcaagatggatgaaatttccaatgaaggaaaattaaggttcatcaaaattagttatctgttagagttttttgtatctaatgccacagtaatgtgctgaaacaaagcatgaaaaaaacccatgatgtccagcagtaaacatttatttttggtcacgaatttttggtttactcggtggttcctctggtcttcttggggttcagttttacattggtggtcacatatgcagttacgttaatcttgctgggctaattcattacgtattgttggcccaggctggggcaactgcagtgatttatttcttctgcacatggcctctcatgctccagcctgctactccaggcttttaccatggtagctgggtggggatccaagagcaaggggatagaaggctacacagctacttgaggcatatgctcagaaccaatatattgtcacttctgctgcattttgtttgcaaagtcagaccagattgaggaatggtgaaagagactatgcctctgatggaagatgctgcaaagtcattgcaatagggtacaggaaggtgaaaaattaggactaagttgtaatcactctcccatggtgatatgaggaatggggtaagaatattccatagacggaaacaccacgtttaaagcctatgaaattggaaggggctacgtaagacatttgaaaatggaaaaaaaaaaagaaagaaagaaagaaagaaaggaattgtggagcctattgaggaaaaaagggaatggtgtcagtaaaagctggagaaattggcagggaccatattatgctggcattattgctaacactcaggattttgaattgtatcctaggaacagtagagctccatacaattttaagaaatgtattatttaattgatgacgttacctaatttattacatgatttaatcgattatatataatctaagtttaaaattatttttattatttcttagagtcaaggtctcactctattgcccagcttgagtgcagtggcaccatcacaacctactgcagcttcaaactcctgggctcaagcaatcgttttgcttcagcctcctgagtagtagctgggtccacaagcttgcaccaccatgactggctaattttttattttattttattttagttttagttttattgttttttgagacagagtctcgctctgtcatccaggcttgagtacagtggagagatcaagactaaccacaatggggatccacctaagctcaagaaatccactcagctcagtctcccaagcagctgggaatacaggcgtgtgccaccatatccggctaatttttaagatttttttgtagagacaaggtctccctatgttgcccacgctagttttgaactcctgggttcaaatgatccttctgtcgtggtctcctaaagtgctgcgattacaggcatgagccaccaagcctattatagaatgtaatttttaattaaagttatttgctttatctgtattaaaatatcttaagaattataattttctaagttatgaaataatctgggagcctattgagtcattaagatgttagacgtgaaagtgtgggtgagaggtagcaatggagactaagaaaactgagatatgattgagaaattttggatgttaaaccaataatatttgctatgaggtgggatgtgggttttgagaaagaggatagtatcaaatatcgccaaatggataattgatatttattatttactttgatgaggaagacttgaagaactactttgaataaagaattaagagttcaatttcagagatgtcctgaggttggatataagggtctggattgccaacagaaagtctgtgctaaccatatgaatttgagaattatctacatataaatgttacttgaagccttgggagtagttgaagtcaccaggagtaaatttttcaatcaagaagaaaagaagacaaaaaataaatcccaaataattccaattattagacatcagggaatataaatagatatgttcatggttttaaatggctacatatcatctgattatatgtctttaccataattattctaaataaatgtctcttattggactttgttaggcttcattagacagtaataaaataactatctattatatacttctttactcatttgccaattatatccgaacagtagatactgggaagttgaattgctgggaaaagtaggttatacattttaaatgtgaatgcatcttgattaacaacctttgaaaaatggttatgccaaatgatactttcaacagcaccacccgaatatgctattacatcaatccctcttgatattatgtattgcttaatatgtacccttagcaatctgatgggtgacaaattcttgttgttttcatttggatgtctaggtttatttgtaaaatcaaacttttcttatctgtttattggcaatttaaaattattttgtaaatttcctaaattgggtctttgcctagttttctgttgaaggattcaaattcatttccaggaattattttaaatatgttaatatttttcttttacaaattatgtgaaatgttcctatttttattttaacttggctagttgtgtttttatgatacagaaattttagcaaagaaattgttttgtaattcaatttctctctcattttctttataatgctttttgtggcacatgcagaaacattatttaagccctatgattgtaaaaactatttttggtcagcactcttataatttcattaattccttcgaggccttcgattcaccttgaattttttgtaatgagcctgaggtaaacacccaaccttgcttccccacccctgccctatgaaatttccccaattccatttaataagtagttcagtgttgacagagcccattttctacttcaaatccaagaggttttctgctgtggaggcagtacaatatagtagttaagagtaaagttcccaattactctaaataattttcccttcacacccctcccggcagggtagaacactagctggtgagagcgagctattctacaaagctcaaagctacaccgaagggtcatatttctcctctagagaaagcccatttaacaacaaaagacaaacttttaaaatggcagcactgcctagatactaatggtttctgatgccttattcttcctgtaaataggtcagatataaaggtttagaagtcagcattaagaccaaatgcagcatctaaactagagaaagtgagtgaggaactgccttgaagtccattctatcaatttcattttaacctgatttatttggctatatgtttgccccctctgcatttcctatatcagctccatcacaaatcagtcccctccaagttgtattggaaaagcaatatatgtgattgagatattgttaacaacaaagccaattctggtcccagagctgttagattgtgattgataaaacttaatattttgaagggaggaagaaaaaaaacctattattccagttcttttatttgtagtgtgggtgaagttccttttatctcctctactttcattgtagcagtatgactgaaattccaataaattattgaatgcaatatccagatgtccagatgattttttggtgctgctgctacttcttagtgagcaagacaaaagatagttgaggttctgcaaaaagtgtcaaagcttagcaataaaataagatttcattgaacagaaactaatggaatcactcaatttatttccctttcactgttgtaatgcagggaaatcttgcttcatacgagtcacaaagcttgagtgtgcagtggcctggctctggcattgcatggtttgtgtgtgagggattggaatacctttaataaaaaagcgtggggtgaagcagcttagtctttcaaataaaagaagtttcagtgtctgggcatcatggctgtttaaaagtcaactttttcaactttttctcctcgtgtcacctttttaatattcttggggtccctgaagacctatatctccagttcatcttggcatacttaggttcaggttttatctgctccatggggacagctacctttttcttagagtgcttccattttcttttctcagatgcactttgtagctgtgtcatagattagccaagcatgcctgattgagatattaatctgaaggagtgttggttaagagacagaccagtggtcagcaaaccttttctgtaaagagccagatagtaaatatgtttgattttccggccaatgtctctgctgttattgggtgaaagcagccacccataaacccattaatgtggctgtgttccaataaaactttattcacaaaacagacagtgagtaggatttagctcatgggttgcagtctgcagagcactggagttcactcagaatactttatagatgtgtcctaccaatgatgactgttaacatttattaagcatttgctaaaaattctccttagataatctcatttctcatattatttactaaaactaaagtgtgggtactatttataaccatgtttatagataaataactgaagaagacagaacaagtaatttactagtacatggtagaagggcatttgaactcaggctcactctagggcccaagcttctaaccactctgccataatgcttttctcattaattaatagaaatgcaaatgctgtgaaaatccattttgttaagatatttttgtctaagtaagttttttttgtttttaattaatgacgtgtcacatatgtttcagcttactattcacaggacactagattactattattatttaaatgtaattatttaatttctattttgggaagattaaccatgaatttactggcagtggaaaaacacaaaggactaaatacaagatgcataaagtcagcatgaagagatgaaaacagacagggatgtgaacttacatgagttgagtctttaaattctggctctgtcctttacaatgtatgactttgcatgttacattctgagccttaattttctcattcatgaaactagaaaaacactagctctatatctacatcaaaattattttgagaatctattaaattacctaatgtagacatgcttgtatagatgtatccatgtataataatatttgcagtatactatatgtaattatatacatacacacacatacatacaaacacacaatagtatatattagtcatttttatttagaggaataaagaaattctgtgtttaaatgatatgttaaaactgctttgaatttggatcaaaatttagagtagattttcacaggttctgaggcataaagagttcttaagggtcatgtaggccatgcctctgtcttcaggaagagatatccttaagccaatgcagatgagatcctgtctatttcttttagagaaacaatttagtgaaagtgcctataaaccatttgctgatagaaagacaacctcttgaatacaaattgactccctgattgcaagtgactttgtgatgacaagcaagagaacttttcacaaacacagaatatcaaaaacattttttgtttgtttgttttcgggagtcaattgcctgtgtgcctgtggcttccggatgggggttccgattcaaaacatccagaggctccatcagtacttactatgcaacataacacctcttagtgtctagaggtgagtcttaatattttataccattaactgtgtagtcccaaagatagattcagggcagatgtttgatgtttggtttgctgagtaccatagcgagtttctctgcctatctttgacatttttgtagcagtaaccacatcacccttcttaatcactggtgctttagataataattccctcaaataaaacaaaaactgaggtgattttataacacattatgatatggtttggctgtgtccctgcccaaatctcatcttgaattgcagttctcataatctccacctgttgggggagggatcctgtgggaggtaattgaatcatgggggcggttaccctcatgctgttctcttgataatgagttctcacgagatctgataatttaaaggggcttttctccttttgcttggtacctctacctgatgccgccgtgtaaagaaggacgtgtatgcttccccttctgccatgactgtaagtttcctgaggcctccccagacatgctgaactgtgagccaattaaacctctttcctttataaattacccagtgtcaggtatgtctgtattagcagtgtgtgaacaaagtaatacacattatattctctcctttttgaagaaaaaattaagaaactggctgttcaaacttaatgtgaagtatcagagaactctatgtgcgatggggaaaaaaaaattagagaaacattggtttgccaccagtggaaactaaccagtcttgtctgtttagttcattgttgcattttcagctgctagagcagtacggggcacattttagttacttaataaatttggcagatgagacttcctttaaatgtctacagcacaatctctttggctttctgtgaaagcagatctcatggcgaagacatggactatgtagtgtatttaggtggtattctcagaagtatggtgaaggagtaggtaaatagatagcaaaaggagaaaacccaaaaactgatgaagaataaggtaattaattggttgtcattgtgggcaattgtggctcagtacagctgagtgccccctacagctatcaagcacatctcattattagcccagcataggccaaggaaactgggacatttactcattaccttctgtacctcattggttaaggatcagtcctcaggacttcaatttctggtaacctggcctgctttctatgtagacaagtatgtgtctgtggaataaaaaataatttctcagagcattctcaggcagagcaacccaaatggaggcagcaaaccctctaacgtaactgtcccccaatgtgacaggtaacttcctaaatgggttgaacagatatatgggatatggggcacctacagtggctgctacaatcatactttaaaagaactataacacttttggtttcccatgtgacagtcataatgtgagaaaattcaagaaattagcttgatatttacattttatcacataattttaatttaaaaggtcacatgtaataagacaagaggaggtgtaaaagttcagagatagcagttccggaatttcacattttttcccgtatacttggccctagtatttctatgagtaaataggttagtttttagttgttcttggtaaattactggatatgcgactggactgcacttatgctatccttcaaataaatgaaaaacccaattgagacaactggacagtgatctcctggattaattattatactgaagatgataattacagtttctgcctgtcttataaataagcagtcctcagttgccaaatgggcaacctcttttctgcagttacagatgtgcggcattaaacatctcaaaaatccgaagtaagagtcacaagaggacttcatggtaggctcaggggcagagaagcttatgcagtgttgtggctaggataagccaaagcaatatgcagtctgagatgttatgggggcatgaactataagtaaaaacaaggagactgatcagctgggaagacagtggagcagatattcatgcaaagcagagttaacagagactgggacacctgtagataaaggaacctagagagggaggaagagaataattggcaggtgtggcaagtgtccttcctgttcccagatatgcctcctgcactttgttggtctaagatttctcttgatcctttttaactccacccccgctttagtttatactactttaagtgaatttcatttcctggcatgtaaagagacctggcgcaaacaatgaacacacaataatcattgtagcagaaattgaaatgaactagaaaatcaaccagttggtcgtttaggccttatggcattgtgctaaagactataggtcatactttttgggatttgaatctttgttctattaattagtaaccagttcagtgaccttttggcaagttttttgaacatttctgggatttagcatttcatgtgtaaaatatatgtaataataataaatatttactgtacaatatgcttgtatagtacccacatatatagtataaattttatgaagattaaatgtaaatataaataaatccaagaagataattggtataataaaaagaaaaataactaaaaaataaataaatgtaataattaaatctacatatcgtttaaatcaactccaagtctttgtaagagttataagttatttagggccatttgacatgtagtttttaaacaagttacttatttcatttaagtctcacaacagtcaaataatatacctattttcagaacattttatagatccattcacccattcctcttttcagcaaatgttcttgagtgccctttgtgtattagacactgagcatattcagagaaattgaaaaaaaatgaaaagtaccattttaaatgtctcacagcttataaatccaagcacttcattcaagcacagatttatctgactccaaagcccaaacattttccttcaactatgtgaacactctttttatgtgaaataagcaagctttccatctgtttgagggtttttctgtctcccctgggccccagtctcttataacctaattttggaagtgacaagccataatttgaccagactcagttggttgtgcagactaatgctgacacaatgcggcaatacacaaagtggtggatattggaagcgagttcattcggggccgttttgcagcctagctaccacatgtttccaggtcgatcctagcctcttctctaagaaacctttaatcagacaaatttggtcttttgctctcttcaattcctaaaggaaatattgtagactatgtttgtagtattttgtatgcattcactcgctttagaggtataattatttcttaatttattaaacatgttcttgttgaatacctgctttttgcaaacactgaactcgcgggaaaacaaggtccctgttttcgtgaagcttatggtctatttagagcacactgaaataaagtaaatcaataatcattgctgacagtgactgggcctttggggaaaaatacagagtgatagggaactgctacgttagattggttagccaagggagggttcactatgtggtagtagcaagtaggctgagatctaaatgtcaaaaagaatctagaatgcaaagatctgggggtaagttttcaagcagaagaaacaagaagaccaagggccatcgggggaagaaactcattatgttccgaaaaacaggaaaataaaatggcagctgtatttggaatgttctgaacacaggtgaaaggatggggtaaacagggccatatcatatggggctttaagtaatttagtaaactatttaaagtcatctttatttctctgggttgactgatcattaatcaaatattttttgagtacctactgtgggccagcacttactggtactgcaaaggtaaacctgtacacattttgtggaaaggcgctgatacaaacaaacggtggcagccaagtagggttattttttgaaaagattttataaatacatgagttagtgaacaaactctacatttaaattactgttatagcaaattataatgcaatgcaagcagttcacctctttgtaaacttattgaatcagccaacatgtcctgaaccacctgtctttgaggagcagccacatagagagaggttgagtggttgatgtcatttgggactaaaagttccagtttcagctttgactgtaacctataacttaaaccagcttcatctgtatttttaaaattatttttaaattttatttttaattaactaataataattgtatagatttatagggtaaaatgtggtattttgatgtatctttagattatggaatggttaaatcaagctaattaaatttgtcaccccacatacttgtcattttttgtggtaaaaacatttaaaatctactcttctagaaattttggagtatacaatacattattatttattatttttaccactctgtgcaatagatcactaaagctttttcttcctgtttcactgaaacttcgcactgtttgactaacatttccccatttcctatgcacccctctcccccagcctctggtaaccaccattctactctctacttacatgaatttaacttttttgattccttgtatgagtgagatcatttggtatttgtcattctgttgctggcttattttacttagcataatgtcctccaggttcatccatgttgccacaaatgaccgaatttcctttttttttttttttttttggctggatagggatagtattttattgtgtatatatgccacatttttgttatctattcacctgatgatggacacttaacttgcttccatgtcattgcattcaccagaatgcagatatctctttggcatactgatttcaatttctttggatatatacaagaagtgggattgctagatcatgtggtaattctatcattagttgtctcagctagcactctctgcctcttcacctctaaatgaaacctagtcactgttctctggaaaaatcagtgtccaggtaattccagtgtaacccaatgaacagacatttccatgactacttctggctccaacttttgctgaagtcccattctctgctctgggtcttacagttttccctccttctccatcctggttcttactcaagagtagaaatgttttcttaattctgtccctcacacaacacacttgataaacacatgtctatagatttttgtttgtaacaaaatgtttgtagacatttaggggaggagtattggcaaaagaaaacacaaattactataagcagaaaagactatttctaagagtccttcagcattctatatcttgattttctttttgtttctgttctctcccctccaccaaatccttcatcatggcaaatgcagtcagaccactttggttgtctcaaagatgtcttgtctcctgatatgccatgtcctctggagctcagatggcccgttttcctcaacaaggtttttcagctttagcctgaaacacaaaaaacctttgtgttttttgaaatatcaatgtactgtctgtactatgttttatttttcccaaattgctttgattttttaatgagtaaatttgtttgaaaaaacatatttattaccactgtatctagaaagccagtgtcattcatcacaaatagaacaaaactttaaaaggcaatacatagttatataaagttaaaggtgtttttttttttgcataacacctaagtgcgtcacccatacaaccagtgatatctctcccacacattggtaatgtctcttctgcttatctctcagggttactatcaacattaaaaatgatgacagaaatgaaaatgctttggaaaaaagtgagattttatttaatagtctctctttccctccctccctttatctaaaccataatgcatgcaagggtccttatcactgaacctaattctccttagtgctgagctggagaaagctacaaagaaaatgccgattgcagctgtgattccaaagaccttgcttggactaagaaaattcaacggaaaaatgtcagtatttaccatcaaccctgcagtcactctcccgaattccagttgtggaagttcttgcaaaccgaaaccagtaggataaaaatctctggtaaactcagagcttatgtccatgggaagtctttaaaaaaatgttcttgcttcacgcttcttgtataaacaggagcattaagacctttacccaggagctctgtcccattacctccaaaactcggccttttgtattttacataggttgcaaattttgcaatctaactttctgattaaaccatcacaatgaataaaagggcttattaagggctctgtctatgaaggaccatagcaggtataatggttcgcataaaccactctttccaagtgacctcgggcctcactccattgaaatcactctcctttactctaatgagagtcacacatgtgaatcaagagggagctataaatgcagttgttcttggaagggcacaggtgcacctaatttgccaccaaaaccaacaccttcagccccctttgctgatgacctggcccaggagtgaattacaagtgagcttctggccagactccctcagacctctgggaagccagtggtcagcctggcccttttttttttttttttttttttttggagacagagtctctctctgtaacctgcgacccccaggttcaagcaattcttctgcctcagcctcccaggtagctgggactacaggcacacactgccacgccccactaattttttggatagcctgaactttcttgttacctaccacctgctaagacttaagtacaaggtcaggatgtacttcccccagtgacagggcagactctgtttgcttgctcttggataaaaagaaactgtttgcagccctctttttcctctccttcctcactttttttccctctcccaccattgagcagggaaagtggtatcctgaatagctgaaaatgaatcagagctgggtagtagtccctattcaataaaaggcctccttttatttttttagttatgtggtcttgagcacattgcttaacctttctgagcactggtgtgtatatttatgaaatgggagtcatatggggtacctacaactcattttgtttataaagttcaggaattgggaaggtctcagtaattaagaggtccccggctcctgtaccaggaagcccctctcacggtacacctctatagctcttagctgttgccatcaaatatttaaccaaaatctaataaacacttgatattggagaaaaattggaatgctgatatccaagtaggaagtaagaaggtcttttaagagtttatagtgtcgaatccatttacggtccaagttaaaatttctctttgggaaagataaaataatatttataaaaattaacaagtggagagaaagtgagttgttttttggcgtcctgggaataatgaattcaacaagctgatctttggatgagtcactttagtgtctgcaatggcaatggaatatacacgtttcttttgccattcagggcttcctcagcagaaacctcacatttctttctgaaaaaaaaaacacgtcccttgatgacaccactgatgacaccttgatgactttcccacatgaggatgatttacctgaagatttggccttttctggatactcccctttttgcctttgaacaatatttatatcacatattaatcccaagaagcacaaattgccccaaagaaatctctttagagattattgactacaaaggttttggcactgtcctccctgcagaacaaaaggtgagaaaatgaacatttgccaaaaggcaaagcccaagactatgagaagcagggcagcctaggatttttctggctattgtatgtccacccaagaggtcactgctgcctccagctgggctgtgtagcttcctaggcagtgagggtcactaaccatcagtctaacaacttgtgtcaagttggagaaacattctctggcataaaatagagagtgggctgggcgcggtggctcacgcttgtaatcccagcactttgggaggccgaggcgggcggatcacgaggtcaggagatcgagaccatcctggttaatgtggtgaaaccccgtctctactaaaaatataaaaaattagccaggcgcggtggcaggtgcctgtagtcccagctacttgggaggctgaggcaggagaatggcgtgaacccgggaggaggagcttgcagtgagccgagattgagccactgcactccagcctgggcgacagagcgagactccgtctcaaaaaaaaaaaaaaaaaatacagtgtgatgtggcagttcttggaataaaattcacatatttttgactttaggtctcctttttgtttttttccattcattcatgagcatttaagctgccaccgaataggcacagaagtaagtcctgactcagtcttcaagaaaatatgtctcgttacatcatccgacactgagatgaaagctgaaaaaaaagccagtttaaaagttcaagctgggattggtggcacacacctgtaatcctagctactcagaaggctaaggcaggaggattgcatgagcccagagatttgaggttacagtgagctatgatcaagccactgcactccagccgaggcaagagagtgagaccctgtctcaaaagttataaaataaataaaataaaaataaaaattcaaaacatcctaattttgttgatgtgccctcgtatcatcagtaatgtgattaaagtccctcacatcatatattttgtacttaacatcttctacacactttaattgtattatgtcattttttttcctctgaggcaggtactattgttagctagcttattttaaaagtgaagaaaactgaggtagaaagatactaaataatctgccctaaatcaatagctagtgcatgcacggccaagctagcatttgaatatagatagtctgaccctaaacttgcatttttgatcattttgttccatcactaagccttttaaggaattcgttagtgggttatttaatctattttgcatgctacctacatcaccttcctttcaggaacaccaaaggccagttgccttttactagttaagtaatctggcatctcaatgtatcctatgcagttccataattgtgttctgtttctctcatctacttttaaatgtagggaatatgccagcttagtaagaagcgagtttgagtctagcccacatctagcacttgtatatttatttttgtcataagtgtcactgttcttaccaccatttgtcaggcaaatgtgtctattatagaaaatcaaatccagtctgacatgtatattatcatagaccaattacctaattgatatttcatattggtttacttgtttaatttatgaaatgtttacctccctgaaaacttaagtgctgggctgttagggaaaaacatgcattatgtgctccttactattatcctatctattttttcataaaaaaaaatgcttctcagtgaattcattatattcccagaaaaacaagaaacaacgcatttttttctctacttatatataaatttttacgaaaattcttttacacccccaaaagtgaggaattttaacttggactgtaaatggatttgacaccaggagctcttaaaataacttcttacttcctacttggatattagcattccaaatgtatgaccagttctaagatttagctattgcctcttttacagcgtttgacaataacattgtgcttgattaggttatgtcgtgttgtgttactgagttatgctaggaaacataataatatcatgaacaccatgactgagtatatagcatccagaaaacgatggtggaaaatgaaactggtttcagtagagatatttctctgtgccaattaataaaggcatgggaaaattagttactatagaactaaaacaaaatcactcaagaaataggaaatagcaacatgaacaattttggtattattcataactggtcctcttcaaagaagagaagcatggagagatacaaatttagaataacctcactataatgttttgagattcttaagagtattttaatactgaaagttgcatatatcatatctgggagttctgtgagacttatgcagatttggggatttgttttcttggtgtctttcaccatttctcttttgctgggcagagtactggcatttctttgccccgcaaaatgtttttgccgtaggccaaaacaaaatacataccttcaacatgggaaccgcatcgtgaaggtgaacaagtgctccaacatcttgtttactccagaaccagctttcagtgctaaaacttcttcagaaggattctcaaaggggggaaatagtatttggttgacggaaaccagaaagcagggtaaaataaatcatagagtttaaaattagacctaacgtctttgaagtgaccaataattgaaattgcttctgaggtgtgaaaagagagaaaaggtctgtctgggtgactttctagatagagaggcagtatggtctggtggttaagcgaatgcactctcgagccacaatatttgtttctttactttgtctttgtttgtttgtttgttcttgctttttgagacaaagtctgactctgtcacccaggctagagtgtggagtgcagttgtgcgatcttggctcactgcaacctctgcttcctgaatagctgggaccacaggtacatgccaccacattagactattttttatatttttagtagagacagggtttcaccatgttgcccgggctggtgtccaactcctggtctcatgtgatccgcccaccttggtgtcccaaattgctgggattacaggctggagccatggcgccttgtctagaaacacagcatctggaattaaattttat

SEQ ID NO: 50 - DNA, 877026 bp, Homo sapiens
gcaagacacattagttccttaggtgaagaatgtattgctaagcacatgttatacaccctaataaggtttgctctcattttgtacctggttaattcatgcagggggagcaaagcatggtgatttagagctccatgtctgtggaaagacagactttggttcaaatccttttttttttttttttaatttactgtatgatgttgggcatattacccaaactatcctaatcccaatttgttcatctacaaaatgtgaacaactgtaatcgtatgtttgatagtgctatagcatgatttaaagaaaatacttagcatggagctaacatataatatgtgctcaattcatgttaaataatgataaaatgataaactgttaatatgccatttcagtctctttacttctttatatgaaaatttatgattccaaactgagacaagatcaaacggaataaatttgaggtaacacaaggcccacctacctataccaaattatcattttctctcctaagagcagcagaggtatttatcgaggcttagtattatttattaataaaaaattatagacaagctgttagtgaactgctaagtgcagtatcatattcagctctaccacatcttgaaatagtgggcttcaattcatgtttcatgtgcagattagtattcatattatttacattaaaaggagtagaaattggtagtaaaattcttagagaatctttggacaatggtcctttcatgtctctgttcataatcttggtattaaggcaatttactaagccttatttatgcttcaaacattgtattttagaatgtactctcatggatatttcctcatttgctcttcctgtgtactcattcttatttctagttaatgtaaagagaacactgagtctcagagaggttaggtaacttgtattcagctctataaaatttgcctgcgtccttttttttcccccaactgcaggtgccattctgttaccactgctattataaacaaaccatttgtggcttttcaaagatgtcctccccaagggaaagctgatataggcatcatcttattcccattgggctgccatcacaaaatactgtagacttgtaaacaacaggaattggcttgtgaacaacagaaatttgttgttcacaagttctggaggctgggaagtccatgatcaaggcaacagcagacttagtgtttggtgagatgtctggtgagggctgatctctggttcatctagctgtgtcctcgcatggtggaagagaaaaacaagctccctccgatctattttataagaacactaatcccactatgaaggctctatcttcatgtcatagtcccacctcctaatactatcaccttaggggttaggtttccaacctataaatttggggaggacacaaacattcatttcctagtagggactgactgcaaggacagaatcatgactccatttacaccactcagagtaaaataaaaatgttttctctttttccgtaacagtgagattgcttttctacagaactcatgaatttatccatattgtattgccataggacaatcttacattccaagctctttgtatgaatatttcaaattggggaaatgaaagcagctagctgaacagtctgaaaatgtagcaaaggcattctttgctggttttgttattctgcttcactctctttgattaaaactggcccactgacaggatttcctgaaatgaggttcaagttaataatcccaaatacaagcatcttaagaaactcattctctgtaccagtctttagttaaaaacttagtatggcttggatttaagctgtagataatgaggtttaagaaatccaggggagaaatacaagctttctcaaatagcactagtaataaaaattctatttatgggctaaaggtatagaattgaggcacagtgtgcttctactagtgtatgtagagctttaatttaactcgaaatcaggatgaactaggtcagatggttaagaagtgtattctctgtcttcagataaaattaataggatgctccctttgtaaaagcataaagacatgacaggatgaagtaaaagtccatatttatggcaatgcgtattccagaagcacgaaaccacagcagaggaaaagaaaaaagaaaaactttgcttttatcatctagtagtatttcacaattgtgaagaatcacatttcaggcaaccttcatttagaaaataggaacaaaataagaaaaggcttttgcaatgctccttttgaaatacaaggttcaagaatccctcatctatggtctgaggaatctttgaataagagaattgcttcatattggttttctttattgagatttgcatccaagctcaatttttgtaaaaagagagaggggagaagtgtaaaattggagtttaaagggaaatgttgccagaaacgactgatatctgtagttaaaatgataatggcaccatttgttttgactctgtaacatcagtttcaagagatttaacgataatctccattctgaagaccccttcaaagatccaccttcctccatggtgttctttatctgattaatatattaacttttcattttaaagagatcatttatcttgaagcaaaacgaactcctagtaaatactgcattgctagtatcaacatggacaaactacacagagtctaaaaagaatgctgaagccacagtaggagaaacagtctattagtgcttttaatttagtgggtggcaactcaaaggaattagaaggtagatcacaataaattagcgtgctctggaactctaagtggaggagaactggcaggtaataatttagttgaaattacccatctaaaggtgagtatcattccaaaaagttaattagcattgttagcagctgcaagctgggtatttagctcagatggcatatggaagccatctgtcacaatgcctggtacatagtaagcactcagttaatgattattaatattattttaaaatatctaattttcctataccatttccttcagtttggagagcactgtctgattgctttcttccctactgaaatggtactagatgattaaccacgttaaagaaaaaggtcctccacacccacacatccatgtctcacctgaaagattcctgcccttgtcatgatgaagtgaacatgactactatgatcaaggttgtatctccatagcagctaggacattaaatggtgagatgcaggaaatttacacacactcatgcttgtgtagccgtttcattcatagtgtggagatctgatttcagtgtataaatgattcgtaaatcagtttgtatcaaatgcgtagtcatatggatcccttaacagagagtaaaagacaaatacatgtgaattaggattcctggttttgaaatgatagtaatcacattataataatcttaaaatatttttattaattgaacactcaaacatattgtttaataggtgctaggcagtatggtaagcatgtgacatgaattatcttaatcctcaaaataagcctatgaattgtgtactattactaattaccatgctataaatgagaggcgtattaatctattcttgcactgctataaagaaataacagggactgggcaatttataaagaaaagaggtttaattggctcacagttctgcaggctgtacaggaagcataacagcttctgcttctggggaggcctcaggaaacttacaatcatggtagaaagtgaaggggaagcaggcatgtcctacatggctggagcagaaggaagagagagagagggaaggtgctacacacctttaaacaaccatatctcacaataactcactcactatcatgagaacagcaccacggagatagtgctaaaccattaatgaatgatccacccccataatccagtcacctcccaccagatccccaccttcaatactggggattacatttttacatgagatttgggcagggacacagatccaaactatgtaaagaagattcttgcttataaatgtgcaacaaaatttagctaaggatgagagccacatttctctctttactacatacatagtattatactagtaaaccttattgtaattgttattattattattaacacagaatggtatctcttggaaaaatacgcttacattaaaacattaaagctcgctactaaaataattttgtttttcattgattccagtttttcccacccactgtccatttaggatggcttcagaaaagagaaatggtgtcaaatctgaagcagtttatttagtgtcttcataaaaaattctgggatgaagtgggaattgctcattaaaatgcatacatatttttaaataacctgtgttttgcatttattctttctgcctctgtaccttacattaccaatgataagcaagaggaacatggcattcagatttagcagttatataactgagctgaaaaaaatctcaacatttaattaggaactgtgaaattgtataaacctgcttcacttttctcccattaaaaactttgttaacacagactattgccgcaaaatgcatttgattagacttttcttatttaaaaggtttttatcattattttttgataatttgttgttttttcttgctgtgaggattctaaaatatctagagcacacactataatagccaggaggaatccaccatatcatgtaattcaatcacacagatagaaactaacctagctagcatttgaactgaggcattcagaatctatttgtcaggtctgttctggatgaatacagcaggaaaatgactcaaaatgggcttaagaaaaaaataatatattggctaactgaaacgttcaaaaaggttgatgcttgtttgtttttcggggggtgggcatcaagcatgccttgagttaggtgtgtgaacaattccaagtttctttcctctgtgttagtttcggatttcagagatgctttctctatttggtggaaaattattgactagaatcttggcgtttatacctcactgtctcaaaaaacctcagtggaaagagatctcctcttcaagagccattctgcaagcagtcctggaactgaatctaattgtctctggttggtttgtcttcatccccgtgtttgtctagtcaaggtggctatgccctacaagcctcttatggcaagacctgaattatgtgctctcacctaatgccagaggtgtggtcagcccaactgaaatgagatggggaggattgggctttgtaaggaaaataaaaatgcaggttaaaaaaaaaaaaaaaagcaaacacatgtcctctgcagatttagaatccaggacattaattcttgtaaccatcttcaaaatggaacaatataacttttaaagcccagtactgtaccctgaatcttataaccttctccttaattgaatgttttatcagacttacaactccaaacacaattgagaaagaagaaaaaaaggaaagaaagagagaaggaaagaaagaaagaaagaagagagagaaagaaagaaaaagaaagaaaattctagaggagtttctttcttagtgagattttcttgtctcttttaagtctcatgtctcttgcgtttcttgccttttgctatcattctggtgtgattgtagctctgcagagcaataagttctcaacatatgttcacaattcatggtttttcacaatggttctactactaatttttttttttgtcttatatgccattcatgttcaattctctagacttccatttggatgtgtgtctaaagcctatataaaaatactataataagaaatacttaaggtttcctacagttggtattttaactaaagtagcacatgattagagcccgctgggaattctaattaattgaatttttaagaggcagaacctgaaagtataattttttgcaagtgatttattagatgagtttttagaaagaacccaaaggaaaagagggaagtggggcagggaagagatagtagccaagctcggtatactgtcaagcaaagttccacagaaggtaaatttgattcaatcctatagctctggagagaatacaggtcatacctagagttgtctcacaactaggagcacgggagctggagaagttataccctagaagccagtcatttattggttaatggctgctcctgggggtatgtaaattcctaggtactttcagttctctctttgtgaagataaattagctataacagcttgaggacagtgtccaaaaagagataacatgtactggctcttaagggtacaaagtacataggaatctggggcggaagagggattagaagggacgtgagtccagcactgacattttctgctacattactcgtctaagaaaggtgtatctaaataggagactccatttcttgtatcaaagggaaaaaatgcttgtccagtaagactttaatgttgtcactgagttatttttctttggacaaggtggaattctctttacacccacacaattgggccacttaaaatggagatccacttttgtaaagtaacaaatacctaggcttcaagggaatgatctaattaggtttgtgcaaaagtaatcctacttttgccatgacttttaatggcaaaagccgcgattacttttgcaccaacctaacacaacagctgtgaagtcagtattcctttgaattatactcatagcttctacttcaagaaaacctgaaaatgaatcccagctccgcctctttagctttagaaaagtaagtgaaattatatgtacgtattgtacagatacatagtacttggtactctgtattgtacaggtactgtgagtctgcataatatatgcatataaggtagctatttgttgtaatattattacaattatcataattgtcaaaatgttcagttacttaggtatttagttatgttaaaaaatgacttctgtcttcacaatcaatataaataactaagagcagagggaaaaatacacaatttttacttatattttgtctgaatgttttagattaaaagccttttcaattggatactttgcatgtatttgttataaatctcagagatttgctgtcataaaaagataaaggatcatgaattcagacaaatattagagctctatttttcctttgtaaaacaattttctcagaaaatttttattacactggtaatgcatgctcattgcaggaaaataatgaaaaccagaaataaacagagagcagaaaataaaataaaataaaataaaataaaataaaataaaataaaagacatttatatcacaactacccatagataaaaacttcacatgcaatacatacaacatatgcatttttaattgaataatacctcatatcctataaaattcactagacattgtgaatatctatgtgaataaagttccttctagaatttcgttcttattggttagtatgccataaaatgaatgaaaaagaacatcagttatctgaggttaattgttgccatgaatataccaatttactgaaatgtcaacttaaatttgtggcaagtggcaaggctttttaaaaggacaaaaacttagtatatgataataattattttttacttaaggcaattcaaaattcaagttttcactgtaattgtatgttaattctgagaataattgaatcaaacattgatttagggcacattttctgacaaatatgtttgagtgcatatgatttttatccttgtgctttatccttgatgtacataggaggataataattttttccaataaaaatgtctaaggcttcataagtgttcttgcttgaagcttctactgagacatcccaactttctgcagttgtttactgctcaaactctccaaatctttatttgccaagcactttgcatgtagttggatgagcctcccacattccttctgctgacttgaagaaattctgcctcttcttcaaggtttaccaattgactttgcaaaatgacttactaccattattattaatttgaaatataattagaatagaattattcaaatcatctaaaaatctataagggaatgaagaatgacttgacaagaggaaaggagagatattaatgtgaacagactggggattcattttacaattcattagtttagtagtgaatattttccttctggaactttgcttgcagcctgcccgttcttattttatgccttctaaaccattaatttctaaattcatcccttattgttaaacacttagtttcatttattataacatgtatttttgctcctttgaaagatacccatattagactaaaaataatagatatgagaaagtagacgaaattaatattaataaagtaactttatttacaagttctttataacaggggacaggctgcggtgtaaatccatctttgttttacttttttttaaatcgtatataaatgagtactttttttgaggatcatagagcctatttaccagttcatatgggtctgttttatagtgctgttttccctggataatttacctcacccatcccatgtcttcagttacctattagtaccagtttagatctggaatactttatatttttgccttagaaactataaatatatatataaagcctgcctagtcttaaatgtcatgttctcacaaagaatttccttgaccactataataaattgacataatcttgttactatctctgcactctatttcttttgtttcggttattgcagtttgcaagtgtacttgtttttattatttgtttatggtatgttttcccactagtctgtaagcaacataagggcagaggacatgtctattttattcaccactattttccctgaacatagcacagtgacttgcatacggcaggcacttaataaagtgttaaataaatgactgattgagtgaatggcgaatgattgcatgatctgaaaactagtcataatacaacagattgatagaatatttttcttgagagttatttgtatggatgctcttcttttattttgctgtcataaagattaaaccgtcttctattctaatgaggtgtaactgtttagtccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatggtgagctaattggatttcaaatatatataaaatatttggtaatgcccttcataataaattgtggaagtcattagcatgttgtgaaaaagtgtcacgggagaaataaggaaggcatatttccgggtttagatgcttaacacaatgattagcagatgggaatgaccacctttaaaatatggttttaattttagcatggtctatgaatgctattgtttattatatttgccttcaaaatatcagcagtgtcatgttaaagccataaaagtttataataaaaggaagcatgaactccatatatttcccattaaacgttctgcagcagattatagcaatcttgattctaattctaagtagaattaataaatgaaaaaaattgataggaaaaatataatactgcatggtggtttataatatttgttcctagttttcatattttgtctactcataagtaggtaatataaaaagaaggcaattacattatttaaaattatgtttgtctcagttacaaaaatctctcgtaaacttaagagagacgatgaatgcatatattatctaaaagctgtctttgtgtcttctttaatccaggattgaaattttctcttacttaacattaagtaaacaatacaatatatctcagaatttgcaaaatgctgtatactattaaaagatccttaacttctttgataaacttaatgtatctgtattagataatttttaaaaagtattgatatatggccaaaatactttcctatgtgacatgtttataatcaatgataaagtaattagagaaaatatgtgtgtatgtgtgtgtgtatgtgtgtgtgtgtgtaataactagaaaaatccaggatactgtaattatcccataggaatgttgattgagtgcccgtggggagaacatattgtgtgtctgtaatattattttccattttctttagaatttccaactttaacctgcaatgaatactactattttatatatagaatataattttctactcattattctcctacagttttagcaaacctagccaagaaaaacaatattttttttcagtagtacctacactttaaaggaaagtctttggaatttagtatcctttgtaaataaaataggatacaaatgggagttttagtagaatgaagatattgaatgctttggctagttttaaagaaatattttccattttatatataatagacaaagatataatcaagggatgaaccagaacacaaaggtatctgtaaactggaaatcaataataaagtacctttctgtatactgataaagcaaatgttagcttacatagcaattttacaaacattcacttatagaattcttaatcttaagaagtagaaatcttaagattaatattaagaggtagaaacaatgttcagtgatactataggcaaaaatatcttaagttaattgtgcaggatctcacagatagtgattgtcagattcaagatcagaaccttgaaatgtcttctgaaactgccatagcatttcaacatggtggtctaagctcattgtactatatctcaccacaaccaaattagccatttaattagcctgaaatggtccttgtaggggaataatggatacttagtcaataacataatcattatgtttcttagtcacatattaattcactttctgaagtgctttcaaaagaaaagaggattactgactcagttacctcagagttgaataataactgagaaattcaagaaaagaatctctcagtctgttatattgctgtgtttaagttataattcagaaccaagtaatattgtatatccatctatatcgtaattttataatctctaaaagaaatctctaaagtattattcatcatagaaaatagaacatgttcagaggagttaagtggcttttcataaccagtcaatatggcagaaaaaaatctaaaactcaaacctgtatggtagacccaaaatcctaagcctcttctcccatgaatttcctacctagttttaaatttaaaactttgctctccagaattttaatcatccaaagaatgttcacgttgaataaataaatgtgttctgtagccgcaattattgcattaagcataaaatcagatatatctgaaacctttgtaagttatgtgaaattacatatgagcatgcatttattttcccaggtcagacatatattaggacaatttctaaacaaatacttatgaattatataattttgttaataatacccagaaacatgattcaatttcaccaatagatctagttcttctaagttttgccttgatttgtccctcaaggctgcaggaagcacattctgtaactggaagttgtcctgattcctgcaagaggtaatcctaggcttagttcccaccacccagagacatcatgatttcttttactcgtttgtagtctcattgaagggtcttctgtcttggtgaaggcaggttgtgcagtagaaaaactctagaagtcagacagacttgcgttttatattgtgcacaatttcgaatcctctcggccctgcttcttacttcagccactgctacggtggccagttcagcactgtgcgttgtagatgtaacctgaaggagtgttgtctcaggtgcaaaactaccaagcacatcttgttttctgttctgggttttctttggctccttcgtgagcctactcagcatttaagcatgcccagtttggatgtgccagtagtttacacctgcactacccttagatgaccatggatgggaactaaatgatcccccttcatttccctgggtagacagctctaaagactgcttagaagttgacataagatggagaacaatggatcgtgttggtggtcaactcaataactcagccttgcattgacttttttttccttcccggtgactacctttttttcctgatgcttttcccttgggctaacattctcaaatgaacatgtggaactcaagccctttacttaggttctgcttttagggttcaaattttggcttccctgttttctaccatgtcatcttgaacaggttacctaacatcgctgcgagaatccactgaaagattgtagagggaattaagtgcaattacaaatataaagcatctggcttgccacagcctgagagtccaagggaagcgtcatatacttctgtatatccaaggacagaactaaataaaggagagggattaattggcacctccaggcagtttccagtcagtttatgaaagagatattcatgtgaaaacatttaatttccaacccgcctgtttccatgaatgatggtaaaaataatacaatcttactttcacgtcaattatgccagtttcttgttgtctcactactatgaagaactttctcaaattaaagaaaatttggaaaactcacacccagaattaaagtaagatactgaacctgtataaaactccaaatgttcaccattccttgtcaagaattttatctaggaaaaaagaatactggattatctttctaccaaaatgccaggaagctcatgtttgatttatgcttcaaggtattgagttgtaattgtgtctgaaacagatacagatttattacttttagtttagagcaaatataatcagtgaactttcagatttattccacaggttcagatttgatatacattttctaacttgacctatgttctaatatttagcatggatttattccctggccctgttctacattttgcccttttcccacagctcccaagttgttatacaggtggagcaaaatgacagatgacaaacatttaacttgagccaaatgcccaatgatatttgcaacaggatttctgtcaacccgcattgaagctcctgcatgtcccctccctcaaatcgtgtgtgtgcaatccaactggacccagttagccttgtccttctgatctctacagcccttgtaatgtagcataatgtcttggataactgccttttaccaaacagtggcacttgcctttttgaaacagctcctccagaatgggaacagaaaatccaaaatacacacctctctatctatgacaacttgctctgggaatgtaaagctagtggaaagccaaacccttggtatacatggttaaaaaatggtgaacgactcaacccagaggtaagcaactatgttgatattaaaagtttacctactctactaggtaaattttgttactaacagtactagtaactaacagaaacagctaatgttaatggagtctttggtatgttccaggaaaggatgcatacactgatttatttaatccttaaataaacttacaaagtaacccatctttcaaaagagaaaaataagtgtagacaagacaaataactttcacaaaatcactgttagccagtaatagattcacatttaaatatcatcatcatcatcaccgtcatcatcgacacggataacacttactgaactctcatatgagccaagccctgtgttaaatatttttccgtgcattatcttattgcaccctcatgaaaacattataagagagatacaagtattattcctttatgtaaatgaagaaaatgagtttcaaagaggttaggctacttgtttaaggtcacacagcagctagtaaatgttagaattagcattttaaacttttattttggtctgatatcaggacccaatctcttagtcactacccagtattttgcttttatgaacactgacgactgtctttaaacccctaggaaagtaaataactaaggcagttatccacatttctccatttaaagcatactttcttctacaatacctagaaaatgaaagatttgttttttacctattaaattatccagataattgtgtcaattctccattttactttgcacatgtaggcatagccagagacacaaagaacatctgttgtttggaagctgaatataatgctgttctttgtttcagcatcagtgaaattttcttcctgcatgccttttgcatatagcattctgtttcctccagcctattttccttttccctagaggatggtaatacatgccttgaaatatttagtcttaagttatatttgtactattaattatgtcactatgtgcactcaaaattgtatttctataccccacatggggttctgtaacagattttggctgtttaggcacactttatagtagtttgtagaaaggaaggatttagctactccaactcaagactcaattagaaaattatcacatcatcacatttcaaatgtttttgaaacttttggaaaatggaaagccaaggcagtgttctagtcatgatatacatgtctaacattattgttaaccgtgttttcctggaataattaggacggtggagtattccaaattactatgtataccaaataacagaaagttaacatacattttgtgcaaagtatgtcaattgtcaaagaaatgagataacataaaacacactagtaaccactaaaattatcctaaacatattttcgttttttaaacttaaaaatgctgctcagaatctagtagtgtattaatacaccaaattatcagatctcatagatatacacaaatgttgtttaataacatatcctggttaagagaatgctatattaacgtacaagcatctttatatgccttttcctttattaggagagaattcaaatagaaaatgggacactcatcataacgatgctgaatgtgtcagattctggtgtgtaccaatgtgctgcagaaaacaaatatcagataatttatgcaaatgctgaattgagagttttaggtaagtcgtttatttacaaccaacaaattcaaaatgacgttttaacaagctataattatgcataatcccaacccaattttttttgtaaattagaaattgctgtcccatcaaataatgggaaatgtctaaattaactttttacaaaattcaaggtggtaattattattctgcttgggcaatgcactggggcttcagaaaaaaacccaccattgggtgcatccaaaccggaggaagctcttccaaagctgattctagcatgaatttttgagtataactcaaagaatatctttaggaatattttcagctgcaaattaaaaagtaataaaaaaatcacaattcacagtaactaaaagaaacagtaatttattttatctcttagcaagaggggcattggctgccgggcatggcacctcaacttgacaaaatcctttacaccttcccttcagcatcaaagcctcatggttacaagatggctgctctagttatagaaatcaagtctatgctcaaggcagaagagcgaggttacagaaataatcacatttatctcttttattagaaaagcagaatttcccttagcttccatagtaaactttttatgtcattaactagagttctgtcacatgaccatccagacatcaagaggaggtagaaaaataagtccctatagtgaaaagtgctgagattaaagcaatttgagaatgatattttgggaagtccaaccagtggtgtctgccacaataaatgacgcgttgatagttttcaacccaagggtttcttagtggtaggaagaacagaggagataaaagagaggaaggatcaaacaacaagacacaaagttttatgagcttatgggtgatgagcactcattcatttgctcattctttctatcgctactgtttgattgaacatttattatgtactgagctgtatcaagatgaagtgatctttatcttcactcaacctataatttcaaggagaaaaaagtgtcagatttaaaatatggcaattcttatggctaagaattgaggagttgctatcgttgcacatgacaagttgaacataacctacattgaggacattccctttaatctaagatcagaagtaaaaacatgcatcagtaaggtgaagggtagagaagcaacatctgaaaagcccagaagcaagagagcatggcatacccgaaagaacttcagttcacttgagctttagattagaaatggagactggacacatggattccaacattcatgaagttggaaagattcagaggcaccctgatagcctaataatttcttgtccttctgaactggcatttgttcaacatatatttagtggggaaaaaaccgacatagtgatacagcatttctgatttatttcaatagtattttattgctaatagcaataaaatatttctgatttatttcagttgctaaccacaatacaataccactgaaataaatcagattggtatatatacatatataaatcacatatatatgtatatatgtgtatatacgtatatatgtatatgtgtgtgtgtttcttcaacatcatatgttccattgcttatatacatatataataaatcagaaacacacatacatatatacatgtatgcatatacatgtatatatatggatacacatgtatgtgcatacatgtatatgtgtgtgtgtgtttctgatttatcatatgtatgtatatgacatgtatgatcattgttttggctggaatagactttcctggtcagaattaaaattccttcttcggcctcttttgaaaccatcttcatcctctttgttgtaaatgctattagaaaagtgactttgtctaacttgcctcctctctaccacttgcttttattattgcaatgaccaccaacaaaacaaaaataagttgcatttattgagcctatactttgcgccaggcactatactataattccctgcaactgttacatcatttaatctccacactaactctctaaggtaatatcttttgtcatcttcattttacaaacaaaacataaactctaaaatgttaagtcagtatttggtccaagaacaccttgagcaaagtaacctgaaaagaggatacagctataaatattagattctgtctagcatagcaagtcacccctggagtcactacatgttaactgagtaattaaacaattttgtctttgattttgtttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaaggtaaacaaatctttatttttaaaaatatttttgtttgtaatataacatcttccaaatttttaggttttagtaggcctttcaaaatttcctcttttatgataaagtctcattggcatacctagagacgccagcattcttctcatcatagtaaaattgtaaaaaacaaaaggatcttataaaataaagacctgtttgtataagttagctgcaatattttcagtgcatgcacttgtaatagatttttaaaaatcttttaagacctttttctacattcagtttgaaggcttcctcctgaaccagcctgctgagaaatcagtgcgaataacatttcacaaaggagagagacactcattggcacacacctggtgttgtggtttttaaatagtcacacaggtgttcaccccatgacaaaatgaattcaccacatgaagaaatgtagagaggttcctgtagagaaagaagagaggtttcctaccataatggatacagttgagaaaccctaggtcagcactggcatgttttctaggagactttgacaaaagaaaacaaacaaacaaaaaaaaagacgggtgtttttctctacttgtaatatcttttattctattgtaccgtagagccttgtatacatgaggtgactagaccacagatgctgctctcttttaatgactcacatgtgttactctataatcagatatgcaattaaatcctaatgtgaacgagccattgtgctgaagatatgaaaatagtccctttcgttcaatgagctcttcttcagcatcatatgttccatgacttatatgcataccaggatgggcaggtaaaaggccaggtgaaagaaaggacaactaaagtgtgttaaaaaatgacagttgttactcttggaagaaatgactgtgacggactagaaagtgagttccctacctaaaaaggatagtcacaactccaaattctgtcaactggttgccttgcgggaaatgagaactaggtttgtagaacttccaatgtttcagagaaagctagaagtctgcattctggtattgaatctcccatgccagaaaaaagtagccataggatgaatgaagggacatcattttatcacttctaatcccaagatttcatttgtggccgaggaaaaaagaggtgaaaacaaacaaaagcaggggtctctgtggtttgtgtagagtccctttgtggttataactgctgccttgaagatccattccatttacacaatgaagtgtacatcagagagcccctttctagggcattctttctttccttattctctgcatttctttacatccctggactaaagcttttcccaggacaggaattatgtcacatttatctttgtatgtcctgtgccttggcacagaaccaaaacttaataaatatctgtggaataaatgaatgaatcaaaaagggtgaacatgtaaagcgttaccagctttacagaaaggctgttcttggggaaatccctcaagacataggaacaggtgcttcagaactaaggtgaaagaaaaggtgaaaggaaacctgttgtcctgactcaggttgggtctcttcttctgtgtgcattgcctaggagatttgctcccaacagatttagatgtgaattctttttaaatgtttcctcatgcattcctaaaatctaatcaaggtttgaatacactgctgtggaacagaaaaacataagagatcctgcagtatcaaacacagcaccttgtactgagggtctggacaaattgattaactgtgcctcatttaataaagtaactcacccaaggagcagaatgatggcatttaccttccacaagctttaaaggtccaaacacgaagtatgtgggaacaagaaagaaaattaggaggagaatttgagtaaagctaagataatgagagagagaaaaaaaaaagctaagataataagaaaaaaaagcaggagggaaactgctttttaaaacagctcttcaggtttttgttttattttgttttgtcccatacagaataaatttggggtcattttcacctcaccacagttactaataatcatatcagctcagcattgtctctctgtgattaagggaatgaaccctgtgagttctatttatacattattctttcattctatcttttcattgcttcagggtttcactgcaggtcttaacaaaagaaaacatacatacaaacaagcaaattatctccttactgtgcattcttaaaagttgaaaataattgagctctagcagaatgtagtaattacagtcactacatctccacccggtagagattacactgagcagtaattttcaaaaggtcacacagttaactccatgagtctatgtccctgcacactttctagcttgtcctttcttctgttgccatctgatcgactggctttattaagtgcatggcttcaagctgtttgttgagaaatacagcatctatgcttctgtttgtgtcagactattgccttttttatagtcttatcgtgggacttccaaacagattgaggtaaaaaattagagtagtgataagaaagagagaaagaaaggaaggaaaaaaggaaggaaggaaggaaggaaggaaggaaggaaggagggagggaaggaaggaagagaaagagggggaaagaaagaaagagagagaggaagcaggaagggcaagaagggtcactgctgtttactatagacgtggtgtgatatagtaaaaagatttcagcccccaccctgttgagagcctgactttggcaaagtcatttgtcttctatagaacttcatatgtaaaatgaattagaggtacttcattttcctaaaaaaggagagaaagtcaaatggtttcttcaagcctgttcaggcccaaggttgattatttcttctacatctttggtctgaaccattacgtggtagccaaattcttttttccctgatcagaaccccctcttctttttcaaaagagtattgacagaacagatcctaaatcctagcaaagtagctacatttagctttcaaattgtcatggctttaagaagacaatattaacgaaagctttggagaagacaacatcaaaatagcagttaatttcacaaaatatgttttcttacatttgaatacataaaaaagtttatttgattgagtatgtatgtgtgtatttgtgtgggtggggtgtgggtagatgggtacctaggaattggcatcagatttccaaagcaaacaaaattaaatatattaggagccagggacagagtattgcacataaaggttgactgggcaatttatttttagatttgattacaaatgcaagggttattgcatgtgtacatacactgttcaatgctatatttgaaaggagcactagagataatgtatcccattttccgaatttacagtgccagatcctaaactcaaacacagaacgctgagcccagtacacattttttaatgccacaccagactgattatttcactcaaatagcaatatatacataacttctaccatctcatacctctgttaaaacatgacacagttgtatatatatgaagaataaaaaagtcagatataggaaaaaagttcaaaattttacaatgattccaagtagaaatggtttctagttcttgaccttggaaatacctatgtgaggaaatgtacatttttagtttctgttgtaaaacttctatatggtactgtctactttgaaatttcattgtcactaactcttgcagccaataaagtataactacctagagatggttgagagggctctaaagaaacctattcaaagtaatcagactgaagtgctgacttataaaaaaatggtggcagtatatatattttgacaatttcttctagtcttacatgaattgaaacagcttccatcacacagctaataagtgaagaagcttagacttggtgccaagtcttccatctctgtattcacgtcttttcctctctatggataatggagtacacgctcagctcttcagtttttgaaaggctgttgtcacatgattcaacgtaatttgatgtgttgataattcagattaagttacatttctcaatacagtgaacatgtttcttattagcctatgtgccataattgaagtcttggctgttttaagagttctgttcctaaagcaaggatctgtatttatagcagcctgtcagaggagaaaagtgtttctcgaaccaaaaataggtagatggcattacagagtccgaagactgcctggtttcctgctgggaatgaatggtcatgcaacatctgtctcattctttttagacccaccagtggtttagaaatagcacttatattgaagagaagcaaaaggcatattcctgcaggagaaccaggaagcactgggaattagaaaacacgggttgtggtctcagatctatcactgataagtggcgtgacttgagtagaaatgctagactcctctttttattttttttttttttttgaggccactatttcctggatttatcttaagatgaaataatatgaaaacaactttaggaaatattaaacactatattcatgcagtgtctgcttgcacagagattacattttagaaatcaatagagaaccttagcccaaggggttgaaattgaaagttctatcttagttataactttatatatgttttaatgatttgcttgggtgaccaggtgactgagccaaacacggcaattgctgtgaactgtcaaaacagctaaaatgatttggttggatggattcagagtttacagagagccctatcagctaggctgtaagctccatgaaggcaccgagcaccattctttaattcaccattataggcctagcatccaccacaaacctggaatatagcacacattcagtaaatattttctgtgttgctaaattaataaaagttaaaatttaatttgtttaactaattttagagattttgcagctaagccaaaaattttaataattaatagaccgatggtatgattattcatttattaatttcttcattcattctgcaaatatttgctgaacacctattataacctaactgggtgctggggataaagtgttaagccagatagccacataacatataacattcttcttgccctttcttatgataatgtttttctttaaagtgatttgaagtcaaagatctgggttaaagtcccaactctatttcttagctgataacttctagcaagtcctttaacttcacaggttctcagctggttcatttcagagaaaatggtacttgtctctctgatgaggttataagagactcagattttatgtccggaatgacaggtgagctgtacacacactgctacattggatgtatttgttgctgtcatcgtaacttgtatgcatatcccagttgtgcatgcttttacctctggcagccaaggaacaaccacggaaaatcaggatgaattacagattaagtttatctctgcaaggcattctcaggcaactgagggaatcaattccacatctgctaagtttgattaatcacttctttttttccttgtggatctacttagcaagtgaactgacagaaatcaaagtcctagatttgtccccttatgcccagtgactgctgtctacctattcaggaatcacctcctgaatttaataggaagtgttaacccactggagagacagttcaatgttgttctctgacaggcagcattaaatacaattcctgaattacctggggtttggtcatagcggacatacaagctatcaacaataaaaacaaagagatggagaaaagaaatgttgtcctattattggaagaataccattatacaattgaatctggttgggtgcagtggctcatgcctgtaatcccagcactttgggaggccaaggtagaaggactgcttgagttcaggagttcgagaccagcctgggcaacatagtgagaccctgtctctgcaaaaaaattttaaaaaggaatggggtggaacatggtggcacacccctgtggtgccagctaatggatgggggtgggaacgggtgttgaggtgggagaataacttgagcccaggatgttgaggctgcagtgagccatgattgtgccactgcactccagcctgggtaacagagggagaccctgtttcaaacaaacaaacaaacaacaacaacaaaaaaatccctgaatctttggtaattgacagcattttctctcattttccttaaaaaaaaagcctactgcactttgcccagatttcttaaaatcaaataaataaaataaaataaaatacagctaaatgtcagaaaaagtctcattaataatgatgataaccactttaagcaccttctacatgctagatggtgtaccaggcactttacatatctcaaaacattaaagcacatttttttttcatattcagatatatttctgaggatcacaattgtcaccgattatatgattaaatttgtatcatttttaccctagtaatctcaaaaagttaaacacaaaggcatttttaaatttacagagaatcaaactgactcaattacagagattctaccccttagcaattggtttcagaaagtgattatattccccagaattgaaatgagcggacagctggactctctggaaaccaattccgttacctttatctacttactccaagtatatatatttgcagacaggtgttatcaaatcatggattctgtgtgatttatcctacaataatgctactgttaaaacctgtgtggccctggacacttggcaaatgcatgtaccttgtgggaaagagtgaacccattaggtgaattggagtcttattcaattattgaacaagcggtgcttcttcaatatttttgccttcaaacctcaaatttagagcagacccactgcacttccacctgcctggctccgcaatgcccagacaccttcctcttggacactatattccattgtgggaaaactacacaaggaaggtataaagatcgtagggaaagtggaaagtggaagaaggaagccaaagtaagagagaaggaaatggtagagaaagaaagatgagagaaaggaccagggaattccctgtgacaagatagaagtgctacttattgagcaagtcactggatctttcttttcttcatgggtaaaatggtccccttgggaagacctgtttgaaagccgttagcataatgcctgacacagacaaggaacagaaaaaaattagtttgtctttattcttctcattgctaagttatgtggacaaagcagttcttctagttacacagccattgcccaatacttagctatcattacattttcttcttggaggtttttccaatcatctgatcttgtggaggcaccagctaatgggagtctggctgcctgaatgcaagacagccaattatatgattcttcctccctgtctgacacttctctacatattttacaatatctaccttctaaattattactgttccttttgcttttgcctttacccccaagtgctcagtcttaataaaatatctccgtcgcacatgccttttcaagacaacattaaccattatatagcaactgcaaagcaggcttctctaccccttcctcctctttgcagagcttcctaatggaacaagcaaataaacttaattttattttgtatctccaactacttaatataatagtgcttagtacgtcaggtagcatgagtatcaaacaggcaaatgaaccatatgttcccctgtttaaggaagaatgacagtctgcataatgccaggcttattacaatctcccttctgtgctgcctctttgtaataaaattttaaattgttcatactcaactcctgagagccttgttaaggtgagcctttccaagggaatacatgttggagatgtcaagagccatctgatagtcttgcctgtttcacatgaagatgtaacaagctaaaatcctgtgtgtgcccctgtcagtcttgttttcattttcccctcttgccatccaattcccctttctttatccccactgacctccactgatctggggcactcacctttcacacagtgcctgcagaaccacccagatgccatggtctgaaaaagctccggttcattaaagttataaagcctgcctttaaatccagcctgcctaactcaatgtacgctgttttaccctgctgccttgtgttggcctattactgctgtagtccctctcccatgttttcgtgacaggtaaagccacccttggtggctttcaaccaagggtaaataggagaaaacaaagaagtttcacaaaataaatagcatcttataaattattaaactgtgtcttacaacagaaaatgggtaggcttccttgtagagtggctgtgaattcatgggctgcgatatcagtcagtttcaaatttgatcatgcaccataagaatcttgtgaaaaatgcagatcccagagccatgcccatgattttgatttagtaggtgtggaataggttaaggaacctgaatttgtgtaagttcactccctctgccttcaagagaggctgaagttgttgaataccacctagaggagcactggtttggtgcacacatatctacttagatagaaatgtgcttcattttatctctgttccaccccagaactttgattcctatcctagcagttcagccattcattctatctcactgttgaagagatataaatccttagttctcccctttttgaaaatgtgaatataattggctctagaatggtgtccacttattttacctcttgcttctaatttctgagtgacacttgtatcttcaaaattttacataaatattcaacagcaataattttatagacagaaaaggtcaattattcatgtaatttatacaaatgaccttttgttcttggtttgatttttgagaaaagaagtggttacttgataaattttaaagtataatgtccttttttgtttacttaaaaagaaaatggttgatgacagatctttgtcacacccacaccttctaatgccagtgagtgtatttaaaaaaataaataaaaataaataattagaaaaagcattgctgtctatgacaatccagtagaagaaataaaagctggagtaatagtatagaaatcagtctcattaaaaccttccaaacaagcagtgaagctgtcagagcactcttttttttttaagccactgactagaatttttcaattttttctttttttcatagtagaactttttaaattttttttcaaatgaaatgtatgcaagaaaacctttcattccacagataaaattgaactaatctggctaatgtcccggagggagaaccagaaccccactcaatgccctcctcaatccctctcaccctaaatctccatggtgtgccctagaaatcccctagctctccaaggagcatagtttgaggactactaatttgtagtgacaaatctgattctcaagtgtgacttgccaaacgattcatttatttataagtatagtggcaaaccaatttgacgggcgttgtgaaagattctgggtttataacttgaatgagctcagagtctcctggggaaggcagacaagcccacagctccggtgcagtggggcatgtgtcaccactaacatgtgaagagagtgagggcaattcactaacttggcttacaggagtctagaaaggtttcaacaggttgcaggtaactgaactggcagttgaagagtgagtgggaatttttcctggaagagaaaagtgggaggtacaggcttattacgagactgtcttactgtatatttggtatccagacttggtgtcatttcagaattttgggtacagatttcccttcctcaatacaagacacacttctcccgtgagtcctctaaatgcaagtaaagggtactcaaatcattttgcaaggcatccaagaattgactctttgactactcaaggaatgcttggatatacctaataacatatattttaattctatctccaattaaattaaccaaatacacccataaatctatcctccccatatttaaccatgagtttcattatataagaataataatgatgatgatatatccatttatatgctatccatcaagggcagatagtgtgttaagatgtttgatacatcatttcgttaaatttttacaacatacctatgagaggcatttattcatatttttagatgagtaaaactaaggcttagagaagttcagcatcataccgcgatcagtaagtgatagaaaaacattcagttctgagaagctctgactcaaagccttgtataatcttaaacacaacactgcaggattttaatgagatttctggtgtctatatgtggaattcaaggcagtccttcataatatacacatttttttgtttcttcagagttatactaaaaaaatcttctgaaaatagtgatatgcaaggtaaaactctatctttatgtcactaaaaggtatagaataagtcaacatgttgtccaaatactgatagatggagtcttatttattcacatcaatacaaaaatatcagttctttcagtggcacagcatcgtgaatacacaatgttcggaagactgattggatttttaacgtaacatacaatgtaatttttgatggcatggagaggtagatatgtaaattcagtaagcaggttaaagtcgctaagccccacaaaggaattaaaataggtataagactgtgtattataactaagaagaaagagttaaagttagcagacaaagagtcacacccaggttggtcccctattctcagccacttttgtaaacctaattttgtagactctgaggaatgctataattcagtagccaaagggaatccaggattggaaattccactagcatccatcactttcaaaaccatgttctatcttgatactcaagttttcagatactcatgtcctgaaatcatcagattacagggagctggagtgaaagggttaataatcattagcgttccagccctgttctctcacctttttatatgtgagggaagccgagaaccttaagtttcaagttggtggtttaaggtcatctgacttgaatctcatctgtctatcccaaagctttcagcagaaacaactttacatttataaaacttcaaagccctgaggaaatcacacaataggttcatagtcataaatgtaataatagcataggcagaatgtcctcacaatgttcagacttctccattctgttctgcataactctctcctctattgtattttcaatgtgttctcctctagtaactttgggagcatagtttgttggttttttttttttaatttatttctttaaagtcctgcattcacacatttttgtgtcctttgccaacttcatactttctagtcttttcttttgatttacttgggctataaggcatgttagcatatgaatctatgttaattctcttttgtgttttctcaggcatcccaaaatgctgcagcgaatggagacactttatctttcccttcttctactgaagagctaaatatttctctttggcctatttcactggattaatttagttaggctttccatctgatgctgttttgttaatgttaaattgtatttccttaacattttatgggagtcagcatagcagcacactctggcatgccatcagaataaagacacatcatggcaccaaataattacgctatttagcaactgctcttacctaccatctcctaatttgtgccataattcagtcaccgtgaatctgtgtttgtgttgcgtcagccactacaaagatcacacttaaattttttgtgtatattaaacaaggtgacacattatgataaatttagaggtctgaatatttgatgcttcctttctgctttggagtttaagacagttgaaccaaagacttaagatggaatcatttgttcactccagtaattacgcactagttgtaaatacaattacagacactaagaattctgaaaaagtagaaacgggcaccagtaacgttctcatttaaattaaaatgtatttgagtctatttctaatatctaggtaacccctctgaacaactatttgctaataaaaccctttcagttaactacctaaagaccctgaatcatccttgaaaaatcagttaatgggaagtatatccttagctatttaatagttaaaaatatgtatttctcgattttgttgaagagttgccaaaaaaaagtaacataaaagtactcaggtctatttcttttgtttgtttgtttgtttgtttgtggtggagtctccctctttcacccaggcttgagtgtagtggcacgatctcggctcactgcaacctccgccttccgggttcaagcaattcttattcatcagcctctggaatagctgggattacaggcgagcgccaccacacccggctaatttttgtatttttagtagggaaggggtttcaccatgttgttcaggctggtctcgaactcctgacctagttatctgcccacctcagcctcccaaagcgttgggattaaaggtgtgagccaccctgcctggcctgtctgtttcttttataagcacttgctttccagcaaaacatagcaaattggatttatttgttacctgtttatgatgtcacttcatgtaggttttcatttttgtttcctttcctttccctcttcctacggcccataaatatttaattacactctgcctaatataactcaatacagctgcccaaaggaacactattatttgcctggagctaggacagaggctaaaaaaaatactagagatcttattgcgacaattctgtgaatcagatgaatatttaggaaccaccaaacggggtctatattgttataataattaaaaacattttactctggcttgtattataccctttagtttcatgatcagaactgaaaaaaaataatgattaagatttgttttatacaccaagtcttatcctagtgatttgaatgtagagttgaccgttggacaacggggattgaactgtgcaggtctatttatacttgagtttttttcattaaaagttatactgactgtgcctgcctctcctgcctctcctttcacctcctccacctctttcacctttgccactcctaagagagtgagaccggacacctcctcttcctccttctcctcagcctactcagtgtcaagatgatgaagaactttattatgatcctcttccacataataaatagtaaatatgttttctcttccttatgattttcttagtaacatgatatcttctctagctgactttattgtaaaaatacattgtataatgcatataacatacaaaacttgttcatggactgtttatgttatcagtaaggctgctggtcagttggagactattagtagttaattttaggaagtcaaaagttacaggtggaatttcaactctgtgagaatgttggcaccccaacccctgcattgttcaaaggccaactccatttctttgcatcaacttttgtactgctttaaggggcatcagcaaactaacagaaagtcacttcaatgatcaaataaccacattgtttataagtataaagtttatactccttatttatacttataaataatgtggttgtttgactaaatcgctttctgttaggggactgaattgattgataatattgacaaatatacatctggctctagaaacaaaaggctgaatatttaacagcaaatgcaatcagaaaaatgcatatttattaagtacctgctaactgttgggcttcttggagaatataaacaaataaagaatattagctactaccttgggacacccattatgctctaggctctctctctctatatatatatagcataatgtatttaattctcaaaacaagatgatgatgttattactactcatatccccattctatataaagttggcatagaaatcaagcaactgctcctaaattaacatggccaaaaacagaaactcaggcacatattcaaagtgatctgactttagagtccatggtcttataatccctgtatcacctgcctcaaacaaaccttagcttttacagcatatttggagagcaaaaacttatctaaaaagaaaattaaaagtacaagacagtaaaatgatttagataatgactcagtagaaaaaacactgactccgtatcagaagacctgtatcggggctgcggttaagttagttattgaatctccctgcatctcagttttttgatgtggggagaaagcatatcgtgaactctagtgactggagaaggatgtgatagagaaagctgtatatcttggtggggttccgcaggaaacagtgctcagttctgcttctcagggaggtccacctgcagggcagcaatggatgattgtatcttactgcacacctgctgcctcacttcaagccatagtcacatcattggtagcttgacatcgtaggttgtcagctacataggttgcttccagacaggctgtatagagaaaccacttgggaacagtctgtggaaggaaagaaaaagggattaatttacctgactgcccctttgctggtggagctgctttacctgaacctttgacagtcagtggaactgagagaacctaaaagatttcataaggtgtgtctgaaacactgggaatcaaagaaggttttggagggtgaatgggattcagataagcagattggagagtgaaacctctgctagatacgaggagaagagagtttaggcttttgtctggcaggttctgtgaaggagggtactcaaagaaagatttgcaaattataaacatttgtttcctctttgggactcacacaactcttccctgaaaataaatatttgtgttctttccccaaagtcagacaaaataaaagagatgaatataatatttaacagtcctttctataaattttcctgaattttttgatatgtgtttcctcttgttcagaactgattaacaattgtctgtgcctgtgctttgctgaaagtgtgatctacgttacttggtacagtggccagatttaggtttgtttcctctggtccctcgatcatgtctctcttgagacagtacttcattttcacttcatctctgtctcttttgctttttttcatttttactacattgatgatcttataaggactgataaattaggttttcatcaatccactgattaaatctttgaattttgcctggacaggggtatcagatgttctctgtgtttaactacttatgtacaattactttttttttttttttgagacagggtctcacttagtccaccaggctgtagtgcggtggcacgatcttggcctactgcaacctccacctcccgggctcaagtgattctcccgcctcagcctcctgagtagctgaaattacaggcacgaaccaccatacccgctaatttttgtattttcagtacagacggggtttcaccatattggccagtctggtctcgaactcctgacctcaagtgattcacccaccctggcctcccagtgtgctgggattacaggcatgaaccaccatgcccagccatacaattacttataattaaagttactgacataaaatgatggaaaggacaacctttattttgatttaaatgagcaaactttgtaatttacttgtttgtagattgactttttatgtggtttgttaaaataagaaatttttaaaagatagcttattaaatgacagtgacattagcatagatattacacattaactataataattgggtgcaaaaatcattaaaatgcaatattaatatttaatctaaaacagattccggtgggacattttaccacaatatcagtatttgatctaaaatagattccagtgggagattttacctaaaacttaaattgtgaacaggaagaatttatacccacatttctatttcttatctaactcattttaataaaatcaattttacattttccaaatatcagtaaaattagagaatcaattaaaatttcatggtctacagcattatctttagacagaactggaagcaatactccagttaataatctaactataaaaatagcagtattgctctagtttcagcaataagaaattataattgcccgatgacctgattttttttttttttagtttaagaaatttagctatttctaatcctctttgtcctcaaactttgtacaaagttatggttgataccaaacaaaaaatctggagcatttcttattttccattcacaccttggaatctacatgtacagatctgttttctgtatgtaaataaattaaggattgggtagatattagatttgttatagtgacaaaaaaggatgtgaatgttaatctctattgtattgaaatagtttagttaattatgaacaggtattagttcatacaatgcaggtgctatcgtttggatatggattgtccccactaaaactcatattgaaattttatcttccatgtggcagttttgggaggtggagcctgtttgggccttggggacagatccctccttaatgcattaatgccctccctctgggttgagtgagttcttgctctcttgagaatagatttgttcctgctctcttgggaatagatttgttcctgctagacagcgttttaaaagagtctggcttcctcagtctctctctcttacttcccctcttgccatgtgacctctttgtacacaccagtttctttctgctttttgccatgagttgaagcagcctgagaacctcaccagctgcagctgcccaaccgtgagccttccagccaccagaatcatgagccaaataaaccatttttctttataaattactgagtctcagggagtctgatagagcaacactaaatggactaagacaccggaaaaacgagggtaaaatattccgcattagtctcgatgtagttccttaaagtaacacaaaatctgatgcacatgctgcgggtaaagaagccctccaagtggatgtgatgtgatccttctccttcctggtgttctgttcataatgacccatcaaatagaaggtaataggtacaaagtcaggcaaatgggtaggacatctgttacttttgttttctgtgtaggactacctaccttccctgacagtgggaagattaaaatgtcgcatgttcagctgctctttaaaaatctgccttcaacttatcagttaaacttgaaatatttatacgttattggcttagttttgtacatgctctatattctaaagccactataaaatctacccagtgtcacttaactgtcagacacagcttgttcttctgaattttgactcataatgcattagaggaattgcatggtacaatacaaacgctattaatttttctattagttgaatagtcatactatatctacacatataaatgcctttaaattctaattttacagaacattttaaatgcaaatgctataatcagtgatttaattatctaaacagaatattgaggtttggtaatttggggaaaatttttctatttaattgtgtgaacagttaaaatattctaattaagtggatattagagaataaagacatgagagaaatggcgttatcactaaacttattgaggaaataaggaggaaacataccaacaccgtaagtcaaatgtcagaatttggtgatgccaaaaccaaggagagtctggggactgataaccagagcttagttaaagccacataacatgcttctgagtccagccataggcaagaattttaagaagacattaggcatgagcaacaaacagagtgagaatcagaaatagtaactggagtcttggaagagagaaaatgtcaaatattagtatcagctaagaataagaattagattaatatctagcatttaattaacttttacagcaatcacattattattcctaaaataaaaattagagcattgtagatcaaaaagattaagtagctaagaacacagacaagaggttgcatgaattcacggaagggttttaagcagtgaaacttaatgctgaggacagttttgctggcattagactcctttcgaaaagcccagatatagttctcaggcctctttgttcaaaatgcagtgtgataaaacaatttcttctttccttgtttattcctcatggagttatagatatgcctacattcttaggcaggatgagaaatcagttcattgaaagcctacctattgactgctaatggagtccggtacagtgctaagcattttgaacgatttatatcaattaatcctcatgactctgtgacacaggtaatattagtatttctatgctatagacaaaaaaaaaaaaaaaaaaaggacttgggccattagttaacttggcccagtaacacaaaaatcaaatgttgggattcagattcgatcataagtagtttgtcctcaaagcccaagtttttatccactctgctaattacaccataattgcacaggatggcacaagaaaagaggaaaaacaatccttagtattagcatgaccattattagtacctcacgtgttaagatatctatggttaaaactctcttccagagcaggggaacggatattaagcctgtctttaagatgccacataaactaagaatcttgagaaaatgcacatacatgtacataaatgttgcatcacattttagagagttattagactctgaaggtcagattttaaatcttcaatattaaaggtcattctatgcaaataaaattatacatacatatatacacacatatgtacatgcacatatagcttaaatttatgctgcttttagtaactctgctattagtaaactatattttggaagtgaactaaaacggaacttgctaaaataagtgttttctggtctgaagaaagatatggttagaatctgagccctccgccatctagtgggtaccttgagtcacttattgcttctctttatgcctgtttcctgatttataaaataggggtgcaaacaatacctagcccagaagtttgtcttaagcattcgatgagttgacatttattacacacttactagagggcctgtgcagaaccagctccctataatatgtcatagcctccataaatttataacaatgagttttaatatggaaaagagcacctttaacatctaacactttttattttcgcatccccattgtaacacctaacataccgtttcaaacacagtagacatttagaaagtatttgctgattaagaaggaaaaaatatcttaacattgctccagtttcaatcatgtatttaaactgctgttgaatttttggaagtctcccatcatttcatggtgctcacaaatttccacacatatttttatgactcattatatattagtagtataacttcaaccttaaatcctcatataataatatacatataatatgtaatcatggtattaccttctgcttttttccctgtaactatatgctttgtactaatcattcatgcaaatctctacttttattatcagaatatttttcctgctttttacagatagccaagcttatctattcttctggctgtgtgtgtttttttttaaatgccagagaagcatatatgcaaatgaaggtagaatattttaatgtcgttcattgatatgttattaccaatccttgagataaagtatcttttttgcatattgtaaaagaagaatagaaaaaaatcagtctctctctatgaatgttaccaaaaccatcaattaaaatgttccagttaattcttacatgtgcattttgccttatctgaaaatgccaattgctcagtgccatttgatcttcactgagtgttccttcttttggcttttttaaaatcatttctgctaagacgtgtttagatatgttaaaaaactggaaattcttttatagtttttgtttaattttttcttaataaaattaagacaatgatcaggttgtttaattctgtttatattgtcatgagattaatttttttaccatattttaatatctcattaattaaaggagaaatctaagtgatacattcaaatatctgtactgtttgttatgccataaaatctttagttatgattaaatctttgaatgtctatatcctagatcaacagagagaacttttaaagtttattttaataaatcataaatcaatttggttactagtttggctatttttataaaacatttaaaatgtatgttattattcttttataaattattttcataagatcataagtaagatgtagtcttactttgaagtaaagaaaaaattttcagattaaagtttaatagtaaatagatcagtacttctcaaacttaattgtacatgctagtcactgtatgtactacagtgcatagggtgtcttgtgaaaatgcagtttgattcattaggtctgggataagaccacattttgaggagtaaacacatggaatatctttagggcatctagtgatgactctgctgaaacttcttggaccatataattaacatgcagaattattttactaaacgtaaggcaaagtaatggttctggaaaaagcctgagtactaggataattagatataacttcattctctcctacttagctagttagtctagggcagattttaacttttcttagtttgctctctcagtaccttaaacagtagtaagtacttaagaaatattgatgtgttgattaggatttcatagaaataatcagcctcaatgatggcaatttcaactcgatttagcaaacattgaagacctactgagcctgaaaggggtagtatactcagggtaccactgcacacttgaattattcctttctggaagttatgtgaaaaattatatgaaatatagacattggcattgacttagtggctggaaaactttcttggtggcctttagatatcagcagacctatcatttctgtcatgtgttttttattggccaatagttcaggtttctgtgttgctcaatattcctagttattcctaaatgttaggggtagatgcacccaaaagcttctcacatttacctcttataattcaaatcagataaagaattatatttggcctgagtttggtgcataatagaatagttttgttactctgtcaataatggcataattcaattgttaatgtaaattgggatctagtacactagacatctcagaaattaaataagacattaaatgtctgctatgggagaatactctaagataatgactttaaaaaatctgattatatgccatggaacattctaaattcagatgtggctccttccactcactgataacagaatttggaatctgttattaataataaatccaacgtcagaagctggcttcctgcaaattgtcgttggctggtattctctgtgtttcaaattgagtaattaattatattagctacattttgtgttatacatatattagaaacaacgatatgtttgcaatgcagcaaatactattttgttattgttaatggatatggcatgcatgccaattgtctagcctttcttgcctttaaaactgttgttaaaaattagtatgttgtcacacattttgatacaatcttgactacctactaatgtttttaaaaggttggtaactacatttgtaagatataaaatatggtagcctaaaattggacgaatatttttgtttttacattttttcagtctcctcttattacatttgatggtgaatttttcagggaacaaatctcagggttttttttttttttctgatttcagtggcattgtgctttagactatgctagagtttcagagaaaatttaatatggattattttatgaaagatgggaacttctttggcagatgaacctcctttttgtactctctcttttaggaatattaatattaattcataattaacccatgaagccttattctttctacttcttccttcctctttttgatgggatagccacataataagcatggccctctggccatggaaccatatagatagtttcttcaactcatcagcactggcaaatactgtcgtggttcaacaccccattctgtggccacagaaaatgctgacagaccacgtttaaaaagacacagactaattgtgaaaattagcttgcatttctcctaagccaagttcaatttttgccagtgagttgactttggaaaatacagagtaaatagttgcatttcttattcatcaagcaacttgacattatactaccaagcactgcttttatttttaatatgctttgaaatcgacaatgataattcaagttatagaatgataattatcaatatcgtgtcagaataaaagcaaatgccatttactgtaatatgtagactcagagatagctcacaatgaagaacagaataataggaaaggaaaaaattcatattatcacatacacccatgattttagtaaagttttaaaataaaaataagcacttatgatttaccagtgttgaagagccttacttctattaatgatgtattttctttttagaatatttctcttggaggatggcagcctcaagatatataatattaccaggtcagatgctggatcatatacatgcatagccacaaatcagtttggcactgcaaagaacactggcagcctcattgtaaaaggtatcatattatcttcatttgtgcttgatgaacattgtaaatatgcaggcatattatgacttgtgttatggtgtcaaacctgtaccatattgtgtatgtaaaattgttgatttcacaagttatctaagagatccattcccgtactcattaataacatgcacactttgccagtgggataccatggtagatgtgaatactttggcaattgaaaatgctgtcagagtgtcattcgagttaaaacctacacctaaattatttggctttttacataagccttaatgttaggggccatggacgttttgataaagtcactggataacatttttttggtcaaatatctttcagaatctttatttttatttgaaatatttacatgtatataaggctaccaaatacataactggctaatttgtttatataactccaggtacaaaactaatgaaatgcagggtcacaacctttagtaagcagttcttttcaaagagaaaaaattaaaatctgtgtgaatcattattatattttcatcacagtaagcagataaactcatacaatttatagagataaattctatactttacttttaagatttctaaatcagtatcaatccaaatgttcctacatttatcaccaaggacataattaatattagaagtatctattccctttccttgctgctttattttgttgaatctcagctcataaaactagtgtgtttactggaagctgtatcacttctatcatttcattgcctcctggatgataaaaatggctctcttgataaagcagtttaagcagctaattaagcccaaatgattaaaatcagcatttggtgctttctcatcttttccattaaaataaatatattcaataaaaagtagttagctgctacacttcaaccatcctttaaaatatctcaaggaaaataaacacccacctttgagcctggaagatatttctgccaacttgtctcaagcgtattacattatgacgacaattgtctgaagtattctggggaaatgtgactgataaaacttggtgtgtcaaaatccaaccagtatggcatattttgaaaaacttctcttccttaagattgtattgtcatcaatttttaagacagagatggacttaagtgtttcaagatagatgttatggctatatttaggaacagactatttctccagcaaatttttggcaatactcagacactgaaaaatgtgaatgctttatatttggaaaagtaacaagttcattaacgggaaaaaaagatatttattatatcatttcaaattaagaaggtgtaggtagtatgcaaattttattacagcagaagattaaaatgtggtgaaggataaaaaggcattttgcagttaaatcttctaggtatggaaaaatccagagggcattaaaacgtgaaatagaagggatagaaaacatcagcagtagcaatgtagtttttaaaagaaagtttctttagaatactggtgatctgggaggagggccaatggttttgctgttaaaatacaatgatggggattccttcactctggaggataagaaaaacacaagttaatggtagattgaactgaatgaataggcactcttcctccagtgtttcttaaactttgacatcataatattcacagtccactaataactgatgaaagaaaaataaaaggtgacggctaacaaaaatactaactgagaaactcggaagccactggactgcattctggatgtaacatttgcatatttcagatgtgtaatatagccatgttttctgcaagttaggttcctagtacttatgatagaaataagtttatctacactttcaagtattccataaatctaaccataatccccagctactctgctctttccataggtaaaacaataattaatcaagatagctcagttaacaaaaaaaaaaaaaaaagcctgacttacatttttgtttgttcatttctagtgctctttgctgaggttgttgaaacaaaattatcccactaggcattccttgttaccttaatcagttccactctttcttcttctgtaccactttttatcttcttacgaactgtataactgacttacttattatggttttttttcttgtcttttcttcccttctagaacagaagcataaagagggcagggatttttgttttaatcaatgatgaatcataaatcctagaacattgctgggaactgtatgtgcccagtaaatatttattgatttaataaaatgttattatcttatgcagcttagttcatagggatatttttcatactggcttccttgctctaaaatcggacagttttcaatttttcagggtctgagcttcttaggacactttgcaaaaaaagaacatcaaagaaaaaaaccaacctttttacatgcattcactttctaattgtagggtttgtaatcttttatttctgacagacatcgatcacctcactctcctaagggggtacaagcctgaacctacatcgaaatccaaaaattcgtgaagagaattcattgttttggtatttctagcacagtacaggagaataactcacatatacaaaaagggtacatgataacataactgatgtcactatgcctgattatcaagttactttcatgcatttacacctaataatgggaaggaaattttgctatattttaaccttcatgacacatccacatcccattttaagtggactttggggtcttttgcttctttgtcattaacaagaactatcctatgcaatataaacatgtacatacttaaccacacaaatacatataaataaaataaacacaaaatgtgtgtacagtatgaagaaaaacagccttagaaagttgctttattatttatctgtaatgtttaatctttatgaaattgtgtgactgtcatacaagcacagttctaagtctattattaccatgtcctcttaactagactgttatctctaattccctttcatataaaaatgttgaagacatcactgccaaggaattattattttacaacctacaaatttgaagcctagcataggaaaaaattataatagtgtacatcaattcaaccattttcttgactattgggtgtatagtcatctggttgtttcttaagatggcttaatagttgtgtatatatgtatgtgtattttctcatcagtaatattcatatgattgctgttacagaatcaaatataattttgtttctcaagccaaaatcagtgtatagtgaccttaagagtaatagagtgttaaggagcaaatgagaaatctcagtaaagctgataaaacaatcatctccctttgaatttacttatcagcctctgtcatgcaagaaatgttgttgttagataacatggaaaagataatagttacaagagtgagatattttccagcttagtttttagctgatatggcttatctctgttaagaggattctgaagttatctgcactgtatgttggaaatttctatttcactaatacagcaggataaggcgattttccattcaaacattgtgagtgcaattagcagcagcttttccagcgcctcagaagatgcccagtataatttaaggacatgtttcagaggcacaaacaaggaatcaagaggaaagagagtttacgtgttttcattttggaggactgagattaaaattacaatgtgtacatacactaagaggtatatgaaaatcacataaaaggagaaattatttgatctggcatttggaaaattattaaaaagcagagtaacagcaggctataaaaatgatcttgtttgcaggcaacatttgtttttgtttccccactggagaagttttggatgttcaattataggcctcattgcttcagtgttattttcaactgaaatgtcggaacttggaaaagcatatctaatgtgcaaattaagtttattgctgctcatttagttgtttattcttcgtgatagaagtctttattataccagcattacagagtggcctatccattttctccagcagaatgatacgggtctaagtttactaagagaaatgcccaagatatgtagataattggaggcttcgtggctctagaaggcagtttgaaggatttgaggtatcaagctcagctttattgacaagcccagtttgattgagcagaccaaaagtacactttcagagaaatgacaagatgtattggaatacatttgtcatatcgtagtacttgaaaacaccagagaagtctccagcagcactaaaatctccccaaaaatgttcagttccacacgccactttcctacacagaatgactgaaagcatttcaacagaatgaacatttgatttaaaaattagtgatggtaaaaattactttcaaggtgagaaaatatataaggagttattatactggtcagatgaaaaaatttcctgttccaatattgaaagtgatgctgcgtgaattattgaaacgtgaatactacaatctcttcaagtaaaaatgtaaaaacaagcaaaaacacgcatcaatttaagcaagcccactaagatcaatgttgtcttggtcttcatgaaaatttagttcacaatcttttttaaaatgcagcatatgtcactcagattaaattaccacatatgacatatagctgtgttttttcttaatgtatattttacaaaatataatgtaaaggatagatgttaatacagcataggttttaccacttttttcaagatatttttactgcatagtttaaacctattattggtcaaagttttgtttaattttgataaaaatagggggtgtatagctagtggtttatgccagttgaaggagaccagacacagaagagtatagaactcttactaaagtggtcaatacacagcctctggaattatattaacctgccattactaactaacgtggaacttgacgacttagtttttatggttattcatcttgttttctttattattattattcattactatttgttaaatacattctctgtcctaggcaccatgataggttctttgtgtatatcatctcatttcaactttcagagtaatgctttgaagcagatattattatctcaattttatacaagggagattgaggaataggttgctaaaaccacttgcccaaggtccctgcattagtaagtggcagaactttagctttccttcttttccatcttccaacaaatgtacatattaaaaaatgcatgagacaattttacatcgcattgttcaaagtctagcaggaataaaagtatagtaacatgcagatattagtacttcctcctaaataccgcagccttcattcattagagtgcaattttatatgtacatttttatatgtaaaaattcatttgagtgcaatatttatgtgcatttacattttattatatgtaaattttacataaatgcacatttatgtaaatgcacatttatgtaaaatttacatataataaaatacataaattttaatgtatattcactaaattttgaaaatggcatttgtaacccaaaacacacaagatatagaacatcattatcatccaacatctagaactttttttatgtcacttaatccttgttcctactacactcctagaagcagctactgtaataattttctcaccatagatttcattcaaatgctaccttatattgtgtattcttttgtgtttggtgtcattcatacagtataaaccactagctatccatctcctatttttattaaaataaaaaaacacttcaaccgatacgtttattctgcaggtaactaaatgcatatatacatgtatgtatatataaatctcaaactattaagtctttttgatctttagtttcctgcccaaacctgcaaacacttgtgctcacttgtttcttgagtttttagttaagaattggaaatttagtaaatttaccttgactctattctgaccgtaaaagaagcaattaggctactcttcttcttaggcattctctctctaaattagctcagtggtcacttatgctctagggccattttttttttttttaggaataaactatgtcattaagatggaaaagacttccccagaagcaagctatgttttcagtctctggatcctgaatactcaagcaagtagttaccaaatgctttcaagtccaaaagaggaatggggttgaagggcgtggaaggggaaaaaataatcacatgaatcaaacttagccttatcctctttttttgggttttattttctcattttgactccctcatcccaacatgaaacgttcagaagaaaatatcatttgtattaacacctattgacaggcacaataaaaatttctactttcatcttctacaaaactacaggctgggtgtggtggctcatgcctgtaatcccagcactttgaaaggctgaggtgggaggattgcttgagaccaggagttcaagaccatggcaagaccttatctctactaaaaataagaaaaattagtaaggcatggtggcatatgcctgttgtcccagctacttgggaagctgagatggaaggatcacttgagctcagaaattcaagattgcagtgagctatgatcatgccactgtactccagcctaggcaatacagcaagatcctgtcccccaaaacaaaaaaggtacagaagtcttctattgtataattcgctacagccagcatgaagttactattggagaatagtctgaatgaacactatctatttataagaaatataaatatgatgccataaatatgtagtcactgcctattatgtactaatagctttgaaacagagtagttgtcatatctaatttattacacagaatctacagagcatgttctgtttaaatagatgtcaggccctgctttgactatttgttaatataaaagatctgtgtttacattttacaatattatttgctagggaaatagggtaacattgcatgttttctcatttagacatctcaacttttagacaatgctttctctagactggtttttcacttgtttcttttaatctggggttctcagtagtcttttaatatttattccaaaccatttaaatgttgaagtagtaaataaatgagtaatggtacctgaaggtaaattggaatatattgaccatgattactttatgcattgaaattaaattttactctgtggtgaaatatgataaatgctgcatgtagattttaatctgtagatacacgtgtgagcagataatcatgcacttgtctaagaggatataaaacattttagacttacggattgtatttgcaaaaaggaaaagcttattaactaaagactaaaaacaactcctttatttctggcttgctacacctggagaaatgaagaccccatcacaccgatttccttgttcgtttgcctgcttttctctgtccaaggtttatttcagagtattagctttgattttcctgtgtttgctttcccttcttttgttcgtttgcttagttttctacggacttgccaacaattcatttcccaaatctatctcaatagtctcccttcaatatcagcctgccctgtgtgttgacgctccattgcctaactccatgcctttctgtttcttaacatactccttcactttggttgattaaaccttccagtggatttttgagaaataatccaagagatatacaatttttttaatctttcatgtttgaaagtgtctttattctgtgtttacattttattagtggtttagtttgaagtagaattctagactggaagccattatttctcagaaattttgagccgttactgtgctctgaaagcctaaactttgttgatttctaatctgttgtttgtgacaccttttccctcttgttctctagaattctgttttctccaatgtttgacaatttcaagataatgtgtcatgttttaaatctgttatcaactattacactgggcatttggcaggctttgtcgctgtagaaactcatacttcttggtcctaaaatatctttctgaataatttaatattttattccattccttctcctaaaagccctgttatttaaatgttatattttctaaactggtagtctagtttatggttatattcatctatatgtatgtatataaacatacatgtatattctatacacattctatatattctatatacatgtatgtatacacgtattttttttctttttttctctcttagtcttcattttatagctgtacctaccctttgtatctcatccagttttatgtttctaaatattatctataagttaattcccaaactcaaatcaagctaattccagctcagatatttctcttcaatccccaaattcaacagcctattttatcatcttcacttacaaatttactatatcctaaccttgaactcctgattcttactccccaaacttgtttctactgtcttctttctccactatattaatgacagtctgcactgacagttgtttagaccaaatccttgagattatttttaatttttttctttcatttaaaccccatattcaattgccccaaaatggtttcagcttcaaggtacatacagaatctaaccacttctctccgcttcaatgaccaaactttaagccatgccatctctttcccagagtattgctatagcacagaatggctcaaccaggatgattttgtctcccaggggacattggcaaaatatgcaaatatttttggttttcacaactgaagggtctcacccgaccccatccgctgccttgcaccacacacacgctaaacccacaccttgacacacacaagaaaaaattatttggaccaactgttgataaatgttaagcttggaaacccagtaatagcttcaaaagcatttgtcctaattctttgtttcccttctagaagctacaatgttgctattaaaatataggcaagattttgtcactcttaggactgaaatcttctaatggttcttcagtttggttttgttccttttgttcagcattcctactgatgtataatttggaataaggtaagggtgcaatactaattaaatggttttcaatagatgattgaataaacaattagtacatttctatgttaggaatctctacttctgtccaaaattatacttatttctttctctaactgacagcaattatcatactcttcaagctattatctaaaaacctactgataaatggcctaaatatttttaccaatacacttaatctattatgaaacattaataataaaggagaataatctgtcttaactagttgaagtaagcttatcacaccaacctcccactgatgttcaccacaaatattgttaaaatatttaaaaatgaacaaaaacagttttttcaaggaattgtgacaacagccaaggtgtttgcaacatgaggtgcagaagcctggagaaaacaaaagcacagagaggttagccccacattccctgctgtttttcttctcagaaatttgtcaattcctaagcagtataaatcaggaatgaagaaaccaatcagaaagtagaaaacatctcagcagaaattttggtagacttacagtgaaagggagacacaaatagaggttcagaataaaccaaatagaatgaagtctgctaagcagctcaaccttgagtcaggacatctgaaggactatgtcctagtaagaaacaaaacaaaataaaataaaattgaccaggacttaaaatgactaagatccagactcaattcatatcagtttcggaccagcttctggctctttttataattgcatgcttgaaaaagtaaatcttcccggtacaaatataacactataaaatcacttacatttttgatccacaacgtctagcattcaataaaacgttactaggaataactggagctatgaccaaatgaccaaaactcagagaaaaaaacagataatagtaacaggtcacagcgatagaaatattgaagttctcagacaagggctttaaaataattttgattaatatattaaaagatagatgacaagatggagaatttcagaaaggaaatggcatctgttaaaactccaatggaagttctagaactgacaattgcaagtgctaacattaagaacagaatacattgatttaacacaaggatagctataacagaaagaggattagtaaaggggaggatgcgtgaatagaaaatgtctaaactgcagcatggagagagaataaaatgggaaagacagaaagtatcataaggaaaatatggaatatagtgaataacttttaacatatataaaattgttccaaaaggagcagagaggacagaaagaaaattaggcatgagcaatatttgaagaaatatttgccagatactttttaaaaactgaaaatgataagtatccaattcaagaaattatgtgagtcccaattcagacaaatgcaaaggaaagcctagctaagcacacagtagcaaaactaaagggaaaaaaatcagataaaaaagatacattaagtcaaaaaaacaagactagcagttgatataacaaagaaaaaaggaacccagaagaaaatgaaatgacatttttaatgcgctaaagacaataccaataagaattctatccctatttaaaaatccccccaaataaagacaaaataaagatgctttcaaacaaacaaaacctgagagaatccccatcacttaaaaaaataaaaatttcatatatttaaggggtacaacaccttaaatgtttgacctacttatgtgcaataaagtggttactatactaagcaacttaacttatgcatttcctcacatagctgcctcttttgtgtgtgtctctgcgatgagaacacctgaaatctaaactcttggaaagttctcagtatacaatacagtatttatgatacagtatacagatatatatatacacagataactgtatcattgtgctgtgcattctatctctagacttatttgttctacataacaataactttgtacctttgaccagaatcttcccattttcctcacttttgtgctctcagtgaccaccattctagtatctatttgtatgtatttgactttttttgatgccacctataatttagatcatacaggatttttctttctgtgcctggcttacttcacctagcatagttcttccagattcttctatattgttgcaaatggtagtatctccttcttttatagagctgaataatatcccattgtgtacacatgtcacaatttatttatccattcatccactgatggacactaggtgatctccatatcttaactatcatgaatactgctgcaatgaacatgtgagtgcagatattcctttgactattgattttattttctttggatatatatccacaagagggattgctgggttgtatggtatctctatttttaattttagggaaccctccatactgttttccataatagctgtaccaataaatattcccaccaacagtatgtaagagctccctttttccacaccctagataacagtcatctcttgtctttttgacagtagccatcctaacaggtgtgatgtgacatctcatcatggtttagatttgcatttgcctgatgatttatgatgttgagcacattttcacatacctattggctatttgtatgtcttctttggaaaactgtctatttaattcagtttctacagttggaaggaaaaccatgtatatagaggaagtaataaagagcaacggaaaggactaatatcttaatatgtagcgtaatttgagattctgaggaattcattagaaaaaagaccaatttttaaaggtatttatttctagacattgcaagttaactagcaagagaaaatatgagagaattttgtcacctatttgaagtgctatttatatactagtttacttaatattgatttcttagcaacattttctataatgtcatagataaataaaggaagagccccatgtttgtacaggaggaagagtttgataatttttcttacacttttgtctatcctttgagaggagtttataacttcagcaacaccttagcagttattattctgaaaagtgacattgataagggtttcaactgagttgaaggaaaaaaaaaacaaaacaaacaaacaatattttctgtatggtcaggaaagatgaattatacatttaactgccatccccttgcttctaaaaatgtagttagagatcatgaaaggtaagagtgtatttatttggccattgatatagagaagcagtcccatttttaagtgtttaaagaaatcacaataaatggtcctgacataagttttgatgtaattagtcttcatgtctgctggggtccccgtaactaaaatgcattctggaaacatcattggctattatgaaatgtgaatttcagtaaggctattcatcaaaagcgtcacatcatatattctattactcttcttaagaataggactgctagatgaagctgtttttatataataacttttagctcactgacagagattgaaaatggtaaatattaaaattctgtggttttacaaactcttcatgaatgattgtcatttatatttagggcaatcttcaaaaagtggctagttcttatgatttcagaaagtgaatgagaaatgttcctccctattctgtatgtaaatattcactctcccccaacatgttcttccttttattattgaaaattgcaagcacacacagaagtagaggtgatagtataagaaactctcatgtatacatcactcagagtcaatagaaggcaactcttatcaatcttgtttaatctatacactaacctacttccacaactccaattatctggaggcaaatcccaaacctcaataatttcacccacaaatatatcagaatgtatctttaaaagattaaggaatcttctttttaatataacataaaaccagttttcttatggtaacaaattattatttctaaattatttagaattcaaatttccataatagtctcataaatatgtaagcttatatgtgtatgcatgttaaataaaaacacatatattttatatgtgaatatatgacatatttatgttgtgtttaatcctcttcaatcatgaaagcaacatttccggacattgtttctcagaagtccttatataccaagatatacttccatttctatgtacgaacactgtatgtatcaagaaatgttacatggattaaaaatattccatactctaccaaatgtaggaaaccttgaattaaataaaattttaaaaataaataaacttacttttaatgacaaaaaccgcaattacttttgcaccaatccaataaataagaattcctttcatttaggaattctcagagcttttaatatgttaaaatgtttaagaaatgataaaagtggagataatatacagaattaattacagttaaccttgggactccatctttctttcttgaagtattactaaccaggaacacttactggatataaatttttcctaaatccacagtattagagaatttcagacaatatattttatatttgaatgtttcttaaatagaaatttcaggttcaagttttaaaaactaagggaacatttgtcaaagcatggtctctggaataactatatcaaaatcaagtggagaagcctgatgaaaggacgtattcaaggtctagacacactgaatcagtatttctggtgcaatatgaggagctcacgttttgaatgcatgctcaggaaactcttacacatgttaaaattttaaaaccactagatcagacttcctacaaatggctaaggaatatgcaagaagaatagcatgacatgaaatgaaagcgaataagtaaccctttgttttgtttgaaaagacttaaagaatctcaaatttttacaaacgatagagtctagcgtagtcaacaactttcctcctttttaatttgttataattcaggccctaaagatctcaccgatccataaataccgagaagtgtttcagtgtcgatgagcctcgagtaactgcagctactctactggcacatatgcactcttaggaagtgagtagaatataggatctgagtggtttgaagaaatctctcagatgcttgagtttcttaagaatttaaggtgtatttgatgaggaattaatggactgaagcccctcttctttccacaaagtagcatgaacagttttgcatatttcaactgtgcaagcaccaatcttccagtccctgcaagtgtgatttttgtctctgtggggtactcatgttagtgctggggctgaggctgcacatggctgtagaatgaactctttgagagagcaatcaatggcctcatggctattagacagccatctgcacaggatgaggacaggtctgcctgtggtgggtggagaggatacagcagttaaaatgttcttgtccaagcacctcttcacccacacaggaggctactcccaggaggaactatgcatcccctttttctggataataagcatgcttatgtagagctacttcttttcaaatacagtctatttttcacactgcagataatggtatgtcatcatatcactcctctgcttcatacttccaaagtttttaactttttcagcaaaaaatgcatttctaaaatttttaattgatgaatagtaattttgttttatgtatttgtgggatataatgtgatattttgatacatgtttacattgtgtaatgattaaatcaagctagttaacacagccatcacttcacatcctatcatttttttgtgatgagaattaaaatcctcattgggtaattttgaaatatgtattacattaactgtagtcaccatgctgtgccgtaggtctctaaaacttattcctcccatctgaaacttagtacgctgtgaacaacatctcctcattccccatccctccctcccaccagcctctgataaccaccatgctactctttactatgctactctctactatgtaagaatatatttcttagcgtgacatccagagctggtttcatggacatacaatccagtcacacagagccctgtgctgaggaagtccccatgtttgaaatattctgctgtgactgtcttgaaattcttaatcattttacctctcaatttgtgttttgtacatactaaacacaaattgagaggtaaaatgattaagaatttatttgtaacctgtgtgtgcatgagctgctgctgctgctgcttcaccatacccacatgcatatgtggcagctcctgcacacacaagttcaggcttaaagacccagcagtcggcatgcgtgcacagcagttggtgtggtgtgcaggtgtgcacatgcttgcctgggtagtcatagtcctggagtcctgagggcatgggcacatcagaacctgggcctcttaaagggatggagataatggtggtagcagccatagaaacggcagtggatggcagcaaaggctgcaggaagcgacttcaaaagtagtcaacaggaggatccaaggtgggaggccagcttgcccatacctcgccggaggctgtctctgtgggatttgcaaaaatattaactctccatcctgagcaccagaacagaaattgttagtgctcaggcaataaactttgtcaataaattattgcaaaaggaaggcatacacatggacattgcaataaaatccacaggcttagaaatagaaattaaacttaaagattattccagtcaatgataagaacattatttttatatgatgctttggggaaaccaataattgatgagttttgctttgtaattgaagatacaaaaatggaatggtaaaacaggcattttgaactatacgaaaatcatgaagtccctttcaatttcttgtacaacctccacaagttacagtgtatgtcagaggaaacattaagattccattgcatacatttatatttaaaattaaattcaggctttcataaaacagatttgtataaagagttaaatctttttagaaaaatattggtgaagagaatcatcagctctagatatttcaacatttatatttcagtgtataattcatcagaaacttctgaatgttactacagtctataaaacagtcttaatggtttcataaaagttgcatcagagaaagatactttgcaaaataaaaacttatcaaaaagtatttgtgatcttgcatttgccaggagtgactgatgtcactgaagttatatcaattgaaaatgaagttgctaaaaatataaattctgttgatctagtaaacaattgaccagaaaagtaatggagaaaattatataatcaatcaagatataacctcaataaagtattatttattatatcgtataaaattatgacaccaaaatcatgtattttgtaatttgtaagtgtatgtcatcactcatctatgaatcataccctaattttattttataagttataaattattttaaagcgaaaagctttgtatttaatacctttaatgacactttttcctctttttcaaaaaagacaccccacgctttcattttgcacttggacccacaaattatgtagctgaccttaatgacgtttgtggcttatatcctgaccaaggctatcctccagcttcatcttcttcgctttcactcctctattactctgtgtttaatcctttcattttcagcacatggttgcacggagtctgccgatcacagttctttttcacacagtttctctgtgaacgctcttgcctgcgcaggaaatctagtttcctctctctacctgctacctttacccagctcactactacttgccttttacttctcagcgaaaacagttctttctccataaactgatcccctcaggatttgccaaacatttcaaacaagtcacttctagtatatggtgcttatcacacattactgtatagtaactaatatgattggattcatgctagcttccttttgtagacgttcatctctgtgaagcaacactccttatctttttgacttgctgcgggtttttttttttttttttcctcattttcttccctatcttgactccagtacttagcataggattggacatacattacatgctcaataaatattagttacaaatgagttaactagtgaaaaatgtaaccattataagtgatgaaataaacatttcttattcataaagctttcatcattattactgtacaacaatgagctatgtagatagggaataatttgtccaactttgccactatgtggtgtcataaatggaaggacttgctgtcatttttaatgtctgaaaattactttaattgcatgatctaaaactttaaatctgggcagttttgctctgtcaacacatccagttagccaacttatcctcctataaatgtaaataagacatttgtgattttttttttcagagtaactacaaaaggaaaatattttctctagttctaaaaaattttcttggatccctggatatcttttttttttttaaggttcaatcacactttattcatttatgtttttaagttttttaggtcatacatttcctcaattcttcatacattttatttcagtcaattaaattacaaaacaatacaagctttttaaattcaaagtctaaagtatataaagtaataatgattccctctctttctcttacccttcaacttcaccttgctaatgtaacaaacttaataatttaatgtgtatctttttttattttctactagtttattctttgattagaatccaataagatccaaaaaaaagaaagaacccaataagatccatacatggcagttggccaagtttttttttaatctattggtttctcctccatctctcttctttttctttctttttttttaattttattattagtatactttaagttttagggtacatgtgcacaacgtgggaattgaacaatgagaacacatggacacaggaaggggaacatcacacaccggggactattgtggagtgtggggagcggggagggatagcattaagagatatacctaatgctaaatgacgagttaatgggtgcagcacaccaacatggatccctggatatcttttacccttattttggttgcaaatctgtgaagaagccttggaattaagaatgggcatagtccacaaaatcattctttaaatttctccttagacaaaattagaatataaagtgcatgcatctggttaggtgcagtgattaacgcctgtaatctcagcacttgggaggccaagtcaggtggatcacttgatgtcaggagtttgagaccacctggccaacatggtgaaactctgtctctgcaaaaatacaaaaatttacctggcatggtggtgcgtgcctgtaatgccagctactcaggaggctgaggcaggagaatctcttgaatctgggaggcggaggttgcaatgagctaagatggcatcactgcactctagcctgggtgacggagcgagactccatctcaaaaataataataacaaaagtaaaaaaaagtacatgcatctaatataaatatggaaagtattttaaataataaaaaatgaagacatatttgatacagaatgagtttgattttctctattatattcatattcagaactatagcgtgtgtttttattttttcatggctcttttgtcagtatgtaccttaaaaccccaaattattacttcctactttctacttctaaatatttatgaatgaagaaaacaattaaaaatgtttaaatggtcaaataataactaaacattctattggtaaaatgcagttacacattaatcattgtgaacatataaatgcaatctcaatgttagtttggtttcttgagcagaatgaagaaggtagaagaaagtgaagattttagtccatttcttagagagctaaactttatcttataaattacccatggagaaatagattctccatgggtcatttcactatttttaaacttcttcatgtataattttttttttacaataacttgcctaaaacctttattcttaaatgtaaatctttcaaaacaatttattcttggtaagatggtacatatctaaatccaaatatttgtccagggccccttcatagatattgagttgctctttgatgaattctcaactctctggaatcagaactttattataaacgaagtagtcataacgatctacattgtgagtctcttttaatctgaacaaatataggactctcaagtacaactggcacaccctgggattgtcctttgaaattttggtcaatgaaatgctaggtcttgtaaaagaaagattgacatagagaacatttctagagggaaggtttttatgatggatgcataattttaacactggaaaatctgaattattaaagggaaaacttccatcttccctattcatgttgcatctttaacaaaaagaaaattagagctacgtcaaagacagaataattatgttgcattcaccctcttaaatataaacgtatgtctaaatctctatagaaactatggtggtcataatcttagaaacatggtttgtctcatggtatatgaagttaacagagagcatttagagctgttaccagtgtgtcaattgtaatgttatgactaaaatgttagaataaaatataacaaaaacaatgcagtgcatcctgtatatatggaatgccattttttgaggtctacagttttctgtaaactattttcatataaggtgtgaatatatttttaattttagtataagtaataagctacaataataaatacaagacatttaaaaacaggcaaaggaatatttcatactggacattgtagaactccaggttgcatttatataatttcaaatgaatgataaagtattcagaaatatgtattttataaccataggctagcatttcataagctttaaaaaataattttttttctcaacagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagtaagttactgaaattgttaagtgcttaataaaatgaatcaagtcttttacatgaatcaccatttttcatagttactctctccatctttatttgcatggataatcactgactgtttttgaagctacatttgtttttgttttggtttattttgtttcgtgtcttccgtagaaatacttgttttctagatgtaattataataagggggataataaaagggtttagatacaagaaatgacaatgatactagtatatcttttaatttcagagttgttttatgtttcgtatttatccagctgtaacaataaagtaggacttgttatatgggcttacgtttttatccatttctccctttctgtctgcaggaatctgttggggatttgatgataaggaatattcagttacatcattcaggaaaatatctctgcacagtacaaacaaccctagaaagtttatctgcagtagccgatatcattgttagaggtaagcataaatggtgaaaaagtgatcacattgtttcttcacagttacagtgttcatatctaaattgtagacctctgagaaaccacaccatgttatggaagtgagatgtaatcagatagagttttattttttaaaccccaggactccatggtatgggtagtgtgaatacagacatggaactgtgtgaatacagacatggaactgtgtaggatttgactatcatgaacggtcacgcttggcaagcggtgtcagtaactaaaacttagacataccttctgtttataataaatcattcttgtcaatccagagtcaaatccacatgctcctgtagttcttcatattagctgcaattacttgagttagattttaagaggaattaaagatgatggttctcaatctttgagtataggttgatatgcaatcatcctatgcctgatattttctaatctccagaggaagcactactacattaatgtcatttaccatgtaaagggaattaatagaactttatcgctaataatgtgctataaatacattatggtcaatattttacttcctaagcacaacaggtaaaaataaaccatcctagtaccaaattaatgaatgtaagtatctccaatggagtcatgataaaacatttttttcaaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacaggtgagtgacaaaagtgttttgggtcactttaaaaataatattttagtccaataattttaataaatgcaattacattttaaattaataattatataattttgtacaattatttgtttttgagtagtcccaacctaggtgccttagtgtctcattctttttagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcaggtaaagaatcaatgtgttctaaaagtgtggaagatttcgtatgatacagttcttaaaacaaaacaagtatttttatgtgtcttctaatacttttggctcaaaattgtttggcagtaaacgagtggctctcattttcttttatttttacatacacaaggcaaggtgtattttctccaaatagtaggttcaataagaaatgattacctttaagccaacatgtcaaaatcagagttcttaggaaactgtgtttgcatcgcatctattttctagtcaaaattcattagagaatctgtagatttgtatatgcaaatgagttactgcttgtttcattaaaatgttgtagccaggaattaactgagactctgttggtgcagtcagccatatattttcatctatttctcaactctgaactagttgtagcttcactgagcagtagtataaatttttttccatgcaaatgaggtaaatcctaagctcatttaacaggggcactaattgagcattaattggttcactgaacagcagaacgcaagaacctggatcagataccatgccttcttaagctcttttcaatggatcctctttgttccactcaaacttttacatccagggtgacatttaatctgctagctgtatatagcccacaaagttcacattcttattcgatcacataaacaaaggatcacttgtcatggctagcttaatttaacaaacacaaattaccttattaaagtgtgcacaattgtcagaagtcaataaatcaatccttaaactaaagataatgttatatgtttatcatagaattggggctagaaaaaggacatacttgacagtgatatcatccaattaaatcacgctagaagcttacagctgagaggaaatccctttgttttacagaagaggaaaatgaacaccaggatattagctggttgtttgtgacagagctaggttttgaatccaaacctcctgatttttacacccagcattctccataaaagaggatcttaatgtagatgagcaatagattagccaaagaaagtgtgtaaatatagaaattccccggccctcctatataccccctggatcagaatcttcaggtgttgtccatgactctggatatgagctttagtttcaggttgtttgtttacagttgatttatattttggtagctttggacagggttgacagaaactcttacattttcatagcaaagtttgtgtgccaccttctaaccattaatactctcttgtttcagtagcagaatgagactggtgatattcatacccactgagtcaaactctactaactgaaaacctactgagtctctcgtctctccctctctgtctctgacatcatcaaagactaacaacttgttctcaatatggttttaggcttaagtacaattaatttaaaattgaatagggaaaggaattttctatttctcagaacattggaaactttgtagaaagtaaatcaaaatataattcaaaatacttttccttacacagctaaactatgcaaagatcctgagatagtgtgcagttagtcactctaagctgtcaagcactataaattcagcaactctgtaaaatccactctgattcacatcgcttttgatcaaaggcattggaagtcttagaaaataaggtttaggttcacataacttctttctaaaaaattatgaagcttaaagctgacaaagttaagggtaaatttaaatacgaaaaggtatatctgaaaggtgcaattttgaaaaagaacaatcagattatcatatgactattttctggtcatgtttatagagctaaacatcagtatgaaatggaaataaataaaataagcaatctagatttatttaggtggtctatatggtggggaaaaatttgaaatgaggaattaaaacttacatattttaatccctgcctaccaatccccagacatatccaagtgcctcctcaaccaaccacctctcctattgttcagacatggtccagtatagacaatttcatgtaattccacatttaaaaagtataccctgctgatttagcgattatcacagatttaggatacttttgtcattacgtcaagaaaaataatgcttttaaacacttacgcatgtgtaaagtaaaacctcattctcgtgaggcactacaataccatatacacactcagcatttcctcagttttacagtttctatgatctattattcattgtgttagtccttacaaggatacagagttgaagggcatagttttttaaaactcatcaaaattactggtttctgaatcctctaccacagagccttagatcccaagaaataaatagaaagaacctctcccagtcgcattcttgacaggagaaaaacctgactttgcaagtgaaaagttagaagaaaatccctcttcttctctcccgagagatttgagattgtaacgaggagttttaaaacaagaatatttatttacatatttttcagtatttaattttaactggtaaaatatcctgatgactaataaaaggaaaaattagtttagtttgtttattgaaaaaaaataattaatatactgcctcagtaacttgtttacagctcaactgtataattaggcactaaatcagcagtgtcactgtcaccatctgaatggaacatcattttgccaattagtagatgatgcataatgatgtcaaatacccgatgttactcaatttttaattaattttggagccagggtgctcatgtatcaaacacaactgtgtcctctctcttagaaatttggatatgtgtaaacataatttacgttcattaaaaatgcaagactctctcacagtatgcctgtgtgagattttgaaaagtgaaattcaaaaacaaaattcttcctgatgaagacgtactttaataattgccatcccacatttctcttggttatttttagtccctgttgtggcaccagtaaacatccatggaggtggaggaagtcggtctgaactcgtcattacgtgggaggtaattttctgtccaactgagttattttgaagaaaagagatttaactggccagaaagaaactgaaaaacaaaaagatttatttgatcactattgagagcgtaaaaaaatatggtataaaaatacatcatcctgatgatgaattatttagaggaggtattaggaacttttctcatggtgagacagtatgacgaactcagcacaattttctcccaaatacacgaaaaacaacttcagtatctattgagcgtgtgtcagtagcattttcgttatcgcttgatgaattaggcattgtttgatttgttacctgtggcactgttgtattgtgaataagttgagcccagtagactgtaggcaaaaaatagttcttgtcctaaccctgctgttcacctctgatcaactcattcttccctgcatctagatgaaagcttaggcacatggagtagattttgtggtcattcttattacccattaacatacaggctcatttttttaccttattaaaaatttcagtctggtgtgtacacttcaaactggagtataaacgttagaatttagactttcaaccaatttaaagtttctcattttcagtatctcagtgcctcagcctaagaattctatagcgtgaaagggaatacgtggtcagttcaacttctctccattctgctctttaatttatctttccccattcacagtgttacctctggattctccagagctgtagaaggttggtgttggtaggggaggagaaaggaaaaggtctggattgctggtacatttctcgtttgactttggtgtgctctagttatggcaaattatcagacgctgccatttcatagggtagggtttctgcgttttttaatttattttttatctgggagatggccactggatgatcccccaccaaggactcccaactgcaattccttggtgcagacccaactggctgctgaagggtatcagttcctggattttggtggtccatttccagactcttccagtgaatattctctctcttgtaggtggtctttgtggatagagtccccttgaaggctgtccatggatgacccacttgcatgggtttcacatttgtcctcagcagacacataccctgctccatgtttagcggaagtgcaatgcatacccacttagcatctctcttcactctgccaccgtgggctgtctggatctcttccccactttaaatttctcagacatttgtcagttaaatgaacctgcgtcccttatgttccaggaaatgcaaaccaggtgtttcttgctgtagcctacttcacatagctaggctatgagagataactgggaaccagagacgttattctttatggttataaatgacagtgtcagaaactagatgcaattgccctgaaagtcaccctttcctctggatatcttgtttcatgtggacattataggcctagcacagtgcttggaaagtggtccaccctccatgaacacttgttgaatggaaggtagtgttttcagagagttggaactctcagaggccagacagagggggaaaccctattttttcaagcatttacaggatttcaggtgccacacagagcatttcatatcattcagtccccacaataatgctataaggtggttataccactttcaagtaagaaaactgagacttagaaaagtgacatcattgggcagagaagcatttgaacacagggttctctctttctgttcttttactgtatcctgtattacaatcccaattgtcttcatgcactgtgatggctgagggtgggcctgagtccttgagtatatctaccttaagtagtaagttaaccatattatacctactactccaaacatatttcccataaaacactgactttcaaatgagtctacaagagaattgtttgtgagtagtttatttaggtttctatattcatcaaaggccaaataagcattatcatcatagtgtacaggaagttttgcctgacttaataacttattttgttctcctccttggtaagaaattcctacaggctgttgttgcaattgcttgtacacagtctataatgagggcccaaatgctatgcattcattcttaaatagagatgagcatgaattaccaaagaatactgtctttccacgatttataatgttcttttttctttaaggcaaaggtacacaaaccatgacctatgagacaaatttgtctagtttcctgttttgataaataaatccacccatagctacatccattaatgtattgatgctttcttgctgttgcatgagaccatatatcccacaatgcttaaaatatttactatctggtagcaacaatagacgctagcgtctgctagagtgacgagaggaagggcgagggttgaaaaactagctatattaatgggtactgtgctcactacctgggtgacgggatccatcataccccaaacctcagcatcacacagtatatccatgcaacaaacttgcacatgtacccccgaatctaaaataaaagttgaattttttttttaagtttactctctggccctctacagaaaaagcatactaacccctatttttaaaaattaaactaaattaaagccacttcctctgtgtttattttttcttcctgaggaggaggtggggggtggatatctgatatgcagatacttgcagaaagtaaattagtgaaatcggtttcccatttatcactcatatttgacattatgtacaagcagatactgagccaacttcttctggtgcccagcttctttatggaataagttatgtatatttaggagaagattcatacattaggatgaatctgagccaccagaatgcaggtagtaattccttcaatttaatgaactctattaggtagcttctctgttcctatcagtggaatacaaaaatggatgagaaaaggtctgaatgctcagaagcgtagaggacagaatggtcttaacccagcctggaaggaggtcaggaaagacaccatcagaactgagtatatctgaactacgttttgaaaagtgacttggaagtagagaggccaccccaggtcaatgtcactcctgttgtagttgaaatagtacctgttggactttgaaaggcactgcgcgacacaagactgttctaagttcagtcacaatctgccattacgtttcataagtgacaactttaatgattatccttcatttaggctccctgtggtataatctgcctgaactgaactaaatatctttcccgtgttttccccagagccacacaataaatgtagattttttgtttatttgttttgatttggtttgtttccaaaaacctagacataatatcaaatttttagaatatagcaatgggtaattcctttttaagggcatgtttatacattattttatcataatgtgtatactcccaaatacttccaggtttgaggtgcttgtggtgaatgtctcataaatattactataaaattaggtacacaggataaagcactatagagtaagagatacatacctacactgagggttggcacgctttttatttaaagggccagacagtaaaaatattcagtctcgtgggccacatgacctcttttctaatgtctcagtctgcttttgtagctcaaaagagccacataccacttacaaacatataggtgtgggtgtgtctcaaaacctttattttcaaaaccaggctgcatgccagatgtggctagaagtacatagttttgctgattcttagtctgtactaaagatttggttcttacagacactgtggttgagaattacattattagtttatcaattttcatagattttactcccaggagaatttcacaatttctttattttactgaacactgtctccacttaaagaaaactctttttctggccttgttaaataactatatatattttttaatcatttgactctctgttgatgtaagaataaagggaagtatctaaataagtctcttttttcccctctaatctgcatatgttggactcaggtctttcttgagagagcaccatgagaaacactaattgtacttgactaacaaaaacaaaactcccctatttatgtagatgaactgactaagcatcgtgattaaatccgagatgaaagaaacttcagaaatgaatcaaatgctctagcaagtagcatcgattcttataaatctcttccatgccattcaaaattaactggtttacttctagtctccctatgaaaaagaagagaagtgttaatatgaggaaatactttgttgtttccccagatgtccggagcagcacttttcttcctcttttcactttctgtatttgttagactgttccacatggcaagaaatagagaccagctcaggtcatctcgggtaatgggggtttattttaaagctacatgggaagtaatgaggacaggaaaaaagtctcagcaagcaggcaggaaggtcagatgaagaaccggaacatggttcatcactgctctgggcactcgggcacaggagctctaggcaaccatcaacaacccctctgctgatccagccccggcttgaatagtctctcatgcttatgcctcagttcctcccatttcctttacttccagttttctacctggctgccagctaatttggatgccctctctctaatttacagcatctgttttctcttagcttctattgcctcactgttcctgctactccatgttctctactttttgcctgctctgtgtatatctatcattgttttgccacccaccatgtttcatatgcaaactctgtgagaggaattgaccaggtctgttagtcaccgtagagtacagagattctgccctcatagatactcaccaagacggtgcctgtggttctggcgctcgtgaattggtgctcgcatgggttccaagtggcaagtagatagtgtgattgatagaataaatggactcccatgaataaagagaacctctgaaatggagttgtggacatgagggactagaagcactgtgtcctgtcaggtgttgcctttattagtctgtcagaatatttattaaaaaaaaaaaagcaaagcattttccttgggaaaaaccaaataaattccattgatttttcaatacaagtttcttgccatcaggagatatgttggtctaaattcaagtacagattcattttaatttgctaagtttatgtgattgtttacaatttttagtatctgcagagtacagggggaatattaccaatttctattttgctattttagtaattttagatttgaaatgtattttatagaatctgatctttgtgagagttaacagtttattctttcatgtgaggaaaaatgcacacatgtcactaccaatgaagatgtatgcctaaaaaaatgatgggaggtcttttatacttttttaaagaaatattctgtgtcttaaagcatatgttatttcacagtaattccattacacatgtcttacaaaaacttgtttaaaatgttgtgaaaggaaaacatatctagtcttgaaataaatagttaagaagttaatttgtgctgagtttaaaaattcatatcaaaccacatttgagtgtgtatcataaaatcttttaaactgttttattattataatttatgaatgatcaaagaaaaatatataaatatgtaaagcttgttttatatttctatctgaaaacttaaactatttatctgagtatctttaactgggatcatttttctaattggcattccaaataaaagtgttttttaatacatcattaaacagaataaatatccatatttgtctctatggaagaaatgtgaaataatcaataaacattatagtagcttaataaaatatttttgcaaatactcagtgattgatcacattctgcccaagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatggtaagttgtcctcaactctggttttctttgagactctatgcatagtttgtgttcccttgttccattttcaatgaaccactctgctaaagatggttatgtctttctctggatggtagaacctcaactggccccaaggggaacttctctccagagtttttctgcttctgaaatggaggtttcatggaatgctattgcctggaatagaaacactggaagagtgctgggctatgaggtaatccacattaatttcacttttgcttatgaatgtgccaatggacttcgcaatagctcctattcaacagtcctatcctactagcctgttgttagcatatgataatgtgtgtctaaagctaaagcagagaatgaagttgagacagggtaggtgagcccccacattgagaggcttagcctgggatgtttcttgtcctcgctcaagacagaattcgagagtgagccagtggtaaaaaaacaaaaacaaaaacaaaaacaaaaaaaaacagctttattgaggcagcagtgttacagttttgaaattgcttctgcagagcagggctaccccataggcagtgtgctaagagcagcagcttggaagcagttctacactcatatttatacccacttctaattacatgcaaattaatgggtgagttagttattcagaaatttctagaaaaagggtggtaacctccaggccattgccatagaaagggatggtaacttccaggtgttgccatggcagtggtaaactgatacggaactggtggttgtgtcttatggagaggtgctttagcctcttccctgtttcagtcagtcttcaatctggtccacagtaaagtcctgcctcctccctcaaagtaagggaaatctttctaggtaattcaaagcaaacaaattaacacatagtagccatttttaaaggcatacagattcagtaagtaagatgagtaagctctaaagatctgctgtacaactgtgcacacagagtcaacaattatgcattgtacccttaaaatttttcaagaggacagatctcatattaagtgttcttaccacaacatcatttttcaaaagtgatcaggtgattatatgattaattattcaaattgcagtcatttttttttcccttggtaagaggtgaagtctgctcctcaatcatcttacaccatggaagaatttcattgagaaacctgctttgtgaattgcagtataacttggaaagatgtaatcatctcagaaaaggcagttaagtaatgaaaaaaaatacctagattgtcttgaatctgctatttttagtctatgaagaataaggcaaattacatttgtaggccttcatctcacaaagtaaagagacaagaacattttaagggaaagttgttcatcactcaatctttttcaacttgcaaattcagtgattcacaaaatgggtaacataatttatttaactttggatttagaataaatgtataatcctaaacattcttaattttgcctatatatatatatatatatatacacacacacacacgtatacatatacatactatatatacacacatatatatacatatatacacatatatatacatatatatacacatatatatatatatatatatatatacacacacacacacacatatatatatatatatataaccataatcctctgattccaacagaaagttctactctcaggacaggtgtcttttccactccatgccaagaatgccttacctcttatctgaaccctagttacttctcaaatttcatccctagtcgcctcttctctctgagctctactcccatcaattcctgatgtattttgtcaaattcttgtagcatattttttctataccacttctttgcaatgcattctgtgacttattttcacatacactgtggattctaacctcttagctagatgataaggggcttgaaaataggtacttaatttattctctttttttttcaatgtacctaaaacaatgctaatgcaaaggtagggttcagtataaattgaattattaattaacctgtgattcaaataactctgaaaagaaatgccaatagcaagacattataatgaaagtctttgactgattatatacaaatgtgtttttgtctgacttgttatacatcatttgctaaagctggtaacctttagatagctcataaaatactttattttggtaatctaaaaaatcacgttctctaatttccattgtgaatttgcattcatgacttttttcctcataaatattagagaataacaattttgttgttgtataaccattttaattagaaaacgtttttgtcatctatacttctgtcttcttcccatattccttgtggttgtggttgatagttgttggtaaaaaatgattgatagttattggggaacaataaattgcttgttttggtttttaattatcaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcgtaagtatgcatacactccaggaaacaagattcatctgtgaagagcaacctattcctttgcttgatgttcatttcattcccacacctcatttctttactaattggttactttggttagttggtttgtcccttaaatatggatacttgttgaaaccttttggtaacaatcaaggtaattgttttcatatttctggaattccaaaagaggaatattccaagtatatcgatgaaagacagaagagcataatgtttaagactggccctgacgccctccttctaaatgcattcaaaaactgacctcctatccttggaacgttaggtggtatttatctttgagtctcagttgcctacctataaaatgaggaaaaagtcatatttatgttttcataggttttgttcaagattgaaagagattattaataataagtgtccagtacacaccttaatatatgctcagtaaatggtttttttgttttgtcatttgagtccgagtatattcacatgtgatcctacaactgtcagacacctagatctttccttttaggataccttattactacagcttacttggaagtccctgaaatctaagaatgaactcttctgttttgtcttatatcccctgataatcagccaggtgatttcacagaatcagaatctgctacataaaagatgaatgtttttcatcttttggtgattgttgctgcctttattttctgactgagtctggtaatgcacaaatattccataatacgaggcacagcaataaattgggaaaggtctgatcatccgacttagttgttcctgtaagatgatttttttgtggttgaataatatttacatattccttatatattattaatgaacacaaattattcataaaatcagactttttaaaacacatttttttgctctctgaatcctgatgaatgaaagataacaaatatagttgctgaattttgagaaagactaagacaaattcagtgccacttacaaaaatctagtttacctatacatgccgtagtctaattacaccaccatatttggaaagaagagatggttaagaagagtttgaaaataaagttatattaaagttattccccttatgcgtatatatgcgtatatttgtcatgtccaaaagaagttagttaggaaccatctcagagaataggcccttgattaaatagattatccagttatttccacacaaccagatcaactgtcagatattcatgttccaattctgggtacatcattgactcacaacttgaaataggacaaggcattccatttttttgctttcatgttcttatctatttattaaatagaaattatctctgtcctcactccttcccaaattacccatgaagcacaaacaaggtactgattctggaagcatcttagaaaatacaaagtgctgtggaactgcaaaagcctgtggagcaaaaatttttgaaccaaatttcctccagtccacccagttttagacaggctgggctgtgagttattttcaagaatggattagttaacaatgaagttctattccttttcctgttttactcaatgttgactaaatcaatgaagttgttgccagataacttggatgtatgatttgcttctttggtcttcctggagtggtttagcttctttcagctaatctgcaaatccgaatgaaaatctccaatcaatcagcagttttcagattacctagacatttagttctagttgactgagagatgccaaactcacagaaactcttgtgtgtagggggaggagccaagatggccgaataggaacagctccggtctacagctcccagtgaagacgcgtgatttctgcatttccatctgaggtacccggttcatctcactagggggtgccagacagtgggcgcaggtcagtgggtgagcgcaccgtgcgcaagccgaagcagggcgaggcattgcctcacttgggaagcgcaaggggtcagggagttccctttccaagtcaaagaaaggggtgacggacgcacctggaaaattgggtcactcccacccgaatattgcgcttttcggaccagcttaaaaaacggcgcaccacgagattatatcctgcacccggctcggagggtcctacgcccacggaatctcgctgattgctagcacagcagtctgagatcaaactgcaaggcggcagcgaggctgggggaggggcgcccgccattggccaggcttgattaggtaaacaaagcagccaggaagctccaactgggtggagcccaccacagctcaaggaggcctgcctgcaactgtaggctccacctctcggggcagggcacagacaaacaaaaagacagcagtaacgtctgcagagttaaatgtccctgtctgacagctttgaagagagcactggttctcccagcatgcagctggagatctgagaactggcacactgcctcctcaagtgggtccctgacccctgacccccgagcagcctaactgggaggcaccccccagcaggggcacactgacacctcacacggcagggtatgccaacagacctgaagctgagggtcctgtctgttagaaggaaaactaacaaacagaaaggacatccacaccaaaaacccatctgtacatcaccatcatcaaagaccaaaagtagataaaaaccacaaagatggggaaaaaacagaacagaaaaactggaaactctaaaacgcagagcgcctctcctcctccaagggaacgcagttcctcaccagcaacggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatatagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcaagaagggaagtttagagaaaaaagaataaaaagaaacgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaacggcagccagagagaaaggtcgggttaccctcaaagggaagcccatcagactaacagcagatctctcggcagaatctctacaagccagaagagagtgggggccaatattcaacattcttaaagaaaacaatttcaacccagaatttcatatccagccaaactaagcttcataagtgaaggagaaataaaatactttacagacaagcaaatgctgagagattttgtcaccaccaggcctgccctaaaagtgctcctgaaggaagcactaaacatggaaaggaacaaccggtaccagccgctgcaaaatcatgccaaaatgtaaagaccatcaagactaggaagaaactgcatcaactaacgagcaaaatcaccagctaacatcataatatgacaggatcaaattcacacataacaatattaactttaaatgtaaatggactaaatgctctaattaaaagacacagactggcaaattggataaacagtcaagacccatcagtgtgctgtattcaggaaacccatctcacgtgcagagacacacataggctcaaaaggatggaggaagatctactgagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatctatgcacccaatacaggagcacccagattcataaagcaagtcctgagtgacctacaaagagacttagactcccacacattaataatgggagactttaacaacccactgtcaacattagacagatcaatgagacagaaagtcaacaaggatacccaggaattgaactcagctctgcaccaagtggacctaatagacatctacagaactctccaccacaaatcaacagaatatagatttttttcagcaccacaccacacctattccaaaattgaccacatacttggaagtaaagctctcctcagcaaatgtaaaaggacagagattataacaaactatctctcaggccacagtgcaatcaaactagaactcaagattaagaatctcactcaaaaccgctcaactacatggaaactgaacaacctgctcctgaatgactactggatacataacgaaatgaaggcagaaataaagatgttctttgaaaccaatgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctggcagaaagaaagaaataactaaaatcagagcacaactgaaggaaatagagacacaaaaaacccttaaaaaattaatgaatccaggagctggttttttgaaaggatcaacaaaattgatagaccgctagcaagactaataaagaaaaagagaagaatcaaatagacacaataaaaaatgataaaggggatatcaccaccaatcccacagaaatacaaactaccatcagagaatactacaaacacctctatgcaaagaaactagaaaatctagaagaaatggataaattcctcgacacatacactctcccaagactaaaccaggaagaagttgaatctctgaatagaccaataacaggagctgaaattgtggcaataatcaatagtttaccaaccaaaaagtccaggaccagatggattcacagccgaattctaccagaggtacaaggaggaactggtaccattccttctgaaactattccaatcaatagaaaaagagggaatcctccctaactcattttaggaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacataattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtccaattgtccctgtttgcagatgagatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactgcaaaccactgctcaatgagataaaagaggatacaaacaaatggaagaacattccatgctcatgggtaggaagaatcaatatcatgaaaatggccatactgcccaaggtaatttatagatttaatgccatccccaccaagccaccaatgactttcttcacagaattggaaaaaactactttaaagttcatatggaaccaaaaaagagcccgcatcgccaagtcaattctaagccaaaagaacaaagctggaggcatcacactacctgacttcaaactatactacaaggctacagtaaccaaaacagcatggtactggtaccaaaacagagatctagatcaatggaacagaacagagccctcagaaataacgccgcatatctacagctatctgatctttgacaaacctgagaaaaacaagcaatggggaaaggattccctatttaataaatggtgctgggaaaactggctacccatatgtagaaagctgaaactggatcccttccttacaccttatacaaaaatcaattcaagatggattaaagacttaaatgttagacctaaaaccataaaaaccctaaaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatcaagaatctacaatgaactcaaacaaatttacaagaaaaaaacaaacaaccccatcaacaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccacttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatatggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtgaggtggggggaggggggagggatagcattgggagatatacctaatgctagatgacgagttagtgggtgcagcgcaccagcatggcacatgtatacatatgtaactaacctgcacgttgtgcacatgtaccctaaaacttaaagaagtaaaaaaaaaaaaaaaaaaagaaactcttgtgtgtaattcagtttctatctcaagcaaaatcaagagtgattagaaatgtgtaagaaacaaacattaaaaaaaaaaacacattgtatcatggtagactgacagacattttagtgcagttattgagccaagactcaggtcaacttttattatacataatcccatcaaccagtttaaggtggattgaaacttgaacactgaactaatcatttacctcaggaagagagagatatatccatatgacatatataatacctatacatgttttaaaattcttattgagattttctgtatgatatatacatatatatattcacatctcactactaattttatataaatatataaaagtgagtagccccacactcccttgacctcaagggcagtctttgaagcaccttcttccctgctattcttaagcactgggtggatctgattgcccagatagggcactgcctttccccaaggtcacacagcaatgaagggggacagatggaggagagggggcctagatgtgcaggcagccccacacggtctcattggagtactgagaggcccaggcctcagctacataggagaactgctccttgctgctgggccagtaggtgccctccgtctgcctcatctccggaagcttccgcaccaatagtgccagccccactgccaggaacaagacagccaggaatcagaggaccaagatgatagcagtgacggccccccgaaacagggctccactggagctggagctggtgggtgtaggccaaacaatgctactctcatttgcagaaggggttgatatttgcgcccagggtcgttcccagggacgacagcagcggcaggcccagcgccaggagtagccccaggccgagctgggtgacgggttgacagtgccgaggaaggggcttctggcgcgcgcccctcctacagcatacagggcgggccatgggcacctgcaacggggcacctgacccaggtgtctttgaagtcgctctgtatatattctatatatatatatcagaacatctcagtaataattttttctgtcatctgaatttgctagtttcattgtccatgaaacctaaattaaaagtgttagtttgtgctaaattattctatgtttttaagcagaaacaaatccttgtttttgacactaaattttttcagttgacccaattgatcctacaaatgggttggacagaaattcacatcaaatgctaaagattattggtttgtctgatggttaacgtatgatcaatttgtcaaagagtaggagataaaaattttcgaaaacagttaaattaaccatgagtaatttcacccaagacacaacgttagaatacctctgctaaggaaaaagtgaaataataatcagaaattctaaactgaagattagcgttcctttaagtattcagctttcttaactaaatcaaacaagaaaaacctctgtaattcctagatatctagtttcaatagctcttaaatttgactcttaccagcctgtatgcttcagtgaccctataaaaatagccaacaagcacctgagaataagaagaatatacaagtctccatccctttgcatttaaatacctatccaacctctcattttattactttgacattctacatcacagacattgtgaaagcagaagagtaacttttctattattctattaatggccttaaactcagtgttttaaaacaatataagttgcttatcacacatttttggaggtcaggagttagacaggggtttcactgggtagaaatccagatgtgctcaagggctgcactagctttggaagctccaaaggataatttgtttcctgttttctggcttttggagaccacccatatccctggcttgtgaccctccttaggtttgtgaccccttcctccatgttcaatgccagcaacagtagggtaccttcacatctctgcctctgaccctctgcttctgtcatcacaactcctctaactctcactttcttgcttccctctttcccttgtacggaccctcctgatgacattggagccacctgaatcatccaagattatttcctcatctccagactcttaatcacatttgcaaactccttttccatataaagtaatgtgtccacaggtactggagattaggatgtgatcatgttttgggggatccttattttgcttaccacagtttcaaattattgagcacttctatgtccccagccctgtattaactttatcatactaaatctcacttaattattacaataagtcaaggagtttggtattttaatttctagataggaggacacaaatgcttagaaaggttttgtcatggcctctgttagactgatgagcatgaaatctcttcatcccactaccactgtgctcctttatcaccttcctccctaaccatcccaataatttctctccctgactgtcaaatcctccatctaaacctcaaactgctttgaaatttttcctcctaaaatgccgtcatacttctcttctcttcatcaaatgtcattgtctcctctattccagagaatgtagactaagaaaaaggcaagcaagatctttcacaatgtgtctcaaagctcctttctataacattcctcttctagccctgacatctcaaacttactgatcttctaaagtttaacattcacttacctggcttcatgaaatctctcagcttgtagtacccctgccaggcctatatatggtcaaatggtcttttttctgctctatagcttcccccaaaatttcccctttaatgtatttgcgtttttctaagaattccaataactttggcccattgtgaaacagtgttggaaaaagttggaatgggacttcagagagaattgtggatatggatccctgctcagccatgtactatctgtgtgccagatctaattatttgataactctgaatgcattttctcatctgaaaaatagagatgaagatacttacctctagcgatttctctgagaaccaaaggatataatgtacaccaaggtgacccagaggctgtcatacatcaaggctcagtgcctggtaacatgtgttattatactcctcctttagaggcaatttactttctttgcattttttaaagtaagaaaccacagctactttctttcactttataagtttgttgcagaattttcttttctttaagggtcgtagaaggacatccaaagcatgcatgaaaaacagctttactgaaacattgatgataaccatgattccaggtgctattcctgtatgtaactttgactctccatgtccttgagatgacatcaagattacctctcaatagtggtgactgaaaaaattctgcattcagcactgtcactgtctagatttgtaatctgatatttgatcttccattggaaagtctgaaaaagcagagctcacatttaccaaaatctctgcctgttctaattggctaagctaaagagaagacagaggtattttctttgtttgtttgttttctcacatgatcatccagtcatctactcaagagatagtgcctcccatgagccatgcctagagttagatgctgagggcctaagagcaattaaaccaagcaagatctttgccaaccggcaatttctcttttagagaagaggcaacctaaaacaagaaaaaaagacaaatgaataaaataatcataaattatgaaaagaacagtgaagaaaataaatgagaaactaagatgtacataaggagcatctatatgggataggctatgtattttgatacaaaattaaagataaagaggagttaaaggacaaaagaacttccagacagaaggaacagcatatgccaaacttcttaagtattattgttgctgttgatgatgatgatactagtattattaaacaaatatcagtgattcatctgcaagtaccaaagcctagtggaaatgatggatttccaaaagaaacagaggtactgcaaatatactgtgatccacacagacattacttaaatggaatttagatttacaaggaaagaaagaaaaatatttatgtcaattccaagcagaaaagaaaagtgaaacaaacaaaacactacttatgtggaaagaagtattcagacgcaataactaaaagtgtttgcaaatgttggctcaatttggcccttgacgttgactgactagcactttgtactcgattctttcttgctgcaaatatgcaatcaatccatatttaaacataaaggaagcattaagcttttattttatcttgcacttatgttctttctcttctgcccaaatgtcaaccccatgctgttacttagaggtgtaacataagaagttgtttttgaattgagttcacagtgtgaactacagttgaaaagaaatgccatctacagaaaaattgattacagggaaaccattagaattctgaggggctagtttaatgttgctctgtcatttgattaatagaaaatgatttagtctttggaaattgcctggaaagattttaaaagttagaaaagtgcttgtttgctgagtttaccattgacagacttggtacaaatatcatgacatgtgttttgtgctatccatgtggcagtgttttggtttctcaagatgatagaaattttaattttatcatagatatttgcaatccagtttaatcaactatatcaaaccagaactgttaacagtactcacattaaggtgatggccttctaaagcagctttcagaagttttatttgtcaatatcagacataaaggattgacactggagaaacatccattgataaaaataagaaaggatgtagactaagagatattctaagataattagctgagactctcccattttatctccctttctaaaaacatatcaagcatccaagtaagagcaatattattaaggggaaaacttgaatgtacactaattgtatctaagaagtgaatcatttgcaaacttcagagttggattattagcaacaaaccacttcgaacacaactgaaaaattgattatgtcataacaccacagtggagaactgctactcttggaagagaattaacagttacagggctttttaatatataccactaaccaaatgaggaatatttcatattttatttcatatctcataaattaggagttattcgtttcattttataatgggaaaatccggctcttggaagagattggatacaaattcaagtctctctgacatcaaagcccaactcttctcatctcccagagagcaagagaagtaaaacattctaaataatctgtataattggctattcataccaaggtactcactccgaatgcaactcttctcgttttatgcccacagaaagttgtgcttctgctttggtagatgaggacacaaatgcaaacatgtcaatgacaaagtcattgccaacattgcaaactgctcctttacatagctggaagaaatcaattctgtctcctagccagttgattttttcaatggatttatagtgttgaaaacaatactttttcctaaaacaaacaaaacatccggaaatacataaaacattcagaatccacactgccaatgacactgaagtggtgaatttgtattttctctgtattgattatataatggtaatgttagtgctgaattttaaagaacagagataaaaagaaaggtatcaagagtagactagatattaaaattgcaatatcctgtgagaattttgatattatatcttttatagctgagaaaaagattttaaaaggcactggaggataagttgaggaaggatagttacaaaataattcttgctgccattcagacctttagaaataaatatgttgataagcattataaatgacaagtacgttgtacattgacaagcaaagtaatggatgcttagtaagctaaaagctttcaggcctttaattatgggtttatattgtcaagaaatgtaccaggacatggtcaatccaattggcctgtccatcttataaataggtatggattgctatgagtctgaccacggcaattggtcttgatcataggacaacataatgaatggattggctgtattgtgtcacctatggatctgcccagagcccagtgcataatcaatacagcctgagaagatcaccacagggccctgaacagttttccttagccaccttattgtacagtcatttattcaacgtgtatgaattggatgtctcctatgtgccaggcactgtgctaggggttagtaatacagagttgagtaaggcacttgccctcaagaaatttaaacaaacacataaccaagaataaatgtaaaccaatgtgataaacctataataaaatatgaactaagcctcatgtaagcatacagggaaacatttctctatcacatcccaactggactgtaagtgattgagtgaacaatagtgatatcccagtggaagtggggtggaaagagaatgtatggtaatatatttgagacacctggattcagcaatatgtgaatcttccagtgacacacaggagattaaacagcagttgactcaaaactatgaaagaaatagtttccacttctaccagtgttataatgaattaaatattatgctcactcagcctcacaaattcaaaagagatgccaaaaacatcttgttgggcagttttatctttacttccactttccagatgaattattttatatctctccagtttcaatctcaaaaatagtcatgtggactcagataagcagcaagttgttctgcagaaacactagactgaaagcgctagaccaagattcgtcagctgcatgcttttggataagtgacttcccaacctggattctcgttttcttgtatgtaaaattctctagttggactatatccattactttagaagccagattctaaatctttcatctcttatctcccaccatctctcacgcagacaacattaatttcagaaaactaaaagtcgcagtttggatttaaagttgatgtcctttgggatgatcaatcagtttgtgatgattttccccttttctggcttcccaaaagctccatttattttaaacggcatgcatctttcacattgtccagacacagttgattaagctaagatagacatacgaccaaatgaagtcaatcatcagctttctcaggggaactcaaacttggactatctctgaacagaggaggttttaagtttcaggtgtggtgaacagtcatgatttctgccgtgtgcagtgagaatgacaaagaggtactctctggcaagatgagtatacagcagaccctgcttcaataagcagagtgaagactgtggctttgtgacatttttttctctcctcagactctgctgcaatctgccatgacttataagaaatatccttgataatttactacaaatattttgcttaaaatatcttgagttagttgtgttacagttagaaagctaactaatacaatgttaaaaagtaaagaattttaggaatgaacatctatgtgttgatatatataaaatgtttgcaacttgaatttgccaaacatgctcattgattgatggccaaatggaatcctagataaagagaccctctgtctgtttatatatgataaagtaaacaaactcaacagcaatgattaataaattaatactggacatgcagcaagccattattaattcataagtctgtcacaaaggcattcccaaatgaccagatttgaataaatttgcttactgtgattagaattaatatatttcaaatgacactgaagacattttagctccttctatgcaaatcatcgaagacttattttttcttttcatgttgatgcatcatactttgaccatgagctaattaacattcatttggatctttgattatctctttaaagctccaagccaaccaccagcaaacattgcctggaagctgacaaactctaaattatgcttgaactgggagcatgtaaaaaccatggaaaatgagtctgaagttttggggtacaaggtgagtttttagtttttcctttaatcatatcaattaagttactaaggaatgaaacatgtgacacccaaatggaaaacaaattggatgcatatggaaacactggaatctttttcaaaattattttgaaaataccattgctgctttctaattttccattgaaaatgttttacattccaaggtccagtaatgtattagggaacatcaataaatcaaattccataggatgtaacattttttcttcaagtggcatcccttgctatcataagatgatggcttatgtgcatagtagatgtgatgacaatgagatcaaaaaatatatctaaatagagattttagaacttaggctgcagtatgatgtgatcttttaacaacataaaaggcatctaacaagagtacaatcaagtacccagagcaactcatttccatcagtgacaatggacatcatctcttggcagacatatattcaacatttgaaatgggtccaaactcaacagtgactttccacagcaagctccaatgataatagcctcaagctatttaactaatagggataaatctactctccttccagaggcattggccaaaaaaaaaaacacctctttttcttaacaggagcaatggaatataaggaaaagacatcacttggatatttccatctgaggagtacaacatttatgatgatgtatcttatgtcttacagtgttccagaacagttgtgtgaaccttagaaaagcaacatgtccatgttaacttgatacctcattttattcagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtaagttgagtcaccattgctgtagtagattctgaacctagacagctgcagcatgaaattcagctccatgaaaccttccagttatggcttaaatgttgggtgataagataaattttcaattgtgagcaaaaggtgatgagccatttttttaagttattctccaaaattataacatacactataaatggttttatgcttcctcatttgaaaaccaaaaagagaacaggaaaaaaaatctttgtgtcattagagcataattgtatcactcattctattatcacaaaaatcagaaagatttttcatagattctttcgggtcttttacaacaggaatggcaaatatgaagcacaggtaaatatacaccctttcccatgttcatggcagacatcactaatcaagtgtggctttcataaggagctgagtcacaactttcaagtcctcctcaaaacaattttctaagccaaccaacaccagtcagtcagagttagcaggcaataataatgtatcatttttgcattagaaaaatcacttactcatctgcctgaagctgtgattgagtgcaagtcattagcatccaatgttggccaatcctttaggcagactttgccaatttagggattttccttttgcatttttatacttaaatcagatgtccttggacaaagacacggtaaggcactttctaaaattaaatataatgtgaatgagacaagtataataaaatatgttactagaagagaaatgatagtatgaaattggggttttgaaaaattaatctaacaggcaatactttatctcaaaatatttttgtcttatttttatattttgcaggtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaacacttttgaattttaaaatccgcacatgattacatgaattcctaggtgccacattaacctggggagttgtaactgctgtgtcttttaagttacttatatggagaaaataaataactcccctcaatgatgctgatgatgaatacaaacttggctcctagttaccataactcacatgtacatttttatgtattccagacaatcacttcagtatttaaaatttccaccctacttcaaaataaaatacaattatttgtttatagttgggattctttaaaaatacaaactattccaaagcatggggtgcttttatctctgaatcaagttggaataagaaatctttttactcaagaatatttcaatatacatgatgttcttctcagcccacttttcagaagattcagtcacaataaaggcagaaaaagtattttatggcaaagaaaaataaatgatgggaaatgagcacccacctaaaataatcttctaacaactctggtatatattaagcaattgctcatggcaaagttgaacatttgaactgctgcatgaacaaatctcaggtaattatgacaagttgattgcaatgtatgtggccttatttttataataaaacaatgtggaaacagaattatttgatcaagttttctacactttggtcaaaatattattttttgccaatcttctctgcagctatgaaaacaattctacatgaaccagggtttagaaagattgtgtgggttgacttttctctagggtgagcctgtttcagtcagtgacctcacttcttaggattgtgtagtctggagaaagcagtctgggagaaggtgagattagtgacctggcccatagaatgctatgtaaccaccccccttcctccacaaacagccttgagaggtcagttcctgctgtcagccttctctggctcccagccagtcaggtttgttgtcctttagagctaaatgtgagaaatgctcacgtgacttttatcttcttaacatggtgcaacctcttaattatgttgagaatatttgagctattctcacaaccctcaaatcatacaatcctcaatatgggattttgtcatttgcatgtctgaggtattttagaactctttaaaataccccatgtagtcagcagcagatgaacaatggctttcatagttcagaacttgctccttgcctgaacagtgtgtcaagcacacaatgcaaattaatgagccttattctccccattgccatatgatctgactgtgcttttgtagagcaaaacaaataagcaacaacaaatactatttggcacacccgtgttaacagctgcctggccaagatacatctgaattgaccagagataccagtgctggcacatggtcttaatggtttccttaatttggtaagagacaagatttgtgtcctcctccccaaagaagacattgagggttaaaaatactgtgaggtttttgtttctactaattaagtgaatcagatatacagtcatttgtgtgtgagttcaaaagctaagttagtttttatcaataattcttatatgtttgcagagtactatttagttcatgatttctggaatattaaatgtctgtattcactgtctaacatatctaacatattatttatcttttcatcagttcactaaatttttcagaatatactttggcattaataataagcagcatgggctttggtgcgataggaatctctcctcttagtgaaaacttggacatatttcttttaacatctccatttcactaatatcagaacaatagagtgttatgtacataaggtatttggcatggtgcaaggaacattgtaagttgtcaataaatggagctgctgttatctgctgctatgaattaaatcccaaatgacataagttattacgtttacatatccaatatattatgaaaatagtttcaacctgtgtttatgtcaaaatccaaaccagcttcaagaaaaatgaattgatcacctactctccatactacatggcactcaaggatgaaaacagtggtgattctaataacctgtttcagggaaatgttctacatgatgtgtatactcctctgacattcaagaaggatttccagtgcatccctgtattgactgagtagactgctgttataaacatgatatgtcatttccatacttcctacaaaaaagggagataatgtgattgtacctggaaatggctggagaaggaaccagaaataaggtttaggagactcaacacagtggaaataccactttaaagctatggactgcctagatcgtgtagagttcaaacacagcttcatttttttctcttttgttcacactctaatcctccatgctcagtgtctcttttctatctatacagcagggggtgaggagggcatggctgctgtctttaaaaacaaatgcagatggtgagggatgacctggaacctatatggattctaaatgtaataacataattattacttctcataagtaaatctagtatttttatacttctatgtatgtcagtcttgagatgcaacatggagtacacactcctgtattagtccattttcatactgctatgaagaaatacctgagattgggtaatttataaagaaaaagaggtttaatggactcacagcaccacatgactgggaaggcctcataatcatggtgaaaggtgaaggaggagcaaagacacatcatacatggcagcaggcaagagagtgtgtatagggaaactaccctttataataccatcagatctcatgagacttattcactatcatgagaacagaaaaaaaaaaaaccacccccatgattcaattacctcccaccaggtccctcccatgacatgtggggattaggattatgagagctacaagtcaaaatgagattttggtgggaacacagccaaaccacatcaactccctgtgtacaattattacttaatgtgctatagaactacatattgaattcaggagatattttgttctagacaatcacatctttgttgaggtcaatacttgcattaggattctccagagaaacagagccaatagggtgtgtgtgtgtgtgtgtgtgtgtgtgtgtgtttgtggagagagaaagaaatatattacaaggaactgactcatgtgattatggagactgagaagtccaaatgcaagagagcctttgatacagttccagactgagctgaaggctaagaaccaggagggccaatagtgtaaattccagtcggagtccaaatccaaaggcaggatgaaacttacttataatctagctcaaagacaatcaggcaaagaagaataattgtttcttactcaggcttcttgtctattcaggccttcaccagattggatgatgcccacctgcaatgaggagtacaatctgccctactccatctaccaattaaatgtattaatctcatccgcaaaatccatcacagacacagctagaatgtgtaatcaaatatctgggcaccaaatggcccagtggagctgacacataaaattaactatcacagtattctttgggctgatattaaataattcaattctgctttcatcagcttttggaatgaaattatttaaatgctcctctcaatttattcatttgtaaaatcatatgttgggatgacaagatctcagagttcttttaaaactctataattttgtactaatgtgcataatgtgtgacttctttgggtataagacagtatttcagaaaccttcacaacccacacatactctacagtcctttccctttttttcccctgtgtttttaccagtcgttccgtgccttttaaactggagtttacattactaaaattgagcatgctttttcaaactacaaaagaccctcagagtttctaacccgtctctgcactccattgagaatcactggtgtattgcagtggttcccaagggcaggactataatgaagttttcactgttcagtgaaaaaaataagaaaaacatgtagagtttggtgagctattcataatgaataatttgtgaaatatggctttcctgcactgtgaaatgctcattctttggggaaacaaagttgagaatggatcacagtttgttttacctgctctgttttaaaataatttacttgggaaaagagtagattactttatatcaagttcaattatttttattattaaaaatgtttatcttctaaggaaaatgaaaagttgaaaaccactggtgttgtcatctttttaatatttctttaatctcataaccattaaattagcaatttgactttgtgtgttgaactgtagtttatatgccaaaacaccaaggttctgagttctatagaattattgtttacttatataaatatttatatttacttataaatttacttatatgaatattaatttacttatataattatattaatttacttattaatttacttatataaattacttatatacatttacttatataaatctaggaaatatggcctaccacttataacaaaacatgaatataattagattgcaagaaaaatagaatgtcaaaatcctgacttttttaatatcttaaaatatggaaattatttgctttccacttttctatgttaaaaattatttcatgaaattaaatatagttagctgttaggctttctttaatgtatttacaaatgattttagcaaaataattttattttagcaaaataatttttattgaaagatacatttatttcttcagtttttttcaaatattattgttcttaacagtgcttggtgtggtcctgggcagagaatgatgcttaaaacatgtatttgctttctggactgatttatacagccaactgttggcaatttgttttcccttggtttccttaataaaataagggccaggcaaggtggcttatgcttgtaaactcccagtagtttgggaggccaaggctggtggatcacctgaggtcaagagtttgggaccagcctgaccaacatggtgaaactccatctctactaaaaatacaaattattagccaggcgtggtgcacatgcctgtaatcccaactactctggaggctgaggcaggagaatcgcttgaacccgggaggaggaggttgcagtgagctgagatcgtgcctaaactccggattttggtgggtaaataatatatctctgaaataaataaaataaataaaaataaaatccttcgaatattgtcatttgaaaaaacatcagaaatgctggtatgttgctattttaaaacacatactttaaaatctagttagatgtgccttagaagatccttattttgtttggagtaaagctctggaggaaagctcacgcgatgactctttaaataaagatagcaagttgcagctcaatgagagtgaaaagaaatcttgatgtaaagtgttttgttccctacacccattaaagagaaggagtaagctaggctaaaatgtttgtgggtatatcatgttattcctggaactgaatgctctgttggatagaatcctattcttaagcagtgattaattaatgtttataaatcacttcaaagatggaaagcattgtataaagtctaatcatttctattatagtgatttttttccaagaagtatattgactttttgcaatagcagtttgaaaaagcatgcatttgtgactgaggccaggtatcatgcctggaggaaaatagtaattggaaagtttgaaaggtaataattctgagatactgaaaatttaggtgaatttataatagcagactattataaattagtccagtctgcatggactaaataattttaattcaaacgtgaagtaatctacatctattcatgacagttttcagcctgtgaaataaatgtcatagcaacagactgtgttcctgaaatgatatatacctgtaacaaacctcaggtaatctcaggggctttcatagtaacaataatgagtttagggaacttttattacctgtaactgcagtagttataaaaccccccaaaactaaaactaacttggaacagattcattttagcctatttttgttgacagaaagcgtaattagatatattactggccttttttccttatctgtgtaaaagtgaaaatgttgtaatttaggcatcaaaattactgttgtatttagacttgcaaacatactgagatattttcatcttctaaattcttaaaagaatagagtctatatatatatatatatatatatatatatatatatatatatatatatttttttttttttttttttttttttttttttgagacagagtcttcctctgtcacccaggctggagttcagtggcatggtctcggctcactgcaacctgtgcctcccaggatcaaggaattctcctgcctcagcctccccagtagctgagattacaggcacgcaccaccacgcccagctaatttttgtatttttttagtagagatggggtttcactatgctagctaggctggtctcaaacttctgacctcaggtaatctactcatctcagccttccaagtgctgggattacagatgtgagccaccgcccctggccgagtctacaattttctaaaagagattcctaagtccgaggacatggctcaggttattttgagtaatgtttggactcacataatatttcaaactagatgacagttgaaaaaagactgtaactagttaaggaaaatctgaaaacccacaacttgttggtgtcaataggtagacagtactcgagaggctgaggctggaagatgactggatctcaggagttcaaggctgcagtgagctatgatcacgccactgcacgccagcctgggcaacagagcaagactatgtctcaaagaaaaaattgacagaatggaaattaatattcatttaatatctgttgataacaactaagataccagatttttctacctgaaattgatattcttcatcagaaaacttcatgccttgtattatatcatgttacattaggttgccttacaccatattttattatttaattatcatatgtctcattttgttttagaaaatgaataatgagttccagaggcgatggaccttatctttgcatttccccttgcatccatcacacccagaagagtacctgacatccagtagttgctcaacacatatgttttcaatgaatatacaaacaaaagaaagtgttgagtgtgcattacttaataaaatctcattgccactcctggaaaagtggcaaagctaacctaaagaattttgtcttttgtaaagctttcatattaaaatattatattgtttttgccttattatttttaataatttatcatgggggatttaacacacttttaaacatttttatcatcttgttattattgctcttttttggggtgtctttacttgggggcttttattaattttattttattttattttattttactttaagttctgggatacatgtgctgaacgtgcaggtttgttacataggtatacatgtgccatggtggtttgctgcacccatcaacccatcatctaggtttcaagccccgcatgcattaggtatttgtcctaaggctctccctccccttgtcccccacccccaacaggccctggtgtgtgatgttcccctccctgtgtccatgtgttctcattgttcagctcccacttatgagtgagaacatgcggtatttggttttctgtccctgtgttactttgctaaggctgattgtaaaacagtataattgaatatgacatacagttgatgcagcactctctgcatataaaatattttaattttttaaagctttctaagattaaaataaattttaagggtaatgcttttttaacagaaaataccatgtaattttatgagagtttcttttccttcccctcaaagatttttaaaagacaattctcaaaatttgtataaacatggctattagaattgcataaccaagccagagagcaacatccatggtgtcacagaagccatgaggatcattccaaggtctaagttgcaattattttccctgcagccgaattaactaaagtctatacccttgatcatacacataacaaaatgtaataatcttgtcatgctacaatattaaatccatatattcagccaggaagatatttttagttggcagatataacacaaacttatgacttcccctttttaggtgctacttctttaggtcatactgtaagattcactcagttttatttccaaaagctcaaaataactgatggatttgctgaaaatttcagagaaaaaatagttctttggcattaaggaagtggcaaactttcagtacaaggtcaaacaggttagatgtcatcagtgcctctttacttaaagatgaaaacagctgtcaatgtttagatgtcagatttcatgtaaatctcactgtccttgaaccactctcagtctgccttccttcatggcactaagctggtgaactagtgagtaagtcttctcttcgagagggagcattcttctctttaccatgctcctttcccagctttcataatccatttatgaacctatctggcccttttagacatttgagttttgacccttgttatatatgatgcaatgtacctagaagacaatattttatggagtcattgttttttacaccatattaccttatgctcatttatatgaacacctcatttcagctgtcatgaactatgagcatttaatgtaagaaagttgaacatttacataacaagaaaaataaaattataatgataaggaattcatcttgtaaaaatatgtatttctttttacattggggtcagaaacatggcaactactcatggaatagatacattcacatttataattgatcaaatctgtcaagaaaacattacttgtttaccatgttctatgcattgcacttgactctacgaaaaaaaaaaaaaaaaaaagcagtgaagaagagaaacatgccaccgaggtgaggagcaggtaataattaagccaactcttctcacttcaaaacaacaatcacctgttatgataagtgctgaggaaaaacaaggaagatgctctgatagaggataaaacatggggccagatgggtaccccaaactggattggcagatggctattcttagagaaatatcatttacagagagacttgaatgatgcaaaaggtaggcatgttaaaaacggagaaaaaagtattccagacagaaaaagaaaaaaagtctgcaaatgccttgaggagaggaagagcttggtatgttctagttactcaaggaagtctggtgtggatggaagatggagctgaaaggagactgaggcatgagttcacagagccaactggaacctggtgatcctgaaagttccaggtcttcagaagtaacttggatttaggttttaaacattacttatgttttaagaagatcactctggttactgtgtggtaagtggattgccatgtgtcaaggagagaaacgaagattctaatagtagtccttgtaatagatcagtggtgggtagactagtttggtggcaggtaatagacctgtagacttgtcaagaattgcccattgatgagatataaggagagtgagggatccctctgaatattttaaagctacctttattttatcacatggagaataccagggaatgatcattcctaggaatacagaagatagggtggtagtcaagattcagtttgggacataagttagagatctctatgagagatctgggtggagttgttaaagagacagatctggcaattagggtcaaggagatctgggtttccccagaagttctagctcttttattaatgagcaacactgacccttgacttggaaggtgacatttgaggtgacctacttcactttatgagtctcaaatttttcttccatataatgcactgctttgttagaggaacacttacattattattagtactcaagcagtataaatgttggacattactattttatgacaagaactctcaaactgcaagatactgagtcagtcattgaaagagttaaattcagattaccatgctggctttattaggcttaagagtgtttttgcctttaagatgttcagaaaaaagttaactataatatacacaatggaatactactcagccataaaaaagaaggaacccttgtaatctgtgacaacatggatgaacctgtaggacgtcttgttaaataagccaggcaccaaaagacaaatatttcatgatctcactaatatgtggaatcttaaaaagttgatctcatagaagcatagagctgaatggtggttatcagaggctggggtgattgtaggggaatgcacgtgaagagttgggaagatgatggtccaaggatacaagctttccattaaataggatgaataagttcaagagatctgttgtaccacaaggtaactacaattagcagcatattgtattcttaaaaatgctaagtgggtataaagtgttctctccacaaaaatgatagttacgtgatgtaatgaatacgctaattaactagatttagttgttccacaatgtatatatcatttaaaacatcatgttgtgcatgataaatgaatctaattttatatgtcaacttacaaattttttaaagatcataaaaaggaattaactggaaaactccattccaaaattaaattggtcattaagattgaatactgataattaattcagaacaaaaagattgttcaggtgtgaccaaattctaaaatgagaaattaacaagttttgttttttatccttgacttgattctaaaaacagagttctcaaactgtaaactcataagcttaaagtaaacttacgatttgctggtccttggcatttttcttttgcacctttagaattttgcttatgctcctttttctgcatggaatgttctctttcctttttctgcctggaatattctctttcccttttctgtgtgaaatattctctttcctttgcctggggagcagcatcttcagctaccagctccagtgccagccactgcactgctgagacttttgctgcagcccactctcctcagaccactctcgcattttactcagtccctggagctccctgtgtccgtctcagtcatagcatttggcatttggtttctcaaccgttggtttcctttcctgcttctctcacttgatggtgaattaattggggattgtaaattcttcagcactgattattatgctgggaacgtagtaggttcctgagatgtatataaggtgattattatgctgggaacgtagtaggttcttgagatgtatataaggtgattattatgctgggaacgtagtaggttcttgagatgtatataaggtgattattatgctgggaacatagtaggttcttgagatgtatataaggaagacaaataggcagagaggaaaaaaaagaaattcaatttttgtttgtttttcagcaagtctgactgtattttgccaatcacatattttagaataaaatgaatcaaaatacaaaaacatagaattgtaatactaaatactctagtttgcctgaaatttttttctaatatttataaaaagcacaccttgaaatatcttgaaataagaagaaaaaaacatattatcaacacaaatcttttattagaacatttcaggcaaactgatgaacaaacattttaagatattacgataagtggctccatatgaattattttctgggatttgtagtacataagacaactctgttggctttgtgacagttaaagaagcaagtttttttctgtaaactgatatttccaggcaaacaaaattccagcactactgcctcctttgtccagaagacaggttaatacccaaaggcaaatgatttaggcattttcatcaccaagatcaatgtttaatttcttcacctaaatagattcctctttacccttttgacctacctacagagtcttgtcattcagcacccctagaatcacagagttgggagggttcttgatgggggggtaattctagctcttcccaagctgcagtctccagacaggatgaaatatgtgtccttcaaggtacagacattcaccagtttatgaataaattgtattgtcttaagaaatctgtcatttagttgttgggacacacgttcactttgttaatagaaatactgctgaaaacagttttttctgcagcctgtaaaagcctatttatcttataatggattgacagtgtagcacttcatggtactcaagaacccaatcttaaaatgaaaccgcgattcaccaacaaagcattttcagagttctggctttgcttatgggaaaaacatcttcttccaacataccagcaacttgacagtagcaacaaggactccacgagcaacaaggactccatgacagcatatatggcgtctctcatggtgtaggacaggaaccccagtaagacaagagtggagaagcagaaacataagatccaggttgtaggaattaaagaactgtaaggaaagaaccttccatcgtgaaactcactttatcaggtgatcagctttcatccacacgccatgttcccactcttctcaggaactttccagtcttatcttcttctgttactttctcttttaataaccttttaaaacccatctagtatcactttactattagctttttgtgttctagcccaagaaaattttattctctcctactgataagctgggcctccatctcaccacagggcctttgcacatgctagtaccttttcctgcaatttctttttgccctcaacaatgtattcttgctcctttcatctggttaattgctattcattctgattaggtaaaactctatatttctccactgcaccaacattattcttccctaacacttatcacagctatagtttatttatttctgttattctccaattaattcctataatttccaaacaatctacaagatccatgaggataggaatcctattgtattgggttgatcattgattgtatccccagtacttaacatagtgctggcacctgggaatctctcagtaaatgggatttatttagaaacaagtgagtcacaattacaataaatatctaattaaataaacataaaattttacattataaaataaaaagttaataacttaatgacaattacttgtatcttctcttaaagactcctgtccataggactcaatttaaagctttaattatgctactttttcctcaaaaccaatagacagtttttctcatgttttctcatcattcttacagcactgaaaataataggaaatcagaaaaatttccattaaattctactttgaatgcctccttcaccttacctccaatctatacttttttcattaacccagttgtattagtctgttctcacactgttaataaagacataactgagactaggtaatttatacagggaagagatttaattgactcaccgttcagtatgattggggaggcctcaggaaatttacagtcatggtggaaagggtagcaaacatgtccttcttcatatggtggcaggaaggagaagtgctgggcaaagaaggggaaagacccttataaaaccatcagatcttgtgagaactcactcacaatcacgagaacacatgagggtaaccaccttcatgattcaattacctcccaccaggtccctcccatgacaagtggggattacgggaaatacaagttaagatgagatttgggtggggacacagcgaacccatatcaccagtggaatgaaggtggcaatatctggcatgcataactctgcctcctggtgatccttagaatccttcttcacacaatcatgcaggcaactactactaattaattttactggcaccatgaaatgaaattgatttacaattccttaaagaggtaaaataaaaagtctcctttctgtttacagcaatataaacttttggggaattgtgatgagaacttactttctaattattggcatttctccagctccacccatacattaagaacagctttaaattgttccatagttttgttgtaaaaaggtaatcttggaatatccaggtggacccaatgtagtcacaagggtcttaaacgtgagagacagaagatgagtcagaatgagatgatgtgagaaagtccacaggggccactgctggccttgaagatggaggaaggggacacagcccaaggaatgtgtacagcctctagcagctggaaaaggctagaaaatgcattttcttctaaagcctccacaagagatgcaaccctgccaaaacctatattttggccccctgagatcccttttatgtttttgtaagctgttaagtttgtgacacagcagtaataggaagcaaatacagtgagtttaagaaacttgccaagttcacacagtgaatggatggttagaaataaaaccgggcagtgtgttttacttagctatcattttatttaactgtcaatgtaaaaacaaatacgtgcatgcacacacacacacagatgtatatataaacatagcataaatatacatatatatgtatatgcatacataaatgtaatatgtgcatatatccatgtatacacatatatatgcatgtgtcatttccaatgttgtactgcctcactaattttggtaatttgaaaataatacatttctatggtaatacaagagcagagatatactcggtatcaaagtggtactaaatactgtttatacagcctgtttcatgagatgctgaagatgtactgtaaacagtaatacttacacgaaattaaagtctaccagtgttatccttgggctgccaattgattgtggttcatggatttcatttactttgtgtgagtgcatcaatgttcttttaaagcgcagggagagtttacaactataatttttactaatgattgctgataggtttttcatgatttagatatcaggaatcttgaaatcaaaactaatagcaatagacaagaagtgataaacagatacttagaaaggtataaggaaacaagagaagggcgcttcattacaagaatgagcttggggagcaggtgtgaccagagagtgtagaagctgtgctaaaagccaggctttgatgtaacttggaggaagtatttagaacagttagagaatagccacttcctagagccagaaagaagacagatcaacttgtaattccattattttccaggtggatgatactgaaatgtatagttaacctctctgagcttgattcttatctctttaaaaagcacattaatatctaccgcaggaggctgttgtgatgattaagtgagccaatgcatgtaaatcacctaggattggtagatgttcagcaaatattatttcctttcttcctccctgctgtctccattgattctttgctaccatgctttaaggtcatacatcctgaaatttgctgccatcaaaggatataatatagttgtttgcccactttttaaataaagtaggttaaatgaatttattttcttttattataccacctctttgggcctttcttattgaactatgcattatgattctttgaggaacataacattatataatagaaatcacttctcaattttatttttcaacaatttttttcacaggaaattacatgagagaattgacatgagactagttcaacaaaacttatcacaagaagctcaaacttaaagtaaaatcttggaatcaagcatcagaatacatgagtctatagttctatcttcactgttttgtggttgagttgagttcaaaacaaatatgtaatgttttaagaactttgttctacctccgttgtctcttctatgaagagttttgaggatgaaactgcaagcagtatgcaaaagtactatccagagttaaaagctccatgcaagcatgagattattattacgttcttttatcatttgacccactatttgttccacaatgtgaaaggaatatagctgattgctcccaaagaccttggtaggtcaaagtaaagaaaagtgcatattatcaggccagaggccacaaggtgtgagactggatgaaatgaacacaatacaatgatctctgtgagaaaataatttatttcaaaataaatgccctaactctagagagctggtagagtttgggacatgaggtacacaggctcttttaacattttcattgaattttcaagcattgttatgtagaccataataatgcacaaaattcttcagaagaatacctggtctcataacaccctccatcttgttgagaagctacatataggtctcttcttttctctgagattcagtattggaaatgtttagagagatggtgggaggattataaattaacagatttttatagttaaaaacatttccaaaaatgtggtctgtggaatatttaaacctagagaactcttccccccaaaaaaattattccacgatcaatgacatttaggatgcatggctctatcccccctctaggagcttcacaaggcacttgaccaatctaaaaactcctggaagtcctgaagtaatgaaaaagattaccttgttctaatgcaatatgtccacaattatttaatcatgttaaacattatttgcaagaaacttacaaaaatttcaccagataatattccaccaaacctgtgggggaagtgccccatgagataatatcccaggtccccaagtcctctaccattcctggagtgtatatggttccccaggagggtgcaggaaggacttggtgcctctacttctacagccttgagaccttcttttataatagtattggtccgcccccatggagtcagtttgtggctggaagtacagtttgcacgattagtgtgcggaacacagtgtgggctgaacaggctggagggaaaaggctgcttcttggggaccaatttttagaagaaagtgcctcctctgtctcagcccttaccaattcttcttgccagctgtggtgtctgtgtttgcccactccagggggattacacattcattttatgtggcacaagaggctgagaagaaaaattgctggcatatgagacacctgtgacatttggggtaaacacaattacataaagccctggtttatgggcttgtgtcatcactatgggaggatcaccttctccctcctccaatggatgggagacctggctataagcagcagaaggggactttataggctgttagacaggcttgacatgggctctgggggtcttccagtcaggatttgcctacccacgcaaagtgcaaaagagaaataaagcatttaaccagaaaattaagacccaaccaagtcacaagaagttgattgtagcaaaagcaatgtacattggttttttctaataactgttgacacataaatctttaattgctaataatgtattgcttatgcactctgctataccatatatatatatacatatatacatacataatctcatttatgcctcacaataatgctccaaggaaggcatttcttatactggttttacaaatgagaagctgaagctgagagtgaagatacggtttgcccaagttattacatacaggaagatagcagaccagaaattcagatcaggtcgagtcaactacaaaacccatgttctggaaccactaaggtatggactcttcctgttctgcatatcttccttgtgttcctccagatcgattctccacccttctctgcccctctttttgtcctaggaggatgatctgcatggattatttttataagttccattttctctggcttcttgttaaatgtgaccaatagaggtcactggcagggttggagggggttcctttaactgactctattctaccatcattgcttttctcaatgcagctaattctatgtaattttctcgctcatagttctggtaaccactttcttctcttttccctttgaaccaagggttgtgtgttagattgctcacagagatagctgcaattattattttcattgttgtataaatattcttttgtaatgagactttgtttcttctccaatataggagtggagtctatttccccatcccattaattagtggtgttcttatcccttgctttaaccaagagaatgtgacaaaagtgacattttccatacgtaagttccagaaccatggcctcaggaggccttacaatttctgccttttcctttttgaaactttaagatcatcgtataaggaatcccagttacactcgagtatgaatgaccacaagatgggactgccccagctaacagtaaaaacaaaacttcagtgatgtgaatgaggctacctgggacctttcaacccattcaatctgccagatcactgcacttacatgtacaatctcaggccaggctagcaggagggctgcccagatgatcctagcctaaataactaaatcacagaattgtgagcaaataaatgttttaaaacactaagattgggaggtgaggttgttatgcaatagatgactgatacagttgttcaactgtcttatgcttccataagttcattttgttcataaatccccctcaaattatctgatttcatgtctaccacctggaccctggctgatacctccaccatgacagtctgataattaatcgaagacttatttgaaaaaggattaccataggatccatctccccatgctcctgaatccatagacgtgtttctctaggaaatcttaattaatagttatatataatagttacttggtgtctggtgtgttgcttacattatcactgcaaaactggaattaagtattattatcatcctattttacttacaaaaaagcagaaatttggagataaaatacttaattaggtgcagtgctagtaagtaccaggctctgagttcaaacctagatcttcactttactccaacacttatgttctttccacttcgtcaaactgcctcagaaattgaaattttagttctaacagctaaccaaccatagacctcgagcacaaactctgtcaacttaggaatctctggatgtccattccataaaaggtgttttgaagctgtaatttcttctctcagggaataaaggtcagattagtaaaagcatattttgacaccatcaaatgaatgtaacttatttggccttcaaatgtagagatgtcaaatcattggtgtagtttcctaataggtcattgcctaatgtttgtgcagtttcatagtaaatctactctagaaatccatcttgtagacccccaggagtaaaagtagatgttcacaaatagagggggaagtagcctgtgattctttttcactatactttctatatttaacatttacgtttcctgtaagaggctccagagataaagaatttatgttaacataggtctctgagggaatatatcatccgaagtgactctagcagattcctgagtatgacaggagcaatactaacttaaggatttgtgctgaagtaacaggcagcacagagcagatgaaaatatattcttgtgacagagcacggaccacattgttaaaggccagttatagaggctatgatgataatagaaacttttttttcttcctttggagagatagcatagatatggcacagtacatcttaggtttggacgctagttatgatgtcttctcattgtgtggcatgaggcaagtaacttgtaacctacaaatcttgttttctttcactatgaaaagaaagaataacaatgacatcaacttcatatgctattgtgaagattaaatgagacaatgagtgtaaaaacttacttgaatacctagtatataaaataaattaaattgttctttatcattggtgtgcctaacacaacaggggctttacacttattgccccatttggtacttccccattcctctatggtgaatatattgtccatttctgtaactgaggcaagttacctacccaaggccttgctgccagtataggtcaaaattagaacttgctttgtcctctgactaaataaaaatcgatctttttcctccacatattgtttccctgcatcagtctgcctctccctggatggtgcatgcatgtgtgtatgtgtgtttatgtgtgcgtgtttaagtttgtgtgtgtgtctgtgtctgtgtgtgtgtgtgtgtgcccaatccctttcatagaaaaagcacagccatcataccacgcacttggctgggggtggggggtgggaagggggcttgtccaacagaggggatgcatttgtcaaaatccatcctctcctatgtgcagtgaccccccacacattaaaataagagagccactgcaggaagctggttccattcatagcttcagaacagagggaagataattgggctatgtagggagtgagcctatggccttggcctcattagcaacatagtttaatcatcagagccaagccaccacaggtggctgtgccccatgcaagtgttgtgcatttcatttcctgaaaacgtcagtgtctgagaatataaatattacttataatcctgggatgattgtgcaggtactaatggaatggtttcatggtattgattttcaatagctcatttgctataatcagcttaacttcatctgctagaaaacgaacttctaattccagtctgaaacatagtacaagcaaatgattttagcctagtctgccaccaccttgaatcccttatggaagtaggctgggtataaatcttaaataaataaatcaactttagcttttcccagattttcatgatcttgcaagattgattttcttccctttaatctgtttttaataaaagagatattttcctttgagacatggtccataatcttttccatgtgtattatcattctcatagacatcctcttttcaatttcaagagaagcaaggcctcttagaggaaggtagcttttgtgactagccaaatctgcacaaagttggaggaattctaggaagacggatgggcctttggtgtaggttggaaagaacaatgtttaaaaataccctgtctcctccctgagaggtatgataccatgattctctctctttatctaaaggtattagtctaaggaattaaaagccatttttctatgagaagaaaaatgaacaagatatgggaaggtgaactagcagagcaacatatagaaataataataaaaggccttattcagaatgtaaaatacactatactaaaaggtttaccttgattatagcactcaatcattccaagactctgagattgtagctattatcatatccatatcttatagaagtttatagagttacatgaacttcctcaatgtcttgcagctagtgtgaaggagtcaggactcacaccatagcacccatattccagaacccacagctaaccactggattctatgcctatgaggatacataatacttactgtttcaaataactttataatagttttcagttaaaatcttgtctctaggcttttgggcaaagaactttaaaaactctgagcctccattcctccagcttaaaaatggagacagtaggtaactcttaccactgagacaacgtatgtaaaacacatacacacgcatgcacatatatatacccccaaaatactggtgttctgattcccattttacagatgtagaaacagggactcaaagttgtcaatgtgttcaacgttttataaaagcagatgaaagagtcaagactcaaacctaaatctatctgactgcaaaaggtgtggcattacctgggcagcccattgaggaagtgctcggagctcattgagtgggtgaggatcttggcaacctggccagggaggcaatgggagaatgactggatgcctacatgtgactgtgataacctgtgtatggaatcatttgagagaagtatcaattgtcccaaaatgtctaccggagcagtgagggtgaggtaaataattgaaatgtttgttcctgaagatgggtacagtattaagagtttctaatgatttcttataagctcctgtaactttaggattttttgtttgatgatgtacttgaggggaatgtgacatcatctgtgtgacgtgatcaatgcagtagatgaaatgagtatttaaatacctgacttaacctgaagcaggataattgttaaaccagaggtgagaacacagattgagaaggtgaccatctcaaccttggaaatttgaacaagtattcccagaggaagaaacatttgactcaggacttaaaacgtgtaagagttttacaaagaaggtattaaataagagaaagggaaaaaagaaaaatgatgtagtacattctggtcagtcaacaaaacatacttatctaaaagctatgaagatccttataaattaaaggcacagaaagaaatgctttatattggtaaaactctatattttggagggaataacactttaattttcaaagtgctttcatttatattaactcatctgattcatacaaccctgtatatagaaggaaataatgtttggtaagggaattgggaaattatttaaatgagttgatcatcaaacaaataagttccaaagctgaactaggacccaaaacctttacatcttgatctactgctccaactagatgcagtataaacagggtgtttacatgtttaatactaggagcaagggcagtgccatacttttggaaatagtaagaaagaaataatgcgcttgtagatctttaatgctaagaaaaagaatctcctatggcatgagattgaggacttttagaagcaaagaggtgaaaagtgagaagtctttatttcagaagcatcatataacgaatgttcatagtcaagagataaataaattattcattattctctctgagagaaaatcaaaggactgattttgaaatattagacatttgtagcagtagacatttgtatctagtgtccactatgataatctttctaatttattttcaacactacactcagaaatatagattcctgattatcagcaagtagcaaaatttcttcaggtcctggctgtttcttgtgttgtattgttggtttccagatttctaagtcaatctgaaggttttttctaagtaacacgacttgcatcgtaagtacttttttagtaaaaagttgtagtaaagagttactggtcttgcattagatataaccactttatattagttttggttatcccaagcaaactgcttgacttctgcctctctctctctgtctctctctcttttatttttttctttttgagacagtctcactctgttacccaggctggagagcagtggtgttatctcagttcacggtagcctaaacctcacagcctcaagcaatcctccctcctcagtctcccgagtaactgggattacagaagcacaccaccgtgctaggctaattttcaaaaaaatcttttgtaaagacggagtttcactatgttgcccaggctggtctcaaactcctgggctcaagcaattctcctgcctcagcttcccaaagcactgggattacaggcatgagccattgcacccaggctgttttctctattttatagctaaccccaatactaataacagctaaaattaattgagcacttactttgtagcatgtattgttttaaacattaattcaaacattacctaatataatcatcatggtactttgatactttgtgatattttttacctctgtgaataccaagaaagaagcaattgtttaaaagcaggaaaatccctgaaattgaggaggcatatgttccaaccccaggtcagctacttaccagctatatgacctctggaaaaacatatacagcaagtcctcacttaacattgttgacatattcttggaaactgaaactttaagtgaaatgacctataatgaaaccagttttatcataggttaattgatataaaaaaggtaagttcttatggcatatttctgatcacaaacatatcaccaaacatcaaaatgaatacccaaaacacttctaacattaaacattgaaataaatgtgagctacacatatatttaagaaagattaaaggccaggcatgatggcctatgcctgtaatcccagcactttgggaggccaaggcaggaggatcacttgaggccaggagttcgaaatcagcctggacaacctaatagtccacttctctgcaaaaataaaaataaaaaacaaattacccaggcatggtggtgtgcacctatagtcccagctactcaggaatccaaggcagaagaattgcttaagcccaggaggtcaagacagcagtgagctatgatcatgccactgcactctagcctgggcaacagagcaagactctgtctcagttaataattaattaatcagtaaggtcattatttacccacttattcataacagttcatggtctcgggtggtcatagcctatcacagcagctcagggaaccagatgggaaccaaccctgaacaggaccctggacagcatgccatcccattggagggtacactcacacacacccgcactcactcagactgggaccatttggacacagcaatgaactgaacatatgcattttggggttgtagggggagacatgagggtcctgataaaacccacatagacatgaggagagcatgcaaattccataaacacagtggccctggcgggaatcaattttttcatcatcaacgttataaggaaataacattgaaagaaacaaagttatttgaggacctgcttatcataaatagaataaaatcaatttcctgaactggaaaatgcagataatagtctctgataagtagcttaggcaggtaaaaatacctaaaataataaagcagaacatacagctgtgtgtctggtatgtttcggaggcccaatgttttccgttgggtttatttaccagtactttagtccacttgaatacttagtttacataatcctgaaaatacaattgagaattttattctctgcttaattaccagggttgatgttgtggatctaatgaaataatgcatatgaaatgacttgaatattgcaaagtaccatacacatgtaactgttgttatgattttccttgcaacttaggtggaagctatttcctatttcaaaactttatgatcggggaaaagtaatcccaaaggacctagaaataagtcgtatgcagtcaaaacatgagaaaatggttgtaattttactcagacactatcaagatgcaacaacctgcatatgtgagcaatgtttcttagaaaggctcagaacactttaccattttctgttgtgttcaccacctagaaaaaaaaaaacggttacagaagagatttctgcaatttaaggaagaatttctaagattgtcaaggtgataaaaccccagcaaggattattgaattaagttcttgagactccttcccaggagaacttcaagatgagaacaggcatctatctgtcctacatggctcagacatttaactgctggagggcaagttaaaggcttcctgccggactagatgagtcgtcaaggtcccttctagctcattcatttcttattcaccaattatattccaactgacaaccttccagttttttaaagggactcaccatatttcttaaattacaactcattgctaaactttaaaatcattgccattgattacactttatataggatacacagaaaatagatgtaatgatctgtagctagatttgacctacagcttgcgggttaatgtgtagggagagtgggaaaggtgactctatctgatgattcactacatgtagaaattccatgatataaaacctgaagtgacagaaaccattgccatcccatgataataattttcttggggtttactttgtggttcaatgtccaggtcagacatgatgacattttagcagggatttttttgtgtttggaatattttctttgttgttttttttttcttactttcataactaatttcccttgaaagggtatgacttggatctgacttgttctgaattttacgctacaataaaacatgttagggagaaacttctgtgtctctgacagcctgtcctctaaaacacatctcaacatgtgaactgatgaaccaaaatgccacaaccttgagaagaaattaactcagagttattcatcttcgaaatccatgttttaggtggtttccatggtgactccctggctagcagcatctttgtctaccagatgtcttattgttcaacagctcatctgtcttcagagtttaaggtttgaaaactgaagtccaagcagaacactttctctaaatatcacagagaagggggaaaaagacaataaaatcattagaatgtttaacggacataagatgggaatggcgagcagagacattgttctgccatggtccaaatcagtgcatgacaaatgatttaggttttcattgggttctgagggcataaatatgttataataatgaaagaaggcttaattatacttaaaacagaactcctactcacttggcaaattttatctccctattggctccacgatatattagttcacatggtaagccacttacttctatcaagtcctgattgttgcaagacaatctgcaagttgatatatgaaagtaacttcaattcagaggctttttttttttcttgaagaaatgagagtaagtggctgctaaaaagattgtacttatatattggcttccacgtctaaagttctgaaaacatcctggaacaaagtcactcactctgttatgttttaattcggtaccaattatgactggccatgcttcaacattgtattccaaaatgagaaaacaagcaacagtaatgataaccaaaaaggttggaagcagtgtagggccaggtgtgaagctgaagaaaaaggctgaaaaccaaagctctgatcctagggttcctgttcagtgaagtgcctggtttgtgtgaaggcaagctggaaagagccatgctaggctgggctcacttgtccacattcctcatggaacagccaaggaaactaagatctagtgagataagtaaattattcaaggtgacaaaaattggttgtgtgactgaaatcagacttaggatcagtgatttcccagttcacgtaggtggaaataggtgatagaggttaagtgattcgtacaatattacccagatctctagaatgtagttttcaaaaccatgcccataaactgtagttctgttttgctttttaatgatcaccagcattgactagtaaacctctctcccaacctactccaccccaaattgtcttttccttgttcttggagccgactttgagactcaacccctttcatgctgagctaaatatcaaatatgtgaaagatgataacatccactaactatgtttaaaagacaagtttcaatttcattgactttctagccaatgctacctgttaagtcaattgcacaagagggatttgccaatcgtctaccatgtatgtgtagggagggcatggtgcagagcaaaaccatgtacaaaacagtcatcgccccctcagaaagttgacactgtagctgatagaaaaatgaactgtcccataacaagatggaatggtatgctgtccccatattacaacctcatgtgaaaagataacacagtttgctaagagtttttcatggacgatcaaactaagaagagataaatttcagctagagtaagaaagataagacggtgggaaacaatgaacgacattagatcctggaagaggaactgcatttggaggaagaaaggagagtgaggaatatttttatctataaacttgagattcttacctcatagggttatgatgagaattaattcggaaaattatataaaccatttagcaccttgcttatcatgttaaaaaatcatgtaaaaataaatgtcatttttattatttaatgatccatacagagttggggtggaaagaatattatagaaagaatctaaagttcttggttcttaatccagtagcaaacagagtaaaataggaatatcatctaatattgcaggatttattttatcattgatgaaatgaaagatttagctaaaatgatctctgggatccattttcactcataaattctatgattctgggacaccaaataaatgttttattcgtctatatttgcccacaatatgcattttttagacccacagggaattttttctgaatcgtggactcagaaccagttaagtgcatgactgacacaacacatgaactttgaacaattacattcaaacatcaggacagtctttgttaacatcgccaactctcttccttattaccagtaagtttttttttttattcgctgtgtaagggcgattaattcacatttcttataaagttgtacaatacaaattgcataagaaaataaatgactcttttctattacttggtggaaaaagttgatttatagtccctgagagaaagaactaaggaagagagttaaaattccacttactatatgagatttttaaagatctagcactcatgcatgttgtgaaaatactaagtatctcaaataatgtgtgagattctccttagaggtaaggttttatattgtcaagacattttttcttttattttttctattgagttactgtctttatgctttacttgtacctcatactataaattaaaagattagtgttcggtgtcattgcattaatgaagattattatttacaacaatagctagaaagtgattggaggtttaagtccagtaacttgagcaattaaaacccttgtagattcctatgaggtttaaaaaatacatgttgttaagggaaacctatgtactcaagaaagatagttattgctagtgtaccttcttcaggaaaccaaaaatgtctctcatcaaaaacggcttctggaaaagactggagttttattaacatcttagtatagatttaaagaaatgaatctcttctcctaacaactagatttcaatcctcttttcagattctctaatcataaaagctaaacatcataaaataattgaagactaagtgataattataatgaacacccaccattttacccacctactctttctctttttctcatgcatttctcttctctctgtaaaagtaaaagcactttattttatttattttattttatttttttaaattttaattttattttattttaattttattttatttattttattttggagacaagagtctcgctgtcgcccaggctggagggcggtggcgccatctcggctcactgcaagctccgccccccgggttcccgccattctcctgcctcagcctcccgagtagctgggactacaggcgccgccaccacgcccggctgattttttgtatttttagtagagacggggtttcaccgtgttagccaggatggtctcgatctcctgacctcgtgatccacccgcctcggcctcccaaagtgctgggattacaggcgtgagccaccgcgcccggcctggcacttacttttctctggggaactgcccctctatgtttcagtgtatcccttttggaaatgtcaactgcagtgacttgcctcttcatcctaacttctggccaatcagtgtgggctattgacctagacatgaatgatgacacttgttttccctgaaagttgggtcttgagcaaagtgacacacaattaaaaatctggatggagagttattttgggttttgagactgccaaagacttcctgcaatgaagatctgcactctgaacttctgagctgctttggttcccatctttcctgtggctgggtccctccctctctctgtttttcctgtgagcacagatgactacattggtgaattcaatcaaacatttaaagaagacataataccagttgtaactgtattcggacaacagagtttatgtgaacatttcccacctcatttgataaggtcattatatcagatattaaaggggagagaaatacatatactttctgctatatataaaaataaatctttttttatatatagtgttgataaacagatataaatatatgtactataatatagatataaaagaaaaaactacataccaatatcactcatgaacatagatacaaatttttttaattataagcacgtagtatctacagacatatatatcataaatatatctatggaatatatggaataatgcactataaccaaacaaaaaatgcaagattgaatattttaaattcagtcaatgtaatcaccccattaacaaaaaaaagagagaaaaaccatattatttgaatagatgctaaaaaaacatttgataaaattcaacacatatttatatttgtgaggctaaggaatgtccttggatgctaatccaccatgttgatttctgattaacctctgttctgggaatgcttttcagctttctactttatgtactattaccgtaaatcctatgcttctgtcaaagcaaccttgaccataagaccacaagtccttccctcaggcagattcacataactttcttgccttttcttggggagttgacttcagttgccctgcacgtttcttgtctatgatatataagccctggatcttggtggtaagcacatggatccatgaactggtctctcggctgccctagactattgcttctgcttgtaaatctgtattcaaggtttctgagaaactgggaatgtcgggctctttctttgtccccaaagcttccttggccttttgggggaaggtttgcatatgcttgctcaccatagaacaatactaagtaaaaatgttcagcaaacaaaaaaatagaacatctttaagatatagtgcatctaccaatatcttaaagccaacatcatacttgattccgagaattcaaatgcttttctaaaaggatcgggaacaacacaaaggcgttttctcaaacaatttctattcaacgctgtactggagatcttgctgaatacaatataaaagaaaataaataaaaggcataaataatggatagatcacagcactgtgtaccttaataaatgtaaaggaattcacaaagacaataacagacctaataagtgaatttgacatgggtacagaacacaaggtcaatgtaatacatacatacacacatgaacaatcaacaaatggttgggaaataaaattgtttaaacaccatttacagtgaaatctaaaaagaaacaaaaattataggaataaatctaatgaaatgtgcagaaggcatttttagtgaaagacatttatactgaaagctacaaaacagtactgatagaagaacaaaacaaatacagaattgacctggccatgagttagaaggtgcaatattaagataccaattctcctcaaattgatttacagaatcaataagacccaataaaaattccaaaagactttttaaaaatagaaatgaacaagttcattgtaacaagcatatgaaaagaacaagaagacctagaatatctaaggcaatcttgaagaagtactgcaaactcaaaggacttactataactgatgttacaactcattttggatctataaaaattagacattatgctgttcatgaaagggtacacaaataaatgaaggcacataatcaacagtactgaaacagacacctatataaggtaacttgaattttgatgtaagaatcaatgcatttctatgtctaaatgaaaagttctttcaacagttgatgccacagcaacttcttttgaggggaaagaacttgaattttactttacatcagacataaaaaattaattttaggttaatcatagtcccaaacatgaaagctaagtctataaagcttttagaaacaaacatggaagaatgcctttataattatagtataggcatatattatttaaatatttctttaaacaatagccagccaagagaatttgacaaactacacttcaaaaaaatgaaatatttgctcatcaaaagttatagttagtaatgcgaaagggtaaatctcaaactaggagaaaatgtttgcaatatgtatcttacaaaggactattatccaggatacgaatgaattacaagaagacaataactcaagttaaaaagttaaaaacacttgtgaatacatacttcacaggagatgatgaaaacccaataaacacttcatattattcgtttcaatgctaatacattttaaaaccaaaatgtgacatcaatttacatccactagaatagttaatagtaaaaagtctaacaattgcaagtgttgaggaagatatgagaaactgcatgtcttgggtaagaaaagtgaaatgtaaaatgatacaatcatgttacaaaactgtttgacagtttctaacatagttaaatacccaacaccttatgattcaacaattctacttctattaatggttaggtacccaagaaaattggaagcatacattcataaaagatttacattgtaggccgggcatggtggctcacgcttgtaatcccagtactttgggaggccaaggtgggtggatcacttgaggctaggggttcaagaccagcctgggcaacatggtagagacaacagctgtctctactaaaaaatgcaaaaatgagccaggtgtggtggtacgcgtctgtagtcccagatgcttgggaagctgaggcaggagaatcacctgaatccaggaggcagagattgcattgagctgagatcgcaccagtggactccagcctgagcaacagactgagacaccatctcaaaaataaattatataacattgtcgatgagagtcttattcataatagctcaacacttgaaatatcccaaatttccatcaatataatagataaattgtatattcattaaatggaatactcaggaataaaaagaatacatttctcaaccacacaacatgaatcactttttaaaatactattttaaacaaaagtagccagacacaaaccggtacatacactaagattccatatatatatataacttcaaaaacaggcaaaattaatctacagtaaaagaattaaagctacaggttacctctgtaggtggttaagattggccaataaggaacatgagaaaacattgtgggacgatgagaatttctatatcttaattttaacgatggtaacaggtgcatatataaatacacacacacatatataactgaagtgtatacttagtatctgtatgttttactatagatcaactaaccacattaaacaaaaaaagacagagagacacaaaagtatctttatttctagatttcattttcatcaatacagtaaaccatagaaagacactttcttgataaatatctttattaaagaagtgtagcaaaacaaagggtaggaagttgaagttaggaggatttaataatcaactggtatttctaggtatggcttttaaagggctgacttttctggatatgacaagctggcaaatgttctcagagtaggctttcaaaaaaataatgttttccattttcgtagaaatcaagatttagtcctttgagtaactaagataatatagtagacttgaaatgattaatttatagaagtcactaccagttgtcattataattatgattttttattattaaaataattattctttgaaaagaataatttgcatatgccacacagaaaaataatgtattttagtaaatggaggacttaaatatttagtcaatgcaacattaggtctactcaccagataatcaagatatagcagtatgattctgacaaaaatatctttctctcaatatctggaatattaataaatagcagtaagatccagtttgatttttttcactctctcaatatcctcgtaactcaagcaaagcaaattgtagataatttgtttttgaaatccagatttattcactgagtgtaaagatggcaatttctgttttttgttaaaatgaaatatattttcccttcaacttgtcatataatttacccactgtcctcactgcttagaatgaaaagagctagtattttacaatttgagaaattgttgtactcagaatatacacacacatacacacatgcaaatatacatatccagattgctttgtgctagcaccaaaatcatcatgaaaataccattttgaaacttgaaaccccaaaatccttttggacttatgttttagttactagtctgtttacacagtcatatgatgacttttctcttttttacaagtctgaaaaagtttctttgcaatctaagggtccaatattaccttatgtatcattatagtatgtatgcctaaatatttttgcattaaataagtagagctctcttaaagttaatatatctttatgaatattataagcagagtagaaatccatacaagtatagtataattggtttcctgtatatgcgttgggcctttttacccagtgactccaggagaaagatctgagaaaatacagaatgtagcaggacttctacgaaagttgagttaccaaagtcaaagtcagatcaaaaggaaataaaggacagaacacttcagggagtagaaaatattccctgttgggtaaaatgtaaagattccatatggtgctggaaatgtgccatgtcctcggcaccccttgtaaatgttttgttagttcactggtgagtctgcctgtttctctctgacttgatttcacagctttggtcactgctgtccacagtcaggcaaacacaaaaggaatcatttagctgttcttcggcactggaaattttcttcatactgaaaaaggcagcagggaataccatttgtctttcgctttattctgagctatggtaactaaggctctgggtcccctggttcccattgatctgtgcaatacagaatagcaaaattggctactgacagccagctggggcaatcagcaccaagacattcagagggctatatttttcttccattttaactaggtccagtagctacctgcgttgcaacagcaccagggtataaggaaggactccttttgaacaccattgcaatcacgatattgagcatagcctctatcccagagaaggcattcaatgcaactttgtgaatgattgaatacaatagcccactatattactttatagccattactctttataattattactctaagcccagagttgggagctgcagagttgagaatattgttaattcctgacttaaaatgaaatgtgtttggtattgtccccattgccctcaaataaggccaagcccccttagattgacacacaagattgcaaccctgatttttttctaacctcacaatcaacatccaaagcccacatgtgatgagtaattcaggggtcatagtctctcttaggtctgagtcttgtgcatcttttcactcacctgcgacagccccacccccttccatgtggaatgcctactcagctttcagatctcagactcaacacctctggctctgggaagacatgaggctttgggaagtccgggctggctttcccttctaagtgctcccacaaagccctgagagccccttattcttcacgcagtgcatggcgattgcatgtctcaaccaccaggccacgtgtttagagacgccagccacacccttccttgtcttcgttactgctgctgacagcatgctctcagtacacaacctttgcgagaaagaataaatgagtgagtggagaagcactagccattttcagggtgaattggtggtaatcagatgctggaatttgctggtggagtcactcagatgaggagaatggccaaaaatttccttgaggtactcaatagaagtttaaaaatgaagaaataaccccaacatcgagtcacaataactaagttgtattttaagtggttgtatttaacatattagcacacacagaatatataagatatttggaaaaaaatatgaaaagtctcactatagatgcatgaagacgttgtgacccaggtccccctggtcctcagctccttaatgctttgttccatgggagtggtttccaggggattcaggaaaacacaccctgtccagacagaaatgagaatacagcctctgggagaaataaggccccagcaaccactcaacatttttctttccatatcccaggcgcaaataggcactgagggaagagtgagcctttcttcctgcccttctcctcttgcaacattttctggagagggcaggaagacctaggtagccagcctgcgtccaggaagggagcctggggcaccttggtgtgatagatgctgaggggacagggccaccagagggagcctgagagtccagagaagactaagagaatcatgtgaccctttgagggacttgaaggtaggctgtggggagtggagggtctacaaagaaggataaaggggcccagctttcctaggtgagccttgaggaccctggagagaagctgatgaggtctgagattactgaaaatactacaggagcattgggatcactgggggagggttctggggagtctggaggatctgggggaccttgggggaaagcgtatggggtttgggagcatggaatgaactaggggagctaggggtggtcattggtggagcttggacgtgcctggaggagcctggagggatgatctgcccctcaatcaatagaaccagttaagaagagaccatctcccaaccctgaataggctcagtgtccgaaggtaggttgtgtagaaatgcatccccacaatcacaagaatcaatgtgaaagtaatatcaggagttttatttcagctattggtgggtcaatcttttttctctgtggaattttttttcttccaaagtttcctgttttcttcataatttaatttccttcttagctttttttcctcctatatatatgatattatgaagtatatatttggtcttcatcctgttttgtgacatacagctgctaaaacctttgaaatctctggaatgaagagtgtcttctgcttgctaatgagatgacttgtgtctggaggccccagtatagcttcaggaagggggctggtctccagaaataaaaaggcatgattagagtattggaccagtcggccccaccctcaaacctcccgggaggagagaggggctgaaggttaagttcatcccaaatgaataatgatttaatcaatcgtgtctacataatgaagcctccattaaaaaaaaaaaaagagggacatatttcggaggaacttcctgatagctgaacctgtggaggttcctggaggacagtgtgcccagagaaggcatgaaagccctgcaccccttccccataccttgcccatgcatttcttccattggggacgttcatttgtatcccttaaaatatcatttataataaacaggtaaacataaataaagtgtttccttcagttttgtgatctgctctagcaaactcatagaactcatagagaaagggtagtagaaactttgatctgtaaccagtccataacccatccattagaagacctgcacagcttgcaatgcctgtctcaagtaggaggcactcttgtgggactgagctcttgaccaacctgtggaatctaaccctacctccaggtagacattgtagaattgaattgagttagaggacactcagctggtgttcattgcaaaatagattgcttgcttggaattttccccacccgtgtaatgtcagaagcattgtgttgtgtttgagagtatatcaggagaaacaggatttgtttttttctatatcctcagagtataaatattgtttattcattggttattttaaacttattcatgtttttttattcttggcctctcttttttcccctaaaagaatatttttcattttttaatttcttctcacctctcattccttcttcatagattcttatttccttgtgtttttctttatatttttctttctgcacaattattttctttatgttcttttcagttttttagcattaacttttcagtttttaataatttcttattttcttctgtttatttttttatttcttcacaatttccttcttctttatgattatttgctaagtttcctttagcttctacctcatcataacttctatctggtcttcttttcatatattattttcttctttataataattcccttcttgggggcttctgtttattatttctttatttatatttcatattttgtttctttctttataatttctctctctcctctatcttcttcatggtttggagtgtgattcttctctctccccttgatggtgatggacacttgctttgggaccaggcagtcctacatccattcccagttacggccctggttagctggatgtccatgaactaaattttgctttctgaaccttatttttgtgacttaaaggtacttatgtagtaactgcaatattgtttttatttatagaacagtttgccaggaaagaaaatatttcaaagacaaattttccactaaaaaataatacagataaaaaacacaaaatatgggcagacttagacttggagaggaggtgcctacacagactaaaaagctgatgcctcttcaatgtgattttctttaaattttatttgtttcactttgtggctgagggtagagtcttgtttctcttgctctttgtttcttttagaaaacatctatctttaagcaagacattagttcccaaaacctgacttttctcagcaaataatacattgatattattcagcttcaaaattttgactgtgacttcaagattgacacatttttaatgttgcccccaacaatatcgccaactaattaagcaaaagtccactctaaacgtaagcatcgaataggtcaaccattacaaggagagcgtttgcttctcttaaaagtttctttccacctctaggtgcattctgtttcaccagctatataaggatcaacagtgtggaaacctgcatcaactggcattgtatttgtaatttattctgatgattgtttagtgtcctttatatttacacaatttgtggaacccagtgtaaaatgaaaatgtgaggctccttgttcagaattattaataatttcaagaaggcaattctagggcattaggcaagtgcaggactctgctgagtctaggtcctgtacagtggcaaaggtcacacgtttgtatcaccggccctgttgatgttgaagttcttagcacgaagctggctgacctggttccaggtacaggaagtgacacccatgaggaactttcagatcccctttatactctcaaaattttagtttttcttttaactttagaaaacttgcctggatttcagttattcatccatagcttgaatatgtcatttttcttactgcccttctctcctctcaacaaccactagtcattccctgtaaaaagtttgggaacattcaacagacttttacagcagaaagtatataatgtggtggcagagaagccctcttctcaaagtcagtatatttcaaccagtggcatacttaggattttgttgtaagtagcttaaaaataacttgcttcatgtctcagccattacttcccacagttgagccctctggccaaatctaaatcatgcaaagggccaattgttaaagtgaatgcctgctaagtaggatggcttggaatccaggttgaggatgaaagcagcaacagcaggaaggaagaacagtggagtaagccaaaagaaaaaattactgctggcacacttctgttcaccatacaattcatccccccgcacatggcaatggagttggtgaacaaacaggtgcataaattaaaatcatgcaattagcggccatgctgcccaccgctgctgccccagagctgcagtaatgctgacactagttaaacaaccaaagcaactgtcattagctaagtgtgttcacttctagaatatcctttttattaacgtgtttaaatagctggatggcagagatttgctgtgagttctataacagaagccagttaacaaccttaaagaccaaattaattggaaagacatattttaaaaccaacacagaacataagctagggtgcataaccagaagctacaattgctcaagttttttagaagaggccatttacattgtaacatcccgccaaaatagtatgattttttaaaatcacagaaattgcacagaaactagatgtttcaaggtatttatgttaacatttcaggataaggaatgagagtcttctctggtgctcatcattttcaggatgaacaattagcattgaatatgcaatgtggtatttcacttcaatctccagaattcctctcaatgcttcattaggctaaagaaattcttttgatactgcgcaataagagtttatattttattccctatttttaagcaaagacaaagagatgtatttaatatgtaagatttgggagaagaaaagtgaaaaatcatcagtgatgtgaactaactttaagatcacacaaacttgaaactactagagtattgaaataacacttgagcagacttaactcttcatccagaatccctgggtattgataacttttatagtgacatttgaaggctttttgtaagacacaatgaattacagggaaaatggagattttatgaaattatgttctacatgaatagtcatagtagttgaaatgtgaagatgaaggaatgaggcttaattagagaagtaccaaagaagatcaagatgattatctcacaacatccctcaggttgttgtctgaaagtaatggtctccatgaactataaagacagggtgtgtcgtgttgagagacaagacccagacccaggttttttccccagctcactaaatgtgtaaaattagataaattctttaacttttttcagcctctgttttgtaacctctcaaatggggataataatacatgtttacctcatagtcttattttaagtgattaaataaaataattcaaatagtgcttagcagtgcctaacactacctttatgtatgtaacttaataggtgatacaaatttatctccctttaccagtagttttccttgactacaaattgaaatcttcggggaagttgtaaaaagcactgatgcttgaagtcacacttggagcttctaattgaacattcttgggtgtggcctgagcatcaggaattttgaaagttccccaggtagttctactctgcggccaaggttgggaaccacgttgctttagacagtaaatacatcattagtaaccacattaatttccattactcaagaaattcactgaacaccctggcatattctaaacatgacaacttgaccatttctccctgaggctcattttctctttgttgcccttctggggttaaaaacaacaacaacaaccaaagtcaatgagacaataattttagcttagaacttaaggatccttttcatgctctacttaataataaatagcagaggacttctttgaacaacatctttaatgtagttgctaaaacaataaaatacacaacagagtacccatcctttaaggaggccaaatatatgatgccctctcttttttttttttttttatcatacatgagtatttctgaaacaagttgagctaaactttgtatcctttgatatcatgggaaataaggaagcagtgcacattctctaaagaaaatgacaatgatttctcattcattctctcattcttctgtttctgttttcatttgctttaaaaacttctttttcttttaagatctgactttccttccaggtgaggaaaaaagaatttccaagtgaggccaattagagttgcccagatgaagcaaagtccccagggatcaatcagaatgcctacacagatgagaaagtaggaatatgtcctttctttctccttgttagagtttagtttctgccctgaggaattctagttatttattttctatcagaaaaaagaatgagctctccacagcacttaactctttcctacttgatagaaatatccaccttcacattgtaaccttgtgctgtacctcattgacttgtccttagttaattatacagaacatctcattcattcagattatgctaactgggaaataaaatatgtttacaagaattaggccaaaacatacaattgcactggaaatggtgtaaaagagatttatcagacgccagctttaactaggagattagatttatgaatacttcccagattgtgtactagggaacattactgttcatcaggatattaacaaggagtttcgtggtcagattaaattgagaaatgataattaaccattttcattataatgatgataaccattttcatcatgctcttctgagccttgcagctctgaatgtagtccgagattggctgcattggcattacatagttacttgttataaatgcacaatctgtattaattctgtagtcccacccccatactacagaattaaaatgttcatttgaacaaaatcctcaagcgattcctatgcacattatagtttaatagacactaccttggatgatctcaattcatattagtatggcagcaaaaaaaagtttttttaagttgaattcataaatttttaaagtctttttcactttgtttatcctatgatataatgaaattatttgaccacagaaatatagctattctgtttttgaaacagttactaatatttcatggcccaaaactttttcacataagataggaaaaagctaagtcaaattatatttcaaaggtcctggtaattctcatattctgatatcctaaaaagatggtaaagaatatacttaccttctcagaaaagaaatattatttaaaaacgctgagcatcctctattggtgatattgtcaattaccaggtagactatagtactatactggtaaagaggctttttcatgtgtagtctgtttccatctaaaatgatgacctctgaagatatggtgtgtgtgtgtgtgtgtgtgtgtgtgtgtgtgtgtgtgtgtgtgtgttggcagtcagtgttcagcttctcttggctgcatccactacagaggatgtcctgaaatggtcagccatgtctccctccagcctcacattactactgtctccctgcccttctgtattgactggaatttggccagagttctaccagagtagtgcctggatcttcatctaacttttaaggaatcaccagacttaaatttatccttgaattaaaattacttaaataactgaaatatcccctccatatcttccaaagtctacccaaatttaggacatggtgggtgttattcctttcctatacccaggcacacaggtcttttcatatcctgctggtattaattattccaatgctcttcttgctttcagaaatccctagatgaaagtagacaccaactctgttcccatgtgttgcacccaaattcagggtccaaacacaagctgcactgagaactcttttctcaaccatttgctccaacaaagtgagaatgggtctattgtttcttgtcctagtgtatatcccccatgaagaaacaagatgtcattgtccctttttgaaagacagagaataaagtgttccttcttgaaagaatgatttcttagatccatatgttatcttataaaaccaatgcaaagtgtgcttttcaaccaaccattttctgagacatcaataaaaataattttatgctttgtatgaataaatccaacaggttttcagtcttattttagtctcttgccttaaaaaggaataaaaaatgtatgtatttcagaaagaaaatgtagaatttaggctgttttcttccattttcttccttgaaaataatctactttggatttcttttgaagacaagtggacatttggcatttacagcttcatagaattgtaaagttatgtctctctagcaacaaagcacagtgccatatttctgaataaatacgttcttccttgagttaaaattgcttacaaagaatctgtaataaatcaatcttagtctttagatttactgtttaaggtcaaactatgtcaattgtgtttttaaattcagatttcattttgaagcaacattttataattatgtctaatttctatttgtgcttatctgttttgaaaaaatttagattaggtcaatcacaagtcaaaaaaatgactaccttctggctccctctcaaaaatgtccactgttcaaataaaaaaaaataacattttgctcagaaattctaattttttaaggggtgaaagtaagatgtgtttatttatggtatattcattccagagtattcttaagaatgcccttactggaaagatgttaggtctgagaaataaagaggagcttgaaaactcacaagaaagcattttttaagccagcagtgaaagaacttttgatgtttcaaggtcatttcactgtgggaggaaattgatagcgtctaattagagtagaaatgctataaagtctgttcagtagagatgtacttggctagcaggatgaagtcagaggaagtatataaaattttctcttattgacttacattttccatggtccccaaaacttaaatgtatgttaatatcacctacagtgtttttatccttgttgagattaaaatatgaaacctgggagttttctcctgcttagttccttattatgggtattcaaacaaatgctgagttgtagatttaattccttatgaattgcctccacttaacaaaatcccaaaacatttactcagaggttgctatgcaaaagccaccgcagatgcaaaagatcctagagatgcctacaatttggaccttggatttaggtgattataattatagttgcaaataattatgtgtcaatattccgtattttacctggaaaaaaaaattctgttcaaaagttttaaatgtatttacactcactttccaaggtagggggtgatagtattcatgttagtcatatatttatatttcacactatttctctcttctgctttcatcgattgatgagaatggggaaaaattattataaacttaatgcctctgcagtttttctgtgtcactaaataatgagagtctgagaaaatatgtattgtttagcaggacatcttcatgtgttttccaacttaaaaaatacaacatgcatgttttcaattgtaagtgggagctaaatgatgagaacacacagacacatagaggggaattggggcctatcagatggtgtagggtgggaggaaggagaggatcaggaaaaataactaatgagtactgactaggtttaattcttaggtgatgaaatattctgtacaacaagcccccatgacacaagtttacctatgtaacaaacctgcacatgtacctctgaaataagttaaataacaaataaataaataataaaataattgtgattaaaaagagacaatatgctgtaaaatatttatttaataaaatagctttttaatctgtacagaattgaataaaaaataaataaaaatataacatacttaataacctatttccaaatctattcttattaaactattaataagctagggatttttctgaaaaacaatacttttttcttagaagaatataatgttggattccttgctttaactttgtgatgcttcatggatcacctatctcaaatctctcattctacttaatgacccaggtttcttgaattgagtgactagagaaaggaatttatagaagatctttaagatgcttcatttttacccctaaaagaaaaacagtgaaaccaagaggacggcgctagctgtagataatttagggtaattcaacccagagatggagcaagtaattatttctgttcttgtctcatcctggttgccttctatttatcctaacaaaaaagccacaacaagttccctataaagagttcctgttgtccattttataaagaggaggaggatcaactttatttatgaacattacaatttatcagagggactctggttctatgtaggcaaattccaaataacattaaattcaaattctttttattcaagttctatcagatttgctgcccatctgttaatcccacttgacttcacagtgctgtttatctcctaataatgtttttataggattgccattgcatactattttttttgtgtgtgataggtacacatagaagtcacattcattgtccttcctagtaatatctgcatagattctgattccatgatcctttaaaatgagcaaagtgagaggtaccattccagaaagaagaaacaagtcaccttgtaaaatgatctgcatttttgtcatgtcaggagcctgcacgtgttgggttacttcatgaagcaattgttgcctacagtagcatttcagttcaaaagcctgttccgttaaatgccatttcccagttcaaatggacttgaactgattcagcatacaaatggtaacatactctttaaaaatatagtgcagtggttaaacgtgaagattctggagacaggtcatctgggttcagaacctgtacttgctgtgtgatcttaggcaagctacttgatcactgtttcctatatttaaaatagggggacaataacaccaagctcataaatcactgtgagaattatgcaagtttattatacatgcttctcatgtgcctgatacacactgagcagtcaataaacgcttgctgcttctatttgaaatcttaaagagaccatataacaaaacctcacctttgggcaaatgagcaaactgaggctcaaatgttaaataattgacctatgtgttctgtccattagagtccacctttactttctccttatttaaagaaagttgaatgcaaaggcattacttggaaaacctgagttcaagttccagttccaccctacatttgttccataaccttgagcaagttccttaatatttctatatggctcagaatggttaagtaatttttccaaggtcacacagctagtgagtagtgggacttggattcaacttgagcaagtctaattctaaaatcagatttttgtccctactataatgtcaaaggttgctttaggtaatatgtacatatcacttttggtcaacgaagaaactgaagttaaatgtctaatgcacagttacagcaaatttagacagagcttggactacaacggaagtcactaagctatcaattaaatattcttcccactagatcagtgattcttaatcctagctgcatattagtcttacctgggtaacccacttcaaaaagacacctttacctggggccctatctcagacaaattattttttcaaagtctcactgaattaattgtaaggtgctaatgtgaagaactgctgaccttgactgaaagagtgcaaagaggattattttgccaaaacagactcactaccaggttgcttccaaattaactaaactcagaactgtcctaacacaaacacaggtgggagtggctctaagccctgttatttacccttcactttctaacattttatcaaagtcagtctccagtatagatgagtagctatgggaaaatactaggaataatcctcccaggccctcttatttttttcctggtttcttatttcttaactggattgtctcctcctctatgctattatattccactgctggattagtcttactgacagctcttaccttgctattctgctttccaagagtttcagtgattcctcagcacccgcagaggaggtgtaaatacactttatctggagctaccaagacctctagcatctttccaaagtgacgtttccaaacttttccatgactaattcaccttcattttacatgccttaaagagcattgtaactccatagggctttctgaaactgcactgtgctgtcaccctttgtgcttttgctatgttattcctttgtctctaatgttttgccctgtaaccctacttgtgagtatcctacttattgcatcattaagcccaagcaattttctgctttcccatcttgactatgactgtttatccttgaatgcacaaatcctatccagaccattgaaatgccattccccgctttgagctcaatggttcaagactagcctgtccaaaatgacaaaaccccgtctctaccaaaaaaaaaaaaaaaaaaaagcaaaaatagtcaggcattggtggctcactcctgtagtcccagctactcagaagctgaggctggagactcacttgagcccaggaggcctgtgttgcagtgagccaagatcataccactgcactccagcctgggtgacaaagtgagaccctgaaaaaaaaaaaagagagagaaagaagaaagaaagaaagaaaaagaaaaagaaagaaaggtaattttcttgactatttcatccatccctttctcttctcaactcctcaccaaaactttttttaatttattgaacttccatagaaatttttttaatttttaatttacttcattactttgtcacttatatttaaaggcagagattattttggatttatccttatattccacacatcccaaagcctagtaaataatactatagacacttctagtttgccttctcctatgaaagaacaacaacaaaatactagatataatcctctcaggccctcattatttctttcttggtttcttatttcttatctggattgtctccccttctgtcttattatatcccatttctagatgagtcttactaacagctctcacgtaattctgctcttctagagcttcagtgattcctctatgcctacagattaaaggtcagtgccctttatccagaactccctagacttgtataatctagtcttaagtgaccgtcccaaacttatctctatcttgtttacctctaccttctaacattttatcaaatatttaatcaaaattttatctcttctagtctcaagccacacccaaccttcagatggaacatgtggatctggcctaagcccacctgtgcacaccattctctggtccatggtgactgcttccaggcacatgacctaagctggtcatagaataaattttaggagtctgctttagggtttgaaccattaaatgtgtagatagcaaggttctggtaattattctgcaactaagagaaaaaaaaaaaaaactgtttcaaataagactaagagatagagaaagaaaggttgaatcccagagacacatctaggacctctctgtccaggatagcctaaaactagacctctctctgaaccatccagttatataaatcccacacatttacttttatgtttacattaggacttctgtaccttgaaatctatgaaatcacaaacacaagacattcactcaataactgttaggtaaccaatcagcctttcaaccgcattaaaatatgccaggaggaggctatataggataccgcaacaactctctggtttaatttgactaagtttttatttttcaatttttgttttttatctcagcgtaagagatgtaatatactaaagcttatctgatatgaggctacaaaataaacacaaggatagaaaaaaccctcatgtccctctctctattaacctcatgcagcaagggtctgtgttcatcattagtttgactttgcaatgcagaaaatagacagtctcctccaatccacttaattgtaaatcaggatcttcagctaaggctcagaacaaagatcaaagataaaaaaggaaaaagagaaaccttcatgtccggatcatgctcttatcttcaggacaacttgagtttctttcaggtatttgtaaaagcaagagaaaatcaatgagaattaaggtcggaggagacgaccaataggactgttacaggtttatcatgttttggatgcaaagtggctggtgctcatcctgagtccatcatctgtctcaggaagacagcaaactattgtgcttgtgttttcagaattgcagtggagataatgctgttaacacaatggggcattgcaagaaactcataggcacaaggattgatcacagatattgcttatgggatctcagagggtaaagaatacccttggatgaagagctgcttaaaagatcatggacagttacagcaaatttagacaaagcttggactacaatggaaatccaagaaggttgaagagttctatagaaccatccaggaggcactaaactcgagatatatttattacacagcagaaaaagttgaaaaaggaaaggaggaaggtggtaaaagtgaagtagatgaagaaatctgggtagcctaaaatagtatatttatatactaaaataatacattaaggctgttctttccttgtgttgctggtggagatacagacttggaatacataaaggagcaagttactattattatgtggaacgattaaggtggagaacttcaaatgccacatcaattattatgtaaatcctaatgatgccaagaaactcacattcaactaaagggtcctatgtgtgtggctgaggtaaaatgtggccttttgaagttgtcaataaaggaacaaatagattgttgtgactatatagggtctgatgagccacttaccagcagcttccaagaggaaaatgtacaggcccaaaaaaatgtcacagaactgccaaaaggataggaaatcgatgacataaatgatgaaataactcattcttctacttgctctttattggtgttaaataattgctaaatttttatttgaatggaaaaacagaaggaaattggtgagtgacagctccttcaaagatgatcctctaaaccagtggtccccaacctttttggcaccagggaccagtctcatggaagacagtttttccatggatgaggggtggggaggatggtttggggatgattcaagcacattacatttattgtgcactttatttctagtattattacattgtcatatataattaaataattatacaactcatcataatgtacaatcagtgggagccctgagcttgttttcctgccactagagggtcccatctgggatgacaggagacagtgacaggtcattagattctcataaggagcatgcaacctagatccctcaccatgtgcagttcacaataggacacacactcctgtgagaatctattgtcactgctgatccgacatgaggcagatcttgggccataatgtgaacaacgggaagcagcatctgtattgaacagatgaagcttcacttgctcgcccactgctcacctcctggtgtgtggcctggttcctaacaggccacagactgccaccggtccatggccctggggttgggaagctttgctttaattatgtccaaaaaagtgtatgtcccttaaacaatttagatcatcaccaatgggaaaacagtggatacttctcatggtaaacagaggaaacagaaaaggaagtaagctaagcaagtcatgagtgaaatttactaggcttttgacctgggagagtagttatctgaggaaacttagtgtagaattgactatagtttaccctggcatttggatagctattgttggtgaaatattcacactcgttcatgcaactactttatgacatatgaactctttgcctgctttattttccttagcatttaactttaaaacaaaattttaaaaaaacctaacattgtgtgtgtgtctagatagataagagagagacatagagacatcaacacatagatacaaatatacagatatagatgatatagatacagacacatcaaaatatcagcctatctcagaaaataggaaggggaagaggttacttataatttgaccagaatttagaaggctaagtagtatgtgcccttggagttaatagtagcagtacccaggttgagaaccacaaggaaaagacagccccataaaaaaacaaggactcactactctgctctctcccacttttcaaagtgattgccatttgccctttattgacactcctttgttattttccccagagaaaaataactatgcattattctagcaggtgtactagtaaccctcacttctctccattcccacacacctgaaagttccccttccagggatggggaatcccagagacatatctagggcctctctgtccaggtcctagacagggatctgggtctggattaacatagaaagcccttcacattttacaatgtggatgtgcatggttctgagaggtgaagccagctgagcttctgggtcagatggggagcctcagaacttttgtgtctagctaaaggactgtaaatatacctatcagcgctctgtgtctagctaaaggattgtaaatgcaccaatcagcattctgtaaaatctgtgaaggtctgcggctcactcctgaagtcagcgagaccacaaacccactgggaggaacagacaactccggacgcaccacctttaagacctgtaacactcactgccaaggtctgtggcttcactcctgaagtcagcgagaccatgaacccaccggaaggaagaaactctggacacatctgaacatctgaaggaacaaactctggacacaccatctttaagaactgtaacactcaccacgagggtccacggcttcattcttgaagtcagtgagaccaagaacttactggaaggaactaattccagacacagttctgccatgacactcttcagcctggtagcccaggcaattttgccattgacttttctaggttgtaagacttagctcttccttgaaatagaatgaatcttcaaattgtaccacatgttaatatacttaaaaattaacaagacagagaggtggttagtggctataaggtgttcactgtaaaattcaactttgctgaatttcgaaacttatctattaataataaaaactgggaagtattagcaagtgagtattttggtttttgtggggttttgttcttttgctttgtttcgttttgtttttaccaattctgtgtcattctttatttgaaatgcaacaagaaaaacagcaagctgtcagtcatgccattaacaaatggatgttataaaacccatgcctgtctgggtgcgtttgctcatgcctataatcccagcactttggaaggctgaggtgggtggatcaccagaattcaggagtttgagaccagtctggccgacatgctgaaaccccatctttactaaaaatacaaaaaaattagccaggtgtggtggcaggcgcctgtagtcccagctcctctggaggctgaggcaggaggatggattgaacccaggtggtggaggttgcagtaagcagagatcgcgccactgcacaccagcctgggcaacagagctagattctgtctcaaaacaaaacaaatcagaacaaaaaacaaaaacaaaaataaaaatattattaaacaaattaaaatatttaataattattgtacaaagttacatttatgatttattcctaggattataattattattacattccaaatactgagtcctttctatgtgtcagttaccctgtatgcattatctaattttattctacagccattctatgaagtaggtattataattatgaactgatttacaagtgagttagccaagactctgggccattaaatatcctgcccattgtcctcagacagaggagccatgtgtcaagctcatgtcttgagcacaattccttagatacagcgttataataaactcctttcaagagatgcaatgagtggacattttctctacataacatgtgaataagacacattgaggaatgccattaggacttgcccaagtaaggacagagaggatacactagcaacattttaatccctgattgtatttgaaatctgccaagtacaaaataaacatcaaaggcagctgtggcagccagatgtcttctttgtttcttctcatgtgagccttctccctgctcaagaagcatgaagctaagtgtgatctaaaaggctatctctgctgcccattcattctttggcctttgtacaaacactgccagcagtacatcacttagaacagcacagcacagcaatgatttctataacagaaacattaatcaattaaaaccggaagtaagccagcaaacacattttactgagctcaccagcaagtcatcatcgcatagatcatcagatagaaatgtttcttgactaaaaaacaaaaagaaaactaaactgtgagttggtgaccaggtaccaggccttgttttgtctacttgtgtactagaatattctctccctttctatttcactagtcacatgatgaccacaagtcatagagtaatattttttaacttactgcataaatggtggggtttatcactttagtttctgtcaccttaaaaaaaatatggtttcttcaaagaatttagataatcaccaatgggaaaaaaatgaatacttctcatggtaaatggaggaaacaaagaaggaagtaagccaagcaaggtgtcagtgaaatttataggcttttgacctgggagagtagttatcttaggaaatttactgtgaaattgactatagtttaacctggtattttgatagctcaaagaaaccatattggattatttaaactggaatgatttgctctatccctattttctcaaaggaagtcaaataaaaagcatccatatggttctcatttgcactgctataaaaactcatatttaggtggcatgacactgcaatatacctggtataaaaagcagcatttttgagcactttctatttgtcaggcacttttcagaacagttttttttatattaactaacttaacacataggtcacagtgtggttaagtaacttgaccaaagtcagtaagaggtggacctaccttctcagccattacgttctacttcttaaatatcacaatatgttaaatgtttattcagcaatttaataattttaaaaaattattaccaatttcaaaagcatgagtataatccatttgatattaagataatatcaataaggacgtttaaaaatatacttgtgtaagtctagcctttatattagaaagaccacccccccccgcccatgaccctaggagtctttttagaagtaaagtaagggaggagagatttaattttagtcactctcctttttagtgtgacagagaaacctgaacgttgttacaatggagaattgccctgttgccaattgcgaatgtctccattactgagtacttaggagaagactatggacttgttgatgagataaacatgctcaaaatttgacatgggcatccagttctgatcaacaataatactttctcttattgctcccagaatgccttactccaaatagaaataggaacaatatcagtaaacactcgttgctgtcctaagcatcactttctgccttgatggcagtggggccagccaaagagtcactgtcagctgattgtgggtgagtgtttagacaggattctttaagtgatgaccgtcacaaacacaacccaaaatatctatcaaaaaaaaaggaaatttattgaatcacatagctgaaaattccagaagcctcttgttttagacaatgctagatccagataccaataaaaatcagttatcattagaaatctccctcagctctacttccctctgtgttttattttcagaacattctccatgatatcagagaatggtatcacacccacataaaataatattttgaccaaaagaagacagagatgcccggcagtaggaaatagcagactacagtgtgccatgatttcttgaacgataacaggcttattttcgatggggtggctatcagtgttggagcctttactcttcctggaaaaaactgcagttgcaaatgcctttttctcatccttctgctctcaccttattcttctctcatatcattggcaccagtatatatacctggtcatcaaacccagaattccaatatcatccttctttctcactaagacctttatttctttttcattattattatactttaagttctagggtacatgtacacaacgtgcaggtttgttatgtatgtaggcatgtgccatgttggtgtgctgcacccattaactcgtcatttacattaggtataaatcctaatgctatccctcccccctccccctaccccacaagaggccccagtgtatgatgtttcccccaagagtccaagtgttctcattgttcaattcccacctatgagtgagaacatgcagggtttggttttctgtccttgcaatggtttgctgagaattatggtttccagcttcatccatgtccctacaaaggacatgaactcattcttttttatggctgcatagtattccacggtgtttatgtgccacattttcttaatccagtctatcattgatggacatttgggttggttccaagtctttgctattgtgaatagtgccacaataaacatatgtgtgcatgtgtctttatagcagcatgatttataatcctttgggtatatacccagtaaagggatggctgggtcaaatgatatttctagttctagatccttgaggagtcgccacactgtcttccacaatggctgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttgttttgaaaagtgtctgttcatatccttcgcccactttttgatggggtcgtttgattttttcttgtaaatttgtttaaggtgtttgtagattctggatattagcccttggtcagagggtagattacaaatatcttctcccattctgtaggttgcctgttcactctgatggtggtttctttttctgtgcagaagctctttagcttaattagatcccatttgtcagttttggcttttgttgtcattgcttttggtgttttagacatgaagtccttgcccatgcctatgtcctgaatggtattgcctaggttttcttctagggtttttatggttttaggtctaacatgtaagtctttaatctatcttgaattaatttttgtataaggtgtaaggaagggatccagtttcagctttctacatatggctagccagttttctcagcaccatttattaactaggaaatcctttccccatttcttgtttttgtcaggtttgtcaaagatcagatggttgtagatgtgtggtattatttctgagggctctgttctgttccattgatctatatctctgttttggtaccagtaccatgctgttttggttactattgccttgtagtatagttggaagtcaggtagcgtgatgcctccagctttgtccttttggcttagaattgacttggcaatgcaggctcttttttggttccatatgaactttaaagtagttttttccaattctgtgaagaaagtcactggtagcttgatggtgatggcattgtatctatacattaccttgggcagtatggccattttcacgatattgattcttcctatccatgagcatggaatgttcttccatttgtttgtggcctcttttatttcattgagcagtggtatgtagttctccttgaagagttccttcacatcctttgtaagttggattccgaggtattttattctctttgaagcaattgtgaatgggagttcactcatgatttggctctctgtttatctgttattgatgtataggaatgcttgtgatttttgcacattgattttgtatcctgagactttgctgaagttgcttatcagcctaaggagattttgggctgagacgatgggtttttctgaatatataatcacgtcatctgcaaacagggacattttgactttctcttttcctaactgaataccctttatttgtttctcttgcctgattgccctggcaagaacttctaacactatgttgaataggagtggtgagagagggcatccctgtcttgtgccagttttcaaagggaatgcttccagtttttgcgcattcagtatgatattggctgtgggtttgtcatgaatagctcttatttttttgagatacgtcccatcaatacctaatttatcgagagtttttagcatgaagggctgttgaattttgttgaaggccttttctgcatctattgagataatcatgtgtttttgtctttggttctgtttatatgatggattactttacttcttaaatagttttttcaaatcaatccaacttatccctattactgtttctctcccttggataataacagtggtattataattagtctttctgactcctatcttgtcccttcaaatccattctccgtgttgttgccactataatcagtctgaaacacaaattctgccatgccacttccctgctttaaaattatcaagggcttacaattgttgtcagaataatatccaagcgattttacctgctgcgtgtgaatagtatacacttctagaattttgctgcatcaaatgttgccattagctatatgtagcaatgtagttttaacttcaattgaaattaattaaataaaatttaaacttcatgtcttcagcttcactagtcacatttcaaatgcccaatagccacaggtggccagaggctatgtatcacacagtgcaaacatagatcatttccatcttcatagaaagtcttaatagtgctgaggttccatggcctcatatctgtccactacccaactattttcttaaaatagtgctgaacaactggtagtttttgagtgagtcatacatattcatgtctctgtagctttgctccttctagtactgtttggattgctcttcatgtattgctagataatagccactgaacattctttaagagtcagcaaaagtgtcaccttctctagaagccaactctgaaaagtgggcttcagccaagcgttttcaaggtattctgtgcatttgctcacctaaccatatcacagaaatattatctggtttgtgcctgacttcctaagtgacaacaatggaacaaacaaacaaaaatgtcttgttctgtgttgttttatcagcaccaggcaaaatctgtggcatgtagcaagtgctctgatatatgttttctgaaatgtaataaatcatgtaaagaggcaaattaagcattttaacctcattaaacaaacaaaatacctactttaatttttgcaattaatgtaagcagtagctatccttgattttgtacttgtctctagtcctggcctaacctcaattcaactccaacatcatatgtcagcctcagaccatattcaccctagagctgttttcctaatttctttacttacttaacacagggcaaacctaaggaatgagttgaagtaagaggatctaggttgaacaccttttccaagaataacaatacagaaggaaagtttacattgttgtaggttgcctcagtgtcatacattcctcagaatatttttacccacgagagatcatatttcttctttatatgaagcactgatggatacagtatccatgaaaataagagggcccacttttctagagatataacatggttcacttaaaacatgtttagggacgggaagcccagcattttcacttgaaactgttctcttctttttatgtttagatttcccacataccttagcgtagatggaggttcccccacaaaaagtatatatggctacttctccttcttcttcctttccaggagaaactgggagagaagtggcattccaaagggactctgcaagactgtcccatgagctttggtaggttttgcataatttagaacctaatatcccagcaattcagttaaacattttgcatgtcagtctaaatagcatctaaatcttttgttctttgacatttaacatcattctgttcattccagtaaaggttgttgcctttttttttcaatgactttctgacctgtctttaaagtcagcattccaatcagtctccactgacgtacagagaatagtgacatattgacttttacaagaaatgaatcaaaaggtgacagaatatgaatcgatggaaccttagcactaaattttccatataaatgcaagtgtcaactaaacaaagggcttgcctctttgcatagtcaatgctaggtggtttatccacataatacacacttgagtcaaaactctgcataaccttggcctggtgctccagtggaattgtgggtcataatttttttaaatataaagttgacttttacttgaacacttgatcgtttaaattagtcctacccagttctaattttagctatgaaatgatgaatggaatgaaacctcagaaatttccaatacattgcaaaatacagattacttaagttacttcatctttaaacttccttggagcttgctttcgtctgcatttacatgggtattctgatgttcccattatactgctagtactccagcccattagacactcattcttccattgtcaaattctatttcgtgtttcattctgcagagtcccttgactgtttccggttttctctaggtcttctttccataatccaagagacccacaccaattaataagtcattaatattaattataataatgctaatgttagcaagagtttattgtacgtttagtttatgtcagtcactatgcttagaagtgtatccaaattatctcaggcaatcctcaaaacaattccatacagatagtattttactgctatttatccacattttagagataacaaaattgagacaaagagaggctatttaagtatcacatccatggtcacacatctagtaaatgtcaacgctttctcattcaagcccaggactgccaaatttcaaaatccaagctcctaaacagatactcctattccccattctgatgtattcaagtttaatttttgaactataaaaaaatctatttccatgtcacagtgtttaagaatatatcaacaatgtacattatgtcaatcttatcatttgaaaattattttaaaataagacacaaatattagctaatgcacatttacttttccctttctgaccttaatatatttagttataaattctaatctctataaaaccattaccataactaagaaatatcagccaaacattatatgaaaatagtttttttttaagactgtcagttgataacggaaaagaaaggagcaagagtgttattgagaagttatattactgcacaaagtagaggattgctttgtgatagattctctttgaatctgagaagtcattatttctaacagtacatttcagataacacatgcaattaaaatgtcttctttaattatcactaaagaaaattatttcaaaggacagcagcctatagaggtactttgccatgacagacaaacttaacaaaaaggatgaagaaagaagaacgcaatggataaggaatgtaaacaaatttatgaaagaaataaaataaagggtggcaagtgaattagcaaggtggaataagtaacaactaaaagcctacaggatattgacgtaggagtgggaactaaaaacgaaggaaaacagaattagttttgagtgttacatggcggatgaaccacataatcctcacccactctgagcaacacggaaatgatggtctatcttatctccatctggcaggagagaggagggatagtttctagagatacaaaaaaaaaaaaaaagatttttgacctcaggcccgcaagtacagtgaacgtctggggtaaagtatgagtttaaaaaagggcggagatacagaagagtctcaatgccaaatggtagaaccctgctcataggactctagaaaaggttgacaaaaccatgcccccaagccctcctttttttctttctttcttttctttttttttttttgagacagggtctcactctgttgcatagactggagtgtagtggcacaattttgggtgacggcaacctccgcctcccaggctcaagcaattctcctgcctcagcctcctgagtagctgggattacaggtgcacaccaccacaccccgctaatttttgcatttttagtagagacggggttctaccatgttggtcaggctggtctcgaactcctgacctcaaaagatccacccgcctcggcctcccaaaatgctgggattacaggcgtgagccaccgcgcccagccgccgtcctcttaccataagcattaaggcaacagaaaactagaaaaatgttctctggaagaactgaataattacagggaaacaatctttgcatactctcattgagagtccagctgattgtgcaatgactcagcagtgaagtccacagaaccacaaataccccctttgcccatcagtcttcaaccttttaaccaggtttttattctttcattcttacatatgtacagacacgtagacagctgatgaaagccttcaatgtcggggaaaaacaactaccagaaaatggagggcaaaaaagatacaaaataaggtaaggctaacattttcaaaaacctcaaatttatgtcctcaaacaagtaagaaaatgtattgggttaagaggacagtaagagagaaagagaaagaaagaataagtcaaagaaaaaagatagctcttataacttaaaattggataatcaaaataaaatttgggcagcaaagtggaataatagtataacagttgaggaatatcccagagtagaataaaaagataaataaatgaaagatactggaacagtatgagaaaatcaaaaggtaattacaaaagatttgatatttagataacagaaattttagtaaaggaaataaaagcaaaagaattatatatttttctaaaaagtggaaatgttccagattgaaggactgatgggattagctgaagataaacctgcattatgaaatttcagaattctagagattaagaaaacttctaaatattttctgcatggactgaattgtgtcccccaaaattcatatgttgaaaccttaacccccaatgtgacaatctttggaataaggaagtaattaaagtaaaacgaggtcataagggtggggcctcaatcggataatattggtgtctttataagaatagacatcagaaagcttgctctttctcttctccatgtgaagaaacagcaagaaggtgatggtctgcaagacagacagccctcactagaaaccaaatcagctggaaccttagtcttggacttcccagcctccagaactgtaagaaatcaagagctattgtttaggtcactcagtctttagtattttgtaattttagtcccagcacactaatacactttcatagaggaaaaataatcacatgcaaaggatagggatcaaaataacatcagactttccaacagtaactttggatgccagaatacaatacagcaacatctttaaacattgagagataagtgactctgaacctataatcataaccagatatggggttatcgactagaatccagactggggttttccagagtaagtggacatgcagcaagcaattaatctccatcagtttaagtttagggtattttgccatagcaaagctaatgtattgaaaatttatgtcagataattgtatgttctagtcactttaatatttctagtcactgtaatatttccatttctgacataaggtgtaccacccagtaccatctctccctatttctaacaaatatgtagcactctcacataaagtatcttaaaaggcaactttaaatcaaatcatgtactttcattctacactttattggagatctaatatctggacatgcccaacaatccctcaaagttcctcagattttcagttaatgcttaattttttattgtatccaaggtattcccttttggatagggatacagtgatcccaatccgcctttgaatagtttatttgtttatgtatttattcatttatttttgagacagagtcttgttctccacccaggctggagtgcagaggtgcaatctcagcgtcctggctcaagtgaccctcccaccgcagcctcctacgtatctggcactagaggtgcataccaccatgcctagctaaattttgtattttttattgagatgagggtctcaccatgtcacctagactggtctcgaactcctgagctcaagcaatccccctgcctaggcctcccaaagtgctgggagtacagacatgagccatcatgcccagcacctccctctcacatatttgatacttgattaagaaacttgaactcactgtgcagcttagcagcttataatttagctattgcttagttaactgtagtcttgtttgaatgatatactatttcgtcagtactctcaactattttaagtttgctcaaggaagagacaataggttttaatttcttttcagacattaacacaattttaaacacaataggtaggcacaaaataggcacttactaaaggtttgctcaataaattatgtcttccgcagggtgctgtggctcacgcttgtaatcctaacactttgggaggccaaggcaggtagatcacttgaggtctggagttggagaccagcatggccaacatagggaaaccctgtctctactaaaaatacaaaaatcagccgggtgtagtggaaggcacctgtaatcccagctacttgggaggctttggcacgggaatcgcttgaacctgggaggcggaggttgcagtgagccaatatcgtgccactgcactccagcctgggcagtagagagagactcggtctcaaaaaaaaaaaaaaatagattatgtcatgttctccactaaggacatgggagatcatgttcatttacccagaaaataccatcaatgacttctgtgttatagattattaaatattgtcaatattttgaggaggcttcaccctttgtccatgcatgaatctgaatcatctgacttcactgtcatctggtgtgacctaggaatggaaactagttttaacaccagctcaggcagaatataaatatgaaagtaatttcctgaaagaaaactattgcatcctaaggctaaatgttaatgacttcatattttccaggtttatgcattatctcagccacatttccctgttaatttatatattatataatggtagagtgagagtaaacactggagagcacttagtccagcaaagtattttttgcatgagatggagtgacgtgcccagagtcacatgacttgataatgataacagaagcagtggggccagtgtaatcagattccagtgcatgtacctcccagtgacctaagagttggatgatgtcatttctcttgttgaggtttttttttttttttttgtatgtagagatcgagcgccatgtctatcacaaagcatatgagctgatgtttcctggacttaacgtatataacactaaatttcaggaaaataatttagcaaggtagctaaatgcttctgtatataggaaatgctgggtactgcacagcgtaatcaagacattttgtttctaaatctaattctgcaaaatttcccttccatttccccttctaattttctattagaataaagcaataaggtaaaatatattaatcaaagtcatcagttcaggagaacaggaacccctagaattattcaaaccatcgacttggatgaggtagttcacattattaaattaatttgaagagtcattaattaacttccttgcatttttaaatttcatagtaacatgttcaaggatgatagagcattgaacttcattagctgattgtttgactcagtatttatagaagactgctacttattcagaaattcagttatttgtaacactgtttttcttactgttacattttaatgaatctcatgtcttattgtcagactcactcacattcgataaagggtagtggtaggagctatcttttatttctattaatctctttcccgaggttcattagcagggaattctttcctgttagatcaatggcaaaatcaccgtctgaagtcattttgccttgagcaataatctgaacatctttcttggaaatgatccgcgtgcccactggaaactttgagaagtagtttttaattgcatttttgttagattctggtgctgccaagccctgttttgatgcctgagacagtatagaaacaatttgaaatccacaacatgggaagattgtggtgccagtcaagctgactgcacattagcaccaatgttctttacatacaggtttaataatcagaagaagaatcctaagtgtttaataattgaacatgtgtttaatatttaagcagccagatctttccagttgttaaactaatattgaagtagggtgaaagcattctacttactggcaactctccatcttacaaatatcttttgaagttcagtacagtatagggtctatcactataccgtctggcggacagtgttacttatcataaccaggaccaaagacaatgcagaagctttcttcttgtcattacagccatgtgtaaaacttatatgtgcaaaaactatagtcataattaatgattttttttaatctcacattttatgtttttttctttctttgtggctattgaatgcaggaatagctatcctgaaaatgaaaaagaaaataaggcaatgtttacatcaggttatgtgctgggaattatttcacttctaactaatcttcaaattgcaaaggagataattatttacttaaatacttgttagcccagagttttcctgtactgtccacagtgacttaacaattttccttaaggattgttacatattgacaacacttgtagccttagacttcacagcagtggctccaccccaccttccaattgaccttgtacattcttgttgcaaaagatatgttcagtttactgatcacaaggtattttgtattggagcagttaatttcacctacgtgaatatgagccagagggttttaaaaatcttatatttcttccaacaatacctgttcttgatatttctgctcgaaattctgattttaaaatgataatcgtgactttgaaattcactttatttgattgcagccttatcttttccaccaaggattttaggtgactgccatgcaacttagttccagatggccttgaattttcctagtatagcttcttttaaaatttgcatgaggaaattaaaatgactgttttgttcttgatggatacttcaaggcaatcttttagcaaaatctcatacttttgcacaaacttttaaaaacttttaagttcagaggtgtaagtgctggtttgttacataggtaaacttgtgtcgggggggtatgttgtacaaggcttaatatttgggtgataaatttaaactttaaaaacaattaaaggtatcccttatagactagcagttaagtgtggctgctcattagaaatacttagtgaactttgggaggccaaggtggatggatcacctgaggtcaggagttcaagaccagcctaggcaacatggtgaaaccccatctctactaaattcaaaaagtagctgggcacagtggcgcatgcctgtaatcccagctactccggaggctgagggaggagaatcacttgagcccaggtggcggaggttgcagtgagctgagattgcaccattgcactccaacctaggcgacagtgtaagactccgtctcaaaaaaaaataataataataataaatacttagtgaattaaagatgcctgggctccacacccagaaaagctgattcagtgtctggggtaaggtcccatcacatccgtatttttctctttcccactgattctactgcctagcactgtgaactgttacacaataactgatggagaagaatttcatctttaatttttctgttttcttaatcatgtgaaaaggcaaatataaaataatgaaacaaacagttcatgaaaagaattggacagcagagatcttgagaaatcttagccaatcaatacggtcggataagatttatgaggtacgaggccatgttagccgtgactattctccttctccttgcatcatcttactaactctaaacactgtgtgatatttgactttgattctttaatcctttttaatgttgtaatatttcaggactcttatatcaggaaatgcttacttaaattttctccaaatccctcacgtcatataatatttgcttcttacatctcttgtgttgtaggatttgggaaaattctatttttcgccactggactttaattctatgaagttgcacctcatctttccctcctagagataacgtgcagcttacatgatgacttatgaatccataaatgatgttcatttgtttctgcaaactgaaaatatatttacactttggtacttctcttaggtaatcagaatgaaaatttcctagggaagaattttcatttaagtggctggagaaaatattttgcatcagtgaagatgtagtgaagagcacttgataaaatacattgtcacatttatgtctaaggtttttcctgtctaattaaaacagcagagcaggggtgttcacttactgtttcaacttgccaaatgattctgaaagtctgtgacctgtgagtatattctttcttctttctgctgcgtgaattgaaaccctgtgtgcagggtaaggagtgaatcccacttagatagtgactagcgagcagcagcaataaacctacactaaggcgtaccttcaaacatacttattctacttcttctttgcactgttaatactggcctttcctgacttcagcctggattatccattgcctgactgggaaaggcagattgttagaacataaatgaaagaaagagtcagtgctcagtttctgagctccagaataggcccttgaagctccttttgagggcaatctttgtgaaacaaagcttttaatttgccagaccctggctctctaaaaagaatgaacacatttatatctttatagatataaactggagtttcttccacaatgtaggaaagcctcctgttctacagaatcaccccctaaaataataagattttttgaaagaataagatggaacagtaaaaacctacgtaactttgtaatcaaagaactaataaaaataaaaataatcctaacgtaagtaaatattaatgtagtgaaatttccactgaccttggcacctaacatgatagttgatcaaatttttataatataaagttcatacctctttctccaagataaatttctttggagacatttacttccaattgagaccagttttatcgaaataaacaacatagacctctgcataaatcaatttttttctaaacagagagaaatgtctttgcagattcatttgcatgtgcagttttagcagagaaattgtggaaagtttagtggttctcgaagccactaaacagccacagttggcacaaatggaaatcacttatgcagtattttctctttcctgaaggttttcttttttaattctggaaaagcctgtctcagattacttcaaaatattaacatactgagaaagtcaaataccaattaatgcaatttccacattttgctgatattcttttcttctgtttgttaattctatgtatatgtatatagctatgtatatgtatttatatttatatatgtatgtatgtgtgtatatatgtatgtatatttccatatgtatgtgtatctgtatgtatatatatttacatgtgtgtatatgtatgtatggtatatatacacacacacacacacacacacacacacacacccacccatgcagtatacacgtatgtcagctcagttcttgcaagaagcagacacttcattcaagaaatttactggagggaatagacctgtgaaggagaaacggagaaagagaaggagtaagcagggagagtctttataccacaagttaggtttgacacctgggaaggggaaagaaaagaagaattgggcagaaagagtctcagaccacagctcaggtttgaaaacttctctcccaagccaatgacgagatccccgaacaagctacctatgcagaatccttcactgggcaggaatgggctggcactggtgccctcactctcctcagtcactggctggctgaagtgcgtgggagttgaggcctccacattctctggagtagcagcttgagctcttagtcaactgggctctccatagcaagctgtcttgaaatgtctgagtggctcatcctgatggctccattaacaaatatccacccaactcacctccagcacacatacatgcttgcacacatttttttctccaaattggaaggccctgatttagaaggacataaagagtatccataaataccttggaaagcagacagaagggacatttcttgctggacaaactaagaaaaggaggtatgtgaagagggtgcttataaagcatcttgaatctggagaaatcttggaggagtctagtccagaccattcaactggtgcttgagcaagtgactgattccacaaccggggtctgggatgacagtgggagctgaacctactgcaaaatgtcagtcaatcacaatgttactgaattctacacattgtgccaaccaaaaagctatattagccacactttactgtgtttctggggagagaatatctgtaaaagttgcttgtatgttgatcttttagcagaaatgttgcccccttgcaccatctttacaaataataccaacaccaaaatattagataactttcctacccagtgccctagggcatttgaaacagactgcttaagacgcttaggctgggtgggggttggggagggtgggagcggtgggggagtggtgggaggagcattggtatggaaggaaaatcacacaatgcccactccccaaatacacccttaaccttgatgaaattaaacaggaacacctgtgattcctctctgtactattcccctggaaaatgctgagttaaaccccctatttccagatatctgtcgtacatgatgttagtgactacttgctgtcacataaggagagaagcagcattattaggaagtaataaaagtacctatgttgataatacataaactccaagagaacactgtgctgtagtagtatttataaaacaatagtttcgtaaaggctctgagcatatttttttactaaattcaagcatctgccatatgattagccctcactatatctgacagaagtaataaacgaataacgtctggccacgtaccatctgcagatagctttggtttggccggcatggtcagtctttaagaaaatgagtcactataaggagcactaacagtactggcctagcactcttactagtcgaccatgaattgaagtgggtaggggtaaaggttctgccagccccattgaatcagacatgcacatctgagctggtctcttgcactcacagataacacagataaaaggaaacatatcccatgctcatggatgggtagaatcaatatagtgaaaatgaccatactgccaaaaataatctacaaattcaattcccttcaaaataccatcatcattcttcacagaactagaagaaacaatcctaaaatttatacggaacaaaaaaaaaaaaaaaaagagcctgcatagcaaaagcaagactaagcaaaaagaacaaatctggaggtatcacattatccaacttcatgctaatattataaggctatagacaccaaaacagcatggtactggtataaaaataggcacatagaacaatagaagcagaatagagaatccagaaataaagccaaatacttacagccaactgatcttcgacaaagtaaacaaaaacgtagagtgaggaaaggacaccctaatcaacaaatgatgctgggataattggcaagccacatgtaggagaatgaaactggatcctcatctctcaccttatacaaaaatctactcaagatagatcaaagacttaaatccaagacctgaaacaaaacaaaacaaaacaaaaaaatctaaaagacaatgtcagaaaaactcttctaaacattggcttaggcaaagaatttatgaccaagaacataaaaacaaatgcaacagaaacaaaaataaatagatggggcctaattaaactaaaaagcttctgcacagtaaaagaaataatcgtcatggtaaacagataacccacagagtgggagaaaatatttgcactcagttttgttacctgccttgtccttctagacatctgtgtctaagaaataatcaaaaagtgtgtaatccaaaagagggtgtgttctttttcccttttcccagcagtctgtccttgctaattatatttagaatgagttaaatattaaagattgcattcccagagcacacagccttgcagaaattgaccatagacattatgcatagtgggactagacgaagatttaaattcttctgtacactgaaaggtaattttctgcatactgaaaataatttagacatagtaattgagactgtatggcattcatcattctaaaaatcctaaatttagtagataactaaaagtcaaatactttatgatcaaatacctttaaaataattttgttttattatagaattacatagaaagaaaaaatctacaatctatttcatttttaaaagagaagtttagtgtttgttatatatgttgtcgtctttgtcatcaaaaaccagttgaaaaacaggctggacgtttgcagacactgagatacccaaaacccagttaatacacagctgccttcccaatcctcaatttaattttaccttcatccccattttagtatcaaatcctgggaatcttcagttcagacacctctgcaggtgccacacataactaacctttcaataagattaactgccagactgtgacatttgatgtgtgataatgcaaggctttgtgaattttaaatgattctgcagatgaatttgagatacagtaaagccttcattagatataatttaaggaccaaccactaaacaatcttaattgcagaaactcttaaagatataagcataaaaaagttaatttgtggaggagagtcaaacatttggacatttttcacggggtatcctaaatgacaagacttatacagacagaggaactttagttgtcatcatcactatggagcactttgtacagaacacctactgagagaagaaaaatggtgcaatactcttcctttacccactgaaaaagtaataataacaacaatgaaagtagcaaagactgattgaaaatagtttatgctaggtactatcctaagtgctttatgtatattaattccatcctcataattatccagtcacctagcttcttttgagttttcatattagaaaggaagcaactgatgctcagagaatgtaaatgtctgaaataaagtggaagccaggcatgatggctcatatctgtaatcccagtactttgggagaccaaggcaggaggatctggattgaggccaagagttcaagaccagcctgggcaacatggtgaaaccctatctctacaaaaaatacagaaattagccaggcatggtggtgtgcccctatagtccctgctactctggaggctgaagtgggaggatcaattgagcctgggacacggaggttgcaatgagcaaagatcatgccactgcactgcagcctgcgtgacagggtgagaccctgactcaaaaaaataacaaaacctcaaaaacaaaaaaccaagaagtggaacagaaagtctcatttaatctgttcctttgactccagggccaatcttttaaaaccctgaacaaatgttcccgaaattttcctgatgtaaactaagaatccccctgacatattaattctgtaactgtgaagtaggcctggggatctaaagtattttaggcaatgttgaacgcattggccaatgttgctatctagctaatgagtctactgccaggaagataatcctaacacccactagcacacccaatccacaaggctttatgaccatcaatataagcaaggcaaaatataataatttcaagatatgaacacataagtcatttctggctgacatttgagggatgtttacttcattaggaactagtaaagtttataacggaacaaagtatttaagaataccttttcatatttacagaatttttattttggatgtccattagatatgctaaaatttataatgtttttatatatacttcacttgataacatcctcacatcaatcctatgtttatgtcatttagttctcattttgcagatgggtgtaaaatacatttgattactttcaaataggaagaagaaataattcactgactgtccccttgttttcacttgcccaacagaattcagaaaaccagaccaaataagaacaaatcatatgtattatttattgcaaataaaactggaagggaaagtcaagcagcacactttggtgtggcaattatgaaaatgcatccttgggttccaagatggccgaataggaacagctccagtctaaagctcccagcgtgagtgacacagaagacgggtgatttctgcatttccaactgaggtaccgggttcatctcactggggcttgtgggacagtgggtgcaggacagtgggtgcagtgcactgagagtgagccgaagcagggtgaggcatcgcctcacacaggaagcacaaggggtcagggaattccgtttcctagccaagcgaagctgtgacagacagcacctggaagatcagggcactcccaccctaataccgcacttttccaatcatcttagcaaacggcacaccaggagattatgtcgcatgcctggcttggagggttccccacccacggagcctcgctcgttgctagcacagcagtctcagattgaactgcaaggcggcagcaaggctgggggagggatgcccgccattgctgaggcttgagtaggtgaacaaagcggctgggaagcttgaactgggtggacctcaccacagctgaaggaggcctgcctgcctctgtagactgcacctctggaggcagggcatagccgaacaaaaggcagcagaaacctctgcagacttaaatgtccctgtctgacagctttgaagagagtagtggttctcccagcaccgagtttgagatctgagaatggacagactgcctcctcaagtgggtccgtgacccccgagtagcctaactgggaggaaccccccagtaggggcagactgacaccttacacggctgggtacccctctgagatgaaacttccagaggaatgatcaggcagcaacatttgctgttcagcaatattcactgttctgcagcctccgctgctgatacccaggcaaacacggtctggaatggacctccagcaaactccaacagacctgcagctgagggtcctgactgttagaaggaaaactaacaaacagaaaggacatccacaacaaaactccatctgtacgtcaccatcatcaaagaccaacggtagataaaaccacaaagatggggaaaaaacagagcagaaaaactgaaaattctaaaaatcagagcgcctctcctcctccaaaggaatgcagctcctcatcagcaatggaacaaagctggatggagaatgactttgatgagttgagagaagaaggcttcagactatcaaacttctctgagctaaaggagaaagtctgaactcattgcaaagaagctaaaaaccttgaaaaaaaaattagatgaatggctcactagaataaccagtgtagagaagtccttaaatgacctgatggagctgaaaaccatggcatgagaactatgcggcaaatgcacaagcttcagtagctgatttcatcaactagaatagagggtatcagtgattgaagatcaaatgaatgaaatgaagtgagaagagaagttcagagaaaaaagagtaaaaacaatcaaagcctccaagaaatatgggactaggtgaaaagaccaaatgtacgtctgattggtgtacctgaaagtgacggggagaggaaccaagttgaaaaacactctgcaggatattatccaggagaacttccccaacccagaaaggcaggccaaaattcaaattcaggaaatacagagaacaccacaaagatactcctcgggaagaacaactccaagacacataattgtaagattcaccaaagttgaaatgagggaaaaaatgctaagggcagacagagagaaaggtcaggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctaccctaaaagagctcctgaaggaagcactaaacatgggaaggaatgactggtaccagccactgcaaaaacatgccaaattgtaaagaccattgaggctaggaagaaactgcatcaactaacgagcaaaataaccagctaacatcataatgacaggatcaaattcacacataacaatattaaacttaaatttaaatgacctagatgctccaattaaaagacacagactggcaaattggataaagagtcaagacccatcagtgtgctgtattcaggagacccacctcacatgcagagacacatataggctcaaaataaagggatggaagaagatctactaagcaaatggaaaacaaaagtaggcaggggtttcaatcctagtctctgataaaacagactttaaactaacaaagatcaaaagagacaaagaaggccattacataatggtaaagggatcaattcaacaagaagagctaactatcctaactatatatgcacccaatacaggagcacccagattcataaagcaagtccttacagacctacaaagagacgtagactcccacacaataataatgggagactttaacaccccactgtcaacattagacagatcaacgagacagaaagttaacaaggatatccaggaattgaactcagctctgcaccaagtggacctaatagatagttacagaagtctccaccccaaatcaacagaatatacattcttctcagcacaacatcacacttattccaaaattgaccacatagttggaagtaaagcactcctcagtaatgtaaaagaacagaaattataacaaactgtctctcagaccacagtgcaatcaaattagaactcaggattaagaaacccactcaaaactgctcaactacatggaaactgaacaacctgctcctgaatgactactgggtacatacagaaatgaaggcagaaataaagatgttcttggaaaccaaggagaacaaagacacaacataccagaatctctgagacacatttaaagcagtgtatagagggaaatttatagcactaaatgcccacaaggcaaagcaagaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaaaaaatcaatgaatccaggagccggttttttgaaaagatgaacaaaactgatagactgctagcaaaactaataaagaataaaagagagaagaatcaaatagatgcaataaaaaatgatcaaggggatatcaccaccgatcccacagaaacacaaactaccatcagagaatactataaacacctctacacaaataaactagaaaatctagaagaaagagataaattcttggacacatgcaccttctcaagactaaaccacgaagaagttgaatttctgaatagaccaataacaggctctgaaattgaggcaataattaatagcttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcatcctgataccaaggcctggcagagacacaacaaaaaaacagaattttaaaccaatatcactgatgaacattgatgcaaaaatcctcaataaaatactggcacaccgaatccagcaacacatcaaaaagcttatccaccatgatcaagtgggcttcatccctgggatgcaaggctggttcagactacacaaatcaataaacataatccagcatataaacagaaccaaaggaaaaaaacacatgattatctcaatagatgcagaaaaggccttcaacaaaattctacagcccttcacactaaaaactctcaataaattaggtattgatgggatgtatctcaaaataataggagctatctatgacaaacccacagccagtatcatactgaatgggtgaaaactggaagcattccctttgaaaactggcacaagacagggatgccctctctcaccactcctattcaacatagtgttggaagttctggccagggcaattaggcaagagaaagaaatacagggtattcaatcaggaaaagaggaagtcaaattgtccctctttgcagatgacatgattatatatctagaaaaccccgtcgtctcagtccaaaatctccttaggctgataagcaacttcagcaaaatctcaggatacaaaatcaatgcgaaaaaatcacaagcattcttataaaccaatgacagacaaacagagagccaaatcatgagtgaacccccattcacaattgcttcaaagagaataaaatacctaggaatccaacttacaagggatgtgaaggaactcttcaaggagaactacaaaccactgctcaacgaaataaaagaggacataaacaaatggaagaacattccatgctcatggacaggaagaatcaatattgtgaaaatggccatactgcccaaggtaatgtatagatacaatgccatcaccatcaagctaccagtgactttcttcacagaattggaaaaaactactttaaagttcatacggaaccaaaaaagagcccgcattgccaagtcaatcctaagcctaaagaataaagctggaggcatcacgctacctgacttcaaactatactacaaggctacagtaaccaaaacagcatggtactggtaccaaaacagagatatagaccaatggaacagaatagagccctcagaaataataccacacatctacaaccatctgatctttgacaaacctgacaaaaacaagaaatgggaaaaggattccctatttaataaatggtgctgggaaaactggctacccatatgtagaaagctgaaactggatcccttccttacaccttatacaaaaattaattcaagatggattaaagacttaaatgtcagacctaaaaccataaaaaccctagaagaaaacctaggcaataccattcagaacataggcatgggcaaggacttcatgtctaaaacaccaaaagcaatggcaacaaaagccaaaattgacaaatgggatctaattaaactaaagagcttctgcacagcaaaagtaactaccatcagagtgaacaggcaacctacagaatgggagaaaatttttgcaatctactcttctgacaaagggctaatatccagaatctacaaagaactcaaacaaatttacaagaaaaaaaaaacaaccacatcaacaagtgggcgaaggatatgaacagacacttctcaaaagaagacatttatgcagccaacagacacatgaaaaaatgctcatcatcactggccatcagagaaatgcaaatcaaaaccacaatgagataccgtctcacaccagttagaatggcaatcattaaaaagtcaggaaacaacaggtgctggagaggatgtggagaaataggaacacttttacactgttggtgggactgtaaactagttcaaccattatggaagtcagtgtggcgattcctcagggatctagaactagaaataccatttgacccagccatccctttactgggtatatacccaaaggaatataaatcatgctgctataaagacacatgcacacgtatgttcattgcggcactattcacaatagcaaaaacttggaaccaacccaaatgtccatcaatgactgactggattaagaaaatgtggcacatatacaccatggaatactctgcagccataaaaagatgagttcatgtcctttgtagggacatggatgaagctggaaaccatcattctcagcaaactatcgcaaggacggaaaaccaaacaccacatgttctcactcataggtgggaattgaacaatgagaacccttggacacaggatggggaacatcacataccggggcctgttgtggggttgggggaggggggagggatagcattaggagatatatctaatgtaaatgacgagttaattggtgcagcataccaacatggcacatgtataaatatgtaacaaacctgcacgttgtgcacatgtaccctagaacttaaagtataataaaaagaaaaaagaaaaaaaagaaaatgcatccttgctgattatggtaatccacatttggtccctcccacattcacagcccacatcctctcaccatgcttagcaaagcctggaccaaacagcacattaagggcccactaatacaaatagtcaggtattgccagattattttatgcaaagctttagaaatctgtgtttaaaaattaacaaataacaaaaacctccttagttgagaacccctgctttcaacagtgttagcatctctgttgagaagaattagccattacaaggtataaatatatatatatattaaaattagatatatatatgtgatgtatataatatacatatatatatttgagacagtttcaatctatccccgaggctgtagtgcactggcacaatcacagctcactgcagcctcaacctctgggctcaagtgatcctcacaactcagcttccagaatagctgggactatgggtgcatgtcaccagcctggctaattgttttcaaattttttgtagagaagaaggtctcacaatgttgcccaggctggtctcgaactcctgacctcaagcaatcatcccaccttggcctcccaaagtgctgggattgcaggtgtgagccacagtgtctggcttatatttcttatttcatgagaaagaaacacttaacattgaaaaattggaaggtaaatttaagtgtaaatataaaatatgagactcattcatgatccctctacaaataggtagcccatgtttatattttggtgtattttgttattttaggcatagaacatgatctgtgcacaaaactaaaagaataaaacatgggaatttgggttgatgttggtttaatccttttcagtagtggagagaaggatgtgtttgattgtttacaggtaggaaaagaaatatgtcaaccaagtgtccctttcttttaatttgtgccacagaacaatgcatagttgtaattaaaaataaaaatttttattgacatgtaattcacatgccataaaagtcaccatttttaagtttacaattcaggaaaaaaaattttttaaacagaaacaataacttgattgtttattaacaccttttcatgttgctgtgttctacaatatcagttttaatgattttatagttttccattgacagtattaaaataatttaatttgtcttctatagatatttaagttgtgtcatgttttcactactacatacaatatttaaatcaatatcagtgtaatgttatctttcatgtccatttttatttctatgttatacattctaccacagggaatctgtttcaacaggcatatacatttttaacctaaagaaaaaataagttaaattcttaggttttattttcaaaattgccaaaggcttttgagaaaaaggagagtactaaataaatgatacacacacacatacacacacacacacattgatagatgatagatagatagatagatagatagatagatagatagatagacagatagacagacagacataactgaaactgaacagatcctaaaactgtgaactgatgtcgcccaagctggtctggaactcctgtgctctatatactatagagggtaggatcttataatatccagtactaccttggggccaagtatttgataagacagagtatgaagtcaggaatatctgaacgaatctaaattttggctcttccactaactagttgcctgatttggaacacattccaattttctcatgtataatatgtgctatggtttggatgtggtttgtgtctgccaaaacttatgttgaaatttaattggcagtatgctggtcttgggaggtggtgcctttcagaagtgattaggtcgttaaaatagatcaatgtattttccacaagactggttagttcttgcaggaatggaatagttccagaaaaagtggcttgttactaagcaggttgttacacactccccttctcctgtagctcctccaccacattgtgtgacagcacaaggtccctgccagaagctgaacacatgttgttccatgcttcttagccttcccagacttcagaattgtgacccacgtaaatatcttttctttagaaattacatgaactcatgtattctcatgtattctgttagggcaacacaaagacaacatcaatatcaaacaaagccatttctgaaacacattaagtactctaaaagtgatgcttggtttttttacattttagtaataataatcattagcacattattattaatgttatttaactatatgctttccaaatataaagttatattctgtaaggatatatatacatatatatacacacatatatatatacacacacacacacacacacacacacatatatatatatatatatatatttttttttttttttttttttttgtcagtgtctagctctgtcgcccaggctggagggcagtggtgcgatctcagcttcctgtaacctccgcctcccaggctcaagcaatcctcccacatcagcctcccaggtagctgggactacaggtgtgcaccacgatgcccagctaattttgtatttttttgtagagacagttttgccatgttgcctaagcttgtctggaactcctgagctcaagcaatccccccgcctcggcctcacaaagtgctgggattacaggcctgagtcactaaacctggcctataaggatattcttatatggtgtttagcatgaagaaattcttggaacaaatccatctactttgttacattattttctatgggccagtctttcaagttactaatgtaatttttgtgagtgaactattagggggtgattattaggaaatgaaaaaaaatttaaatatggcttgatacctttaatatgattcaaaagacataatttctaaagcagaagcagaaagccaaatgagataatagattatgatatgaaaatgcaacttcataagatgaaaaggaaggtccttgtaagaagaaatacttgcaagaaaactaaaaacatataaacggacttaagacaccattggagtcaggtttgaacagagttattaatgctgcaaactaagtcaatgatatagagacatatggcagccaataatatatttaattttttaattgatgtttataatgaaattgacctttaattcaattatcttagactgttcttatctcagtttggtactagagctatagtgacctcatcaaataaattaataaacattccatcttcttctatattcagaaacaactcattaagacagggtcctggaattttggcagtgatcgtttgtgaagccatctgagcttaatgatttttcaataaaggaattttagaatatcactgcagtgtcttcaacagcttgggatctgttcaagattttatttattttggatcttaaagtggaatttaatactttttttagaaagttgtatatttatcttagatgttaaaatttgtggctgtacaattattcataatattttaaattttaaatctatatatgttttattttctttctgttctttgtgttcttttctttctttttccttgtttagtcatgtcagagatttgtctattatatagtatgcataaccatttattctttttgtgttattataagctatgacattaggttttgactttattgttttaaaatgttttatttaaccttattttttgctttcttttatattgtttttcgattgtttccctattgtttttcttttgatattagaaactgacaatttaatgcattttacgactgaaaattaagtctcagactttcttctttactgtaaaatgtagtcagaacgactattaccactcacaggtgctactaatttagccatattccttacttatctagtctgtgtcttcattcagccttaaataagttgtgatttctctcttcaaggatcattttataatatcatttttttctattttcatatctaattttagctatccttttgttgttttttaatctcactgcaatttggtaaaagaacataatcaatggtggtggtttatttgtagctgttttgtgccacgttggagtctttcaaatttactcaggctttccttgtggcccagtacacgcctgacattttgtgaatgggccatgaatattaaaaacataatgcgttgactgggcgagctggctcacgcctgtaatcgcagcgctttgggaggcccaggcaggcagatcacttgcggtcaggagctagacaccagcctggcctaccaaatggtgaaaccccgtctctattaaaaatacagaaattagctggacagggtggtgggcacctgtaatcccagctactcaggaggctgaggcaggagaatcgcttgaacccgggagaaggaggttgcatgaatcgagatggcaccactgcactgcagcctgggtggcagagtgagactcctccattaaaaaaaaaaaaatacccataatgtgttttgtctgttgtatctatctatctatctgatttacctaccaaccaatagcgctagctccatattagataatataatttgtcatgttattcatattttctgtctttgcatatttctgtctagtcaggttccaagtggggtgtactgaaatatagaactgtaattatgaatgcatgttgttctcaatgtatttatataacttgatgttttatatatttgagactatgttgaatgatcatagtgacgtgctggatcaagtttatactattaatagctcacaagagccaattgtttattttcaggaattttatgagccagttgttacacataataatttttaaaaattaaattatattaatttatgattaagtacagtatagtaaaaacaaaggtaataccaaaatccatacttcctattttactacatttacaaagaaaaaaagatatttttacaattcacaggtctgccagacaccagcttattcaaatgatcaagcacagcatcaccaacagtagaacaaactaaccttaggtgtctctctagtggtgcaatgagactaactgacaacgccttggtagaagcatctgtgtgtctaaaatcaatcttatctagagaaaagagatagatatgaactgttacactatagactaccagacaaacctatcctaaaaaatatgaggtagtaacttcctgtggttttattttccaccaccctattgactaatgatgctgagctcccttgttttgtgaggttactggccattcatatatcttcttttttgaaccatttgtttacattattttctcatttttaatgggttgttccttttcctattgctgatttgaaggagttccttagtcagaggtatgcgtacttctttgtcagatgaaccagagtggagtgctttgttggttatatgtattagaaatatttttccccagtctgtggcttgcctatccatttttgtcatatgtctttcgatgagaagatcttatgctcctagaacatgctcccgctggtccttgattcagactcagtgtataatttctgtgtcccaggctccaaaccagccctttctctacaaggtttgactccttcccacccccaaagataatgctattagaacccatgttctggaaactagatgttcttgttacaatttcatttaatcctttcagtgtaaagaagtagaaaatgtttaaagtttagaaatcgtgaatttatgttatcactgctaattctattgcaataacacagagattttcctccccttccttaattctatattggcatctcttttctctcattgagaacattggctccaaaatacaacagtatatttattcatttattctatcatttaattcatacaaaatactttcagaattaatatattcattctctctaccaacaaaaaacctgctgtataaagtttaaactttctttctaattaattttgagactgaattctgatcaagtataacctgaaaccttcttttattctggtgtttgtattatacatatatattaatttgtttttcatcgtattcaatttcaggagtttcttttttgcatttgccttaaatttattttgtttttgaatatgtgaaacatctatgtggttcccaagtcaatacaatataaaaaggtaaactgagagcctcatttgccttctacattcctcccactgacccatctacaagtacctatttaaattagtttttgtgttgttatttgtgtttcttaataaatttttttaagtgtgcataggtacatgcataacacacataaaataaatctgattatgcatatgataatctgaagctcctctcttttttctatggaaggtttactctatatacctttttacactgtaatcttgctttgttatttgatattatatagtggaaatcactctttatcagttcataaagatcatatatactctttattttttaatgcctacacagtactgtactgtgtgggtataccatagtttactcaccttgaacgacatgtagatttttccagtgttttattaccaaaaatagtgctgcaatgaataaccctgtaggaatgttgctttgtttctgtgcattttttaatactgataaatctttactttaaaaaatggccttatcactactctcaagagcccacaatatttcaaaaattacctcattgatatacatacattcaacattgcctattagaacaaattaattggcatactcctttgaaatctgtctaaagtaaataaagatatatgatgtgaataaaactagtcatcatactagaacgtgatttgctatttactttgttacatatgcagacaaattttcatgtgagaatattattccagccacacctaactcttgtttttatgatttttctgggaaaaatatggtccaaattctaacagtatctttttaaaaatatcttttagacatgtttaatgctaatttgcagtttcttgtgtataattaattaccaggggatccataaacatggctgtatacagaaatcaaacaaaaccttaaaaaaaaatacaaattcctgagtctcattaaagtatgcagaatcggaccacctaggtctgtggattgagcagttcatttataccacatttggtaactcctatgtggtaaatatagggaaagggactagaaaattagataaattgtcacaggcagaggtggtcatagaatcttcctagacatggtgacctttggttgggttttgaaagcagagaaatgaagcaggggaatatgcttctttttaaatatgtccacaaatttttctacctcttccccattcaaaagtggagtctaattcacactccacttacgtggagttttatttagccacttgcttctagtgagtagagtatggaagaattaatggaattagtcttccaacagtagatcgtaaaatgccctgcagcctttcagccttttagattattcactaaagggaaagtaggctgtcttgtgggatcctgtggagaaaccaatatgataggagctgaagacttgtcaagagccggaggaactaaggcttcctttctacaactatgttggtgagccagtgaggaggtggaaccttcagcccaggcgagcctttaaataactgaagatgcagatgacatctggactgcaacatcatgagagaccttgagccagctgttctcatgactggcccacaagaaaataagattaagacaatgtgatgttttaaggtgctaagtatttgggtaatttgttatgcagcaatagaaaactaatgcagacagtcaacagggttttcagtatgtggggagtttgagagaatggatgtcatgtaagacaaaggaagaatatattatatataactcctataattattcacaacatttctgacatcaaatgtatgggttttctacaccaagtaattctccaattccctgctgtcaccaagtgggtatcctacaatttaattaaattctgacactatccagagtcagtgctgacaccaaaggtaaagagatcagtcccacaagactgccctccacttcagatgccagtcacaaatagtgggtcaccaggttacccacacttctgtctaccttgcctacaaatcagaggttcccattacctcctcctcgggttcaataatttgctatagtagtagctcccaggaaggtggttactggtttatcataaaggatagaaattaacagccagatgaagagctccatagggcaaggtctggaagggtcctgagttcaggagcttctgtccagtatgatttgagatgtgctaccctctaggcatgtggatgtgttcgtgaactagaaaactctctgaacatttttatttaggagttttatggaggtttcattacataggcacaattgactaaatcatcggccattggtgattgaattcaatctccagcctctctctcattcccaaaggttaaggattagggctgaaaattccaagcttctcatcacttggttggttcctctggcaaacattcctcatcctgaagcaatctaggagccccatcaagagtcatctcattagcatgaactcaaatatcacaatgtcgtaatatacaaacataacactttagtaaatgagaatagagcattaaagttaaatgacaacaaatattgaactagtgacataatatatgaagtctaacagagtctaaaattttttgacatttgtgctctttgattatataagtacctacataatgtcttcaattttgtctctttaaattttttttttattttattagcttttgggttacaagtgtttttttttttttttttctccacagatgaattgtatagtggtgaagtctgagaatttagtgcacccttcacctgagtagtgtacgttgtacccaatacatagttttgtatcctttgcctccctcccatcctctgttttctgagtctccatagtccattatatcactctttatgcctttgaataccaatagcttagctcccacttataagtgagagcatatcatatttggcttttcattcctgagttacttcatttagaataatggcctccagatctgcccaagttgctccaaaagacattatttcatttttttatggctgagtatttcatggtgtatatatacaaaattttctttatctactcattagtcaatgggcacataggttggttccatatctttgcaattgtgacttgtgttgcaataagcatacgcatgcaggggtctttttgatataatgatttattttcctttgggtagatacccagtagtgggattgctggagcaagtggtagatctacttttagttctttaagaagtctccatactgctttccactgaggttgtactaatttacattctcaccagccgtgtataagcattcccttttcaccacatccaagccaacatatattattttttgactttttaataatgtccgttcttgtaggggcaaggtggtatctcattgtgctcatcagcctgacagcttgtgatattgagcattgtctcgtatgtttttggccatttttatatcttattttgagaagtatctgttcatgtcatttgcctactgtttgatgggaatatttgtttttctgttgctaatatatctgagttcattgcagattctggatattagtccttcgtcagatgcatagtttgcaaatattttctctcattcagtgggttgtctgtttactctgatgattatttcttttgctgtacaaaagctttttagtttaattaggtcccacttatttatttctgtttttgttgcatttgctttcagggtttaagtcattaattctttgcccaggacaatatccagaagagtttttctaggttattttcaataatttttatggcgttagggcttagatttaagtgttttatcctcctagagttgattttcttatgaggtgagagatagggatccagtttcattcttcagttggctagccaagtttcccagtatcatttattaaatagggtgtcctttcccgtttgtaaaagctaattgaaggaggatttttactatgactacaatcaagaaaatcattatgcaattctaatgatgatacgttcaagaaaggtacccatagaaacagaaacaacactattttaaggtatgaaaacaaactagggtcaatatggttaaagagaagccaaaattgaatggaagttgatttggaatttctcattttggaggaaagtatatggtgtattaaatatttattgttttattaatttaatattttcttccaaatgaaaatctcaatatttcatagactaatgtgcagaaatggttatagaacaagtttaaaactctatttgatattttactgagattaggtactattcgttttgcaactaagtaagattaaatcatttttattacttttttaagtagaagtccaactaagccacaaatatgcaacaacaaacatcttaactgctttttctttaaatgagattgtgaaaacatttcccaatatacttaaggttttttggttccatttttgaaagagggttgtttttctgactaaaaaggctttcaaagataattataagcacttatgctccctttttcttattagagatcttagacgggagatttaggagaaattatcagtaacagcacttgaagtatcctgaattgaaactcagttagctgagaattttgactaatttattccctggtcccacttgcatgatggatggttttttacaatatgttgatatttttaaggcaatgccagatagtggaataattattatcagatgaaaacccacaattgtgttgtgataagatatttgtcatgaaaatcatacaaatgcatgttgaatataaaattgtcttaaatgagttgagtgatcattttataagaaagatagattcatttaattgagccctgcttggggaaagtcaatacagagattgccaatataagcaattacatgttaaatggaatttgtacagaacatcggagcgtagattttgcctttcaatgtttttgcataattgcaaatgattaccttccaaagagacaacttgagctgcaagtcatggaaaacgtcagtgcttcttattgctaacaggctcaagtgagagctttaagtattggatggtaacaatagaatcaaaggataaagagaacagtgagagacaatgttcaggtttcttgcctgacatggaattacatttaatgattgaatgaatatgcttgttaaagaaaaagcttcttacctcaataacttattgcaatttttaaatttcctatcatgatattcttctatgccttgagtcacttatattacatcttcttctacctctgtgcttcatgaaaaaagggagataatttagttcctatgttagatggctaccagaaagtcaatgcatcttgtaaaatctagaataaataaattccatattttttaattcattgaggggcacagattaatattcaagaattgtttacatggcttcttgtttcattcatttagtaagtgttgagtattttgtagttgctatgtactaattcccatactaggtgctaagatggaatttatccaaaaatgtttgaaaagcaaaatctacagtaaaatgtattgaactctaaaagtatgaatacagcacactctccatttccagggtgccttacagagcaagagaggagaacaacccccccccccacaaaaaaaatcgatactttttatcttgtataacaagtcctctgatagaaatgttaaccactctacatctacagtactaattatacttctaatttgtacttgcagataagaagatagagtctgagtttaaaaaaaagggaatattcactctctcctgtagtactgaacattttactcaaatgattaaaggaggctttttctttaaaaatttcaaaatatcattgtatttcattccaatatgcaaatgcagattaaaaccttttccaagagtatattgttcttaaatttctggaaaagtttttgagggtcatgagagctcaagggaacaactaaaatgtagaatcctttaaataacaacagatgtctaagtattttatctccttttaccacatgaactatttgctgacttctgtctgtgtatcttcaactagtatttgtaaagcatgtagctgattaggtcaaaggaacttgaagttttattatttatgctgaacataaattgcaacataagtctggataggatgtgatttacaacattaccatagtaactacagttgatatttttatatttaggtttgttgttgtattgcctataatagatttaaaatcccaatatgttttaatagaaaacagaagtaaagtatctacatatcaaatcacaagagttaattgcctggtctgaagtctatggaatagggctagaaatgattagaaatatttatgtgatcttccttataactagagagaaaataggcagaaatagggattctaaatcaataattctgaaaatgatacaaatagacagttgttcccaaagaaatatgtaggtgacgtgaaatctggatgagcatcattctgctaagtttggcccttttctagttgtcataaccgctgatgcaattggcatccacacatcaaagcattctcatatctgttcacctccagtctaaatgaagctccagtttattctcattggcctatgcagcagaaaaggagtggatatgtggcaatattccgatgtattatgtcagcataagcaggtaatttggatgtaatcccgaaaactcaccccttaactaagaagttgtggagtagatttgtgtctatttgttcaaatatgttactcactgtccaatcagcctcttaatttggagcataaagcctatgatctgtggagaattagaaattgtttgattgtagatactgtacagcaacagctctatactctagttctaaatactatactaaggaaattagaggtcccggaaaaacaagtacaaggctattcctggattgttatttactccaatacattattgcaactacctaagattctggtactagaaaactggtaggaaaaattgtgatatattcatatgatggaatacttatgcaaacatcacactatgtatttttaaaatagttcattacttgggaatatgttcattacataatattaaatgaaagtggaaaacacaatctgatttaaatttgtaaaaataaaactgaatatggaaatatgagtatacatttaaattcaacacttttctgaacaaacaatatataccagattgttatctttagttgatgtcatgacagctgatttgtattttatttttgtaaattgtgagtgctaggtactctttctaaagtgatcacataatgttttaaacaaattaattattaacaaagtggaggtatatagggatgttcgagtaatttattctacagaaacattcaaaagtcctgtataataccaaataagaaagcatatctgatatacattgtctaatgctatagagaccacacaagagtaaaccataattatcccaggcaacatttctttccctagaaattcaacagctgctggttttccagagtcatataaaaatgtattcttcggtgataaacaacaaattaaaatttaaatcacatcagaaaagccaaagtcaatttggctgaacccttccctcattaatttggtcacagtttgggggaaatagctcctaagaacatttgagaagaaactcccaaatgcccaactcctaaagtgttaaatcaggattgcagttgaattagaggcaccatccttgatctgcatttcctgacaagttttatggtgtgcttagatcataaaatatttaaatctccccagtgcctgataggttgctaagagcaaaatagttgctttaaagaaatatacactgatgcatagtgattgcaattttcactaaatgaaatctatctcagcaggttgattttgtcactacgtcttattctcctagactctcttatctaatcaaagtaaagatctgacctttcacacagtactagatccaattaatgctttgtagttgctacatctctatggagaccctcgatttctacttgtttgtactgattcactataagagctataacttacattttataattaagaaataaataacaggatccttggtatttatccaaatgagttgaaaatatgtctacacagaaatctgcacctgaatgtttatagcagctttattcataattaccaaaacacagaagcaactgagatgttatccaatagaggaatgcatttttaaaaactgtggtacatccacaaaatgaaatattatttagcaatatgaagaaataagcaatatgaagaaaaaagaaaaataagaattttttttcttttgctaagaaagagaaaacaatctaaaaggccacatactgtgtcattcctactattctgggaaacacacaactatagaggcagtaaaaagatgactacttctcaggggttaggggcaggtaggaatgaataggtatagagctcaggatgtatttagaatagtgaaactattctatatgctgttataatggtaaatacatgtcattgtacatttgtataaaaccatagaatatagaataccaagagtgaaccctaatgtaaactatgggttttagttaataaatatttattaatattggccctttaattggaacatgcaccatactaatgccagatgttaataataggagaaactatgacaaatatgtgggagaattatatgaaaaatcttgtaatttatgcttgatttttctgtaaacctaagactaccctaaaaaaggacaatctatgaaataaataaataaaaggaaaggaaagaaaaagaattgagaaaagacccttttatgtctattgtgttgtacaacaagtaatttagggctgaaataaactattggtgtttgtatatttatcttattttaataatttttaactcatattctgctattttattaaatagttatagcatttttatataacgacaattgaatgtctttttacacttcaaatttattttatctttcccctctttcattccattcttcctccttctccctcctcccttcctttgttccttccttcattctctctctctctgtctgcaatattttgttttgtttttctataatgattttgaaatgtcaatgacagaagtaattttctttgtccagtgcattttaggaacatgaggatgggaaatatcttgagttaagggattgagctttaggttcatcatgagtattacaataatctatatattattcctaaatattagatgtataaagtactgcatcaaaaactgatagtaaggagaatatcagaaatattataaagattgatttatactggtacattaaaacacaaagtacatttttatgtggatgttaaagaaaatatttttataggaaaaaggtgaacaattatggactagaaaagttgatatataagaagatagaatgtactatcataggtttcatagtgacattttgttaagtaatatataacttagtgatgagtgcaagaaagggaaaccagtggcttgtaagaccgagggttggatttgaaagttcacacgtcgtcaaaaatacctgatatattaaatccatctgtgctctgaaaaatcaaacaaataataaaagaggggaaaaggaagaatctgacatcaaattcaacattttagggagttctgcaaatgggtctacatgagaaacacgcttctggagaaaaagaaaaaattttgagaagaaaccaaacaaacaaaaacctttaaatggctaccttctaaggtgaagaaattccagatcctatctcagggagaaatgggtcaaaaaaagggggaaaaaagagagagagagagagagagagaaagagagagggcctctaatgtggtgctgttaagaaagtccactgttgtttatgttcactcacactattattttagggaagcatccttccattcctaattggataaaagatgtctttcaatagaaatatcttgtcttcatctgttttgtgttgctataacagaatactgcagactgggtaatttataaagaaaataagtctatttctaatagctatgaatgttttgaagtttaatttcaaggtgctggcatctggcgagggtcttcttgccaagtcatcccatggcagaaggaggaagggcaattgcccacaagacagcaagagagagtcaaacttgtatttataacacgcccaatctctccataactaactctctccaacaatgatgacattaatcccttcatgaaggcggaggccttatgatctaaccaccacttattagagccctacctcccaaaactgttgcactggggattaagtttccaacacatgaactttgagatacacaattcaaaccttagatatttccgtaatcaccaatcaaagtcataataaaatgttccttcattataaatcaagataatctttttaaaaaatttaatctatgagcataataaattgttattaatacaattttgctgaagttgaatcatctttgcacatctggaattaattaattcctggtacattttttaaaacatgctgcctatttaaattttgtttactttctttatatctcttataagtgaggtatatcagtggctttcctttttctgctaccttatcaaatttgagatgtggctatgctaatcttattagatgaaaacaagagcttactctcttttctatgccattgatcaatttaaataacacgagaataactcattcctcatagatttgatatatcttgcctgtcaaaacattaagtgacaaaattctccactccttgtggttaaggaagatattttcacatacttaccatgatcatcccttcaaaaatctcttctagaatattttcggagaattaagatcctgcttaccagcatctttccttcttacacatcctaaccacatcagcccttttaatgtccattatttcccaaagttggatgacggaaggatcaaattatttttgtctcataaatcatttcctaagaaccgatagtataaaactaatttaaacttgtacattgaagactggcaagaagggtgactggttatgtcatcaaaataccagttacatttttaacaaaagaattcaatgccttcacttcaagaaataaatgactataaagtgatatttgagaatttataacatgttttaggtgaaacgtaaaggtagagaaaaaatgtttggtcgggagatggctaatcagacataggtagagggaaaggcagccttgctttctaatatattaagagtatttcagaaacaggattattgaagatttctttattttatttttaaaacataccaccaatatttttcattttgctcagctagcctaatgctgactgtttctccaggatctcttctgttaggtgaaaaatggaatacatatggggtgaggttggcgggaaggaataatagaaaccaaagcagaatgaaatgcaacaaaaccacagaaactgtcaataaaaaattgcaccagataagttaaagcagacaaagaagacttcattcaggactattacaatgggaaacagagatggaatgcaactcagttgaaccaaaaagtgggaaagtgtttaagcactggaagagttgtgtgtttgctaattgatgcttattaaagttagagtcctactttcctacatactaggagaaagggctgaacagaataggtaacccagaaataaacccaaatacttaacagccaagtgatttttgacaaaggaaacagaaacataaactgggggaaaggacaccctattcaacaaacggtgctggaataatttgcaagccatatgtaggagaatgaaactggatcctcatctctgaacctatataaaaatcaactcaagatggatcaagcacttaagtgtaggacctgaaattataaaaatgttagaagataacatcagaaaaacccttctagacatcgcctcaggcaaggatttcatgaccaataacccaaaagcaaatgcaataataacaaagataaatagctgggtcttaattaaactaaagagatttgcatggcaaaaggaacagtcagcagagtaaacagacaacccacagagtgggagaaaatcttcacaatctgtacatctgacaaaagactagcatccagaatctacagcaaattcaaacaaattagcaagaagaaaaagaaacaatcccatcaaaaactgggctaaggacatgaacagacaactctcaaaagaagataaacaaatgatgaagaaacatatgaaaaactgctcaacatcactaatggtctgggaatgcaaatcaaaacaacaatacgatacgaccttactcctacaagaagggccataatcaaaaaatcaaaaaataatagatgttgacgtggatgtggtaaacaggaaacacttctacaccgctggtgggaatgtaaactagtacaaccactatggaaacagtgtggagattgcttaaagaactacaagtagaactaccatttgatgcagcaatcccactactgggtatccacccagaggaaaagagataattatatatatatatattatatatatcacagtttctttatgcacacattgattgatgggcatttgtgttggttccagaattttgtaattgtgaattgtggtgctataaacatgcatgtgcaagtatgtttttgacacttcacaattgtgaattgtgctgctataaacgtgtgtgcaagtatatatatatatatatataattgaatactactcagctataaaaagaaatgaattaatggcattcgcagcaacctagatgagattggagactattattctaagtgaagtaactcaggaatggaaaatcaaacatagtatgttctcacccataaatgggagctaagctatgagaacgcaaaggcataagattacacagtggactctggggactcagggggaagggatgtgaagaggatgagggaaaaaagactataaatcgggttcggtgtatactgctcgggtgataggtgcactaaaatctcacaaatcaccagtaaagaacttgctcatgtaaccaaataccacctgttcctcaaaaaacctatgaaaataaaaaaaatctaaagcctacggaaacacacacacacacacacacacacacacacacacacacacacacacaaagaaagggcccaggtccttgggaaaagcattcctgggttataaacctggcaggtggctgggagaagatttacatctcaaacgaccagataaataatttacaatgtaaaattatctaaactaaatgctctaagaaaagagaggtcaggagcttcaagtcaggaagaagcttgtctcaaatttagccaagcttaggggaatattaaggccttttgatcaaaaccactttatacttcttgtgacctcttcatcaagtgctgctggcttactttcatagaactagggtttgggagacatttacttttctgaattttagttttatttatttaatcatccactcattcattttcagaagacactttcaaattgggcaatgcttaacagagacttacaaaggtctctaattttctcaagctcctacttctgaatacattcaaaacttcagatgtaagtttattaaatggccttagcctaaaatccacttgggaaatggaatttgtttctttctttttaactaagaactctttaataagtctgatcccacaaagaattctctagcttgtttcttacaaaagagtagaaggaacatattactttatatagtaaaagaaagcattttggccccaaagatagcaactttattaacagcaaacaggtgtaggaaaaaataaaataaatgccctactactgatggcgttctctatatgtctgttgagaagaggacaactggaagagtgtgaatgacggggctttagttactgaaatttgattatggggcaaggttctggaaaaatcttgacttgtgctagtgtataataataataataatagagcaaacaaagatagaaactgtacttcattgaaggggctgtgaaatagaatttttaaagtgttcaaagaaaggctatttgcagaactttattgatgttgtcaagtaaaaagttagcagaaagagaagaaaatgagaaggaaagcaacttgtaagccactcatgaaacctgttgtattagtttctgtttctcctacactttctgtgctcctgtcccaagcattttctgtattctgagcccaatcctctcaatgaaaagcaaaaagagatatagattccaaagacactcatgccaataacaagactctaatgtcattgaacctgaagtttttctcttgacactagcatgaatatagttgacatttccttaataaagagcactgctttcttcgtaaaaatgtgtaagtggaatgccaatgtggtacattttttgactaaaatgaacaacaggaaattgggatttgagaatttataagaaaaggtgtggtaaatgtcacatccccagatcaccctgcatacgttctagtttacatgttctctttttgctgatgtctaatcataatggcatgacatagggtggttgagggggaatcctgtcatggtgactttgacatcccctgagccagcggagcattttgtggtggttgaacttttattaaattaattgctcaatgcaattcgcatggggtcacttggggtacagacaaggtctttattacataattcaaggtagtccttaataagaaatcttatttttgtactctttataattaagattctagatgcataagagaaaatttttgttgtagggaacactaagacaatgtactaaggctctttctgttctgtattaatctattttgaaacaacatatctttcctaagcatgataatttcactacaacctatggttataaatactcataagtattaataattcctatggttataaatgctcataactattaatatttccatagatcaatcaaaattcttttccaaagtcatcgtgatattatttagcaggatgaattcttttcccaaggttaatatttagacatgaaattttattccctcatatttatcaatcagttctagtgaggaaagggaaaaggcaaggctgggattatacatttttaaagatactctaaatatggccaataaagagttggttcttcctatgggtacacagaacaacaatatgataagaaaagttgaagaaactttttcatcttatatagagcatcccaagtgtttctggagaaaacaacacagtctgtcaaagcatatgtttgaagcttggttaaaaatgacatatacattctaatcctgggatgacaaattgatgaagaattttagatgtcactcagtctaagtcttatattaaaaaataaaatacttttattggtaattattgctaggaatgataattggcatatttaagattagaagattacaactcaaacctcctggctgtgattgcagcatattttccattacaccagactgcctgttgtgatttacattcaaaacaacttttcgaagcaaatgatggaagcttacagatgactgaagagattagtccctgttttatcaacttccctttcacttctctagcaaaattgagctggcatataggggctattcaataaatttccattattaaaatattagcataatttattattcacaaatgagcttctcctgtgagcacagagttactccagtctcgaactaatcataatggggcaggaggcttcagtactaacaaaaagcatggatcagaattataccctatgagctcctactttggttctaacatcctctgaaataattctctctgctttttattttaatattgtgtttaaactatttttaaagccttttattttcatggatgcttgtcttactaatacagtgcattaaacagttccttcctttctcctcaaatccctcaaatcaggattaacttgttgaattagaaatgcgtcacttcctctgtgacttgcaaagtatctgccccgattacatttggtaaacaaaatgaataaatcggcatttcagtggtgttcttgaatttaattcatcctggaactagcaaaataaataactgttttgtaatatattatatataacatatacccgcagatgaagagtgtttggcattaaggtataatacaacagaaacagtcacaggaaagattgatttaaagatgttgaagagagttcaattctaactaacaactgaaatcacaattttaaaaattcaacttaatgttccttttaacagagaatttaaaactgctttaattaggaacaaagctcggttaactaaaatgttaaatgtgtcaagtgctgtaagtttcaagtgaaaatagcacacaatttgaatttgcagatatcacagtaggctgcctgtgtcttttcagcttcttgaatgaaggaactcatcttaacccgagaggaacaaaccagaaaccagtttgttgttcaaatacattttggtatcaatttatgattggagacagtagagcatagtggttaagaaaatgtggcctctggaattagactacctgggtatgtctctgaaatctggaagttcaggtcttactacaaggtcagagattactcatctatagcaggtgttaactgtagatggctcatggaacaaatcctgctcactgcctgttcttgtagataaagatttattggtacacagtggacacctgctcatttatgtactatgtgtggctgcttttactctacaataacagaattcagtagtttcaacagagacattgacccacaaagcctaaaatattaattacttgcccctttacagaaagagtttgcctaattctgggtataacagtaattagacataggtttgcaagctgagtaaattcaatggttttgctgggaaggacttctgtagatttaatactaaaaatgtgcagaattatgttgaaaaaggttcataaaaagtagattatccaaaattctacttatttatattaaagctttattgaagcataatttatataccataacattcaccatggtaagcacatgatttaataatatactgtgccatccagttttagagtgttttcattacactggaaaactcctttgtacctgtttttagacaatctagtctcaaacaactactcatctccttttggtttctataaatttgactcttataaacatttcatgtaagtgcaatcatataacatatcaactattgcatctgccttctttcatttagaatattgttttttaggtccattcatgttgaaacattatcagtattttgttctctccaatattaaaatagtattttgttatatggatataccatattttatttattcaccagtcatggacatttgtattgtttctagtttggagcttttatgaataatgccactactgtgaacattcagtaacaagtctttatgtgaacaatatattttttcatttatttattttatacagattcttaaaaatgtgtgatctgctaaatttatgcgtatttttttcagaaattgccaaactgttttccaaagtgactgtatcacgttacattcccaggaacagcaaggtatgatggttccagtttttctgcttccccatcaacacttgttatttcctctttctgattttaatattctagtggatgtaaatgatatcttgttttcatttgcatttttaaacaacaaatgacgtttcatatgtttattaccactcacattgtttttggtgaaatgtctactcaaaatctttgccaactttaaaatttgatactttgtatttttaagttatagaatggttagagttccataaatgctagattcaaatattttatcagatatctaggtttatttttaacaactcatttcttcaggtcagacacagcccagagtagcaatatccttctgatttctgatagatggaacactgtgtagatgatgtgtagactttgaagtcagacagccctaggtccatattttattcctgctgttaccaccttgtagactctgactgagttgaatctcaaagtttaatttccttctctttaaaatggaattaataacacaaacatcgtgtgagaaattaataagcaagttcaagtcagcaacttacctcaaaatgaatagataaaacccaattcctcccctctaatacttatattatcttcggaagagaaagatgtttaaatagagaatgtcatcctgccaggttctatttttgaggtatttacaggatctagcagatattcaaaagaaggaaattgaacccatctaggtggggtgatcaggaagttcttggtggcataatatggatagtaggcattgttaaatactgagtggaatgagccaggaggaggagaaatgcaaagctaactctggtatgtgagtgtctttctttacattccctctgtgtttgattaccaaataaattttttatgtggaatttataagtgaattattttttagagagtgtttgttttctacccactgacaaagaagcggcattcatgtcaaggccgtcatggcaaatgagggctaaacttatgaagattggtcagttgcagtaagatttgtgaataatttgataataagattcagaatcgtttctgaaggatttgtaaataattgctagaagggttaggttgtaattatgcattaaaaagaaaccagagtaacccagtttccattattttctatttccttgcaatgatatagagctataaaaatggctggatttttttgtgcaatcagcagagaaagtaagaaagctaagaaacactggaaggcacgttaacttttttaggccaactcacaaccccctagtattattaatgaaactttagcacagcctagttgtgcatgtgttttgtgttaaattgataacaaaatgaaagtgtgataggcaaagcattaggggaaattctgggtgccatttgatatcctttttttaattcttattaggagcctgtcttcaaagtgtctttcagtttggcttaatgtgaaaaagaggagaatacttattttatataataatgtgacattatacgaaatgagaataaaaggatggagggagttcaaatctgggagaggctgagaagaggaagggtagcaaaaagccagatggaatgtggagagaagataaatcaggatatggaatgtatgcactcttcttttccaggtagtggtctttcagaaagtccagaagcagttcatatcctgacattacttcctctcaggagaattggaaacttatgtacaaaaacagtgttaccaggaagccacagacaatataaaatgtgtaggctcttccaagaagatttatcatcaattactatgaaatgcaaaaacaaacaatcacctgtaaggggaacgctggaaaaaactgtaaactgtcaagtgtggaattaaaaaaaaaaatccaggtaagtctcattcatgaacccttctctccctcttcagcagaaaataatagtatacatgaacagaagtagtgctatctacgggcaattttcagataagtcaaaattattagcatgatatgggaaagggatgggagagagaaagataatccaaaataaagcaaagaaaaaattttagttagtaatggaagctaaaacaaagaattggctgtgggaaaatatctgtgaaggtctatagggactgagatttcaactcccagtatagaataaagcacagctttgatggttatcagtttaatttgttcttgaattaaagtaggcttttctttcacttgtttccatggatccactgaactgggtagctgctagctagagtttcaatagggatatacagacacaacatttagattcaagtgaataggccatattatataaaaaacatatttggcagaaaaatctttatttgaaccataaagaatggatgagtttatgagataaatcaaagcaactatataataggtgatttgcatagacacagaagtcataacaaatggcctatgtttctttcaagatctagttcaaagaccttcccttgatctcctgatcaaaattaatcatccttcctcttcactctcactgttctctattgtaacaattatttcatgttccctttattattatatacatgctttatccttgaagacaagaactatgtctatcagagttttgtttgaccactatacacacacatgcatctttcccctagcatatggggtataatattgtgcaggtattggcagcatgaactctaatcacagagcaacacaaaattttgaacatggctcaccatgtaaatgttagattagattaactatacaaatctgagataacttacttagccttttaaattttgtttcttgttttgcgaatttggataattcctattgaaccagttgccacagggtgaattgagatatatttgtcccacctctttcagctgccatagaaagacaacttgaatcatcttacacaaggaagaaaaaaaaaaaaaaaagcagatggagaaggtggctttggctagggaaatgaaactgggaaagctctcagatcaaagaaaggattcaaggattccaggacactcctgggtttttaggtatattgtttcccccagagagatggggtctagctctgcagcccaagctgaagtatagtgacgcaatggtagctcaccacagcctcgaactcctgggcttaagcaatcctcctacctcagcctcccaagtaggtgagaatacaggtgcacacctccatgcttgcttatactttttatttttaatttagagacggagtcttgctatgtagtcgagtctggtcttgaacttctggcttcaagtgatcttccctcttcaaccttctaacgtgctgggattacaggtgtaagccaccactcccagctgagtcttcaggtatttctgaactcaactccagcagcaccattttcctgagctcctaatttccacattttaataaatgtcagctttatttcctcagtctttgtatatgtgaagggaggggctttcaaaacaacaaagaattcattctccctgtgaactctagcattacaaatgccaagaaaggacttcaggttgtctcactgaggccctgtgtccactcctggttataatcaggaacttactagaaagagggaagaaatggattcttagcggataaaaggcagtaactagaaagtgcaccccacaccagatgcttagcacaatgattacatatagtgaaagcttaatgagtggtgtcttttttaaaaataattttcatgaacaaccagtgaactctagataaacaatgattttactatctgcagtggcttatgcaatacgaatttgttacatgtatatctgcggacagggtgaaaaaataatgatctggattattatagtgcacatctttcctatatcagtaaattgcaatatccatcctaagcatacaagtttagcaattgattctctctagactgcataaagacccagtccacttctttccacttctgtggatacaaacccagactaaggcactgacatgcctcaatggattgctaggcttctaaataaattctctgctttcacttttttccttagtggctgatttcaccacagtaaccacagtgatcttttaaaagcatattcaactcttctgtttgaaatgagtgtctgctcattgcaataagaatttaatctaaatctctaactaggcttaaaattcttccgccatccagcctctgcctcccacggcaccctcatcccttactgctctatgtccctgtatgactagccttccttctgtgtttcaggaacccaacatactcccagctgaagatgttgacactgtttttcctttccagaatgttcttctttcagactgttatgaggctgcctcttttgtgatccttcttcagattgctaatgaaatgcgtcgccataaccaggagccttccctaatatttttggctaatgtaacacaccccgatctcatttcccattcccttcactagaatataaactcccagcaggtaagaattatagctctcttgtccactacattatccctaggcttaatatataggagggacttagtaattatatgatggtaatagaccaagggtgattaaagtagaaaaaagaaaagttgccagctcaaaactctcacattaatagatgttaaaacttggaattaagaaacagtctctgtagggctttgttagagagatgatttgacacactgtcattgagatgtgaggggtattgcagaccggataagtaagtggttacctgataaagtcctaagggaatggaacccaaattaaatatttttgaggaacaacagagaaataaacatcagatagatttaggaacctgctcagacttcttatcctgtgatttgtacaaccaggaaacagtataaagtaaaagaccactaggctccttagaaagaccacagtactaatatttaaggcaatcatggttcctaattttctggaaatgtagacattgaaatggcagaataacagcaggcttagtgttggaagaccagacagaggtagtcatgaccttgttgggtgaccttgaacaaatccctcttgtcactgacctccagttttcacctctgcaaaatgagggttggcttaacgacatgtagagcctttcctaccctaatatatatgagcctatagacttcctcacagaagcattcttcaaatataaaagaaaggtttacagagccttgggagtcttccttaaagtctatagggagtgaacaccaagaaaaagtatatcaattgccaggcagcttctcccaggtacaaactaggatggatgtggcagtaaccatcctgggactgtcctctttattttgtcagctcagtagaggataaacgaggaatgttaagatgaagtcatgggtgtgtgtgtgcttgtgtttttatgcttgtagattttgtgtcttttattatattggtttgaccttctttaaaaattaacaacaacaaaaggcagttttattttagggcttttaaaaaatattgttcatagtatctttgtcatagctcccaagaatctcaactacagctgaagctgcaaaatctttgtcttgttagctgcagatattactatcttaatgtgggttacagattctactacaagcctgaaaagaaccagagatccagcggaagaggttacatgcttaattcttaattcttgtatctgttatactttgagtgcaccaaagcagtgaaaattttccagagcaaactcagatatgccccagattttggaggacaggatctatccatcaagaatttcaggttagattccaatagccagtgactgagtctcacaagcaaaatgaggaattgcctctttgagagagaattccacagaagggaggcacctcgtgtgggatgaaatgaagcttgctattggaaacaggtcttcatgaagactagtcactacaaaagttttggtgatattagaaacagacactttaaaattccatctttatcagaaatgtttctgcttgctatttacaggatggaactgaactaggaaaagccaagggtaatggtcttatcctaatacaatttgcaaacctcactgttttcactgttctgtggccatttcaagacaggtttaaggaagtagatataaaataagtagtaagtatgattctctgtgcaacaggttagaagataaaaaatatatatatatttgctactaaagatttaaacagaggtcctcaattttttagcatttagacagcaattttttacagatatgtatgaaatgttcaaccctccatgtgagaggaaactggaatactttgccccaaaatctacttctttggcatatttcaagacggctattcaaaggggctacagacagtagaatagctctgaaaagctgtctttttgtgggagggattttcatctgtagaggaaatctacattagtgaagtaaagaacagatgcaaacaggctttctctgagactccccttatctgccttgtctagatctaggaaagattaactcacgggaaaaggagacctaatagtctgacacttttaaatgtctgagagagaaactttaactacagcctactgtttatcctttctcctggcagctcgaagattacctgagaggttttcatctgcataacaagacagcctttgcttggcatgccttcctcccctcactcttccagaacctgtgatgccacctccccctgggaaaccccaatctcctgttctttctgtagcctcaggatgatagaaacattttaaccacctggctccacctctgagcctcatacatagcacatggcttctgtgctgacgcacatgataaaatctgtattttttatacatttttttcttttaatctatctattgtcaattcatctcaatagacttagacctgaaccttcaaagagaaagtttgaacttttctaaacatgaaaataataaataggaacacacacacacacacacacacacacacacacacaccccttattatctggacagaggaaaataataccaaaagaaatctcctgctaaagagaatgcaaggagggttaaaagatcgttattgcatattataaatataaaaatgttgtagaatcccaaaatccagttttgcatacccaatgcatagtaagccaaacactgacacatcagcacttaggagcagagacgtatttgatttttccaaagcaagaaagtcggagagacaaatatcacaaattcaacctgcctttgaacataactgggagcttagcttttatgagtaaggtaggtatgcgggaggtgagatccccagatgatcaaagatgttttcttccctcagcctgatcaaactcctggatgccatcaaggaggtctgcatgacctaaggatcatttttctttaaaagaaaaacaagttcattaatcttgcgggcagccctccggggttagtgtatgaagttaatcaattactagtgactcccctctatagaaatgactatgagcaataagcgtgtgtggagggggaaaaggaaaaagagaaaggaaggtaaataaaacaaacaccttaaaatttttataacgcaggcttggttacaaaaagagaagaaattcattctgattccaataatctagaaatgtggaaaggttcgatttgagtaaggatatcacttaggagtaaacctttcctgaatgagcactgggttgtgagtatatgcaaaaggctagaaacagcaggtactatttgaagagaagtaggcaatctcatgtgacagaggtataggtaagtgaaaacgtgattgagaatatagcttgttgtggccaacactggggttatgaatttaacctcataagaatataaacccctcccagcactttgggaggccgaggcaggtggatcacctgaggtcaggagttcgagaccagcctggccaacatggagaaaccctgtctctactaaaaaaatacaaaaattagacaggtgtggtggcacatgcctgtaattccagatactcaggaggctgaggtgagagaatctcttgaacctgggaggcagaggttgtggtgatccgagatcatgccattgcactccagcctgggcaacaagagtgaaactctgtctcaaaacacaaaacaaaacaaacaaacaaaaaagaacacaaaccctttgttatagtatcaagtatggtaccattcaccaactcaaggatgagtatcaaggatgagttcaaatcctatacctttaataaagcctttctaattattgtagctcacaatgatatctctctactatgacaatctttattagctaatacagattttccccttaattacaatccattttgtctcaatttctacctgcttcatttgtgttcatcatgtttctcacaagaaacttagaactctttgatgactaattttatagtataaaatggtcagacacagttttaggtactaagcactaaataaacacattactgactactataaagtgaggaggaaaatcataatccaaaatcaaaacaattacagtcacaacctcatgtgctttgcttaattcgcaggacagatatggatcctgtccagcgacaagaagggaacttgcataaagggtttactttatgtacacttcagtcatattcaccctgctgtgtggtcaaaaattcatattatcagagtgccaacaatgcatcaaatgtgctgttaatttcactcacagcagaggttctgcactttgatgagaaccacttaaatttaatagagaagcaagctgccctatgcctggtctcaaactggaaagtgacccaaaagccaggagacagatttatgtgacatgcacagaaggtgatatgtgcctcttggcccacagagcagatttttggccagagcttgatgagtagatacggcagtctggagacagaacctccgttgtgctgtgcacgagtaggcaggcttgtttctttcatgcatggcccagaaaaaggacaaccctcattttagagagctgataaaagtgtaaaaaaaaaaatttatccaatagagcagctctatgcagacaccaaggcaaccagcagtcctggagggagggtgcagcctgccaagacgattgtcagaaatggttgccagagtcagatgctatggatgtaggaatactgtctgtagcttggagtttggaacctacattaagttcaaagacgagcggcaatgactgattcaattcccaggggaacacccaagctatgttatctataatttatttgactttaaaggcaatctttgatttcgaggacatacacaaggaatgatgtttcctctgtaagagaatctgccttagagcgtgtgtgctctggatctctctaaagatgagcatgaagattgaaatgacagagggtgctcatcatgaactgtcttgattaggtaaattctgattatatttgagtcaagccatgggagtataagcataactctaaagcaacaagcctaattggttcaacagagttatgaaaactggagcagaattgtcaatcgccgtacctaactaacggaacaatagagccaccctacaaatagttgggaaatttagaaagtaatctgtcaaagtctgcacagcagttgttgaaatgcttgtccccaaattgtaaccagagtgaggatgggttaggtaagtgatgatggctggaacttttgtctcagatcaaaacttaagactatactcacctagctaatatcctccagtagtgtattaggctgttttaaggacaatcagattattgatgtaaatgcaactgaaagggatgtaatctttattcatgtcttgcaaagtacatattctctctctctgtgtgtgtgtgtgtgtgtgtgtgtttagggagtgtaattattaaagtaaacaatatagcaacaaaatcatcccaagttttagcatatatacacaacatatcagtgttagatatatagcaattgcatagtctaataattacccaataggatacctttactctaggagatgaagtttgaataattacatgcacagcttatgtctggccacaacttcagttgctataatcagaagtatccttaaaagaatgaggtcatacacaaatgtaatcaacacctgctatactatgcttttatgacccaagcatgtcgggacgtacatcaaaccttagatcattaatgtgttttagcagtgattagttagcagcaagaattaggcacatttatagctaccaattattcagcgagctactgtgctatcatagtagagtgtttttagtctactcaaaaattacaaagtttcatttgttattttatgtagaaagaaattgatacctagagaagttaaataattagcctagtaaaatgctattgataaacagtgttcctgggtgttacataatgctctaggtgatattaaggattcatcttttttgttcctctttattctctgattcatatctatgtttctttgattcacgtctatgtttcctagtgacatgggaagtgggatggagtttttaggacgaaggaaatgcatactgatggagaatgtgacaaaggtaccaaagattgcatacatctatgttaagattctgtctaataatgtaaatgaatgacttacacaagtatatgttttatagtttgtgataggttttatatatatttccttacacagtgacactgtgaattgctgtagtttacattttgcagatgttgaaattgcagagctcagaaaggttatgtggcttgcctaaggtcaaacaatgtagtatatagcagagctgggtcttaagcccagattttctgagtcaaaatctagttctttccattacagcattcttataaatcctcagaacatagctgttcctccaatgtgggtcttggatatatggtatcaaatcacttcagatgataaatttagtttgttgcaaaaccattactaaggtaagtgtaaatatcttatcaatcatcttattgtttgttgttactttttggcataagtgaaattggatctataggcatttggattcagactgtcgataacttccttcagaagacattgtaattgattctttcctgcatcttgttatcaatgttaataatatatgctactccaacataatgtaccagtttactgagttcagtgggatattcctgcatcatcaaacttcaaaattggagtattgctatgagaagcattcatgctatattgttagcaagtataatattttataaagttcttgcttatatatttatagaaactgagagttctaaccaaattatgactgacacaccttttactgtatcggacccagttgtcttcttttctgaggcaaaacacatgtaaggagaatttggatgcagcagcattgaagaataaggtgtttttgtactatgcattaatgcagacagcgtgtagggttgaattccattatgaatgcaactatttatatccaatatccattatcattaatggacagattttcttgtgactccagtgtggaatccataaaagatacaaatttaatagcaaacaaagtcatcatgttcaaccatgaaacagctgagaaagaaggggctgagggttgcattttctattccaagatacctgtctttaggattctaaaatacagatagtatatgcctatcagaatgcatgtgtgtacactccaaattctgtcttattgctcaatctggtttgttctatgatttggaatatgtcactttacctttctttagtgtcattttatcccttcatagtgcttacaattttcaaaaacacacttctgacttaaatgaaatatatagtcaaagataaacaatataacaaatatttccagtgctgagtcttttttataatgtagaaatgtaacaacttgattcctgcgtttgaaaaagtttaaaagaaaatgacattttctcaattgcaatattgctcaaaatagaaagatggacagaactcttgtggtgattttcgttccaactaaccatccagctagggaaggagtcagatattatgcaaaaaaggaggaaagacacttattttgatcactgatttctactttgaacagttagtatttttagtcatgcaagatttatcgggaaatctaaaagttcttaaaaagatgataccactatgtataatcaaaatattgttgtgaaataaaaatctattttcttcttttttaaaaaccttgaaaagttaaaaaaaatcgtattaattgaaagagaacaacaatctacagtgaaagccattgtggagctactttaacgatacacaatctgtgagctatctgaagactgtaaacacactaatatttcaagaagtataggatgaatcacccatttagaaacattgaagagaagatgaagaagctcggagtgagttgtgaagcaatgaataaggatgtattacacaccagaaagccatcaatatttgtttattatgtcagggtaaggaataaatctgtgagctaatttgtattcttcacagttaattccagtgttcctgcttgagcatttttgtttcagaatgagtgctgcacagctgtttaatggtgccatcaagaattcggaaagtcatggtcccttggagatagaaaggcattgtaaagtatgatatcaaaccacaaataatgaagcaccattaccttacaacatcgtatacttctcctttgcgttttctttctcttctctctccctgcctcactctcttcctcttaagataattggatttgttaacattcccttcatttaaaaaaaatacatctactcagaagacgagcaaaacaaccatgagtttaaatgatcaaaagatttcttttgttgcaactgcaagctttttggaaaagattttttttaacttagtttgctttagtaatgactttgtcaataaaattaaacacagaaattaaacaatttcatatgtagaaagacctacgcttacacattgctcttaggtaagtcactatatatattatagcttaggtttatacatgtacctatgttaaagtagacgttttttaaaaattatttatttcacttagatactaattgctatccatcttttgtgttctgtaatgccacatgctttgccttcttttctgattttgctaccctacagacaagatttacacttgctgccttaccttactttaaaggaaaattgaaatccttaactctgcctgaaattacgagacgaaagtgacaaaactggacttgtgctctcaaactctcattaaatgaggttgaagtttgctcagtccagtgtcacagaaagttccagatgagaattctattctagtgattacagtcctgtacatgtatttattgtagatgtaaaggctgagatacctacagccttgtttttgtgattgctttccttgctggtaaactaaagaataaattagtgtccgtctaccagtagtttcaaagtcttagaaaactgaagaacaaataatctaagaaatatttgatgtcctctcctactaaaaaaaaaaaaaatccctcttaaccaaatcaactataagcaatttcaaaatcacatgactatattgctaggccagtcatcaagagcttgtcttgtcttcaaatatgaaattctatgtatgatactcacatttttctcctaccaaatatttttaatgacaatttctttcactctgattgcttttatgttcttagtgttatattaacatcaataaatattaaatggcctactcttgtaagaaaaaaatatatgtttttctcaagttgtattttaatccacatataaggatatgccttttcaaatatgtatacagtatatataatatgagtgagtccacatatatttgtacttataaaatatcaaacactggttattaataaaaaatttaaccaattacattgatatttgttcgcttaatctgaaacttctgtccatttgacaagatccagatgatgcaatgaatatatttttaaatttttgcaggtatatacatgactagtgcaactggtagaataaagaaaatgtaagcacatataataatttctattatctgggtgctaaatattgctatttaaagatattgatgaaagggtcatatttttcagggtatatatttttccccagtagtaatatattaaaactatgtaaatcaactctttgttgtcttttttgttttgaggggaggtggcaaaaggaacacttttataaatgctcagttaaaaacagagcacattctatttcataagtctctaaattgttccaacaatgaaataaaaatctcaatttttatttgtttgttcactaaagaattataaagtcttcagaggagaactgatttcagaatcatggctatgaatgtaaagaaggtcataaaggctttgtgttgactctcacttctggttttccattaatcatctggttctataacatctagtttgcaatactatgaagttaatccctgattcactttgaagggctaaagttatgtcttagaaaatcgcacatctgaggcaaatgatgacatgtataattaaatgagaaataacatacttcgtaggaaatattacatgttgtaaacttgtttcgtacacaaaggatttaaagaacttcctttttcccaaaaacattaattttagaactttacattctaaccacacatgcttaaagagaggttttatactgtccttggtcctgagcaaaaccctagtatattctgtcaaccaactgtacatactaggtagcttacggatcagtagtctaatttttctcattcaatagcattagagttgacatgcttgtgcagtttggtttatgtctgccttcctacagctactcagacatggtttttttccttcaaagcttcagttatgtattgaccataaagcgtaccaagcctcagagaataggaagagtccaatgtgttataaaggcacagcgcttacatgtatgtagtaacatctctaccaggaagccagtgtctgagagtcaacataattctttctcctattaactctggcacctgcttgagatccagaaaatagaaagattgttgttcttttgtagctttttagagaaggggtctgcagttcttgtagttctaagtttcccagtgcaactcaacaatttgtactgacttagcttgaaagtcaaacaaaaaggaaagcatgcaaaacctttcagttatatcgagagaggtagagacagccccatagttgattcctgttcaggatacgttgtgaaggccaacatggtgtttatgaagtgacagagatggagaattattggaaacagtagcaaactacaagtgaaaaaccttgtacaattattcttaacatattatttatattcagatgcaattctacgaatgataaatagatgcttttacttagtataagttgacttccatctgtgtttcttaacaaaagaataatgaaaaatttgcagggagctttactgcaaattcaattaacatttatattactatgtcactcttgataatttaaattagataattgtattattaatcattgaatacctactctgttctagacactatgctaggaactggagaaacaatgctatttgttgaatatgtccactaaagttgatgtgttggaaagctaatcctcaatgcaatattgttgagagatgagtcctaataagaggtgattaggacatgagtattctgtctcataaatggatttatgttcttattgcagaggtgcttagttattgtgagagtgagttttgttataaaagcaagtttgggccccttttgctctctctctcttgccatgaggagccttctgacatgttatgatgccacaagaagtccctctccagatggcgtcagatgctgacaccttggaggttggactttcaaacctccagaactgtgagaaataacttaattttctttataaattaaccgttcttaggtattctgttatagtagcacaaaacagactaagacagaaaattgatactgaaaagtgggattgttactacaacaaattcctgaaaatgtggaagtggctgtggaactgggtaaacaatggtagaggctggaagaatctgaaggagtggactatgaaaagcccagtttgccatgaatggaatgttaaaggcagtgctggtgagagctcagaagacaaaaaatgtacagaaagtttggaacttcttagcgattacttaagtggtcatgatcagaatgttggtagaaatatggttggtaatggtttcatgaggtcttagatggtagcaaggaacaatgtactggaaattgaaatagaggccatccttgttagaaagtggcaaagaacttggctaaaatacttccatgatctagggatttacggatggcagaattcaagggcaatgaactaggatatataaaagaagaagtatctaagcagcaaagcactcaaggtgcttcatagcttcttttggctacttacagtaaatttacagaaaagaagaaaagatttaatgatggaattcataattaaaagagaagcacaatggaaaaatttggaaaactttcagcctggctatgtaaagtaaaaaaaaaaaaaaaaagaacatgtttgggagagaagtctaagggcatgggcgagcaacccttggctatggacagaatggagctaggttctatttatcaagacaatgtgacaatgaccctgaaggcatttcagacatctccaagccaagccagcatcttgagtgcaaggtttccagagaagcactcgcaagactttagtatttgctgcccaagtctacctaaggacttggctcccaggatttgggtgcagtgtttctcaccagccacagctcaagcagacccaggtgaggcttatgacacagttccaggaggtggaagtggtaagccttggtggtgttgttatggtgctaaagagaataaacttgttacaaaaactagattggcctcttctttttccctgttgtcatgaagggcctgctgccatgttatgatgcaggaagaaggccctcgtcagaggcctgtgtcttgatattggacttcccagcctccagaactgtgagaaataaatttctcttctttttaaatcacccaatctcaggtattttgtcacaacaacacaaaactagatacttaacaattgttgaacttgtgatccagctaaagatgtaagatcaaatgtgattccaagttttgtgataaatgaaaggaaaacacaagtggtgttcacatttttattatgaaaacattcaaatgaatataaacatagagagaagagcatattgaactcctagatgttcctataatctaacttcaacagttatcaatggatggcagattctcacgtgcattctttttcaaaccttaatttcccccttactccctaaataaaatactagatacaatagcatttcatccactaaaaatatgtttgtctacaagtccctttttaaaaagcacagtgcctattaaactatcatgcttgagaaagataatagcattatttacttaatatcagctaataacatatcagtgttcatatttccctgattgcctaaaacattttagtttactcatttttgttaagttatccaaatcaggtcaaaataaactcttcatatgacatttaattgattgataggcttttcttatcactttatatgaaaattttaaacctacaaagacaaaaaaaccatacaaattacaccaaacccatatttaccaactaggttaaatcatatattattatacttgttctaccacacatctattcgcctatctattcctccactcaagcactaatctatcttaatttttgaaggtttccaaaactatgtgactggaatttaagacgtgagaagagtaattaaagatgggtgcagctggagtagactgaggccaaatcatgaaaagcctgattttggggggttaagaagtcagactttaccttatgttattgtgtggaagacagaaaacaaactagataaacaagtaagaaaggtatgttgtatagtggacaaggagaaatgttaaaaagagaattggaagcaagaacagttggaaggtagcaagatttgcaattttaagtgagtggctagtgtacatcccactaagaagatgacatttgaataaagacttgaagagaagtgagtgagcaagcaagccatggggatatccagggaatgaagattccaagagagggaaggaaatagtgagtgcaggccccaaagctatgataaattgacattttaaaaatcattttaatgaagcataattatacaaacattataatgattttataagagtaataatgtaacaatagaataaaaagtcacccataattctgctactgctggaaaacaaattattttcatgttcaattttttagacttttatttttctctgcatccatgtttacctaaaattatgcttatgaaaaaaattatttacacatacatgcatatagttaattttggatgttaatatttttatttctttatttctttttttttttcttttgagacagagtcttgctctttcacccaggctggagtacagtggcattagctctgcacactgcaacctctgcctcccaggttgaagtgattttcctgtcagcctccctagtagctgggaccacaggtatgcaccaatacactgtgcgtgtgtgtttgtgtgtgtgtgtgtgtgtgtgtgtgtgtgtgtgtgtatagtttttgtagagacgaggttttgccacattagccaggttggtttcaaactcctgaccccgtgatccacccgcctcggcctcccaaagtgctggaattacaggtgtgagccacagctcccagcctggacattaattttgtataaatgttttctgtgtattatatagcctacctattattttaatgcatgtctatttcttatttatgtatttatttattttttgagacggagtctggctctgtcgcccaggctggagggcggtggcgccatctctgctcaccgcaagctccgccccccgggttcccgccattctcctgcctcagcctcccgagtagctgggactacaggcgccgccaccatgcccggctgattttttgtatttttagtagagacggggtttcaccgtgttagccaggatggtctcgatctcctgacctcgtgatccacccgcctcggcctcccaaagtgctgggattacaggcgtgagccaccgcgcccggccgcatgtctactttttcaacaaataaaacaccatgaaatcttttacttagcaatcctcctgttgttaaatatttaagtagtgcatctttatttttcttaaaaactatagcaataaatgtatttgtagttaatttcgtgtttttttttttttctcggagtctcgctctgtcgccaggctggagtgcagtggcgtgatctgggctcaccgcaagctccacttcccaagttcaagtgattctcctgcttcagcctcccgagtagctgggactacaggtgtgcaccaccacgcccagctaatttttgtgtttttagtagagatggggtttcaccgtgttggtcagatggtcttgatcttttgaccttgtgatccgcccgcctcggcctcccaaagtgctgggattacaggtgtgagccaccgtgcctggtcgttacttacttttcttaaaaaaaataaattttattgtaactacctattgggtacaatgtacactactagggtgacaggtgcactaaaatctcagacttcaccactatataattcatccatgtaaccaaaaaccacttgtactccaaaacctattgaatttttttaatttaataaattttattatgtatatttaaggtatgcaacatgatgttatggaatacatgtagataataaaatggttattacagtaaagcaaattaacatatccataatcttacatagttatctatttttttatttttgtggcaagggcagctaaactctactcatgtagctagagtccctttcaaatctttatttaagaaaaaattcaaaaatgaaattatggtatcaaagggtgaacatttcaatgattttgcattcccaaagggttacattaaattgtacttcaaactaacagtatgtggttttgccaacttcacaaataggagtaattaagaattagaggatgtattttgatcacttaaattataaaatggaattgtatagcgttattttgcattttttattattagcaaatattaatattgtgccatgtgtttctttgatagttagatctgttaatatgccgattgcaggctttaggtttttttcgtaattttttaaattttaagcattctacaaatgttatctctcaggtcctaggtcttaggtttttctcatagtttgactttatattttaagcattctacaaatgttgtttctcaggaaaacttacagcccactgttcttttgaaaatacatgcaaatctctgtaatatacacatgaaattttaaacaattactattaagttattcaaacgtttcaatttttctgattataaaataaatgcttttttagttttttttttttaactttctacttgaaaactaaaaggcaataaaataaaaaaaatcagttctatttctgtgtgagaggtaaatgggacagccagacttatctcccctcttttccagtgccttatctccttcgtctctttaatcaaataaaagtgcatatgcagactggacagtggtgttagaggacaataatatttttactaatatataggaaacaggaagaatagtattctgttagtagataaaacagagcagagggcatccctccacagcaggctaggaatgtactgcagtgaaaatgggggccgttgcctacgtggcaaaacactgaaagttcccaagataaaaatcagtgactattgagcaaagtgagttctggagcagtatttagggaattgcattaaatggctctcaccggaagagctgcatctgctcatcttgttttatgtttcctcaaggcatggacacaacatctatttatttattttccaccactcttccccacaatgcaaactcgatcagaacagggacatcctccattctgttccagtgcctaagacagtgtctggcccacaagaggtcctcaagatgtgctgcgtcaatgatcccaatccaaaaatcttccccacatctttcaaatggtcaaagtccctctgctcctggatctgtatttcaatgtactactcttcgtgtttccaattaaattccataggccctgggttctttctggtaattctttctacggagactgtcatacctctatttccatgatgtttccttgtttatcttttccagattcatcaaaggcatttagtaggtcatacaaggaggttcatcaagactgtcagccaagtgtaatttttatccaaacatgttatgttttaataatttaaaattgtattcttggcctctctggctacattagaatgtgtcatatttaattgcttacgccttttgcttcagtagaatggggcctggaggacctctgtaaaattcttcagttacaaacattttcccaactactttaatgggatgtacctttctggcctcgtgcacttttttgttgttgtttttaaacgcaacaaagtgtcagtttcgcttctggccacactataaccattccccaacactgatctaacttcaaaagcatgaaaaagtgtgctgtgcttttgaagttgggcagagaatgcacataaacatatcctaagagagtaccatttcaaaaaagccatttcctattaagcagtttcaaattttcttttatttctcttttcattaaaaaaaaaattagtcaatgttctctttcagttttgcttctacctagtttatcatattggtgaacttttgatcttaaagttttgtttttctacatttattccaacgttttgttttataccacattgccaaagcatttctgctgctgtattcctaagagtggttctaaatgagaagctctcaataatgtttgtttaactgttcaatcttcatttagactctggatagcagccctactggaggcctggtatagagcaagagggaatcatgcatctgatttaagatttttaataaaaagtgaatgttaaaagtaatttgccaacaagggaaaatggcaaagaaaagagcaacccagtgaaattcctgttatggtgaatacagaattatgagagtgaacaggcataaagggagtggtgtatctcacactacattaaatctgctagggacagacactcaaaagaggttcagagaatatagtacatggaatcttcatagcagaaactgaggttgtgatatgaaatcattccaatactgtgataaatggaaagagccaactagacaattgaagctcaacatcttttataaataattgtttagtttggattttagtcaatgaatattaaacatcttctgtctgaattatttttcttctacatactttacctcagatcattctaacaataatactggaatgtatgtagtatttcccttttacataagagaaattgaagctcagaaattttaaataacttgcaaacattatacagttagtaattgttcaagttggagttttattaccagatggtctgattctaaatgcagtgttcttttcataacatacaactttctctgttggacctacagtggccaaagtaaacgaaaaatagccagatagccattgtgtgctttatagaaatactcgtgcagatcagaatcacgattagcagtggtcatgaagcagataaggaaagtcaacaaaatattttctgacttcagaaaggaaaagtatgtctcaaaacagaatttataaatgccacatatattcttatctcgccagttctgttcagctatttctgatttaaacatttttcccatctttctggtttcagatgagacattgaacaaagtcaaattaaatgagagcgagtttcttttattgtaacaagattatgtacatatacatatgaatgcagctatgagcacagactttttaaagaattttgatattcaaatccttctctttcaaatatttcattcaaaccagaataaggaaatataccagaaaacaataggagagaaaaataccattctatttgtaagttacatgtaattactctcttgttttgctaagtcatctctagtctgagaaatgattactcttattaagcatgtggatggaatatattgatgaatatataaaacacaaataatggaaatatgtatttctttaattttttatatgagatactttaagagttaaaattttattttacaaatacatctgtatttagatcaggccaatacaaggaggtataaatattttctttactaaactatttgatgtttatcctataatctcatcatattgcttttttctttctctctctctccctccctcccttgttcttatttttgaaagggccactatgagccaaagagagaagaaaatatttgttttgtgccttgcataatttttcatgcactttttgggttatattgttgtattgctctcaccaagaggaagcaaagacctccttttcctgctgtaaaaatttcatacattcaaaatgaattgtatctaaaagttctctcttcctaatcaagtatacttctccttcactgttttaacgaaatagttttttatctgtagtcattaaatccagtgtatactgaaaaatgcattcttgaatctgatccttgctcttgtagaatctctctcttttgagcagctacttatactctaaatgattatcttcatgatgattgaattttacaatagattacgaataactactggcatatgttctttttcatatttgaggatgacaaccatcattggattcattagtagaatgcatactgtgtagaaaggaaatgtaagaggaaaggagtacacaaatgctagcgtcaagactggtgtcaagactatttgggtttcatatttctgtcacttactagctgtaggaaaaccagtgaagctctctgtgtcttaatttcatcaactgtgaaatatacccaccttggatcaatttatggaataaatgacttaatttgacataaaagtgttctataaatattaactatttaattataataatgctaatacaattattgtcttattaatatttgttttattggattttttattgatatactgattttcctatgagttgtgcagcctccactattatcctacattttactaaattcataaaatctgacagcagcttgctagtgttaatcatattatctgttgcccctgggatcttatgagacaatggccttgacctcattaaaatgaggtcataaaacgagataggtccaagtcagttggtgactgctcttactggagtaattatactatatgattcttagctcgtctttggtctaaaaggataacaatggtacttgtttgtacagcaccaacacagcattatcctgcaactcgaatttaaagctatcaattgataataattattccttgaaacagtaaaatgtttaatttcatttacatttcattagcgtcattatcactcatatcactaatagtgcaaaactttacttttttggtaacttgaaaaagtaatatttttaggcatggaaaattgaaggaattacattaattctttaaattaattaatttctctagagatatcttcctttgatgctcaaagaaaatgagcaatcatttgtttccagtgtgtgttgtttactggacccctttctgttagtgtttttaataattgggagtaaaggatagtctaattcactgtatattactgaagaaatctcctatatatccaactgtgaactgttgataagtcatgatattggcataaagaagtaggtaagactgcacatgtgtgatttatacatgtatttctgtgttttctcctgccatctgtacagtggcagagaagctgaaccacatacctcagtttatttaatgaccatatttaactcccacagtgttcccagcatgcaataaaattatattaatgattacaaggaaaacattaataaagaagtaaatcagagagcttgtgggttcagccaaaatgaacttcctagttcatgctggcccatgtgaatagggatctgattcaggttaagttttcattaccttatttctccatttggaaggctgtatgaatactaatgaaagcaaagtggtctcaagatgggtaaacatgcagaacctaatagtatgaggttttcagtagttccacatggaattataataatacaataaacacagtggtgaggtattaataataaatatgtaaatgatttactcttaaaaatagctgttcttcaaaggtgagaagcccttatttaattatttgtgctgagtagcttggagaaatgctgatttcagtgcttatgtgttccttgggaatgaggcaggcaggttaaaatgaaaacaagccaaataatcaaacagcacaagtatgtgggttgttgaagtttttttgtttgcctgcatgctgatttacatgcctgagcaaaatggaaaaaatagagcgttcaggcctattagaacagagccttccttttgcaaatagaccatgattagaatacatagtgatatgatgttggatatagattctctgaaatgaaattaagtctctttgggcccattcttactgctgaattttatgggaggaagtggattctctagtgggactgttaaggcctgcattctaaggaaataaatgcatatttaatgagttgcaaccacatgtgaagcctcatgctaggcactgtggaaataaaaaataaaagatgtagtactgatgctgaaggcattggaccaattagagatataaactcataacatgaagtgctagaaataatagagtcgttgaaattggatttgaatttgaatccgggatcacctgtcagttcaatgacgtgcgcaatttactaaaaaaacactttgagtttcactttcatatctctataagaggactaatgaaacctaacttgcaggcttaaaatgattataaacaattatttgcaagaagccatgagccagaaaatacactgtgcatttttcacacaacctgtgaattgctccaaattgccactatattgtaatataactgacctctcaaaaaatttcagtaaaaagctaaactgctatgatgaaaacatcctaaagtacagtggctccaacaagataaaagtttttctctaacatcaccatctagggcaggtaggcagactctgatccaggaagtcatctagtgatctcagtgagtgggtctgcttttgttctagctgcacttaatttcagccatatacaaggaaagagataaatatcaggatggtgcaaaagtaactgtggtctttgccattacttttaataagtttaaggtacatgtttttaaagaaaacaagctataggttggctgcattcattttgtcacatttcattagtgaggatttactcacgtggtgaaaactagggatatgagagcctgcaaagtgtgctgtataatcatatgcccaggaatttaaaaaaattgatttggagagagcatttgtttgccacatttgttcgcagttacatagcaataatgtagttaaattttgaaagtttatttctgctggtagttgaatcccaaattcatatctccagattatatttatcttctaaggtccgtagcaataaatccctctcccttacttaaatcatcttcttgcaggtctcagagccattgcatacttaacaagtatacatcttatctcttgatctactttgtaaatctggttccttttcagtggtttcctacaccaatggagcatttagttaggcaaaccagacacagcagcattgcctttatcagtctctactccctcatctcccaaagccagttgaaaaacaagccctgaagcctttgccttctaaacacagcacaactctagctacctccctgtcttcccacggatccactctaaaccatggcactatcctctcttacctgatctaaggtactagcttcccaaatcttttactcacgtccacctttgtgacttgtctaatctccacatcacagccagagatgatgttgtggatggagttttgttctgttttgttttacattctaaaaatctgatattatgcccctacttaaaatttctcaatgactttcacatgcatgttcttagttgaagacaagtacaaaatgcttcaatgtcacctacaaacccctcgatgttctgggcctaacaatgttctggcacctcctcctacatatgctgactcatctcatattttactttgacttcttccatatggaccgcttgttgatttcccctaagtcccgctccatctcccagcacaaggtcttttcatacatggttttctctgcacatgttgttctttccccccattttcactgaactctctcctgtttaccaaatagatttcagctcaatagttaatatctaaagaaaggtttcctctaggctttttgatatcattatattttcttatatagattccaggtacaataaacatgttattctaataacacaatagcaatattgcattgatttctttgattatttgtttagttgtctctctacctaccagactgaggtctatgcatatacactgacatatttttttcactgtagattactaaagcttaatatgtctagatggttcataataaacattctataggtatttttagaagaactatattaaaatattttatttcaaaatgaaaatatgtctcatttgtttcaaacgagtagtaaaaaatagtgaacatcataaaaattcagaagataaagaaataatatcaaattgaaaggataaagactggcatcaccaataatgcaatttttaaggtatgtaatgaatgagaaaaagctttttgaaagacaagaagaatatatacagaattcggataacaagaaaggcaagagccaatatggaaagtttctatattactggtgctcaaggtgacagtggctagaccagattgattaaaagggagcatttttgtaggaaaattatgaacatgaaaagttgagaatcaaattacatctatgttagtaaggaaaatctagaagatggatttagtgaatgcaaaaacttagttcacttagggatccagagaagaaagttaaggggaagtatagatgaagaaggaagaatatgagatgagaagatactggggctgtttactgagacattttgtgtcaatttaggtgataagggtagaaacagagaaaaaagcagctgaaaaagaatcatttttaaaaatgactttcttttcagaatgacatcaaatcaaaggtgtctacaacactattaaaatgtggaagttgagcccaggaaataggccaggcatagattatgagtcatcatcataaagaactcaaatgaaagaaataaaaaggacctttaaaaaagaaaacagagaatgagacagcaggaggcttaaactgaacggttgaaaagttctatatcaaggatatcagagaaagcataagacatagcaaagttatataagagctgtattaagagtatggtaaagttggtgaggtacttatgagatctcccttcaaggaagtgcagtgtagacatctttcagctgtcagctccttcaagatttgtctctgctgcagaaagctggtccaaccaaggtcacactattccaagagcagcctgaacacagtgactgagaaaggcagaagtataagcatctgacatctcagtcagatacaagccaattctgatggccaatactctttccagagtctcttgcacccacacctggttggccaatgctatgtcagacattcattacagttggacttctgcccagtcctgcttcctccttcttcctgtcataggtattgatccattaaaaaacaaaacgaacaaacaaacaaaaactttgcatcccaaagcccacctcagcatgggcttactcagagacccaactgtgataagagctgggagaaagagcatacgagcttcaaggatgtatttcataataatcatttaggtataaatagaacattaccagtctcagataacatttacatgagttctttttgatacctcatgtccctttttcaaagttgttgagtcatttcaggaaattgagtcttagggatttaatttcttccatgaattgattctgcttgttggatgtgtgaatctggaactcagaagaggagtgatcaggaatcatccagttactcttcctgaaagctataccacttttgtggcagaaccagggccacaaataagaacttctgtctctaagcagaagttcttttcatttcatcctgttgtgggaagtcagggacactgaacagagggaccaactggagccacggcagaggaacatcaattgtgaagatttcatggacatttatcagttcccaaataatactcttataatttcttacacctgtcttactttattgtcttaatcctgttatctttgtaggctgaggatgtacatcacctcaggatcactattgtgttaactgtacaaattgattgtaaaacatgtgtgtttgaacaatatgaaatcagtgcaccttgaaaaagaacagaataacagctattttcagggaacaagggaagacaaccataaggtctgactgcctgtggggttgggcaaaatagagccatatttttcttcttgcagagagcctataaatggacgagcaagtagggaagatatcgctaaattcttttcctagcaaggaatattaataattaataccctgggtaaagaatgcattcctggggagaggtctataaacggccgctctgggagcgtctgtcttatgcggctgagacaaggactgaaatatgccttggtcttctgcagtacctccaggtttactagggtggggaaaaaccccaccctggaaaatttgaggtcagaccagttctctgatctcaagccctgttttctgttgtttaagatgtttatcaagacaatacgtgcaccgctgaacataaactcttatcagtaattctgcttttgccctttgcatgtgatctttattctcctttttgccctttgaagcatgtgatctttgtgacctactccctgttgttgcaccccctccccttttgaaatccttaataaaacttgctggcttttaaggctcaggtgggcatcacgggtcctactgatacgcgatgtcactctcagtggcccagctgtaaaactcctctgtttgtgctctttctctttatttctcagattggctgacacttatggaatagaaagaacctacgttgaaatattgggggcaggttcccacgatatcatcctgctgcaaataaagaggaaagtttatgtaaaatcctgaacagcgtcagatgtttgagtaaagagaatgacaactggcataactgatatattgctaaagcttcttagaaaaacctgagttttaaatataaaagttgtgaagatattggtacactccaagattcctgcaacatgcctacactgaaattcacttttatatataaatagataattcattttacagcatatagataaaataaggcacaatctttttcagaaatcatgttctttccataactttgactatttagcaggatagacaaacattcaaatagaatgtttgttcaataaacaaaagactgtaaaagggaatggcaatggttaatttccagtagatacaacagcacagtctcttatagtgtctaggattccctagaactttattgtttctaaataagtctacctcaaagcatctcatcaggcgatttcataatgtatacttgtagactttaaagaatcagcccaaatgaaatcaaggtaattcatgaatgttatgtaattaaaagaaaggcattgaaaaaatatataggtttcttggattggaggcgatttgtagctgaagagtaaataaatatatataaaatgtatcatttggaaatacatgatattttaacttcaggagggagacttttatcatttagaattatttctactatatataacaaaaacaattctacaaactcagactgctttcaagaataaggaaggttatcgtacctaatacaaaactgaaaggttggcaatgactcaggtttggataattcaatggctaatgatgctttctgtctaaatactctgtcataattactctcagcttcatcgtaaggctgctgtctgttgaattttaagatggctgtccacaggagcaacgtcgttatttttttaaaaatatccagtgggagacagataagccctcaaaaaaaaatgagtgatcactccctcaattttcccaaggattgtatagctagtttctttttatattagtaggatatattaattaatttcatactatggatgccttcaaacattcattcttttatgaccgaacatgtctaggaagggctggctagtaagctaacagaatcatattagggctatgataggaaagaggataggagatactgcataccccatgggtaggaagccaatggtaaccagtagatatatttattgtattgcacctatcaaaattccactgcaagatactcccttctttacttttaaatctggaaagattgatcttggtttatcactagtacatttaaagatgggtgttttatatcatttatcttccttcaccctgctgggtctcagtaacaatccttgaatattatttatcttggtttgattcacattttctcagcagttgccttcaacgtggctcttgtttcttcacttcttatttattaagcagcaaatgtatgacattgtttggtttagttctttccaattcaattcaacaatgtttgcctcaaaccatccttcttcattgagccatctttatcctgtactattctcttcttctcacttgggtacattagcaatgactgtataataggattcaatttcttttatctcccatgcattcagaagtcatctgatatcatttgcttccatccattttgggtccgttcagagattatttatcttgatttcttttttctcactgagaaattatggagttaatgccacatgctagccttttctgtaggacactatttctgatcaagatattagacatttacacatgaacactctagagactactcagcttcagttgagtcagctatgtattttcatcacatcatacaaattctactaaaaatatactctaatgttgaaaaatagaaataaaaagaagtgaccaaggacatccttggggtagattacttaaagcacacactttaaaaaatattttttttcctggataaaattctctatatgtgattgcaggcaatattttgcagaatctgcctcttactcctccaagaagaaaacaagattgaatattttatgaggttctgacaaagtatttacacctcattggtaactgttgccttcaatataaagcatctgcaagtacaaggtctggatttgccctcagcacaagcattgaaatttgcctgcccagaagatatgctacaagacatcctttccaattccagttaaagtttaacattgaaaagtctataggtaaagtggctgaaagctttataattgcatgatggacaaattatattcatttaatagctaatgtacatagttctttgctaatttataccaaaaccagtcacaactctagctcatcactgcattcggtaatttacatttcaaagagactatctggtactatttcaaagagtttatgtttttctgattaaaaaaaaaacaattgcttaaatctttttctctcctggtgttctacttaaaattcagttatgtatttaaatcatttttataactcagtgtttttcaatagtaactcccattagaacttctgagaatattctaccaggagattctaccttgttgcttggcaggagattctaccaagcaacatgggttttttgaaatggatacacatatagaaatagattcacacatataaactctaagatttgtttttcaggttatgtaaaccatttggttttagacataagaattttggcaattttacttcagattatattattgatgccatcaaggcccatctcccttagaaatataacaattggggtgctcacctggctaggcaggtaaacagtggtcatagtgacatcagataacccgttagccctcatcagagtctttaaacaactggtgcaacactgaagtggtaaccttttctggttcatagaatctttgagaataaccctgatttcatgacatttcagagcacgtcataaggacagaatatatctccctcagagagtgatacaaagaatacaaaaataaaaacatttaaatatgcaattgcaaaatattgtccatactctcttcccatcttcccagttgtattttcttcccttcaccataacattatgtcaaaaaagaaaaaagaaaaggaagggaaaaaaggcaatagagaaggtcatttctggttcttttagggaaatttatcattttttaacaatcagtggtctacactgccaattaggtgatattgtccagattccagagtatttcaagagggtttgcaatgttgcccaaattcaaaactgtcattgatatattctctgtgctttagagggtctatattcaaatagaatacaatatgaaagagccttctggaactgtgccatttagcggtgctggttctaaaacctaggtacattctcacattgtctagtattcataaatccctagttaattgggtgtcatatattagagaacaaaaagcctgactctcattaagaagtcaaataaaatgtggagtatggaagaaagaactctttagcagtagaatacctacacacagcctgagtgaacctggaggtttgtagcaaaaagaaaaataaggaccctttagtgaaagttttcctacagagctaaatttgttgaatttaaagaaatgttttttaattttccaattaggtcttggcaattttttaaaatgagcaaaactatgacaacaaactcatttaaaaatattatttgagatactatgagatacagtagtttggaaactactgttataagacagtaagattaaaaaaaattgattatcatctttcatgtatataccagctcactcaacttcataaccattcctggtttgaagggaggaaagaccagtggaaatacatttgacatgtttttgtgcccattatggtttattgcaattctattttgatgttagtccctcacatgtttactaccagacttctaacaaagacaaatagtaataatcaatagtgatgacattaaagcatttcattcaaatatttcaaagcacgttagagccatagaatctgctttatatactaagacagttttaaaagtttcataaaataatgttttgtggaggtgaatggcaattattctaattctgaaattcacaattgtaattcttgttttatattaagtgacttacaaagtgtaccataaaatataatcatgatgttattttcagtgttataatagtcaattatgtgttacattatttttattgttttactcgtgtacatgcaggattcttggaaggatttttgagttcctcaaaggcagagtttgttatatttcttttgatcaacgaaaaaacccatttcagggttgtttgcataattggagctaaggaaatacttcttatattctgtttaataatatgtttaactttgagaggtaaatattttaaaaatatttggaagcattaacctagatattatagacaaatttttaaaaagtttttgtaagtgtatatttctatcccaaagactgaaatagagtggcagagggtcgtgaagagagaaattaggttcaatataactttctgtttatgtacgttgagcatggaaatcaaaattttactgctacattttaaagcaataaactgtgctattcttattaatatacttcaaaactggtttaataatagtatgactatgtgatagctaaataaataaaataaggtgccacagtaactaataagcacagcagtttttacaacatgtagtgtcttaaactgtaatataattaagaaaatttactttaactgtcttaatttcttcttacttcaaatactttcacacaatccagactatccaccgaatgacatttaatttttttttcatattatgagttttttactctttaaccattacagaatttgctcttgctcttcaaccatctggaaaccttaaaatccaagcttttgaaagaactcaatgctagtgcttttaaaaaatggattgatttcttccatgctttctttgttctcttctataattaactctaagaatttttaaagcatttatattaaattttcatatctgattttgaagctacaatatgtattttcataaacatactgatattatgcctttgaaccacttccccacatttggaaataattgacagaaataatcccatgactaactgctattttataggtttgtgtagttacatggtgtatattttatctgactgtggccaattttatttatataggtgcaaaagtgttattcattaacgcacataagcctccttggtctatggtcagtaaatctaaagccctgtaaaatatccatatgatgagtctgcaagacgttatttatcttttctttctttttatgttttctaagtcatcttctctgagaacaaaaaaccacctatttctactagtttttgtcttcagtatttacaagagtttttccccttcctccaagatctcccaaatttgtcagtgccctagtatgccgggaagtcatatttaatgcctgagaggctttctaagaattgtttccacatgtgaaatacagaccctattccttaatggtgagcttgtcagaccagattagttgagatttatattaaaatgtgacatttctgattgagttcacagttacaaattcagtttgtcctatattacatcctggtaggagtatgcatttttatcaaacacagaaataagtgcattgccataaatgtaaagaaagccagtgaaggcatcctgtatatattctagccaacatatcgaggaattttatggacacagtcaattcatatctgccattttgtgcagataacctgtcttttcaaaacaatggggggcactttcagtgcttatttactttttattagcaaataaactgtgcttttaaaatgtaaaagtcatgaatttcttaaattcatatctttagttctttgatcacttctaaatcagcactcttcattctatgatttatcagctcctggaaatgtatagccttttactaatgagacaaatttttctgtagacttttaactttgttacttttcttttctcttgtgaattgcatttttgtagaaaattgttaattgtctttttaaatttttgtgcactgataattgaaacatttcctaatttgataatttacttatagcataaatattatatctgcatcttcttattgaattcaaacctacaactcaatttcggctacctactaagcctgttatctaaataggttttcttcctttatagggaggtaagctatccatcttactttagaaaaaaaaaaaaattaatgctttcagcttgagtggatgtggaaaactattgttgtactttaattaagcaaatgcattggggggaattttgaataaaaataagaaaatccattagagataattggaaataaggtataattttagtggtacaaaaataaagattgctctataaatacaccaatacataatgggatttcttggctgattcagtatttacaagtcataaattcacttgcaaagatattaggcaatacagaaactgcaagttaaaatgatgaattctctgtcagatgaaaatcaatccaaagtaaataaaacacatctcaaaaattataaaactaaaacaattcaaattataaattaaattttaaaaattattaatttaggattttttaagaaaactattatgttcagtgagctgttctttgtaactctttctataaaatgtagtggcccaaaacaatgactttccctttggaaagtgattgctttagtcgtaaggaataattttaatatttagagattttttaaagtgttgctattttagtccaatttggattgctgtaaaggaacacttgaggctaggtaatttataaagaaaagaagtttttttggctcttggttctgcaggctgaacaagaaggatggcatcactatctgcttctggtaaggacctcaagaaggttctattcatggcagaaggtgaaggaggaacggaagtgtcacaaagcgagtgagtgaggagcggaggaaggtgtcaagctcttttgaacaaccagctgtctcttgaactaataaagcaataagcaccaagtctgttcataagagatctgccctcacaaaccaaacacctcctaccaggacccacctccaagtgggaatcaaatttcaacatgagatttggaggggataaatatcaaaaccatatcaattggcttcttaaattggtgaggttgcattaaattggaattagacctgctttttaaagagcttcataaaatgtttctttcagatcagtacgtgctgacttattttgacctttacaggaggagtaaggattcaccgaatttttactttttacaggagactttagagaccatttaactgatggtctttatacagttgcagtcactatgggccacacagattaaatgatttcagtcacacaatcaatagcaatagtctggtgctctagttgttttaaacactgatttggtaacaaatcagttaccaaaatgttagctaaaagggtagcctcttttttaaactgaaaaagtatatataaatatgaaagataaaaataatagaaaagtagaagacagtcaaggggtttgtatatatctaattgagccaaatctcttatacagcaggtcctcaaataacattttgttcaacatcatttctttatgatgttgatgggaagataaaattggttcctggccagagccactgtctgtgtggagtttgcacgttctgcccatgactgtgtgggttttctctgggttctccagttttctcccacatcccaaagctgtgcacgttagatgaattggtgtgtctacattttcccagcgtgagtgtgggcatgggtaagtgtaccctgcaatgggatggaatcctgtccaaggttggtttccacccttcaccctgagctgtcaggattctccagctgggaatcaaatttcaacatgagatttggaggtgataaatactgaaacgataccaattggtttcttacccctgaggttggactgaaccttaatgaactgaactgaatcctgaactgtaataattgggtatataattatcatacttgttttattaatctttcttaaatgtattatagctcacatttatctcaatgtttaatattagaagagttttagtctttatttagaagtttgatgatgattttgtgacgagacatatgccatagaaacttaactctcacttatatcaatcagcctattataacattggtttcatcataggtcatttcacttaaacttgcagttgccaagcacctattgacgatattaactcaggacttactgtatacatgtttgggttcatttatgtctatgtgtccatcaagaataaatcccatacattattattatttaaactattactttcaaactcctcctccatctatttatatgtcatctatcattctcctaataatacattagcttttctacataccacttaccaaccctcatatttcttaattctcaatttatagctcattatcaggtattctggtcataattggatttggctagtagcttattaatcttttcaaaaataattcggtaataacctattatatacacaatgtgggggatacattattgatcagggtagatggaattcctttcctgggagcacttgccatctagagtaggggaagagcactctatgaaccgatgctagtgcttaaactgttagttgtttattactgcataacaagttatgtcaaaatttagaaggtgtaaacaacaaatatttattatttcccagcttttctaggtcaggaacctggttatagtttagcagggtcttctttctcaaaattttacaaggctgaaatcaaaatgttggccagggctgtggtctcatctgaaggatcacctaggagagtatctacctttctttaatttcactcacatggttttggcaggattcagattattgttggttgttagactgaggatctcatctttatcactagcaatgggatgaaggtctccatcagttccttattatgtggacctctccatagggaaaaaattacaacagtgtttctaactttcatcatagtaagcaagcaagggagaatgaggagggaaataagatggaagccagggttcattcatgactcaatcttggaagagacatcccatccattttgtgatattctgctcactagaagaaattcacaacacctgattcacactcaaggagagattacaccagggcatgaatcaggaattattggtagttacctcagaagctatctaccacaagcttgtattatataaaaatatcagtatgtgaccaattggaaatgaaaatcaaaagacaacattgtgtcaagaaattttatttatttgcttttttgagacagcgtctcactctgtcacccagactggagtgcagtggcacgatcatggctcactgtaggcttgacctcctgggctcaggtaatcctcccacctcagcctctcgattagctgggactacaggtacatgccaccttgcccggctattttttgtattttttcgtagagacatggtttcaccatgttgcccagaccagtctcatactcctgtgctcaaacgatctgcccacccaaagcaaagtgctaggattacaggtatgagccaccacgccaggcctgtggcaagaattttaaagggattcagattttactctgtgtttgtgtccaagttaataaattagagagtctgccacagtctcatagatctggtaggaagaaaagggactctcggcacatagactaaagacagtttatgacttgtagcaataagagtaggcagagtatttttccattgattcacggatctgattctcagataatacgaaggctactgaattgcagttacacatgcagtgaactgcactacaaaagagggatcctgaatttaggcttccggatctttttaatgaacaataagcatccctgccctttcctccaaagggagatactatctttatgttcagattgtagaaaatttatgtttccagaaggagaagataaattatcttctaaggctgtgcactgtacaaacatctttgaaaatacagtttggaataaagggctttaagtgactctgtcacccataagacatgcagtaacatgagagttccgtgggtaattatctatcaacatactgggtcttcaccacagacagtatgagaagcactgaactagaggttttaaactattttttaaagacaaatctcacaatcactctaaaatcactgaggtttatactactaagagatagtactagacaagaaaactttgacttatatatgttttattcttttttaatatttgagtccgaggtaagagtgtgtaataaagattctgctacaatgttgaaaagaactacgtagaacctgagttgagtgggagaaagattagccatgcttcttaagcttggctccagccaaattcttgcaatttcatcaagataaaccacaaattggaataagaacaacaatccttgagggagtgctctgaagagcttgcatcatgatgtatgtttacaccttggaagacccatgaaatatcacctattaactttatagcttatttcacagaagagacaacttttgcaatgttaaacatgaaacactgattgaaatgggaagaccatgcaaaatcaactgtgtaagagaagaaagaggcattgtggttagcttctagaaataacagaaatcaagttagtaaattctagaaaaagtatatgggccacaagaaagtcatggagaagtgaaaaatacaataagaaaacacgaaaaactgtgaaatcatttgcatgtttttagtcaaaagagtgagaaaggcaaagaatatggtggaaatctaaccaaataaagttaaatataagttaaggttgcactgtgcagactctacctcgtaagaatggaaatatattgggggaaaaggtcgtgcaaattaaataataattaaaagcacttctgaatatagtctaatttgctccatcttaagtgaaagtcttgagaggaattttaaagagagttatacttgagagaaacaatgatgtcttgaaggagaggattttgagttagatacacaaggatgaactttaggtactcaagagggatttgggggatccctgttactcttccccctgacattgtcaagttagaatagataataaagaaataagttagatcttcatagtctcctctctgttctttggtgctatacagtaagccagatataaggaaaagttgaaaatcttgactttgattctctctgtaaactggactgagattggtgcagaggtcgaggtgtcttgctacatagagtgccctccttgtttgtaacacctcccaagagtcatgaatgttgacccctttcacgtgtgtgtgtctatatgtctatatgtgcatatacaaatccatgtaaaaattacaaaaatatagataaaacaatgatctgacttgcaaatttccatcccaatataatttctgtttccagatgtgcatatgatcagtctggtatgtatttcttcagatttctacaaagatatttatgtggtcatacatgtagacgtagaaatgagatcatataaaacagagttcagaaaactacagcctgtggaccaaatcttgtcaacggcatgctttactgcctgtgaaccaaggaagatttttatattttttaatggttacattttaaataattatataagaacctacataacaacttcaatgttctctcctgccctgcaaagccttagatatttaccatctggcccttcaatgaacagtctgccaatccttgacatagaataaaccttttcctaaaatatctttatctacatttaaaaacatgtcttggaaatctttctgtgaagctatcttattcattttagctgaaagatgatagtccattgcatgaattattgttgcataagccattcatctattgctagatacaaaaatattgttccattttttaatattacaaataattctgaaatatccactctttatagttgcctttgagtgcacacaggcaagtatttgcacatgaatgtcttcattaattttataaacacatacattctccacaaatttgagggcatttcccacttctaagaattttaccaaagtcagacactcttggcttataactttatgacaattattaaatctcagggagaaatgtaactatcatgtggacagcagtcttacatcagcaattataatacacttttgcatcggcagtgctgtaaagaatgaaccgttataaccagtaaagtgtttggtgagcacagaagtaaagcaagaagtatcacttatataaacttaatgcttaaaagcgtcaggctagttcagtcgggtgtatctatcactaaaatagggatagtcctgataatggaccatcatatgatagactgagtattcgttatcccatacacttgggatgagaagtatttcagatgtcagattaaaacaattataatatttacattccaataccatttgacatggtttggttctgtttctctacccaaatctcatgttgaattgtaatccccaatgtaggtggagggacctgggagatgattggatcatggatgggtggagaggattagatcatgggggcagatttccccctggctgttctcatgatagtgagttctcatgagatctggttgttttaatgagatctggttgttttaaagtgtgtagcacttcccccttcactctctgtctcctgctctgctatggtaaactgtgcttacttcccattcaccttctgccatgattgtaagtttcctgaggcctcccagccactcttcctgtatagcctgtggaactgtgagtcaattaaccctcttttccttataaattacccagtctcaggtagttctttagagccatgtgagaacggactaatacaccattcaaaatccaaaatactcccatgagcatttcctttgagtgccttgtcagccctccaaaagtcagatttcagagcatttcagatatcaaatttttacattagggatactcaacttgttttggctactccttcttttcaatagactctgtaagattcttatttaaaatatgcaactctacctctgtatactggcacagtataggaacactcatcatttcctgaaagtgaaaataaatatactgacctgtctttgcttttgagattgatattcagtggcgcatgattagaggagcgtgtattataggagaatagatgaaatttaattaactaaattcatgggattactatgtaataataatgaagtcatattacatgtactgttgaaaacacttattctagccaatttcaagtactatagttaatttgtagggagtacagagtgaatcaactagagaaatatgcaaaagaataacatatttaaaaagacgaagtatgattttgaaacaatatgattaaaacagcacatttatttacctgctcacaaaggttttatctatataatgtcagagcatatattttaagaacatacactaaccatattccagtaatttcatggctatcataaaaaagaaagattgaacactctaggctgtcctaaagcagtcattttcaaatttaaatatgcatcagtatccttggagagcctcttaagacagattgctggaacccacacctagagtttctgatttggttggtgtgatggctttttggtgtgtgaacttggctaggctacactaagttcctcataattccttcttgtaggtttctacatagagtgggctaccagagatagcctcttaagagttggaagaaggaaggaaagcagcagccacttcgtaccatacacaaaccaccttttcccagtgattcagtgaagcgctgatattagtactgctgtgaaaggatctggcaggtgtaattaacatcctaattagttgactttaaggaggtcatttggcaccattgtagaaagcccccactaggacaatgcttagtggaggcttggagagtgaggcttcccccaagatgccagacctgcagagccacaagtgtgcaacaactctagcctggaagagctacagaacctaactccaaccgctgagagctgccgtgcagcctgcacccagcaaagtgatgatggtgggctgccccaggccttaggggaccaacctccaccccagtgtgtccagatagtcatgcatagagtcaaagaagatttttctcaagcctcaagatttcatattgtttgccctattgagttttgaacttactcagggccttttactactttcctcttatctatttctgctttttggaattggaatatctatttaatgcttgtcccaccattgtattttggaagcacataagatgtttgatttcacaggctcacagcttagagagcaatttgcctcagaatgaatcataccttgagcctcacccaaatctgatttacataacgtttagatgagactttggacttagactttaaagttgatgctggaaaaattaagactttgaaggctgttgaaatggaataaatgtattttgtatgtgagaaaaacatgaatttcggaagcccagggatgaattgctacagtttgaatgtagtgtcccctccaaaatttatggtgaaacttaattcccattgcagtgatattaagagagggtctttaatgagttgactatgtcatgatgactctgctctcatgaatggattaatgctttataaaagaggctttggagagtgtttgctcctttttgttcttatgctcctctgccatgtgaagatggagcagacacacaacatgcctgtgcttaatcttggacatctcagcctccagaactctgatgaagtttatgttctttatgaattaaaaataaataaataaattagggagataatcttgggtggacctgacttaatcaggtggaaggccttaaaagagtacctagaatttccatcctgagagagggattgaaaaagaaggggaggggagaggaagaagggagaggaggggaaagtaggagtgcagagaaagaggagaggagaggagaggagaggagagaagagaaaaacagaagacagagaggaagagagactcccactacggacaacagcttcatcccgtgctcatggggttttagcctgccagcttcttataatagattcatctctctctctccactgctggtctggaattacattttgaaaatcactatactaaaggattgaacatgagccaatgtgtatgaattacctagggaaaaatattaaacataagatagaggtatcaaacaacctggaattttcagtaatgagtaatctgccttgtgtagaagtatagtttagttctctctattacaaatgttcaagctgagtttggataataatggcacacaccgagtacttaccatgtgcctggcaatcttcacaacacacacatatatacactacccaagtattttttttattatggcactcagagagtatacataatttgctcaaggtcacagcagaggtggtaaaacttggatgacaatgagacagtctggctgaaagcccatgttctcctgaataacagcaatactgccaatgtacagagatgccatcagatacagaagaaacagccagcttgaataattctttcattttactctttttttccccactctcagaattgactcctttgattatttgtttgtgtaaacagtcttagttttataaacatgaacactaagccccctggtgacttggataaaatgttcatattttaatttttgtaataatacagattataattttttctatcacgggatgactcaagtgaatttagacctcagttccttttttcatattgatatttgtgtttttctgaaaacttcaaagtgtgcatacagctctgcttaaagaagtctttattatatggtacatgtttgcagattaaaggttccagaagagaaaaggttttcagggcccaaaatgttatcagtgaactatatcatctttatcattaatcatcatctgctatgtcatgcttgctctccatctggttgggtatcaggtgtgatgttgaatagtttcagtacattaattcccaactagtgactactggtggcaggcagatcaggttattctgtgagtatttattgactctgttaattgtttgacaaatcattgttgactaccatacacagaatggcagatggccagtaaagtgttaaataaaattttctgtacttttgtgatctctcgatagatcttatatttaaaaaaattaaaaagaagaagcattctttatttaagaggatgaatgaattatgatataaaatcaaggtatgaataattttagtatgaaaattaagcctgatttaaaatagagtaatgaagatcaaattaaacttaaatgctcacacaattaagggttgttttcaggatcttttgagcttccctgataataagtttattagaaagtgttctagtaatcaatattataacagtagaagagtgaacctgggaaagaatccagagagagtggaatagtccgtggcacaaatgctttttggatggaaaaatgaaagtgagacaagggtgaatttatgttcttttccagtgtttttacacatatgaaatttcaaaatagcctgagtaagagaaattcagtaatggaacatgtttaattattttcacctttaaaacttcagaaaaataaatttaaatttcaaaaatttgctgatggagaaatttgaaaaacaaatttaggaaatataatgtagaatgatctgaatactgggaaaccagtcctaagaaatgacaatgaactgtataagaaattcacaactacatctagaacggatttccctctttccttcatttcatcttgtgtctcattcaccactgccttcctatattaacttgcctaatgcaagctgatttaataaataaacctcaaaagttcagtgacaacacaactgaagcttatttcttgctaagataacacttctggtgcaaatgtttctagtctgaatgtgaatttcttccatctaaaggtttagagattcattttttttttaatcatggaattctcccattgtctagcattccagagtcttctgtgctgagatcaaagaaggtgaaaaaaggagacagtgaagaagatattcacacttcttaacctcctcatactagaagtgacatatgttactttcactgacattctgacagcaaaaaataggcatatgccctcacttaaatgcaagggagtctggcacatgtagtttctgtctgggcagccagttcccagccaccacactattctgtggaggaacggcatacattttcctgaatggttaactctctctgacaaattatttcacagatgttgtgtttatatttgtggaataaataggttagggtgacatttaattggactaccctctgggagaggaaatgatcaccaaggtgagaggtcatcagtgaaagttatggagttttctctcttggataaatggcaacaggtagaagcaggtgccagctgctgtcctgcttcatcacgctttaagtctccttcttctgaattttttttctgaagtctaatgatcaaattacaaagttcatgaggatagcgttcaactgcatgggatacttgctatttcaaaactcaaaatactcatccattccatgaagcttttctagacttactgaatctcttctaatatttccttatatttagcttctgaaatacctcatcagaatggcatcttcttgatttgtgattcagctgtaattagcagtgcccccttctaaattatccttaagacttttaattgtcttctaattctttctcccaccacagtctctctgtcaaacacatcaacaaatatatcatcaaacatcatctacatactatagggaaaagtcctaaagaggtcttgcagtgacttaagttatgtttaaaatgtttgctatgttaaaatatatcaaatgcttattagtccaaataataatgctaggatcaatgggtggggattggagagaagtagatcttagtgcaatatgagcagacacttatagagagtcaatgaggtataataggaagtacactgaacttggaatgcaaacacttttgtttgtatgtctgcaacaacatgtattgtactggctgttgtggtatcagagagatcagttaccctctttaaatcttaatttcctgatgcataaaatgaggattattaaaaacaatcttttccttctactatacgatcacatgactatcaaaggtaatgtcagtgagacccttttctaaaccgtaatgtgctgctcaaatgtgaaattatcacctattagaactttatcttaatggaacaaggtttctcgccaagtaagagattctctttcacttgagtcacggtggccattcacactgggccttccatattagctggaggttaggatgagtgctctcaagggtctcctcaaactgggagatcatctggttttattcctgtgaaactcttcattttgcaggtaaggaaatcagagaggtaaggtaactttccccaatgtaattgctagagccagaactctcttatcataaatgacatcatttttttttttctggaatcatgtgggcttcgatcttagctttatcttggcttcctttagccctttctgtcatcttattttgattgctgttttcttgcctactgacccaagagcacatgctttgacttcatacacaataattcctccacactttgaagagatctaagtaatatatctatcaatatcctgatggctcaactggtttttagaagatataaatcattcaaatgactgtttcacttgatactcaagttcagtatgtgttctaagcttaagttaaacttggtatggtcatctaggaattgtactagcattgatacagtataacaacagtactagctacatgaaagactaaaacattacagaatgattttacaatgatccacaatgtctgactatataaattgaaataaagaaaaatgtcattacccctgtagcatctataaatattaatatatttaaatttttaaagactggtattttctaatgtctaaggaaatatttttcaatgaaataagctttcagtagatatttactttgactggtttctactatgtaaaataatagaagagaagatggtttccccattcaaatttagcagtctaatatgatggcaatggagtgggagaacaacaatagacgtaatcaattaccaatgacttggtctctaagtttgtctcaataaatatataccttagcatgaatcaagttactttattttaaaaatctgcatcagagaaatgaaattacatgattttctttagtatttgttggtcatcttcactgagattatcaaatctgttaaattggaaatattttctttctctgcaatctcaccattaaaatactccggttctcaaactcccaatttggaaaaattaatttcatattattctaaatttagagaggacaatattatgtaattttaatagaacaaaaaggcaaacatatacagtgaaattatgatgtattgatctgttttaccaacaaatcatacttgctaatattgagaaaaaatataattagaaaattctattccttgcatattggaaataatattttatgtctgtagcctttatagcactctgtttactattccattgaaaactttatctgggcattggaaaatgcaggaaaagactgttgatagactcgtgtatcaatactaggcaacctttttaaatggtttattacatttctgacacttgtgattaacaagtatatgaaagatattgctatttacaaatttcataactggataatgtttcttaaagctgaagctttattagagtcacatgcttgaaaataacttcatgaaatctcagcattttctccatccattgatggcttagcatatagtgtggtccttaaatattagttattattatcccagaaatggatgagctgagttagatgtatgtaacaagtcacaagagaccacgtttgttcttttcttgagtctttactcaatatattgcaagctacataaggaatttactatcctcatggagaaattttaacttttaaaatattctctttttgttcttcattctttaaaatgcaaatgttggctgtcacaaaacaaagcagtttatcactttctctcagagaaaatattcctgtttatctgcacagatgtgggattaatgactagtacttttgagttttgcccacttaagctgtctgatgcccacaacagctgaagtgctcaggttcttgcagccaatatgtaggcaattctacacccactccatgacatcaagcctagaattgttatcagactctgaattgaagaaacttttgcttctccagtttttcatacagaatattagaaaattattgttggaattagttttcgaatattttactcacattgcaaatagtatgctagactttgggaacacaaataaaatataattcttaattttaaggcaattaaaatcagagagagatatataaacacattactatttatttgtaatgtattacttactatagtgtcacattttatcatcaataacttgattacacagatggagagcatcgtatcatgagaggtgagtaggaagttttcagttaaaagttgcagtttcggccaggcgcagtggctcacgcctgtaatcccagcactttgggaggctgaggcaagtggatcatctgaggtcaggagttcgagaccagcctgttcaacatggcgaaacccatctctactaaaagtacaaaaaatagctgggcatggtggcgcatgcctgtagtcccagctactcaggaggctgaggcaggagaattcacttgaacccaggaggtggaggttgcagtgagccaagatcatgccactgcactccagcctgagagacaggttcaaaaaaaaaaaaaagttgcagtttaaagagtaaggttgaatttgaagatgaagagaatggaacgaaagaaagggagagatatgaagagatagaaagggacactttaaatatataggagtccaggcaacatacaaattataataggatttatgggacactgggtagcaagattagcaagccagatagcagaagcaaacagtactaggtgattaaataattttctgataagttctaaaacttttaagaaagccaaaattctaaaactgataagaaagcattggaaggtcacactctccaagcttaattgaaagcattggaagttctcactctcaccacccaacctattgggacaatatccctctttggaactctggcagctacattagtattacatatttaattaatttattatttatacatgaacttccttgtcatatcttaaaaattcctttgtcttaaactgcaaattaagccttattgctttacttttcacatacataaactctttgagggcagggttccaatataataatataatgtacgccctatattgcatacatggctcacacatagtcgctatttaatagtactttgtttgttaaactacatactttgtgtggatatttgttttgatttgttacccccaagtaatcttgaattttgtttcctccaaaaaagacaaaattctaacacccagtacctcagcatgtggccttatttgaagacagagtctttaaaggggttaaacaaattaaaataaagtcattagggtgggtcctaatccaatatgaccaatatcttcataaaaagaagaaatgtagatacatcaagggaagatggaagaagatgaccatctacaagccaatgtctcatagagcagattcttcctagcagccctcaaaaggaaccaaccccaccaacaccttgatttcagatgccagcctccatatctgctagacaataaatttctgttgttgaagccacccagtctgtggagcttttcatggcaaaagccctagcaaactaatacatcctctaaaatgacttcacaatcctattgaaatctttcaagcatacatttttttataagtcacttaggactcaaagtttgtcaaatccccttaattcctgatctcaccaaataattgctcaatctctgcttctattggcatgagaagacctgactttactgatacatagggaaagtgtcacgatatactttaccatttcaaatgcagctcatgctcatgaaagaagttttataaataccctcaaaggttatttgtcaaattgccagttgtcagtcatctctcaattacccatgtatgaattattcagagctggtttaacttcaggctgatttctttttgcctccaagcacacatctgatctcactctctgttccagcaattgctatgtgcttagggaatgcagactaatgttaatattagcccgagcaaacaattaaaaggctaaatctgtgtctaaaagaaattaatgcactcccccaaacaaacatgtatcatctttgtattatcagatgttttggattatttaataccacggctcgtttccttgataattgagtctaataagccctatgcttacactatttataattttgggttataaagccttaatcatcagtcagatgatttttatttcagttttctacagtgttcaggacagcattacagtgcctgctaatataggttgacaacatgatatggtttggctgtgtctccacccaaatctcatcttgaactgtagttcccataatccccacatgtcatgggagagacctggtgggaggtaattgaatcgtgagggtgcttatccccgtgctggtattcttctgatagtgaatgagttcccgtgagatctgatggtttaataatgggcttttcccccttttgctccacacttctccttgctgccgccatatgaagaaggacgtgtttgctttcctttccaccatgattgtaagtttcctgaggcctctccagccatgtggaactgtgagtcgattaaacttctttcctttataaattacagtctcaggtatgtttttatcagcaccatgaggacaggctgacacacaacacaagactgaattctatcctgcaatcttaactacttacattagaagaccttattgtattctactctcagctctgaacaactcctgtctctttggtgactgcccatccttgacgcacaagtgagtccaagttgccatttcatgcaacattatccaccatcttcccagcccttatttctggtctggggatagataacagattcaagatagatgactctaatttctttcctaagatttttggaatttgggttcagtgaatgaatccatctcttcaggtgcttagatcttattatgtaaattcagaatctgtggatggcaaagttgtctggcttttgaactgagaagcagacagtgtaggtcaacaaataagagaaaaaggtgaggtttccaggctctgattggttttttccaggtgccctgttgcaattctggccctgagtgttgtgaaacttctccatatccttataaattctacctgtttgataaaatgaagcctggttatggttgtgtttcccacaactaacaaagcaatcatccggccaaatccccttagtttaaaaatgagaccattggagtacaggaaagctaagttgtgggtccacattcacagataatttgtattaggactaggaaaaaggcatgtaactccaaattcccaggcaataggttgttttgagataactgttcaatgcagttgtcaatcctcgaaaatagtagaattagagcttaataactggtaaatttatctcttactaaaaataactgtcatgtactgaatggttgtctagtatgcactatttacattctaggcccttgagatatagcaatggacaaaacagatgaggtcgctgatctcatgaagcttatattgtgaaaattatactccatcatccggatggttgagatcctttaaattttcctataagcatgactacatttgcacaaaagcatctcttgtgtggagtcttccctgagataaagtttatgaatatgcaaaatggctggctgcagccaccggtacagtttgttccccatggaatgctgagaagccagctggtcctcagaatacaacaggaaagggaaatataacataaggtattgtagggcgtatttacacagtttgtgccccatggctcagtcctgtccaatatgtcagcagactgagaaagcttaaggaattctatctcctcagagaaaacagtggttgtaaatatatactaggcttcttgcactttttttttttttttttttttactttggtcatgagtctatcactaattgctgtagaccccctggcatcaatcaactgacatttatgccctagtatttaggattctcagtatttcaaaattgtaaaactacatttgcaagcacaatcattttaactccttaacctcacgtttaagattgtccatggtcgggctgcaaggtacctcatatgtattacaagaatttagtaactggtaactgaaagaatgaattatttcactgttttcctccaactccacatactcaggtcaagccaaaatatttactcttcctgcatacttccaccaccacccacccccatggttcttttccatctaggcctttgattctgcaattcaatgtcctgagagtacctgcctcctatctctgagatgtgacagcctcttcaccagctgctgctctacctgtcttcactgatggtaggacttgtttaaagaagctgaataattcacacatgtgcttgccttacattcgttattcactacagtacatagctatgtgaccttattctgaccaatgggctatgaagggaaatttgctaagaaagaattttccttcacgataaaattaaagtgtgcaaaagaaagccccttccttcctgttttgtctgtagaaaataattacagtgagaggtgaatttgccgaagtcagcttgccactctgactgggaggctgaaaccatctctgggaaacccagtcagagtcccaccattatttggctacttgactgatccaggatccaggtgcgagctgtgtccagacttcttgttacaaggggaaaatgaatctccattctaaaaccaccttcaactgggtattttggcacttgcaccaaacccagtgtacccttttatgtttagccctctatatcctgtattaaagttatttccttataacttacatttatatcgtacattataaattactaaagtgttgttctcccgatggttaaaaaaaagaacaaagtgaagctagaagctatgtactgtttgaaggcacacaggtggcaaagaggaaggcaaactttaagctcatagcatccttgaggtacggcttctcttgaataattagccagatgctggtgatttttaccaatcctacattttcatgggttcctcttttgcaattagcctttcttccagaatttatgtcagtgtttgttcattaatgacttcataattcgtattacaactatgcctgcccgtgacttccctgtggagttaattccataaacagcccacatattaagacagtatagtattcctcagatacataagaagcaggatagcttagtagttacacctggtatgtagtaactcacagtagtagctgtgagttaaagtgttggattcataccctggctccactttaattcgctgtgggccaaagaaaaggtaacggtagaagatacgtttgaatcagctctttctttctctaaagcccactataacactcattgcttatattgttgcaaaaaccatttcataattgatgtttttctaaccccagaatctggcacacatggcacagtatcttagatatagttgatattcaaaatgtgttcaaatgaatgaaatttgttaagtgaaagtcacctaacctttcttttactgatattagtacttactaatccaagttgcctcaagagaatatacaaaggcaaataataaatactgaattctttatttttagcaatctggccttgttataattctcacctctctctcccaaatcataggaatcatggttaaggtaaaatatcttttgtagcccccaaaatgttacagcacaagaggtttgagtttttagtaatataaaaatgcataattgcccacagcataatttctttcaggccttaatcccatgggctcaatctaaggagttttaagtttttggtttttgtttttgttttttcactgtgttaacctgttaaagctcatcttagcaggtttctttgctctgtctcttcatatgcttttgagtgtgtggggccacagttactttcagagtcttatttgctcaagaagacataagaatccagttccttcaagaaaaaagcaaattaaaaagttattaaagcatgtatcgccacttgacaagcccctctggatccatttgagcttatgaccatggtgagtcttcagaaagggttttatttcacaaaccactgagcccttccgagccacatgctgtttgataattaggggctatagtatctgtgatagaaacccagtactgaagaaaacagtgaaagagactaatatagacaaccagctgttgattttctgccactgtactggttgacttaaactatgttgccatccaaatttatgttgagccaaaacccttttattcacagtaatgtgatggcaaacagaatattgtgacatccaggctatactgccatatcaatagccaacatctgtgtggtctttgcaatttacgatgtacttttacatcatttatcctatttaaacctcacaatatccttgtgaactaggaaagtgtgacctccttttggaggtgaaacagatatacagattacatgactcgtaaaaggtctaatggtggatctggaactatctggcttctacttccttcttcattgtcatcctcatcatctatgcttcaggatttgggtatctgtagaaacttcaggtggatttttcctattttcttatgtgagctgtgctgaagtttctacctttgcctatagcagagtcatttgaataacaccacacagcgctcctcctctaactacctttgattgaacaccattggtgctttgacccattgtacatgggggtcagcccaagttaattggcaattccaaaccaccattctctgttgagctaataggaacaaaaggatcttatggcactaatttctaagagatacttcaaaacaaggcaacctggctgttttagaaatttctcccttggtaactgccttctcaccatatttcattagctttaaatttgcagactatgaaagatgaagttttaccaactgaaaacacatctaggaaatttttccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagcatggtattggtaccaaaacagagatatagatcaatggaacagaacagagccctcagaaataacgccgcatatctacaactatctgatctttgacaaacctgacaaaaacaagcaatggtgaaaggattccctatttaataaatggtgctgggacaactggctagccatatgtagaaagctgaaactggatcccttcctgacaccttacacaaaaatcaattcaagatggattaaagacttaaacgttagacctaaaaccataaaaaccctagaagaaaacctaggcattaccattcaggacataggcacgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccagaaaacacatgaaaaaatgctcaccatcactggccatcagagaaatgcaaatcaaaaccacgatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactagaaatactatttgatccagccatcccattactgggtatatacccaaaggactataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaattgatgagttcatgtcctttgtagggacatggatgaaattggaaaccatcattctcagtaaactatcgcaagaacaaaaaaccaaacgccgcatattctcactcataggtgggaattgaacaatgagatcacatggacacaggaaggggaacatcacactctgggcactgttgtggggtgggggggtggggagggatagcactgggagatatacctaatgctagatgacgagttagtgggtgcagcacaccagcatggcacatgtatacgtatgtaactaacctgcacaatgtgcacatgtaccctaaaacttaaagtataacaataaaaaaataaataaataaaaaagaaaaatacaaaaaaaaaatacaataataatgctaaaaaaaaaaaaaagaaatcacctctctaatagttcatttaggaaagttctcagttttattaatctttgtgttgcctttgaagccaaacctgttgtattgcagatcctgcttcctggcagtcggaacacgtgtttataatcattacttccattccttgaaggcaacctttggactttattgattgctttatcttagttaatactcacctgacatccctgagttgtcctttatgacattggcagacaattttagcatcattgtctttaatataacacgttcaaaaaatgaagaatgtgtgattattttaatgaaaatatgagtactggtatttttagtatttctgatgtttcctttatgttcataaggagtatagagagattgctgtttttacactgttaccttccatcacttcttgaaaaggcaaagacaaggtaagtatcatacgtaatactgagaaatatatttcaaagtaaatatttttccttaattctatccctgttgtttcttctcttggtttccttcctttcttgttttctatctttctccctctaattcttcctggtattatcttgttttctatctttctccctctaattcttactggcattggctctgatgctgtacagaaatctaaaaaatatggcactaatttcagagaaaacgtggtgcaattaaaaatctttgttccaagtttaaattaagattataaaccaaaatgtggcagaaatgatctaaaaaccaagaatatttctcttacaatatacgtgcttcattaatacttcacaaatctagggtctttttttagccagtttttctcagggatttcttaagcttggaatgtatgctttggaagaaattatgaaaggttactaaagatacctgggacagctgtaaaaggaaggcctcagcccataaaattaaagtgaaataatgagtgtagaatcagtctcatgtgtgttgctgctagagatacagtcacaatgaccttctctcaatttctggaacatgtctagcatgttctcatttgtcaagccttactactttctagccttatacctgctattttcctttctgctatctttgtgtaaattactgtttctcaaacatcaaggctcaactcaaatgtcatctcctcagagaagcctttctttggtcactctaatgtagatacctttgttattctcgatcactatattttataagtcattcattgcaattatttttatttttacttgattttgtctttcccaatgttgggaatcagaaactgatacccccaaatatggtgctttgacaggtgctttgacatggtgaactgaagaagcctcaagttctctctgacctcctcccaggccccatctctcccagagcacagcatgaagttgttctctgacattcccttatctgcctaaagcctggacgcaccaaagaagaaaacaattagccctggtcccttccctgaattttcattgcctgaactcatactacaggaagacagaccgaagtccgtcagtgcacctggacagactttgtcacaggccagtgtctgttctgcaaacccacagattttgtgccaaaccattctatgttcttcaagcccattgaattttctgaaaaatcatttactgcccccaccccccgaaatcatccacatctccccatctccctttcccctaagaagggtgtatagccatctgtgtcccattgtggtggggtaattactctgtgatcctcttctgtgtacattaacatttgcatgccttttctcctaataatctgacagtgaagggaggtttttccttggcccctacaccctcaaaatgcaattttcatgaggctagagacactgtttatattgtttccattttattctagcaaccaaagtggaaacaagcacatggcaggaacccaataaatatttgttgaataaatgagtgaagtatttcctcacaattattctgaatcattggcattactggtagggagttgggctggggaatacaaagagatgtaaaatgctggagctgttctcatgtctgctttaaacttgggaggtttttttaaaaataaaattttaaaattttatattttgcttaaacattgatttgttgggttttgcttaagtattggtttaatttttggtattattggtctactgaggtataattaaccaataataaactgcttcatatataaagtgtataaactgacaaattttgacatatgtatgcagatatcatcactacaattaagatcatgaacataacaatcacaccctgtgaaaatttcccctgccacactctcttactccctctttcctgccctcccacgcagctaggaaaacattgctatgtttttctatcactaaagattaggtttcttttctgaaattgtatatgaatggaattattaagtatgtagttgtttggggcctgactttttaccctcaatataattactttttaatctatccatgttattgtatgtgtcaatagtttattcaggtttgttgctgagtaacatcctgattaatgaatataccacaatttgtttatccattcactgttgatgggcttttgggtaccagttgaaactacaacaaataaaactgctataaacattcatctacatgtttttgcatgagcatacttttatttacattgggtaaaaacctagcagtataatggctaagtcatatgggagacatatgtttaaatttttaagaaattgagaaatcgtcttccaagcagttgtaccagtttacattcctatcaacgtggtatgagaattccagttcttttacatttttgaaaacacttatcatggtcaactttttcaattagccattgaggtagaaatgtacaggtatctcattgtggctttaatttgtatctctctaatgattagtgatgttgaaaatattttatgtacttacttgccatctgtatactttctttggtgatgtgtctattccagcttttctccattttttggcattatttctctttttgttactgactgacttgtaaaagttcctgatatactatatctatgagtgttgtcagatatacgttgtgcaaatatgttttctcagcctgtggcttgcctttttatatttataacagtgtcttttgaaatgcaaaggttttaaattttaatgaagtcaaatatattgtttccaatttatatgtctttctatttgtgttatgtttaagaaatctttgccaaacccaagaaactaagatgtttccctgttttcttctggaaattatatagttttagctggcatatttagaactatagtacagttggtttatttgaagtaagtttttgtatatggtatagttttaattttgtacatgatgtaatgttaattttttacatggttaactgactgattgcaaatggctatttaattgttctagaagtagttgttgaaatgattacaatttttccattgattttctttagcatatgtatcaaaaaattgatcatatatgctcggctgtatttctgaactctattctgttctattcatccatttgtctttacatcaatgttacactgccttgattactatagttttcaatatgtcaaaagttagtagtgtaagttttactttgttttgttttcagcattgttagccttttaatttgcatatggattttataatcactctgttaatttctacaaataatcatgttaggatatggcgtgagatttaatcaaatcagtaataaatttggggagtagtaaaattgttgacaatattgattaatgtgatatgtgaacatttattcagatcttatttaatttctctgagcaagatttggaggcttacattgcacaagtctttcaaaatttttatcaaatttttccctatttacatttctgatactagtaaatggcatttcaccattaagtatagcattaactagcagttaatcacttttattggccttttcaaagaatcaatctttagtcttattgatttttctctatttttaatgttttattttttgttaatttatattcctttttcctattttaggtataatttgttcttcttttttagtttcttaagatgatactttgggtcatttatttgaaacttcttttcttttataacataagggtttagaactataaaattttctttaaatactggtttagtgtattccacaaattttgatatgttgctttttcatttttatccaaatcacaataaattctaattttttttgagatggagtcttgctctgttgcccagtgcagtggcaagatcatggctcattgcagcctcaaactcctgggctcaagtgatcttcccacctcaacctccaaagtgtcaaggactacaggcatgccaccatgctgtgctaattttctaaaaatgtagttggagtgatggggtctcaccatgttgtccagattggtctcaaacttctggacttaagcaatcttcctgccttggcctcctaaagtgctgagattacagatgcaaaccacggcctggccttaatatttctttgacccatgagatagtagaaatgataattttttggctccatgaatttggagattttgaaaatagcttgattggtttctaatttaatttaaatattgtctttgaacatattttgtattatctgaatcagatcaaatgtgctggagacttgtcctttattgagaatgtggtctgtcctagtgtacttcaaaataatgtatattctactgtttgttgggtagaattttctagtaatttcaaataggtcaattagttcaaattggttgatagcactgttcaatatgctttctaactttttgtctacttgttttataacttattaatagaaaggcatacacattttcaactataacagcacatttgtccatttcttctgtttggtcagtttttgtcatgaatgttgaagctctgtcactagatacataaatatttggtttgttctctcatcttactgaattgatctttcatcatcatccaataaccctttttatttcaggtagtgttcactgttctgaaatctatttcatctaatatcaatataggtcctcctgtttggtgtgggttaatgtgggactaatctgtttttcatccatttatcgttaagctttttgtatactggagatgtgtttaaaatagtatttctactttcagccaaggtatatttaccctttctaccacaaacaactagaaaactggacaaaacatatcaaacagttgtttccaacacagaacatcatgcagtgcagagcagtaactcctgaaatagtggaaacaagtgaagtgagttcttcaattaaagcagcttactgcatggagactgcttccaggcagcagtggagaagcagagaactaatgcagaactcaatggacacactctgagctgcagaaatggagttgaaagtgaaaggttgatgaacttgtggaaatagaattagaccattagaccagaaaaaaaaactaaaaaataagcagaatattattgaactctgggataactttaagtgacctaaaaaataggcaactgtagttcctgaaggagaacgaggagagtgagaacaaaacagaacaaattttaaagatataatgtctcattttttcaaaatttgaaggaaactagaaataaacagatctgaaaattcatatacatcccaagcacaagatacataaaaaaactacattaagccacattgaaatcaaatttctggaagcagctgataaagacactatgctaacagcagtcagaaaaagaaaagacacattacatactgaggagtaagataagaatggcagaagagttctcataagaaacaaagtgagccagaagacagcggaatagcatctccaaactacagaaagaataatctgtcaacctagtattcatagcggcaatatctttcactaatgaagacaaaataaagactcttcaagcataatcattcaagaagcatttatcaccaggagacctacccttgaggaaatgttaaagaaactcctacaggcagaagggaaaagattccatatgaaaatctagatcttcaccaaggaatggaaaaccatgcaaacaggaaattggtgtataaatatatgagggtttttttccctatttttaaagtctattaaaaatttgactatgtaaaacaaatataataacaatgtatatgctagtttataacacatgtagaaataaaatataaaaataatagcacaaaggatggaaaaggaagcataacattatcgtttgtttttaaaattatatccttgaaatggtataatattacctatagatagacttattacattataggtatgtcctataaactctaaaacagctactaaaaaggaatcattggtctaccaaagagataaaatgaaattataaaatcataattaatccaaaagaaggcagtaaacgagtaaaagtagattaataatatgtcacaaatagaaaaatagattgtaagatgatatattgtaacccaactgtgttaataatcatagcaaatgtaaatggtcaaagtacctctattataaagacagagactgtcagagcagattaaaaaacaaaacaagcaagattcaagtacagtaatgtgtcatttaataatagaggtacattttgagaaatgcatcactaagcaattaagtcatcgtgcaaacatcatagagtgtacactcatttcgcagtatccacaggagattggttccaggatttcccacagataccaaaatccatggattctcaaatcccttatattaaatgtcacaggattcatatataaactatgtatattcccctgtatactttaaattatctatagattacttataatacctaatacaatgtaaattctatgtaaatagttgttatattgtattttaaattgatattgtttttattgttgttttcatttagctttccaaatattttttatccgtgtttggttgaatctatggatgcagaacctacggatattacagggctggctctacttgcacaaacctaggtgatatagcctatgacatttctatatatgacaaggctatatggtatagccttttgctcctgggctacaaacttgtacagcatgttattctactgaatacagtaggcaatcgtaacacaaaggtgatcatttatgtatctaaatatagaaaaaggacagtaaaaatgcaggattataatcttatgagactgccattctatacatggtcagtcattgactgaaacattgttacgcagcacatgactgtgtatgctgcttatagctatgtagccaaggtattccttttacatctttaaatgtccaaacaaaattattaactgtagaaaaataaagcaccaaaaaacctagatttgaattgtgcaccttgctcaaaacaaaactaatgaattaaaactttgaggataagatttgagcacaattttgcaaaattagcttgaagtagtaggcatgggataaagaaagtttctaatccccacctacttctctatctctagctcattatttcttctgaatttaccctacagtcttgttaattcacactcaactcttcaattttccctttacctctctttaccattcctttgtgcctttgcatatactgttctatctgcctgaaaccccctttctacacttctgtatctaggtaagttgtgctcatttttcaagacttggttcaaatcttctctttgaagactttctgatttctccaagttatgtgattatatttacacttacataatgatacatggcttgaaacaaagcattctcttttaacccttgatacagcccctgagtcaggcattactttttttttttacgatgaaaaaaacttgggacgagaaattagatgaattgtaaaaaatcttatgtacaacatatgacagaatcaagacttgaatagcagccttatcactcattgtagtgtatcacggtaggttcacaataagggacaggatatatgttgtcacagtgttctttctcagtgaagtgcttatatattcaataagctaatggaaatactctctgagcttcttacaaggcttatggtaggtatgtaaacaatgcttgcttcagtctccattaaatcactttaaatgagatactgtgagtatacacaataatgctattcaaatgcttttgtgagcaaatgagattttctgcttaaattcttctatcatctttttcctattttcagaaagaaaatggggacaattgcaataatggaaatgcaagtgactggattagtcaatagcattgttgaactaagttaacaaacaccttagcttttcatgaacaatgatatagctaaactgattaacatagaatgatatcagaattagctcatcacattcatttttcttcttatcaggagtgacactgttgtagcagagcagttgttttctagctggtatctgtcatcatatataagattataactgtgacattgattttttcccattataatagagtggatgtaccctgcttaggtttgaatgtagggcattctatgaacctcagaaaaaaacagctggtaaggaaagggaggaacaaataggccagaactaagagatatacattggctacggaactggcttttccaaagattctgatgagcagagcaagtcacaaattccagttggcagacttaggtatgatttttcctgttgtagactttcaagaggaaatgatgagattgtagaagcatgtcaaaaaagattgtaggcaccgatgatgctcatcaagtaaatggcaacaccttcatttggttcacattcccattaaccactctgtgatggccaagtgtttggactggatgtaaacaggattctacccaacaattagaaacatggagagagtctccaatgtagatctgacaagcagttcatctctagatatataatagacttcaaattaagagcataacttcttgaagtttgagctcttcatgtttaaggtttggtcctaactgggtttaatggagcagaaactgctaaatgaaggacttaagtacttacttaataagtaagtatatagtagatatatatatatagagagagagagagtagatatactatatagttatatatagtatatatatacatatatacacacacatatatatatatgatatagtagagataggtagcaggcaataattggtcatgctatttaattatttatatttttggtgaaaagtaatgtaagttcttgtcctaagtaaagagagtctctgtgtagctttcatctttcaaaccaactgacaataaaaaagagaaagtgaaaaagaaaaaataaataagatttgtcataaactagaaaatagaaataatgctgaatcacaataaagaaaagcctaaaaatgctttgaaaattaaaactagacgtgggaaaacatgatcatgtttataaatatttcagaacaactcttcagagttgtccaaaagtatattttgcatcctgaggaggaaaataaattcctctctttgaactagtagatgatctactagttgtgtaagttgtgttgctagagccttcctaatctctgccctccacaatatcataacaagggagtggcagggccaaatgaggaaatgcacagaaaagccatagggcaggagtcagaatgtcattgtgacagtgccaattaaacctggatgggattcagtttacatcacgagaaggactcatgacaaatcaggttccactctgagcaaggccagaatacagacacgtcatggagcaggttatttcttataatgtgttctgaagcaacggactaacatcctagaggctggctgatccaccccacactcccaactacttcctgacactattcttcaaagattatctggtctggaaaaaaagtactcctatttaaaaatgagtaaccacagcaacaaacgctatgggagctacagaatcatctacatcagaattaagagggatgaaaaacagccaggagaaaaataattcaagccataaaagctatacagcaaagcaaatttaaattatgagttttacataagtgccactggaaatacaaaaaaaattgaaaagtctaatttcaatgtttcaagttcaaacaagatatgaaaaacaacaaaattataaagtgaaaaataagctgaaaggccttagtgaagaaatggaagagataaacactaacattgtgaaagcaaaagtcacatttaaaggaataaaatgaaaatcagtcactccttaaagcacagcaagggtgaataagatcagcttccgaaaactgagtggaatgaaattgaaaagacgtgcttaacacgtttgagaaaaagaatagatatagaagagaaaggaaagtcacatacaaatggtttaactccctgaaagggataaattgaacagaaaataatcagttacatgtatacagtaaacaagaataggggtgaaaccaaccaaaatatgtggtggaggccagggtcaggaatgggggagataaacagacattgtatagacaccatatcaatcagggaacaatcagagaagtagagtcgttgagccacatttattatattgattggaccttctacaattgtggaagctaagtcatgtatgtaagactgttgcttctgtgtttcttgctagaacctgaaatatccacagggaaggcagttgggaggaaagccaaacatgatgtaggaagcaggacaaagggggaacctctgagaatggattggagcctacactggcctctcaccacctccagtcctccggctttgataaggcaggggtggcctgcaggagaaactgattttcttcatctcagggctgagcacacacctggcccaggatttagaggagctgaaggagggaatgtggcacaaacttaaggagctaaacttcagcttctgtcccacagcaaaaaggtgagatggaaaagatgcaacagctcaggagagctacagtgtctaatgccctgcaccaaactactgtgtgtaaaaatatacgtatatatggctactgcttcactgtaaaatgtctgtggtgtcccatgctaaccagatactacgtagggcacagggatctggaaaatactgttccaggttggttaacgtgatacaatataaatccaccacaacctattggagtcctaattgccatatataaataggtatctttgaaagctgatgaatcaagaattccaagtatcaaaacattttttcaaaagttaaattttataaagatatccagatgaagttacaaaatgtaaagaaaatctttccaaacattaggaagaggaaaaactgttccttcttttctctctgtatttctttctctccgtctctgtctctcaaagacacacatacatgcacacacatgcacacacgcacacacacacacacacaaatctttaatcatggcaataaaatatattgggaagaggagagctataaaatcagatttgccagggttagattcctggctctcattctcattatttatgtgactttaggaaaattaatacatataaactcagtttatacactcctaaaatggtaataatagtaccttcttcaggatgagagagtaagttaatacatgcatgatgccagataactttggatcattctcctaaattgttggaaacttttgccaaaattactaagttgtgcaatttggggagtagcacagacaagccctacagcaactgggtgagacagtcattgctgaatctctgtagcaggaattattatgacgttggagcctttttactgaactctgtgtcagatgagctcccaacaatttccagatcatcaagaaaagtccagttttcaaaaagatatggcaagaaatctcacagtcaagaatctgagaattgtgctcaagccagtgtcataaatatttctcagaagtagaaaagcagagagaaagaatgtttccctccagaaccacgagatgatctcccgcttcctccgtggaaaatagtcctcttcaacctgtatttcattgctgagtttttgttttgattttgaagccacagattaatcatgcaattttggcagcaaatgaacgactagtatgctcaccacaacacaggacttgaatgtagcaagtacgtgagctagttgcagttaagttttaggctctagaaaatgcatttgaatctgaggagaaaaaaataagtatatatgtggctttaaattcaaccattccttggaagactttctacaatgttggcagcatttatgaaatagttatatttatttctttttggaatacatattttttctcttataaacaactatatataatgtaagggcaatcataatttaccatagaaagccacatcatgcaataaaccatctgagcactcttttggcctctgttataatttactgtattcaaagctgttggtgaattgtgtgggtggtaacgttatgagtttttcaatatctcactaagtatatttagaatgcttaattgaagcttaacctttattttgttcaatacatgttgtttctagctaatagttttgggggaaataatcccctaggtcaaagtcttatatttagctgcttctgttttcttttaaagctagaaaaatgaagggtgtgaatgaattgatataacaggaaatcaacagggtaaagaataattttgatgatttcttcttggcattgcaattatatccagtacacttgatgatgaaataaacaaatagttcaaacaaagccattaattttcttcctatctacacaattttaattagaaacatttaattagacttggctaaaatttctcaacaagattgcagaatgcatgcttatgctacttgtacaccaggaaatgtatttttcagcatttactaagtacaacaaatagctgccatgattgtaggtatttcatggaaaacattcttgtcaaaattatcttttatcccaaaaagctttcactggaaaacaaagttccctcagagtttattagttattaagctttgatattttaattgttataataaataagatgcctttttaatatattaactgcattttatattatgtcatttttatggcaagcaataaatgtgtttgatgttcttgatactatttcaccactgaattttttaaactttcattatcatgagcatttctgacatgaattaaaatgacatgcaaatctgtaagctcatttcactgaagcaaaaatgctaaattgttgaattcatagagccttttaatctttaggggcaaatattgttttcaactaaatttgatagaactcaaccaattgttttaagtagttctcttttatttctctcattctacaaccatttgtgtgtagaaaatatgcaaacacagttgtttttcaacttaaaaaataataaacattatttccactagcatgttaaattatttgaaggcactgtactaggctttctagttaaagaaacttatattacctaattacacccaagaggtaaggtccttatatgactcaccaaatatttactaataaattgttaaatatagttattttgagatgtctatgtttctaattgcatttaataataaataaaaatttaaatgttatctttaataatcacatatcagtactatattcttattctcagcatcttgggaaagacgtttaagtttaactagagtgacacttattttggcatttaagagtagagcttattaatatttaaatctatgcaattagatttcaatttttttcaaacgttttttgttattaggacacattcaaatttttaattttttctaaatttataaaagtatctacatggttgtttaaaatgtacttcagaaatctatagcaatgggaataaatcccatataattgccccaaaagatacaaaatgttaaatagtttgatgcatattttaacagatttttaccctacatatgtttaatttttcaataaaatagtgaaactacttgtacatattcacttgcaactggttctttctattcaataatgtattttaatcatgaatgaattcaatatataatggatttaaagaaaaaatacatggttagtctgaacgctgcctgagaattacatggttattctaaaactgaaaaagtcagctttgttctctttttttacttcttcaatttatcatcatagacacacagaggaagcaaatctcgattcactcctatggagtgagcatcacttttatcttcatgttacagctggggagtcagagacagaacattcaagcaatttgtccgatcccatactttcaggaagggaaggagccaggattcggaaagtggcagctatggtgtcgccagtccattttcctaagtactatgttccttaccacccacaggaaacaaccctccccacaataactgagctctgctacggtcactaacgaggtaaatgaataatatgcgcctacactgtaccccacccaccgacctgtttaagacacacaatacaacttcatgcctggaatcataaccatttacttcagtcccaaaacgtcagagatgctcgctaatgactgcccttcttaaagttaattctgtaaatgttaagtattatcatctcctaagcctttcccaaagtgtgtgttccatgaatagtctatggaaatgaaagagctgttatttactcaaaagttatttgtaggaagaggaggagaactcatgaaaatatacattgtgagcctctaaaaaaggcatcaaatatactgatcttcattttgtctgtaaaatattttataatatatcacttttctttttcagaatattcctaggtacaatggttccgggaaaaagattttgggaaaatgcttatctaatctgtaatcaccaaagaacataaatttagagtttgaatagaatagaatagaataaaatagatgcaagtcactgcttcatgctttttatatattttaacttgcgtagtctcagtttggcatttggaaagtgagaataatcataagtattccataacattttgtgaagataaaatagctaatatattatggcagatttatggagtaccacaaattcattggtactccttcattaagagatagaaactgtttagtctgggttagtctgtaactgcatttttcaatagactatggtagaaatgatgctatttcctgtaataagcctggcagcttttaacttggtctcatgaaaaaatcaagccatcatgtataaaatactgtgataccaccatgctgtgaggcagccccagacacgtggggaggctctggagcatgaaaaagcatgcaaagaaagaaatagagcagtcatgatatgccccagtgccagaccaataagtgaagaagacatcttggaagtggatatactccaggcccaaatgctataaatgaaactatctggattaaaattcaactatcctgagaagtgatgtcagcagaagttttaaagtatgaagctgggaaaacatactcctccataagagcaatgagtactaacaaaaattgtcaaaatcaaatctggaaattaaccaaaggcttacaacaatctggtagcagtcattcaagaaaaatggatgtttctgagtaataacaatgacttttgtggcattttactttgctgtattcctatcccccactctcccactccacagttcccttgcaaatgagcagccttggaattattgtagtcataaaaagcagaatcaagggacaactaagatacctgacaaaagaaagtttggaggccaggcgcagtagctcacgcctgtaatcccagccctttgggaggccgaggcaggaggatcacctaaggttgggagttcgagaccagcctgaccaacatgaagaaacccccgtctctactaaaaatacaaaaaattagccaggtgtggtggcgcatgcctgtaatcccagctactcaggaggctgaggcaggagaatcgcttgaacttgggaggcggaggttgcagtgagccaagatcgcgccattgcattccagcctgggtgacagagtgagaatctgtctcaaaaataaaataaaataaaataaaataaagaaacagcttggaaacacttctcctgccaagagaacccaaaaccttcacactttgaacagatcttttgaggggaaaacctgaaagttggtacagagaatacacagacactgtggataaagaaggaggaatctgggaactccagagtcaccaagcaccaggaccagctctcagtactgaacaggtcctaaggaaggggtgagtgaaggaactgcaggggaccacactcctgctaggacctctgcgatcctagctacaagagatccctagacctccacagacttttgaatttgcagggggaattgaccagagagcaggcagagatacagccagaaccttggcagagcccagaaagtttcctggcgtgcagtgcgactgcagcaaaaggcagccagagaccatctcccaaggctctccatcttgctctgagtgactccagtccctgctgactcctgggccaggagagagcacggctgcctctcccacaggtccagggtgcatccgatccacacaatcccttgtgcacaggccgctcccagactgactgcctggccgctcctacaggagaggcgcccacagcgcggcctcccctggcccgcctgagtgtttcacaggtaacctgggagcagtcaggcatgcccagcgcagcctgcacttgaccttgagaggacagagggcaaaactgcaggcctggtcccaattccccaagatttgagcacagtacccagaggtatggagctgagatctgcagcccgagctcaagttggggaggagccccactcatagaacatcaagcagagtgtcgcatgggttcatgtgtgctggtgcaggagctgggtgtccctccctccacaacatcagtctgggaaagacatagcctgttagccagccacaggcccctttcccagggagatccgtggcctggaacacctggaacagcccagtaatctgggcacagaggcttgagacaagtccagctggttgggcctgctcctggagtcaatgctggaagggggctcagtgaacagggtgcgagcagggcagtccccacagctgtctgcttggataacagccccggaccacaggtgccacaccagctgcacatttacaatacagccgccctgatcacgaggtcaggagattgagaccatcctggccaacacggtgaaaccccgtctctactaaaaatacaaaaaaattggccgggcatggtggcgggcgcctgtagtcccagctattcaggaggctgaggcaggagaatggtgtgaacctgggaaacggagcttgcagtgagccaagatcgcatcactgcactccagcctgggagacagagcgagactccatctcaaaagcaaagcaaagcaaaacaaaacaaaacaaaaccaaaaacaaaccaaaaaaaacccactacggctgccctgccaagggatcctccaaccttgacacatttcatcactagaccaccctcaaacataccctacaacacactctgactttgccaagctcagagaaccagcaggtccccagggacttgcaggtctcctggtgacctaaactttggctcagactgcccctctgggacatgagagcacagaccgccaaagccccacgtggacctaaggtaacatgagcagggcgccagcaattgcaggggctccaccaaagcctaggaacaaacttggtgagggactcttctctcatcctccatgtcccttctcccgagcactgctgggtatgcactgaaatacaaaagaagtatgtggctaagagcccacctactggccctactcttaagcactatctactggatcacagcatgaatgactacaccaaacaaaaattctttcagcacagttgaatgcctgtgaaacccaacatgggaaacaacccacaattaaggaaactttggagaaccttgaccctctgcaagcactcagatacaaagccaattgattacccacaatatacactgcagtcaaatcctcaaagtaaaaagaatatgaaaataaaaggtcccatctaaatagtagcaatttcaaaaagaaaagaaacaccagacccctcagatgaataggaattagtgcaagaacgctggcaactcagaaagtcagagtatttccttacttctgaaagattatagtagctccctagaaatggatagtaataagactgaaatgtctgaaatgacaaacacagaattcagaatttggatgtcaggaaagctcaacaagattcaaaacaaagttgaaatccaatccaaagaacatagaaaaatgagtgaagacttgaaagatgacataggcattttaagaaagaaccaaactaaacttctggaattgacaaattcggtacaggaatttcaaaacagagttggaagccctagcaacagactagaccaagctgaggcaagaatttcagaactggagaccagtccttaaaatcaacttagtcagacagaaataaagaaaaaggaatcttttaaaaaatgaacaaagtatccaagaaatataagattatgtaaagggaccaaacacatgactcattgacattcctgagggagaaggaagagagtaagcaaattggaaaacatatatgaggacataatccacaaaaatttccccaatctcaccggagagggtgacatgcaaattcaagaaacttagagaatccctgtgagatactatacaagaagacaatccctaagacacattcaccaaggtcaatgcaaatgaaaaactcttaaaggaagctagagaaaagggtcagatcatatatgaagggaataccaactggctaacagtgaacttcccagaagaaaccttacaatccagaagagactgtggacccattttcagcattcttaaagtaaagaaattccaaccaagaatttcatatcccatcaaactaagcttcataagtgaagaagtgatgaaatatttttccagagaagcaatcactagaggaatttgctaccactagatgagccttacagagatctttaagagagttctaaacatggaagcaaaataaagacacctgctaccacaaaaacacacatgggtatatagctcactgatactccaaagcaactacacaatcaagattacaaagcaaccaggtaccgacactgtgataggatgaaaacctcctacctcaatagtaaccttagatgtaaacagtctaaatacaccacttaaaaggcatggagtgacaagttggattaaaaacaaaaacaaaaaatacaagagccagccttctactgtcttcaagagacccatctcacatgtcacatgtagtgacacccataggctcaaagaattgatgaaaacagaaaacatgcaaacagaaaacaaaaacatacataggtcactattcttatatcaaataaaacagactgtaaatcaaccacattaaaaaaaatgacaaaaaggtcattacatattaataaagggttccattcaacaagaagacttaactatcctaaatgtgtacttacctaacattggaacacacagattcatagaagacgacttaggcagccatgcaataatagtaggagacttaaacacaccactgacagtattagatcattgaggcagaaaataaattttgaacttaaattagccacttcaccaatggacctaacagacatctatagaatacttcacccaaaaaacacagaatatacatttttctcatctgcacatggagtgtatattaagatcaaccacatgctgggtcataaagcaagtcttgataagttttagaaaaatcaaaatcatactaagcacattctcatactaagcacagtggaataaaaatagaaatcaatgccaagaagatttctcaaaaccacccaattacatggaaactaaacaacttcctcctgaatgacttttgttaaacaacaaaattaaggcagaaatttaaaaaaaatccttttaaataaatgaaaatggagataaaacataccaacatctctgagatgcagcaatagtagtgttaagaggaaagtttatagtgctaactgcctacatcgagaagttagaaagattgcaaattaacagtcaaacatcacacctataaaaactagaaaaaaacactatttctatcaaactatcaacatcatctttcacagaattagaaaaaaaaagtattctaaaattcatatggaacaaaaaagagctcaaacaagcaaggtgatcctatggaaaaaaaaaaagaaaaaaagctggagacatcatattacctgacttcaaactgttctacagggctgcaataacggaaacagcataatgctggtacaaaaacagacaggtagtgttgcaggaagtcagggatcccgaatggagggactggctggagccacagcagaggaacataaattttgaagatttcattttaatgtggacatttatcagttcccaaataatacttttataatttcttatgcctgtctttacttcactctcttaatcctgttatcttcgtaaggtgaagacgttatgtcacctcaggaccactgagagacttgtgttaactgtataaactgattgtaaaatgtgtctttgaacactatgaaatcagtgcaccttgaaaaagaacagaataacagagatttttatggaacaagggaagacaaccataaggtctgactgcctgcggggtcgggcaaaaagtgtggggtcgggcaaaaagagccatattttttcttcttgcagagagcctataaacagacgtgcaagtagaagagatgttgctaaattcttttcctagcaaggaatattaatattaataccctgggaaaggaatgcattcctggggggaggtctaaaaacagctgctctgagaatgtctgtcttctgcagttgagataaggactgagatatgccctggtctcctgcagaattctcaggcttactatggtggggaaaaattctgcccggtaagtttgtggtcagactggttctctgctcataaaccctgttttctattgtgtaagatgtttatcaagacaatacatgcactgctgaacaaagacccttatcagtggttctgctttttccctttatcctgttccctcagaagcatatgatctttgttagacccttattagtagttctgctttttgccctttgaagcatgtgatctttgtacctataagtacaatataggtacaatccctgttgtacctataagtacaatatacgtacagtataatccctgttcttatacctcctccccttttgaaacccttaataaaaacttgctggtttgaggcgcaggcaggcatcatggtcctactgatatgtgatgtcacccccagtggcccagctgtaaaattcctctctttatactgtctctctttatttctcagccggccgacacttatggaaaatagaaagaacctatgttaaaatactaggggcggattttccccaataacattgaccaatggaacagaatagacaacccagaaatagagtcacactcttacaaccaattgatctttgacaaagtcaacacaaataagcaatggggaaagactccctattcaataaatagtgtggcaaacactggctatcctatgcagaagcatgaaacttgacgcctacctatcatcatatacaaaaatttactcaagatggattaaagacttaaatttaatacctgaaactataaaaaatcctagaagaaaatctaggaaacaccactctggacattagttttcggaaggaatttataactaagtcctcaaaagcaattgcaacaaaaacaaaaattgacaagtgggactaaagagcttctgcacagcaaaagagacaatctatgaacagaaactataaacaatctatagaatgggagaaaatatttacaaactgtccatctgacagatatctaacatggagaatttataaggaatttaaacaaatcaacaagcaaaaaggaaataatcccattaaaaagtgagcaaacttagaagataggtagtgatatataaaatttctttaaaaaaaaaaaaagggagcagaggacctaaagagacacatatcaaaagaagacacaagcagccaacaaatgctgaaaaaaatgctgaacatcactaatcatcagagaaatgaaaatcaaagccacaatgagatatcatctcacaccagtcagaatgactatgattaaaaagtcaaaaaacaacagatgctgttgactttggaaagaaaaggtaatgcttatacactgttggtaggaatgtaaattagttcagccactgcaaaaagcagtttaaaagattcctcagagaactaaaaatagaacaccgtaacccaacaatcccattactgtatatatatatacactatataatccacacaggtggagtggataaagaaaatgtcgtacatatacaccatggaatactatgtagccataaaaaaagaatgaaatcatgtcattcgcagcaatgtgggtgcagctgaaggccatgccaaataccatatgtcctcacttataagtaggaactaaacattggggacacatggacataaacaagggaacaatagacactggttaatacaagagcagggagggagacagcagtgcaagggttgagaggctacttattgggtactatgcttgctatctgggtgatgggttcatttatacatcaaacctcaacattatattaaatacccctgtaacaaaccttcacatgtacccctggaacctaaaataaaagttgaaattagaaaaaaattgagaattatatcaaccactaggataaataatttggagttctcccaaagccctactctccaaaaaaattgtcatgatttgacctgttttgcagttccctggaaaacaccactcagtgtttgtcttttttgatctatttcaaaacttactgactgcagacaccttttcttggggggcatttataaaaacagtcaatggcattgcagttgtctgaagtgctaataacagttgagcaatcaaaaagcttaccaaaatctgaaaagaaaaaaattggtgaacaagatgcccatagaagtctatgaaaagctacaaaataactgggaatctagtaggccattctgcatatgtgtaggactgtccatatccctgggaaagacctgagaagtcctaatctcatacctctagctgaccttgaggctttgtgcaaagaagaggtaaaagctgaagcagaattataaactggctcctttatccttgaaggcatgcccaaatgagacaaagtccctggaaaataatggtagatttattggttccatgcatttaagaaaatctctgtccaatcactaggtgaccactaagctaactgagcagagatttcagaggctccacatgataaagagtatagaattagtttaggaagtcactaaacagaccaaaagtatgaaaaataagcaacaacaacaacaacaaatagtaataaggggcagattctgattttgaaatctggcacattgtattatttatgatatccaggttttattaaaaaatatgagacatgcaaggaaacaagaaagtgcgattgatatacaaaaacaacaacaacaaaaacgcaatcaaagaaagtgtcacggatgagctcagctactgggcttattacaaagactttaaatttgctattttaaatattcacaaagaactaaaataaagcaagccatgtctaaagagtcagaagaaagtatgagaatgattctcaccaaacagataatgtgaataaggagataggaattttgtttttaagaaaataatcaaataaaaattctggagttgaaaagtatattaattgaaataaaaattcaataatagggactcatcagggaattttttttctgccataagaaacaatagcaaatttgaacagaggttaattttattatctagtctattaaaaaaataaatgaagaaacatgaataagacctgaaagacttctgggacaaaaatctggcaaacaaacgaacataggcataatggaattcacagaagagggaaagggaaaggagcagaaaacatatttgaaggaataatatctaaaaatgtttcaaattgatgaaaaaaattaatctacacaactaggagctcattatttcctaggaagataaacccaaaaagatcaatggccaaccacacaataattaatctgtccaaagtcatagataaagaaaattttgaaagcagcaagagagaagtgaccttattctgcacatggcattctcaataagattaactgtttatttctcttcagaaccatggaggccagaagacagtggtatgacatggtcaaatgcatgatcaaagaactctatatctagaaaaattgtctttcaaaattaatggaaaaattaaggcattctcagacacacaaaaagactttacggatagaagaccctccctacaataaatataataaggggactccttcaggctgaaatgaaaagactttagatagttacttgaatccaaatgaaaaagaagatcaccagtaaatgtaactatatagataagcataaagaacagtataaatttatatttatttgaaatattttttatcctgtttatttagaagataactttataaagcaataaatataaaactatgctgatgagattacagtgtatcaaatataatttgtatgacaaaatagcacaaggaaggtggaatggaattattgatggccgttgagaaacctctgttcttgtctccttgtttgaaataatttaaacaagagtcacacagcaaaggagatgcagcatagaacagtttagtgcaaaggtgaaataatactctgaaagactggttgagaatagacaaagagatgatttgaattggactgcttgtgaggatgagacagtgttgactgttactggggaaactccctttatgggactcttatatgattattcataagtggattagaagaggttttactaataagcatgttctgggtggtcctctgggtacacatgtgcagtagctgtacatgcttgttcatacatcatatgtctcattagcaccttaaatctccacatagggttctgatttttactattatagtgagtgaagagtcagtccgaggacaggtaaaatcaaaatatgcatgctctctacaggggaaattccctactgtagatagttgtgcttgaatgagtcagtttgactataaggtgaatgctgcagtttattgtattgatggtgcagtcaccatagttgccacatagcgaggacatgtttacttccttgactacttatcctgcctcagaatgaagctgtataggaataaagattttataccattgaagtcaacttggtactaatccaaacaagaagtatataaatcgagatgttaattttaattttcagggcaaccactaacaaaataactcaaatatagtgaaagaaaaaataagggtatttaaattatacatgagaaaatatatctaattaacacaaaagaaaaaagtgatagaaaaatggaggggaaaaagatacaagacatagagaaaataagtagaaaaatggaagatataaatcttttcagtaattatattaaatgtaactggattaaacactccaattcaaaggcagattggcaaaatgaaaaaaaaactagaaagaacgagccacctatgtgttatctataagataaatattttagattagagacacaaataagctgaagttaaaagatacataaagatatgtcatgcaaatagtaccccagaaaaagctggagtagttatattgctatcaggcaaaatattaagtttgtgacataactatgtattactttatgacaaaaatattactataagcaaagaaggacattttataataataaaaaggttagtcttttaagaagaaataacaaatttaaataactgagattatgcaaagtatgtattctaaccacaatagaataaaattttaaatcaataacaaaagaaaatttggaaaattacaattagtttgaacttaaactataagcttctaaataaccaatacatcaaaggaaaaatcataaagaaaatacaaagtacttaaagatgaataaaaatacaaccaaaacttatgggatacagctaaagcagtgcttaagaggaaatttatagctgtaaatgcctgtatttaaaaaattaaaagtcttaaatcaataatctaaatttccaccttaagaaactacaaaaaaaaaaagagaaactaaatccaaagttagcagaaagaataaaataacaagaactacagtggaaataaataaaatacagtacaaaaaagagagggaagaaaaacaaaagttgattgaaataatcaaaaaaattgacaaacttttagctagactgattaagaaaaaaaagagaggacttaaactaacaaaataaggaatgaaaaaaatgtacattatcactgcccttacagaaataaatattttacaaaggaataccatgaacacctctatggcaacaaattagataacctcgatggaatgaacgaattcctaggaagacacaaactaatgaggcatatacaaaagaaataaaaaatccaaagagatctataacaagtaaaaaaaaaattaaaaattaacaaagaagaaatcccacaaagaaaaacacaggaccagatggcatcactgattaattctaccaaatgattaaagaattatcatcaatccttcacacactgttccacaaagtagaagaggaagaactagttcccacatcattccatgaagctagtattctctgccaccaaaatcagataaagacatcacaagaaaaaaaatagaacatagaccatattccttatgaattgagatgtaaaaatcctcaaaaataaaatgaacttgaactgcccatgggaggctttcctaaaatcttgacccacaatatcatgaacacaacattttttatgccattatatttagggctattgtaaaatagcagcaaataactacatgtgtatgtatgtgtgtattatatataactatactaaattattatgtattatacatgtaacaattatagaagattggacaaatctagtaacatctaattaatattcaatttattacaaatctaataatagctaatttgttgtttttatttaacagtaatgggagttgagaccaaaaaatatgggagttgttgaaagtcatttaatccctacatggtcaagtctgaatttgaacccaaatatcctagacagtacttctctggaagctggtattaggtagatattgaaccaattcttcatttgtctcagatctcagaaaatgtaaaactattagaaaaggatatgaatattgtacataaaataaggggaagacatttctttttcttcattttataatctagaaataaaacctacataggaaatttatatgcatgtttgtatgtttgtgttaatgtgtatgaacatatattttattttcaaggaagaaattattttctaaataaggaccaatctctaatccttaaagtatccatcagaatgtgattcaataggttttgcaaaatcctagttcagatgcaacttaatcactagtcattatttcggtgtgggccatacttagaactaaagtgctcagaattcttagtcaacaagataagtccttgacagatcgtaacggacttgtctattttattttatttttttaaaaacccagtgttgaaaagagaaacttggttagaatttccatgattttttataatggataatttggaagaaaaggaaagaaaaggctgtgaataaggaagattaagttattcttttatgcatccatccattccttcatttacaaaatatttattgaacatctattatttgtcaggcatgctggagacaggcagtaaacaagacagccaagttctctatccttattttattgcgggagagagaaccaataaaagataatgaggagacaggatgaaagaaggaaactagccaagttactactaagtagcacaactgagagatatctgtattatctgtctgatcttatgatggcatcagtagagatggaaggatgcgaatgagtatgagaaatgcttgtaggctgaaaacaagtagtataatttgcgtattatgtttatttgtgttatttcatattgttttgtgtttcatatcagtgatgttacttaaaatatgcttaaccacatatctctattaaagccaaatattatttgctcttcatcattgtatattttttaagtattttagtgataacacattttaataagtttattaaatcattttcaaagatcgtctcaaatgtgaacttaatggaacttactttgtagattattaactttccaagtcacagaaaacaaaatggagagaaaagaatctcagattttttaagttgctagatacagagaactttggttctgtctttctgtcctaaatacaagtggctgaacatttttaaacttaatgcctaataatggaaatgaaagtgataccactggcattggtggttgtttgtatttctgctaggtgataagtcacttgaatgaaatgaccaaatcaagtttgtggtatggacacagataataacacccatggtatcaaagatgagtacctaaaagagattggaaaaattactgagaggctgaatttatattttttaaatgatatgcatataataaattaaaatgtcaatattttaaaatagagtcacaaatattttatttatttatttttattgttatcatttttttcctctgaaatccttgccctctattgggcaaggggtgagggaagcagacagaccggttggacatagtagacaggtatgtgaggacaaaatgctactcaaaagctagccaacccatactcccctgaaatggacgctaatgcccttcaaactctgggcattggtttcacacacatcgtcttccagggataaaagaaggggttcttgtaaagcttcttgttaccctcaaccatggaggcaagttccgagttctggttttcctaggacactaactctagtgtccctgttgcatcagtgcctgtgtatggcctcccagcccaaccagaaattgacagaaaggcatgtatttggtgaaaagatatacatatatttagaattagccagctggactcagtttagatgatcccaattttgtttgcaacatccaaagcatcataatcaggagccagttgaacatatgccttcttctctccatcaggtcgaatcagggtgttgaccttggccacatcaatgtcatagagcttcttcacagcctgtttgatctggtgcttgttggctttaacatccacagtgaacacaagtgtgttgttgtcttctatcttctttatggccaactcagtgatcagaggaaacttcatgatagcatagtggtcaaacttgtttctcctgtgagcgctcttccaaggatatttgaacggcctccagagtcccagtgtcttgggcctccagaaggtgagtgacgtgtggatcttctttttttttgtggctgtggacacctttcaacaccgctttcttggcatttaaagccttcccttgggcttcagctttaggaggggcaggaacttccttcttcgcttttggcaccatcttgtgaaaaggatatttgtttattttaaataattagtttctctctttgcacctcttgagattatcagagaatggaaataagatgagataaatttaaatgataaaactaacattttaaagtatattttgattgttgcatccagcttgtaagtattgaagagctgtaagttatctagttctacacaaagctcagtgaataaaaagcataaggcaaagcacaacttttcaatctatcagaaaaaaaaatattcaaaatgccatgtgcaaagtgtatgctcaattaaaggtgttgaaaccatcaaggctcatgcaagctttttcttagcttctgtaataccaaataagccctgctatatgtcttgatttaccatgaaagttaagtgtcacattttaggcaaataaaagttattaaaatttgacagctggcaaattatgctaacatctggtaacaaatcattcttgacagttcaatagtacacttcttattgcatagctattaatattataaacagcaaaatgcaaaaatcatagcacccaactaacatattccctggagtgatagaaagaatgcactgtttatcttaatgtgtaagaaatgtcatcttttcacgtctgaggtttgaagtagattggaactgaataactataaacatgggtggcaccatgcagtgccacaagctaaaaagagatttgaaaatttctgaatttggagtgacatgatgatacatttacagtatgtggggggagtagaaaaagtagtaagaatagattgtaaccaataataataacaataaaatgacattacatgcttattcatcactcatctggtataatatcactttcttggttaagttggctaatagttatatataacagaatttctaactggtgctttaacaaaatcaagttctagaatctagtaagtggttaattcctatctggctcaaatacctggcattgggatatggatgttccttgctgtcacccaacttcttaaaggagggaaaggaattttactttcaccttttattttgatagtggtggtttctacccataagtcactctcattcacttataagtgttacaaaaaaaaggaatataatacataaaaatataatcttaaccaaaacttaaattgtgtttacaaaataaaagctgaattgggatgtgggcatctggattgtggctctggcttggtggtgtaaaaatttctgtccctccatgagtgcaattttttcaaattttttttctttttaacttttattttaagatcaggggcacatgtggagtcttcttatataggtaagctcatctcacaagggtttattgtacagatgattttgtcacccaggtattaagcctgctatccattacttagttttcttgatcctttccctcctcctgtgctctaccctacagtaggccccagggtctattgttccactccacgtgcccatgtgttctcatcatttagctcccacttataagtgagaacatgcagttatttggttttctgttcctctgttagtttgctcaggttaatggcctctagctccattcatgttcctgcaaaggatatgatttcattccctttatggctgtatagtatttcatggtgtatatatgccaccttttctttattcagtccaccattgatggggcgtataggttgatttcatgtctttgctattatgaatagtgctgctgcaaacatatgcatgcatgtgtctttatgacagaatgatttctattccttgggtatatacccaataaagggattgctgggtcaaatggtatttctgttttggggcctttgaggaattgccacactgttttccagatggttgaactaatttacactcccaccaacagtgtataagcctttatttttctccacagcctcaccagcacctgttagttttttacttttttataattgccattctgattggtgtgagatggtatctcattgtggttttgatttgcatttctctaatgatcagtgatgtagagctttgttttcgtatgtgttttggctgcatgtgtgtcttcttttgaaaagtgtctgttcatgtcctttgcccactttttaatagggttatttgtttttttcttgtaaatctgtttaaatttcttatgatgctagatttcagacctttatcagatgcatagtttggaaatattttgtcccattctgtaggttgtctgtttattctgtcagtagtttattttactgtgcagaagctctttagtttaactagatcccatttgtcaatgtttgcttttgttatgattgcatttgctgccttcatcatgaaatctttgcccatacctatctccagaatgtttttattgcctaggttgtcttgcagggtttttatagttttgggttctacatttaagtgtttaatccattttgagttgatttttgtatatgatgcaattttcttactgtaaaattagaagatttaaagaatataaattctatagtcatttctaactatggaatgcatgtgctcttaacttagatcaaactccaattgaatttagaaaatttagtcaaccaggaactaattgattaaacttgctgaatattaaatgtagagaattttactcactcatacttttgtgtgtatcaatcactaagaccatataattaagcaaaagcaatggtagctctattttttaatatacattcaatttttaaagaaaaatacagtaccgaatacaatatgaattagcatatgcattttataccttgatgagagaccccaggtataaaataacacttctaaaatggtatcttaaaaaactgttttatatatagatatattttaggaagctcctgtgttttgtttcttggttggctataagactgcagagttgaacattctaaaaataatcaatgactgagaattcatttgctttaccacatttatagataatttatggatggtttttcacttctctaacactcaagcctcaattcattttcaaatacatgaagtgtcattttaagtatacagtgggctcttaatgaaatttgctgtcttaacttttaaatgtttcagagatttttattttaagcttggtaaaaaaaaatcagagtaaccttcatatgttttttatattctataagctgcaattaaagcacgtgatttttaaaaaagaatttaaatttcaaaccatattgctttattacagcaacagaaacttatgtcctaaatcaaatgccctataaaaatattgtattttcactttttgcaattttaacaaaagctgtccatttgagttaaaatgtcattttattagtagtttttcattatgtatacttgtcattatttttcctttttcccttttttttttggaaaatttaagatttgcagaagagaaattacaggaaactatactcttttgttgttgcagttgaatactagattaatagaatagtgaatcctcaaagttgacgactgcatacttaaacatctgactgtagggtcggtaaattcagtcttattttacaataaagtttatttagattgactgtttatgcagaatagcatcctactttctctaagttttcttctttgactgaggaggttactaaattaagctgctcacttgtgaggaagatctgctggttcaattgccagaccaatgggcagactgctgaagcagagaaacctcattgttttaaagaggttagcaaacctaatggaaacttggttactgccatattctcacagacttgagattttctcttgcttccttctggtatccacctttgcttccggcctgatacttttagagaatttgggaaagagaatcaccgaggagcaggggctccattgccactactatttcaatagtgcaggtggtgtgctatagaaacttggaggacgggttatgttattagcccccatttttatccctttgttataggatcttggaggggtcgcctttccagccagaaagctctgtggccagtggtgcctttgcccgagttttgcttgagcctactgggctcattctgcctactcagcctggcaggctgtgctcagctcaggctaccagcctggatcccacgcctccaagggagactgagtcaggcgtggagtggcgagagatgtgtgagcaagcatcgggtctggccacactgtgcagtcagacacaccagctgctgccacagggtgggcagctctaggtgctggcatgggcgccagctggaccaggcacatagcaagcagtttctccagctggcaccagggaatgtggtggtgcctggaagcttggagatgccagaaaccgcagggctccaaagaggtcgtcacagtcctggcttggggaggtcccaggtctgggctcccctaagggctgcagctcttctctccttctcttccccctcaacatggagagcaagaggcatgttgcagccctgtttgtgttacagcaattttcgcctcgccattcggcaggtcctgaatttttgtcctgcaaccaggaaggatgagttctgcagacaagcgaaaggtcagcaagatgaagaggagctttattgagctatagaacaactcagtctctcgcaggtggcagctcctttccacagccagggtgtcccctccagtgttcggcccccagcagagagggtggctgccctctgcagccagtcctcccaacgcctgcagctcttagcacagaggagcccctggagtgtgtagctccattctgcagctggttgtcccgacgtctgctcagctccgggtgagctgaggcttttgctgtgcagaagctctttagtttaactagatcccatttgtcaatttttgtttttgttacgattgctttcgctgtcttcctccccttcccgggaggaagtgtgtgccgactggtccatgagcagccatgggcgggcccagaaaaggcaccacaagttcccattccagtccgggtgactggcagcctgcaccccagccttcaggccctccatggtcggaaggtggagcctcgctcaggacccacctccttccacccaggaatccgtctgcttcctgctgcctttcatggcaccgaggctgtaggtgccaaagggcggccaaggggctcagctttatgggacaggctagagcaatgtagtgaggaacagagatgtaatcgttgagggtttagcaattttaaatagggcaatagtgacagacctcaatgacaagagggtgtcagggtggaaaatcagaagtgaggagacttctggtttcagttctgacatgtaaaggacttggaagtcattactctcatccttacaacaagaaaaaggctgaatgaactgaaaatcagtgacttttcttggatccatcagataagtaaggttaaagggaaacctgccaccctgaagtatggagagaattgtgaatctagagagttacagaagaggcctactcacctggagtagctgttgctagagacgtacattaacatcaaccaaacaaatggtcattttgtcagattgctggaggctgagtgtgaactaaaaggcttatggtgttgtgtctaagaacaaaccaacaaagcaaggtcacctagattttctcccatgttatcttctaggaattttatagttttgcattttgcacttaagtctctgtctagaatctttttattttcatatggacgtccaaatcttacaatacctagttttggaaactattctcttttctccattgaattattgcctttgtttctttgccatagattagttgactctatttgtttaggtctatatctgggccactctattctgttgtcttgatctattttttctattcctccactaacattatgctgtcttgattactgtagatatatggtaagcctggaagtcagatagtgtcagtcttcttttttgttcttcttcagttttgtgttgacaattccaggaggtttttcagttgttgattcttttagattttatacttacacaaccatgtcatctgtggacaaagacagatgatttatttctttcccatatatatttatataccttaattttcttttcttattttaccagttatgacatttggtacaatgctgataggcgcggtaagagagaatgtgcttgccttgttcttattcttagtaggaaagcatactgtttcccaccatgaagtataatgtttgctgtgggttttacatagatactttctgtcaaaataaggaagttccccattatcctagcttgctgagaatttttatcatgagtgagtgttagattttattaaatgctatttcagcatctgttggtatggctatatgattttccttttagtctgttgatgtgatgggttacattgattttcaaatgttgaaacaacttttcctatctgggataaatctttactgattggggtgtttttttttaatacatgattggattcatttttctaatacttgtggaggatttttgcacctatttttgtgagagatattggtctgtagttttccattcttgtaatgtctaattggctttaatatggagtaatactgacctgataaaatgagttagtaagttttgcctatgtttctatttttttggaaaatattgtagacaatcactatgatttcttccttaggtattataattcactagtgaagccatctgggcttggtgcctcactattattatttagaaggttattaaatattaattcaatatctcaaggcctattaacattatctatttctcctcgtgtgagttttgtagtttgtgtctttctagaaattcatccattttatccaagttatcaaatttgtgtgtaggaagttgttcataatactcctttattattcttttaatgtccatggaattagcagttttgcccctattttattttggctatgagtaattttgtcttctctcttttcttgttttgttagacttgctagaggtttatcagttttattgatcttttcaaaaacacagtttgtagcttattgattttctctattgttttcctgttttaaacttcaatgatgtctgctatagcttttatctcttttttttttctggttgcttcaagtttatacttgccttctttctccaatttcctaagatgaagtttagattacagatgtatatatcttttttctaacacatggattcagtgctatattcttctaaatacttttgctgcattacacaaaatagggaattataacttgcattacttttatttagttcaaaatatctttgatttctcttgagacttttttgccccacgtattctttacgagcatgttgtataatctccaaacaattcactattttctatctttcattaataatttctagtttaattgctattgatttctagcatattttgtatgatttttattctttcagatttgttcagggtgtgttttatggatcagaatgtggcccaccctggtgcatgctccttgtgagcattttgttgttggatggagtattctataactgtcagttagattaagttgatcaaaagtattcttcaggtcagctctattctaacttttgttctgtgaaagacatcgttaacaatgaatgaaaaggcaagccacagactgtgtgaaaatatttgcaaaacatatattttataaagaatttgcatctaaaatatacaaagaacttttcatatataacaattttaaaaatctacttaaaacataggcaaagatccaaacagacactttaccaaagaaaatacacagatggaaaatgaacatatgaaaatatgtttaacacgattgccattaagaaaatgcaaattaaagtaataatgaggtactagtccatacgtattaaaatagctaaaaaaaaattcatgacaataccagtttctggtgaaaatgttgagcaagaggacctcttgttcattgctggtgggaatgtaaaatagtgtgactgctttggaagacagtttggtagcttttacgattaacatagtctgaacacatgattgaacaattattttcctggatatttcccaaattgacttgaaaaatatctgcagatataattatagtagctttattcataacaccaaaagctgcaatcaacccaaatgccattcaatatatgaatggataaacaaactgtggtacatccatacaatgaaacattacttaatgattgaaaagaaatgacctgtcaagccatgagaaggctaagacatctttaatacatttttgtaatgaaagaagaaagtttgtaaaagttacatgctgtgtaattccaatgatgtaacatcctgaaaaaggcaagactatacagataattaaaagataaatacatgcctaaaaggtggagagggagagaggagtaaatatatgaatcacaggcaatgttttagggtggtgaaactattctgtatgataatataattgtgaatatatgcatttgtcatactcattgaaatttacagtacaaagagtgaacatatcttaatgtgtgcaatttttaagaaaatcatttaaaagggtgagaaaatcccaggacagcatgcaaaatgtaataaaataaaactggattactaacatatgaaacaacatcttatatcaatgatattgatacagttggatttatatctgccattttatgttttgttttctgtacatttcctaattttttgtccctctattcctactataatcctttcttttgcattaagtgaatgctttctaaactagcattttaactccttgcataattttttactattttttgagagtttttaaaaaatgatggctttttgatttaccatacacaacttatcacaatcagctccacttttatgctagcatgtttccgggggcatatagagataccacttgtagctctagctctattccctttcttcattttttgtgttattgttatacgttttacatctattaatgctatgaatccaacaacaaacacgttataattattattttgttttattttctttttatctttttaaaagttttagattcagggggtacctgtgcaggtttgttatatgggtatattatgtgatgttgaggtttggggtacagaaggccctgtcacccaggtggtgagcatagtacccaataggtagtttttcggctcatgcttccacaccccctagtagtcgccagtgtctactgttcccacctctatgtccacgtgtattcaatacttagctctcacttattagggagaacatgcagtctttggttttctgttcctttgttaatttgcttaggataataataattattatgttaaaatctgtagtcattttttaggccagtatagttttgcttccatccacctactttgtactattattaaatatttgcaaatatattctacttctgtatgttatgcccaataatgaattgtatacatactgcttgatgcaattactttttaaatcacttagaaaagaaagcataaatatgcattggtaccatcttttataattacataattacatgtaatagtactctttgtttcttcttgtggatttgaattaccatctggggtcacttactttcagcctgaagaccttcctttagtatttcctgtaaggctagtcaagcataggcttgatatgatgtgatgaaaatggcactttacctcagtgggtcttcccctcagaaagtcgtaacacaaatcaaatcataagaaaatgtcagataaatcccaacagaggtacattatacaaaatataaaaatttttaaattgccaaggtcattaaaaacacgtaatgtcctgagaattgtcatagccaagaggagcaggagtggacatggtgactaaatgtgatgtgatattctggatgaaaccctgaaaacgaaaagggcacttaagtaaaaactaaagaaatatggacaaagtatgggctttagctaattatactatatcattactggttcattcattatgaccaacataccatactcatgttaagatgttaatgataggagaaaatgaatgtcgggtagatgggaacactctgtactattgtcacaatttgactacaaattttaaactattcttcaatataaattttatttttaaaagacaaataaattagagattcttcagtagggcagctctctcaggataagacattcctaggtgacagatcagctggtgctaagatggaaaagtgtctggggtgtctggggcacaacgaagaaaccagtgtgatgggagtggcatgaacatgagggaaagttgtattggaagttagagaggtaacagaggacaggaagaaacgtcttttcatgtttagaggccacttcaaggacttagatttcatcgtaactgaaataaagaatcatatgtgggttttgaaagggttactggcaggctcatttgaaataaactgcaaagaggggaagaatgcaagggtggaagcagagatactgattgggagtcttacagtaatctggaaggagttggttggtagcagtgagaacaatgagaaacgcctgactctggatatattttgaatatagaggcagtaggatattctgactagctgtggggtgtgagagaaagagacatatcaagaatgagtataaaattttgggggtatctgcaaggttagaattgccattagctgtgatccaactggagaaggtttgggagaaaggtgggaggctcagatttgagcttgtttggcttgagatgtgtatttaatgtctaagtaataggtatcaggaaacagaggggcaaagaaacctggaattcagcagtgagatccaggttatagttataaatttctaagtagttaacatgtagatagtgtctaatgccattagattggatgaggtgacaaagggaacaaataaggaagtccaagaagtgctctcttagaacatacactattaggagttcaggaaaaagagaaagagattcagaaagagctgtcaatgaggtaggaaaaggaggaggaggggaggaggaggaggagctggagggaggtaagaagaaagagaagaaagaaagagaaaaaaatatttccaggaagagagatgtctgctgcagcaaatgctaccacgggataaataagaggactaagggttgactttgagttcagtaatatgaaagtcacagcttggggagggggtggtggagtacacacctcactgatcacagagaatataaaacatttcaaatagctttactgaatataggagcaaataaaatgtcaggaactagaacaaggaaagtgtagtaaagatagtttcacctagatgaaaaggattgttatcgcctacacaagtaaaggactggtcttgggtaggagtgtggacaatgcacctataataagaaatgtgaaagcaaaccaggttggtactggtgctgctggggtcagtggatgtgatggtgagagtctatgtaagatctcggtcaatggttttcattttctaccactgtattattaacacattattatttcctccctaatttatttgagcatcaaaacaatgttgtaaaatcacatatatatataaaaaataaatatatatatacatatatacatatatatacatatataaatatatatatgtgtatatatatatatatatatatatagagagagagagagagagagagagagagagagagagagactgattcttgctctcttgcccaggctggagtgcagtggcacaatctcggttccctgcaatctgtgcctcccaggctcaagcaattctcatgtctcagcctcccatgtaactgggattacaggcatgcaccaccatgcccacctaatattttgtgtgtgtgtgtgtgtgtgtgtgtgtgtgtatttttttgaagagatgaggtttcactacgttggccagtctagtctcgaattcctgacctcaagcaactcacctgccttggcctcccaaagtgttggggttacaggcataagccatagcatccagcctcaaataagattatagttgtaaattaccatgtgaaaaagatgattaacctttataccacattccatttttgatatattcagacaatgaataaatatcatgatgtcacagacaataacatctgctctctattgaacactgcctaagggcagtgttctctttaaattagcaattcttagacttttttctttcagcaaaacattatatgagatgacagattcaaagtactctttcttcaatggaaaaagagatcattagaattaatggcaaaactaaccctctctgaatgaaatatcttaataaaatgttatcagggctccctggaatgtaaataaatgattgtctgcttctggaacatacaactaaaaacaggcacaaaatccattgccagcaagatagttattgatcatcagtaatgcctgtttgtgaatcatcgtttgatccctaacaaatgctcagcataaggtaatcaataaatgatttgataagcacatgaatggatggaactaaatctcatggcaccctaaatagtgacctatagtcaagatcctctaatgtagttaattgaaagagagtaaggagaaaacatctatttataagaaaagttgttgtaaaggcttgcctgtggaatgcacctttttcatcaaagcaaaggagatagaaatttcctaatcaatgtaacccctcccctgaccacagtaaaaagagaataagaaagagggaagtgggaggaaaaattaattgaagaaatcatgtggttttttgcaacaattttgtcaattttcagcattccccttgcctttgacttgacttgcatttgtctacatggacccgagacagtgacttactactgcataattgataaagctaggtctccatccgtaggggtttctagattaaagagcaatatagattaaattctcatatgtggtatctgtatactcagctacaaacatacacatcgatgagtacttgcttaaacagtcactgattttctttacattcccataacatgtcaattaatgtctataataaaggctaaaatagttctaaatcctgggaaaatcttaatggggggaaaatatatttgcattgtctccccggatagaagaatgtttagccagaagtttcttgctgatctgtaccatttggcggattggaactatttctggaggagtatgtgacataatattttaatttaggcaactctgagtgcaaccaacaaaaaaaaatcagatatttggagaaggttaataaagctgcccctgggctccttcacatgccccaggagtcctcacgatctgtgctgtgaccatgtgctcctgtgacatgtggcacagctcacttctgtggttattacagtgacaatagcaactggctgaatgttactgtatgcacagctgcttccactaattctaaaaccccaaaccacagagagatgtctcccagggattgtagaatgaagagcaaccattctggtggatataattgaaaacagaatgtccttttgcactctgtaaaatcaaaagctgtgataacagatccacctaaaaatgacctagaaaactgaatgtatagattcagatgcacatggcaggaaagcaggaaaaggacttgactgaagagactgaaatagatgagggaggtagcctcgggcccaggatgtgtggtcctctcttgttggaagcaaagaataatatagagaagagggtgttccttctcagcaaagggaagagacatagatgttccacaaatgagccacttttctctaaacttcaatcctgatggcttggcctgaggataacctaggtgcaatgtaatgcactgcacatccaggaacattgacttcagagagcagtagttattattactaatgggaggcattactttttttgtttttttttttttttgtttgtttgtctgtttttagcagcaatgacatttcacttctcccctaatctaggtgaacaaatatatatagaatatggttcgtttgtttaaaaaaaaaaaaaaagaatggctccttcggaaaatgctttctgttgttgcatcccagttcggggaagagtttcaggggtaagttatcttgcacatgcttttttcatcgtgcctcccagtcttttttatttctgaatcatcaaattccttctttcattttaaattagttggtctgaggaaaacatattcttcatgctaaaagtctatgagaatttccatttgatttcactatgttgagcgagggtatattcttgagcaaaggtattattttctatttttaagtgaggtttaagcatgtcgattgaactaatagctaaccaagctctactatgttccaagtaccatgctgaatactggaacatgcattataattaaacataaatatatgctcacagcccctaaaatctatagcatcatcacatttaaatgagaaggcagcatatgcagaatagggtagcattaaaataatggtttcttttcaaaataagttcaataagatgcctctaaaagatcaaattgtggagaaaaatgactttttttacatcaagaattacttcacatttttattcaagttctgttaactttccctaagctgatagagcagtagacaataatcggtaaaagctgtttcctgaagctggtgcctgttatgaacaacactctaccttgtaactgttcagtcttcttgctctgcggaccagctacccagtggcgctgcctggttggcccattaactctgctcagggcatgctttatcattactaaacggcctcaattcccaattacagggtaatggcatcattagtttttccatcattatttggtcataatgataagaaacagaaaatattgtagaaaattggggagaatttgggcactttacagccctggtttttacgaacatatccatacacacctgcacacttcagttcattaacagagacagaaactctttttctgatactcatagttactaataaaaatcaattgcaattgaaggagaaagcaatggggaatgatcatgttaccttttctgttcggtatgactctaaacagaagctgtatctaggaaagttcagatttaaaatattattttttctttcctacagggtttctaacatctaagaagcagatccttaagaagaaaaaaatgtcacttttcaacacatttatatctcagaaaaactcatattcaccttccatttactggaatattatcttcttatgttaaatttaaaaacaaaaatatttggacatctggtcctgattagattaacataaaaaaaccaatctaggaagaaaattgttaaagtttatttctccatgctttgtaagagatgtcatttctaataaaactatggtacttatgatttaataactaactgatttcactttgcatttatgccaccatcataactcaactttttagaaagtgttttatgttttatgttctatggtgaacacttcccatcagtgtggcatattttaataatcatagttataaactaatacttttgtaacagtttgcaattttcaaagcactttgagataagacctcatactatcctcaaaaacactccatctgtagtgtagacataatagatattgtctccatcttcagatgaggaaatgaagccatttgacttcttgattcagtctttgaacttagtctttttagtattactctatcagagctttatctatccatctctatatatttgccatcaaatttttgttttaatttttggaaagtttctttagattattattttcttttttctaaattcaagttcttcccgtctctggctgtagggggcctccttagatgtggtgaacatttttttcccaagggcttatttgtgtacctggcaggtatacagaaaactttcccagtaccaagaagcatcttcatagatgtcaatcaacaacgtgtctaccagccccagaatggaccacactcaattcaaaccttattttgagttcccgtctcctactggtagccagggagaacaaactcacatttaccaattattataccaaaatgcagttttaaaattatcgtgtctaattgtatcatatttttgtcttctttcttgatttcagactactcgtctaactacttatgacaatcattttccgacttctaaattaataataaattgttcttataaattaattctagtaattaatatataaaatacccaagctttaaagagcctgtttttttttttttttttttttttttggtagggtgattcaccctttgtgtgttggttttgagctcatattttgctgttaaaacattttaatttctgctatttttacattttcaatgatattcttgacatttgagattactaattattttctgaacacatgaagaattactgtaaatgaagcattactgtgtggcttttggtgagtttgatctacatgctatcatcatttatatttttactcttctggcgagatttttgactcaaaagaaaagaactacttcaacacaatcactgacccttatgtattattcaaagttcaacaagattctctttaaaaagggaaaatttgcaattggctctctcactttgccccttattctataaagcttcacaaagatgtttttaacagcacgactagctttgttcccaggtatgctcaaaaacaactagttttgtctgtgagatgtagaaacctttctatatttatgagttataatgaaatagttcacctcattgaggaattgtgatgaattatttctggttttacacataagtattgatagcattaaatttagaaggtagtatctttggaattgacttttacatcacaaagtgcccatttggttcacatatgagacttatttaaagacaagtctccacattgttactgaacattctttgaaaatatcacaggtctataactggggctatctgagtagtataacaagttctcttcagaataataatgggttccatgctccatttatttatgtttcatttagaggaacattacagaacaaggaataacaatagtataaatggtaaaacagttaggtgtaatgattaagtttgcaaaaacgtgagttaaaattctagctctgctacttaccagctatgtgtcctgtcaaatctccaactctcattctatctacccaacaggccattggggtaaaatgaaggcaagttgtgtaaaacacttagtacctgacgtatttttattgaatgtcctcaatatatggtaaattatattattatggtttttgctgctgtggttagatatttagttatgttttttgatgctgaaggcatggtatatatgaatatgcttgtcttatggagataaaactttaaaactcttaaagtctttggaaaatgcacataaactcaaagagaaattccatttaggataaataagaatattctatttacatcagaaaagaatattctatttacatcagcttagcctcttcaatctaaaattctcaagaatactcaggatttctagtccttcagaattattcctcctccaatattgcttctcatttattcttactaaacattttcactgtgttcaagtactcagcaatccacagtgctcatccttccttcttaggatgtctgataattagaaaatgccttctctgtttgaattatgctctttcttgcttcacttaattgaatctagttctatgtcatgaaagctatacaaaatgaatttaaactcagttctatctaataatacttttgatatgtttttgaaaacagctattatatatctcctccccttcgtgtcctctcctctttatatgacatgcttccgagtttaagatggtttctcatcaattcagtctctcagtacctctttaccaaggctgttcatgttttcacataagcagacacaatacctgagaagctcatgataaagaaccccatctggcagccatcgctgcatcactgcttcctttcttgtacttttgtcatcactacgtactgccaaccacactgtgccattggctaataaaagagtttcaatttcttatctatttaagttacaccctactcaaaccttatccccaccatgaattcaatggtcttattgctgatttcacacataaagcattatagttacctatttcattttttcattattacatttggtcaattgaaatctctttcagattttgatcttttcatgtaaaatatttgatatagcagaacagattactgtctataagtgacattacagcctaaacctccattctagttgatgcttattatcatcaatactccttttgattaatagttaaagtgtctgcaaattcacttgataaaagaggaataggatttaataatgaataggagttttttctccctatcccttcacctcaccttctatcatcttccaacctccatttaagagagttttatctttgcagatagtctctgatctgtaatgtaaaatcaggaaaaaaaggcattgtaaatgtaggaagaaagggaaagagtagaattgatctgagactaaagtggtatagaaaagaaagagtagggactgatggaaatatagattggaaatcatttttaattttgttgtttgagctgctcttaggtaaatcttagagaaactggtatttgtggatggcaagttgtacaattatcctgcatgcattgttccattttatctttagaaaataatttttaaacattttcaaatgcacatcttccaaaagtttgtaaatatttttatttcataaaatgtaaattttatgtaaaagctgtacctctaataaacatgtaatatgtaaaaaaaaattttcaaatggttttctaggtcaaaaaaaacccacatctgctgtaattagttgttgttttgtaggttttttttttccaatttacagatccatggacttgtttgtaccaagaaataagaacatcataccatctgacgaactgtggatcatttagtctgtgctttcactttcgaacaaaagtccatctaaacttgcatgtaaactaagtttactatattttatgcctttgtcttttcttatttcaaaatgcaaaaagatttcaataaatttgcaaataaagttcagagacatttgtaaaaaaactgaattgagaacagagactactttaatttaaaagtacttcataaatggataaatctgaataaacattttacgatatattcaacagttaattcttagctgtaagagggcttaagtggacacaaaattgcaaaacttagacttatttacttttatagaatgctcaaatataaatgttaatatcattaacagatttcacctgtgtggtctcacccactgcaaaccatcacacacatgatacagtacctttgcacctggttgagtgaactgggaaactgaaaaaataacttgggatttagatcatataaatgatttcttaaatattgatcaacacctccatcttcatttgtctatgtcgatacaacacaattatcattgcttttctttctttagtcatgaaatatattaatggaaatatgcaagcattatacttttatgtagacaatatgtatgtattgtataacatttccaattgagctgactttctaattcttatcagaatacactaacagcaacttagttccctaaaagatgtcacatctgctctcatgtctcaagctaactttgtcacctctgggtttctgttattatggccctgggcaagttacttcacacctctgtgtcttcattgctcagatgagatgactggtctaaatgatcacttcttgctttaatcttttattattggatgatatcacagtgattatctagttcttcttagcagctgggacttaaccaagacaggtcaagtatttttaaaaatgacaaaaacaaaacaaaatactatggtttcactgccactttttcaaagtgacatcctgttcttgggaatgagaattgatgatgtcaatctaaatatgaagaaaaacaaatcaatagaattctctgacatgaattgacccactgggtgtattagcatcataattttgttatgggcattttggaagaatgtcagcataactcctgaagaagaggggcctagggcaggatatgacaaagaaaagaaactacaggtactttaattgtgaaaggatcagcaggtgccaaggaagaaaaccaaattattcctaacataagcaagatatagtagaaataaatgagacataggaaaatgagagctactttgagtaaattgctcgaagacctcagagccatcataaccagcttaacgtaatacagaagaaatagttttgcaataaatctcctctattcattttattgtaagccaaatgtaaatcttcagttaagttccttaggatgaaaatcatctttaggaaatgtttctattcatcatcttcacactagtataaaggaataattttggtgaatagaaattaagaaaagaaagtggggcaaattgtttgccatttcaaatgatcatgaacatgttagatctgtttataagaacagcaagagctgatattgggcaaaattgcaaatgagcagtgccttttttacccctgatatttgcccctctatttctttccacccccactgtacgagtatttttatgacagctacactctatatgcatttatttgcacaatctaagctccacggaccttgtgtgaccttcccttgccttccagactttacaatatggctcacatggtttcatgttacattttcatgcccataaaagtaaggcttattcaacagatatttttaggcatgtagtattagctgggcaaagattcagtgcctggatatagtgaagaatgaaactgcccaggtcctcaagggccttataagaataataagtgcttgtagattataggactacagacaatattcaaataaccataattgtacattagatggcaataatgctgcaggaagacataagccaaagagaataaaggggcagaaggaatagtctctaatgtaaagtggcattttagaggggacccaaatgaagagagaaagcaagccaggaagtatgtgaagaaagagcaaaaaagccaaggggatcataatttcaaacgtatttgaatgtcatggaaaagcaggaggccagaaaggataaatcaaagtgggcaaagtacaggaagtaagaaggttagagaggtagccaaggccagatcttataggaggatgttgtagtccatggtgagaagttaagattttttgagtgaagccaccacaaggttttggacagaatattgacaagatctcatcacataatgatctatatgaatggactgcataataatcagggtgaagcaagtaaaccaattaggaggcattgcaatggtccaggcaggaaatagtgtggctttgattaaggtgttaacagtggaggtggttaaaggaagtcagattttgtacatattttaatggaagaccaatattttattgtatcttagaattggaggtgaagactaaggatgtgagagagattgggaaatcaaagatatctccaaatatttgtcctgagaaagtagaaaccagagtttactgtttattgaaagaggaagtagtgatcgagcagatttaagcaggcatggggtggatagagaaaaccgtgcctccagctagctctcaggttttttctcaccctcttgacttaactttgtttcaacaaaacaggctttcttgctgtcacttgaaagtaatatgcattttacctctttagagcctttatatttgttcaatctggagaacattattctcagaatgcctgtaacacatccatgtgtagatgttgaatgggcatttgaatgtacgagacaggggttccaggagaggtctggacagcaggtacacattcaggagaaaatagatcatgataacgagaccacagaaacacaaccagttacataagagaggggaataaaggaagagcagtgaccaggaaactaacaaagggtttcaaaaggaaagggctgatagtgtcaaattctaataggttcagataaagactgagaatttaccatgactttggcagacatttctttcacctgatataatttgcccctaacaactctgccatttcctgagattcagccaaaacgtcactgtctccttgacatattttctatatctataatttttgttttactcctctgcctccaaaaaagggataattgttctaaatcactagcttgttttttatgttctccctttaaaaaataatcatattgctcctacatcatagcaaacacctagtatattttaagtatttattatataaaattttagacaaaaggaaaagtgaaggaggaacatagggaaggaggaaggaaggaatgcaggcaggcaggcaggcaggcaggcaggcaggaaggaaggaaggaaggaaggaaggaaagtttctagcctgaaatgtttttctaagttccattacttttttttctaggatattgctgggtgactaatacataaaattaattttgagtaagccattaatgcccaataatggttcactgtgttctatttttcttcccaagtttatgtggcttttagcaggagaatttctgaaaataaggatttttttgaacataaaaaactaaatctatgatcgtgtagcatttatttatttattacttatttatttatttaatcacagaaacatgttctcactatgttggccaggctggtctcggacttctaggctcaagtgatcctcctaccccggcctcccaaagtgctggaattacaggtatgagccactgcacctggtctatgcagcatcttaatagactagaaagacttttgccttcacatcttataacctttatgaagatattcactgacctttttatgcatttattattggtccttcttgcaaactatgatgctgtgtaatttctaagccatactctgatagttgtttacctcaactaaattatagctgaaaaatattacggaacaagagtgagaagatgattattacaacactaaacttgaggattaaacaaaacaaagtttagtactttataaaatctttataaagacttaaataaataaaagtttcctgacttttgaaacccatttcaaagaggcccatcctggcataaattaaatctaggaaagactttaaaaaataaatttagatgttatttgtcatcacttgaggagcttcatttcttttctgaatgagtagaaactgaactcaaaatgatgctttttacaccaccaagttattgtcggaaagcctcataccaccacacaacttctaacttggaaaaaataattcaaatattttcatacatgcaatgaaagtaattattagcatggccctagaaagggttagctttgccaaaactaagtggtaaattgatccacatttaatttggtttcctatattatatgcttctgttcagattgtctaaaggctagataaaacacagtgatgcctgctgtccatcaaatgttaaccagtggaatttgtgctatggcgtttattattctaggaatagaaacaatccaagaaggataaaggcagaaacatgagaaaggttgtgatgtcttgaagagtcgacttagagcatatcaagatgtactgtggtgtcatagagtcaagggaaagaaactgatgtcagactggagtagtaggctaagatcacatgaaaaagatcctgtgcactctcctaaagagagtgaatgatgatcccaggaaccaatgtggcaggcaagtctcttttcctttaccagctctgcttcgtagtggttgcctgctgatctctgttgagaattaccaacgtactatatgttcagcagtaaaaattgctgttatcaatcagaaaacctgttggtcaatggcttgatatctgcagtatttgccaagttcaccatatataacaggagccatcaatcttttttttttaaccaaataatgaaatatcaaggatttgctctttggaaggacactgctgggaatgactagatggaatggaggtgacagagattagaaatagaaaagactggatgatacagcacttcagtttgagaaatacaaaggtcaaaaaacaggtcagtgatgggggaaatgaaatttataaattaaatacattataatagatctcctttcaaggaatatttgacaaggtcacattgtattaatctaataattttcctggagaaaaggttgaatgttttcccaaaatccattgattcccttacacctctagaatagcggttcttaatttttcccaacgtccatgttttcaggaagaatagtaatcctaaacaaacataggtgagacaatggactacatggaccacctgtcccccaagtttccactttctagtgggaattaaaagtgagttataacaaagaatagagagggttgaaatcacaattcaggtaatcacagcccatcaattaaaagcaaatgacacacaaagattgatccatgaataatgatggttgaaaattaagaccaaatcaggatagcaatgatcatatagtatgttaccgaaattttcaaatgcttatgtaagggtcagtttgcaataatgctaagcaatgtgtggcaataggaattctaaaagaagatggaaagaagacctcagtaaatgctggtgagtccttaattttaaacagtcaagatattttgataattctgataattaagaggggttactaggaagtattccttagctataggtaattatataataatacaacaacaatcaccatctccaccatcacggctactaagtggcatttattaagaaattattatgtttcaggcatagccttcgctcttaatcaatgctctattgtgcatcctgtgtcttcccgaacgaaggtattgtttttcaatcggtttatgtattagtttaggatctactacgaggagcctgatagctgcagttcctactttggaaaacactgcttgaaaatcccattcacactccagacatggatgtctcataaatggagttcagtgggtttgaattcctgccaaaagtcctacttttgccactgagagagtcctaatttaattttacctgacaaataataaccactgctttatttttatctgaaatgcatatggattcttgatgatatatatattaagctttccaacaagacaggattaatgttgaggttattttctcatgtatggggctagactgaaaaaaaaatccttttaatcaccattttactgtcatttcttaaacttcctgcagcaatctagtagaacctatccagaagaataaatgaagccatttttatatcacatgatggttactttcataatttccagtaggaaatggagaagctatttattggtctccggaatttaaacatttaaaaggaacctactgttatatttattatcctttacaggaaatgcaaagctctttaagacagacaatgaacagatagcttcataaaagacactgcaaatttaataagctacactatcttttgctgattcctatttactattcatgaaaatgggatttgggtgacttctctttttacatcttgtaacaggaatttcaagagaatgaggaacaaacagcatgagatccatgtctcaggacattatatttttaaattaattttcagcctcttttagcactgtatttatatgaatcacagctcctttaggtattttgcagaatgacacctttgtagttgagtcagataatacacatgtatacttgtttgtacaatgataaaaataatagtcataccttgagtctatatgtccatatatacctttacataacatatatctctttatgtgtgtgtggggatatacatatatatgtatgtatatatataaaatagtatatatactaagaagctaaaactaaatgaggatatatatatgtatatatatccctccccaaaaggagtaaaaaacattccacctacaaataaacctatgttttgtgactcagtctcatggataatgatcagtctttgggtatttacataattctttggttttggtccctttgaagctaggatatttcaatgcatttccagagagcaatttcaatacaatatatcagtaacaactgataccaatgcatatttcttttctaaatattttagcacacagaaatttattttctgtttaatgtttctttttgagtagatactgatggttttatcagcaacatcctggaacctctctgaattaaattcttttattctctcattcaaatcatgtattccttattatttatgcataaaaccctgactgatagttctgataagacattttctttaaatttgtcttcttagttgctttttctcatattaagcactcaaaattattttaaccatattttttcttaactgttatattctttatgaaataatgttactgaaaagtgaatcagttgtcacttcaaattttcctaaaattgatcaactaaattattaacattaaaaataatggtcatagtataaagtttttaaattttataatctgatctgtcaatcattttcattatggcttctgggttataaattattctagtacctgtcctttcaatgctaaaataatatcataaattttactcattaatacagtgtgagtaggggtttgagataagaagctgaaaatagatgagatttatattcatcaacatggccaaaatgatacttatatgtatatatatttaacaatgttaaagtatataccagaattattaaagaaaattttgatgaaatggaagggaaatcactcacattcctctgagaaaattttacaaataaagttcagtgtgatagatagataagactgtgatttctattcatttgaatgggtgacacacggctgaatctgaactacatgttctgaaaatttacctcttcctggtttaacaaaagagacagtgtgtaactaccataataaccagctatttaaactaattatttccattttgttcatgtggaacttttattgactggactgctttaggaaaacaggtcttctgcaagtggattgtaaaaccatggcagtttttgttgctagtgaaggtggcattcagcaggtggtaaaaaaaaaaaaaaaattgaggatgttgcttggagaaatacttattttgcttgttttagcgtgtttgtgatttttatttccatccagagtgtgtgtgtgtgtgtgtgtgtgtatatatatatatatatatatatatatatatatatatatatatagaattgagtatttgttaatatctatcttcctcatgaaataaacatgaaacttaagcattgggcccaagagagtactttttaatagcaggaaccagtaagttgaatctcacagaataatgaaatttgagacatgcctagaaatttagagatcatttattcagtaactagatatgcttaagaaaattctcaaagccacacaccttaataataatgttcatttttgatcactattattaataataatgttccttttgatcactattattattaatgttcatttttgatcatcattattaataatgttcattttgatcattattattaatattattattattgttattattgttaataatattattagtgttcactttgatcattatttttaacattcaaaatgaatcttaaaacagcaaccccaagctctggtgagatagcaatttatggcaaaagggtagattttctgaatctgtaatttttcaggcatcctgcaattattgacaatgactccattcaaactagatgagttgggttagatgagattacatttggaaacattcactttcaatacaaacttcctggttgaatcagtagtcagcaggagggctttgctataaagcaatcctgacacaagcttttaagcagtgagtaataacactctttaataacatgaatttctcgttatcaccaacactgatggtgcagaaatcatgctgtctaggtacaatgagttattttatggccagcaatcaaagcgccaccactttttgcccaaagagaaatgtttcacccctctgacaaaaatgctgcaaggcttaatgataaatcaatgataaataagattgatgtgaagtatttcccgtagtataaaagaaatatgccttatggagaggaatcattattagagaggctgactctgcaataatgtatgtcactcccccaaaagatagttagtactttacaggacataaaggagtcactcaggtattttcatattgaatagtcccttttcccttctttgatgatgaatggatgaaggaagccttaactgatatcaaagagaatagcaaatcggccgggcgcggtggctcacgcctgtcatcccagcactttgggaggccgaggcgggcggatcacgagctcaggagatcgagaccatcctggctaacacggtgaaaccccgtctctactaaaaaaatataaaaatcagccgggcgtggtggcgggcgcctgtagtcccagctactcgggaggctgaggcgggagaatggcgggaacccggggggcggagcttgcggtgagcagagatggcgccaccgcactccagcctggtcgacagagccagactccgtctcaaaaacaaaaacaaaaacaaaaaaaaccccacacaaacaaacaaaaaagagaagagcaaatcaatgaaatagagaaaagtgatctttgtaccagagcaatagtggatatattttctcttttcccattgatagccagattcgacctttctgacacacactattagagcctgaagcatcctttctgtgagataatgaatcccagggttggtagaaaccataacaagaggaatccccaactgtttgtgctgcttccttctggctgagaggaggtgtgaattgtattccctccttggggatgtaaaattcttggaaagtttgtcaccactctggaggtgaagaaagctcagagtgtggggagagtttgggttcaagttgcttttctctctctctttctttgtttcattcattctctttctttcttttatctttctttctttcagagcttattgtgttaagaaaatctcatctctcatttattttttattgtaatctaaagtaatgttgcattaaagaaaaaaaaaggtggaaatattttaatagtcccacaggaagggtttacattcctgaggaaatgttgtactttgcagagattatttagtctctgattaatttgtacacggataaaacaagtttcatgagcgtcactgcaacaattacatgaacatctagaaaactaagcaagattcttgctatctcagaggggaacaaggattgaatactgaatttttacaaagaaatccgctcttcttaactaggattgtcacatgattttcaaattaaagaatggaagaaaatggcattaaaatggaaatagaagctccttgtttctgaagactaattttgaaagagtgtaactggtgttttccagaccttcagaaagaccttaaacacacccaagagacttgagtttgatagaggaaagcttggtgatgttgagctctcttaaacacagggatggggtatgaaagataaatggaaaatctccttcttcaaagggtttccaaaacagttcacgtggtgatgacagtgtttttgcaaaaagcagacactaattagaaaaccttctaggtccttctttgatgtgtagctataattattctaaagatctggaaactggcagagttaaaggggaaagtctaaataacttttactctattcagacatagaagacataagttattttgctgtaaataagaaaatacaaatataaaagtagttattatttagtagcaattgttttaatataatgatgctattgtaacccaggtttcctgggttttggggtacacactgtgaaaaagtgtccacttataactgttgcaacttgagcttttgttgtttcaaaaaaattccaagaagctcagccctgatacaactttacctctagccaatatcattaattattttcctaggcaaaaacagtcccttccttgaaccaaaagtgagaatattttcctccagttcacacttacttaacctaagagtctgtaatttttctttttcttctccttcagttttaacttcagctccaagtctcatctcaaattgtttaggctattacattcagtgagaggttgattatttttattttattttctcctaaatttcaaatagtgtcttactactacaattcctagctaaaattctgcaatgtcactggaaagctccatgccttactatctagatttatagttagttttttattggtttccagtttttcgtgaactttctgggactcaccacctttatctcttgctcctcttttttcccaagtggcttaataatgactagggaccttaacagaaccaaatttatcaatattagtgaaggcacacacacaataacaacaaaacagagacaaaatgggtctatgactcaagagtgtaaaaatgcatatttttgataaatttggcaatttgaaaacatttggcaattttttaacaaagtttaacaactggagcaataattccacttttacgacttagcctatgaatgcgtagttatgcaaaattaaaaagcaatgatactgtctattgagaatcagttaaaatgatgagacactggaaatagcctaactgtccataactgggacatttgtttcctaacattcattgtatctaaaatgaaagatcatcaagctatgtcttaagaaaactttagccaaatgctctttgataggtcttaaacctctggaaataaaaaattgtgacaacagtggttctcaaatgttaccaaaaaatgtagacatcataaatcacaaaaacaaattaaacattaatcatagtaaatggtatatatccaaaacacagggggaaaagcagaaggataatgataagtcctttccattgcgtactaggccattttcttgtaagcccataccgaagattcatctatagcttcagaagaatggaacacaatagcatagggctcagaaaatttatgttctgtaaaacttattagatgttatgattttaccaaagagtcatggttggttcactgtgtatgtttgtttgttttactgtcctgtagacattaacctgctatgtatttcagtagttttgtttgtttctcccacagactatggaaagcgtatttctcagatacttttttctttcaacctgctttttcaccctgctggctccctcatcaataagttaaataaaacaaacttgaggtgagataatagagctctgactggcaactacgattcccaaccatcactgcaactaatatcttcctaggagaggatgtcaatgattcaaaataactcccattttgaaacaaacatccaactataagcaaaacttatgtgcttacctcctataatgttgaaagttcagatatggtaatgcatttttaaaatctcagaagccatacataataatctaaatgttatattatattttcagtggaggataaagttgcaaaatccctctgagtctctacatgcagagtcaagatgcattgttacaaagaaaaatattatttcaaatagcctttctatcatgatctaaatcttagaaaatatatataagaacaagtctagagaaaatacactaactttcacatagtcacatatgcatccctaaccccggaaaatatatacccaaccactacagtggttatctataggatcaaggattaaatgaaatttctcacttttttttatcagacttttctataagatataaattttgtaaaggaacggaggaaaaatatttcaaataagagcaggcagaaggataagaaaaaaatcctgaaaagcagtatatattagacaggagaaacttctccacctgtctccctctgcccattaatctccagtctatgttttattagatagcggagaaaaacgtttctttttgggtgtaatagcacagcatattcttagtcagaattatttaatttctaccaatattttgtaacttttgtacctttaaaactaagtagtgtacaaataagattgtttaatcaactcatttatacttcatgtaaaatttaattcaaacataatatgatttatctctcatgtaagtattatttctgaattattggaatagataaaatagaaaatatcacagtatttacttttatcatggaaataaaaattaatttttccacttggtttataaaatatagattgataaatatatgagaaaagctattagccacctaaccaaagaaaagactgttattaaaactaactcctgactcatagctaaagttggttttactcataacctcattctgcctatataatcacacgttaatatagtttattgttgctaatttagggaagtaaagacagtgcatttgcctgaaaatcttgagttaaatggtaaattagaatcattacaccaatcattatggaacaggaatggactttggcattttaagtggagttgtgtctattttacaagagtatctcttatctgaagtgtcaccttgatttttaagagaaattcagatgcatggtcaaacatttaggtgttctacaaagtgacaaaatgattctcagcaactaagtagaaaatagtcatttattgtcagattttatggaaattttatttgaggctagaaaaacacctaatgtatgcagtaaatccaaaagcaaatatttctatttgtttctctaataagccttattaccacagtttataaatattacaaccatggagcaattatctgtaaattattgtgagcagaagcaatggtttttgaaaaggatttctagaatatccaattcctaaaatacctcagtactggtgggcagcatgtaagaatttgggagtaaagaagaaaaaattatttttatccctgggaaagccctggagttgtctccttaatgagatcacagggggatccaacagctgcccttgaatcttgcctctctctctacatgtttgttctctgtaccatccctctgaagcggatctcactattgattgccccctggcaagcagacatgtgaccaatatacacctatattatgagcctagaccatttaaaatcctgaaaacgttttttttctcttcatggaacacataattttttggcttgactttgaggactgatttgagatttgaacactgtaacactatttttcactccataataccctcttttctagagttgacttcaaggatattgttataggttaaattgtgtttcccccaccaaaaagatattttaaaatcctaatccctagcacctcatatttggaaatagggtcatggcagatgtaattagttatattaagaagatgtcattcaggagtaggtggacccctaattcaacatgactgatgtccttataggacacatacatggggagatgaaggtagagattggagttacgcagctgctggccaaggaacaccaaaggttgccagcaaaccatcagaagctaggaagaggcaagaaaggattgctttataggtttgagagggagcatggccctgctgccaccttgagctcagatttcttgcctccagtactatgagcaatacatgtctattgttttcagccacccaatttgtgaaactttgacatggcagtctgggagattaatacagaattgtaatataaataagtcagtactagatttagctctggttattacatcacaaagtttaatgttctgaaacttctttggtgaataggatctagataatctacaaattcaaactaacttcattactcgaattaaactctttattacaaaaatctaacttatcctttagctctattatccattccttcattttagtcggctgagcacctgctctgtgccaagttcctgggtgtaccatcttggacaggaagtctgccctgtctttacagagcttagatcctagagagagagatttactcagtgccaattcttctccctacacttactattctcaagcacaccaacacaagctctatgatgatatgcttgagatatttttcgggcagtcacaaagtgctggagcccacttggcccctgaaccattggggatcaactcttaatcagtgagagagaatttggtgtctaaatatcccagctctcttgccccactctgaagcatgttatactgttgcctagacttcccttttcagactgagcttcagttgcccctaacaatagcctgcccaatgatgtatctgaattcatttccttccttcacttctccactttcttcctggtgtttcctggggtaatatccaaaataagctacttgaatttacatgcttgacacaggatcagcttcagggaatccctgaactaaggtaactggcaaataattttaaaaggcacaaaagtgaattaattgcatactttccaactgtaatgggtgctataaggtaacaagagccttcagtagatgatgactggaatgggagtgtattcctttcttcagtcagggtgatcagggaagcttctctgatctagtgaccattaagacctgcgggaaggaaagaagtagccatttgaagagcaggagcaaaggcgttacaggacgctctatcagcaagtgcaaaggctcttaaattaccaatgagctcatcatcttcaaaaaactgaaagaagtagagagtagagcatacattagaaggaggaatacatgctaagacaggaagacttttgttttgttttccatatgcagtggaagtcatagaatagtctatggtaatgaaggaacatagttgaatttacattctgaaatcactcttaccactgggtggcaaacccattgcagagtgatcaaagtagaggtagggagagagaaatcagttacaaaaagaggtgctagtgacaaacatgaagagggtggcaatcaagatggaaaagtgagagaagtgtaactcacacattctctcaaatgtgggtaatactgtgaataatattttgaaattaattgatattttcttaatcatatatctcagacctgtttttatattagcctgcaacattctttttaacagtttcagatgtttcctgaaattgggtgaagatttgagatataattttttagaagcgacaagattttcggatggatttaagtgggtggagaataaatttaaggaaacaaggattattgacaaatttctagcttctgtggtaactgtggtgtcctccaatctagtagcattaatatgagaataggaaagacacatggagaaaataacagaatagaatgcaggcaagtcaccaaaggggagtttagagctctgtagttttatgcacatcatctgcaaatggtagtgccttatacatagtacacaacattttttttaatttttaatttttttagtgaatgaagataggagtgctctctgaggagcttagacatgttaataagtaaaacagatacatatatagttagcatttattagaaacttacaatatgtcagagggtttacaggtattatcttttttatttaccacaaaactgcatcaataccactaaaaatcctgaggaaattaaagaatgccaaacactctacctaaggaattgtaatgtaaaataactactaattgaggaagggataaagtatcatcaatgagagcacaaataagagaactatgaattctgactgagaaatgacaggaagttgtatatatgaaaatttaaagacgacatgaggttttcaacagagaagaaaggggtattttagggaaaggaaattatttctgcaatggatgagaacaacagccatcatcagatttctatttcaaatacattttctggcttagcatttattcccattacataattttttgagtaaactcactttaatgtttgccccttactaaaactgcatgcttcataagtgcctggatttcacctgagttgtacaacacgagaaacaggtaaaagtaatcactcattaaatgtacatgtatgtgaatgagtggaaaataagtgaatgagtgaataaaagaacaaatgaagaacaaataaaagaacaaataaagtaatcaaggagtcagccggggcgaatataccgtagttaccataaacttcaggggggaggagtggggcagagcacagcgcggaaggtcagagtacaagcctggaaggagactggcttgtgtgaatagctgctctgtctcttgatttctgagcaagcttggaaaagttacttaaaagtcaattaaaccttgtgaactttaattccttaaaaaactgagagtgatataggagttaggaataaattacttagccagatagtgaaggtacggtggtcttcagtgaggttttccttttaatgaaaagcaacccccaaatcattttcttttctaatacagagcagcctgtaaaactgagctgcagataatcaagctggaagctcgcacgagtgaataccagcagttgggccaacacggaaaggttacatgggactaggcatgttcaaaatggcagccccctcttctcttctcttggtcaaaccaggtgtagagtgagaagacaatatggcgctggccaggcaaagaccctgtttgcataataagattagagtggggcaaccagccctccccacagtgctgtgtaaacgtcacacctgacggaaccaatctgtgggccctgtgtaaatcagacactgcctcctcaagcctgcctataaaatctagtgcagtctacccaggccagattctcctttcagaagctcctctctctaaaaagggagagagctgttctcctttctccttcttctgcctattaaacctctgctcctaaactcactcctcatgtgtgcccgtgtcattaattttcatggtgctatgaggaaccccaggtatttaccccagacagtgatgtgcttcaatagtaaaaatagtactctactcactggattatgttgaggattacaggagacaggacatttgaaacactgagtatagcataggtattaaataaatttaagttaactaacagggggaaggaagtattgtctaaattcaggtgactaaataaagagattactgagggcaatgacaaagacaaggagatgataaggagaaactggaggcttctattaaatacagtctataagatttgaggtatgactagagtataaggtatagagtataaggatgtcatgagaactgtgcattccaacttgcagccctgcgtggatatgtaccatctattgacactgggaatctaggcagacaagcatgttttgggtaaagaaagtaattccatttggaatatgttaaactggagatcaccgtgtaatgtatatgccaaacctacagagcacttactctaggtcaggtactacctaccgagcatttactctgggtcaggtaccacctacggagcgtttactctgggtcaggtaccgcctgcagagcattcactccgggtcaggtaccgcctgctgagtatttactctgggtcaggcactctgctttacacttagaggggcagagaacaatttatataaagggaagatgtaagtgatgcaacaatcattcttcaaggggtttcactctaaaaggagaaataaatacacacagattaatatcaaaatggcagatttagaatttactttgaacctttgcattctgacttctgtaccctatgtctatggttgtaaacggtgatcctcataggttttttgcaagataaccaaagtgtattttctaagttaaatcctcctggttgcttctgtctgctgcgaaaccctgaatacttgacctggcctatcaggtcctaattacctctcctggctcatccagtatcattcaccaccccactcgaccatcagtccttgaattcactcacgatgttcttgtagtttgttacaccagtggtcctcatacatttttttgccctgcatgccttccaataaaactttttgagcatgcaatcctaatatactatatatttatttatagcacactttatatgcaaatgctgctgaactaatattgtatgtgtcttataagactacagaaaataatcatattaaaggttgaaataaataaatgtaagtagaagttctaacactcaatgaatatatggtttttgagactactattttaactatgctgaacttctccctcaaggctgcacacgctgttctcctctgcctagaagctcttgctttgtgagtaagattaattcctgctcatctttgagtttaaatgtgacttcttcagtctgccccatccatcccggtctacattaaatgcccaattaggtatttttctagcacttggtagtttccctccccacaacatttatcataattgtaacttaatctgtatgtgatttttggttaacgtctgtttccccactacacttcaagagaaccatttgcttagggtaccttacacactattgcatcccctacctcgttggttattcagtcccacccacttttttaacgagttttgatgactaaaactaatgtcatgcactttacaacatcattaccctttattcagtatcaccttgtgttcccccacgacaagatcaccaaagcttctgcaatgcaaggaaatcatgtataaggcattctttcagctttttctcctatagagactttgagttagaaactagtgaaataataattctgtgcaaataattctaataattacttttatggaagcattaaatctagggcggtataccacaacagataagagtaagggctctggagctctgattgcctgggtcaaaatctgggtagcagaacttaggagctgtatgactgtgtatgtcacttaacctctccctgttcagctgcctcacttctagagctggtattatggggttacttttggagtacattattatgtctaaaatactcagagatgtgtctaaaaatagaaatcactcaataaaagttcaccattattaatatacactaaacagcctattccataaatatctggagtttcgatttaattatatatcaacagcagcttcactttgcgtgtataatccccatccaaactttccgatcatggatatgtaaagcactttaaaaggtagtctaaaaaattaatgtaaagaagttacatggtatttacatttcaaaaactgggtaaagcacatttgaactcattgtgaatacaagccattccctgggctgtgacatggggacattttattaaaagaagcagagaactttatttattgctcatttctcttcatggttcacagcttgtaatgatttgaaccaacaaaatatctattatcagtgtgtatgcataagcatatagtaagtatgaaagatatatattctagtattaaagtctcccttttctttcttgctcataattgacgcgctctttctgaagaggagtttgcagtggtccgaacaaagatcacgatataaaaataaattatagtatgtatcccttggtgcctcactcataaattatttctctccactgatgctctttcatattcagtggtagatttaaaatttccttcctcgatattattcatacaggacattgtagttaaagagcttgccttttatagctgacaggctagtagagtccaagcttcagatgagggaggagggggtgaaaacacggaccctgtcttcttcctttccctatttactgccactcattacatgcttttgacatgacttctataaacattatcaatgagtgatctggggagtggaaaaagaggaaaaaagaccgtggaagaaaagttgaagaggatacaatacgattgcaattcctatccctttaacagggactctgtgctccaactctgcctgtttcatgtttaatttggaagcaattgttctcaacagaggtcacacatttcatcatttgagaactttaaaaaatgatcatggctgagatactgatatatttattcttcttaaaactttttcaagttcccccggtaattctaacttatagccaaaattgagaaccactactctaaatcatcagatccattcagtgaattcaatcaattcagtccaatgaaatgcagtcagttatagaaatgcagacgacctatagaacagaggtactcctggggttggagaaatgcaggataggtatagaacaagtctgggcctgagaagagtgacctgaagccaatgcacaagctatcccgtgttgtgaggctaggaacaagaggtgcgccgggataagaaaatgaacaggtttctggagagtgcattctagtacctaatttgagcaaacatttcaaaagtcacaagaggtgggcagcaggagccataaaaatgaaaatcaaagtataataataagctcaatactgagatcacagacaaaaaccaggaaatccaatggaactgaaaaaaatgataagacaataagcttaactaatctaggcagaaagctttctgagccaggtaaggacattttgaaacagaggccgtgcttctgaatcacttagtctaagggtttgagcaatacagaatctgtaggcagaaaatggctagaggaatactttcctaaatctggtttcttaaattattttgcagtcaaaatgtcagaggtatttgaactagagtgactctctcttgaataggggttggataaaataaggctgagacctactgagttgtattcccaggaggatgggcattctaagtcataggatgaaataggaggtcagtgcaagatacaggtcataaagaccttgctgataaaataggttgcagtaaagaagccagtcaaggctgggcatggtggctcatgcctataatcccagcactctggaggcccaggtcagcagatcatttgaggtcagacattcgagaccagcctggccaacatggtgaaaccccgtctctactaaaaatccaaacatatatatatatatatatataaaattagcccagtgtggtggcagcttgcacctgtagtcccagctacttgggatgctgaggaggaaaatcgcttgaacccaggaagcagacagagggagatcacatctcaaaaaaataaatacataaaagctggccaaatcccactaaaaccaagatggcaatgagagtaacctctggtcatcctcactgcttattatataccaattataatacattagcatgctaaaaaacactcctaccaaccccataacagtttacaaataccatgtcaatgcccggaagttactctgtatgctgtaagatggggaggaaacctcagttccaggaactgcccatcactttcttagaaaactcatgaatacttcgtttattcatttaccccttatttagcatataatcaagaaataaccataagtatactcagttggcagtccatgccactgctctgcctatggagtagccatccttttgtttctttactttcttaataaacttgctttcactttacaatatgaactcatcccaaattctttcttgcacaaggcccaagaatcctcttttgaagtctggatcagacccctttctggtaataaaaacatccatataattgattatgtcttagcctaaatacactagctaacaaaatgtttggcattaagtgaacaatagacccttcagtgaacttaattcttccttgattaacttgagaacccgatcggcaactcttcttataatgtcaagaattaagcagattcatgagaaatggacaataatatcacttaagaattggcaagtaaaaaacagaatatttgttctttgatgttatcaacaacacgcaggacataaagaatttataatatgctttgtgactgtttattgtaagtgaatagctgctttgaactatagaaagttactaatagtataaaaatcataactctacagtgtcacataaaagaggcaatgtaaagaaaataaagacattataagagaaagagctcacaatttttaagaacttcgttattaaacaaagataatgatagaagaaagactgaatcagtaatctaaaatattagtaaataatgttatccccctggttagaggtaacaataaagctccctttcaaatctcatgagttttcatttaattttactaagggatacaatagacggcaagagcagatactgcagctgtaagggatacaatagacggcaagagcagatacgcagctgtaagggatacgataggcggcaagagcagatactgcagctgtaagggatacaatagacggcaagagcagatacgcagctgtaagggatacaataggcggcaagagcagatactgcagctgtaagggatacaataggcggcaagagcagatacgcagctgtaagggatacaatagacggcaagagcagatacgcagctgtaagggatacaatagacggcaagagcagatacgcagctgtaagggatacaatagacggcaagagcagatacgcagctgtaagggatacaataggcggcaagagcagatactgcagctgtaagggatacaatagacggcaagagcagatacgcagctgtaagggatacaatagacggcaagagcagatacgcagctgtaagggatacaatagacggcaagagcagatacgcagctgtaagggatacaatagacggcaagagcagatatgcagctgtaagggatacaatagacggcaagagcagatactgcagctgtaagggatacaataggcggcaagagcagatacgcagctgtaagggatacaataggcggcaagagcagatacgcagctgtaagggatacaataggcggcaagagcagatacgcagctgtaagggatacaataggcggcaagagcagatacgcagctgtaagggatacaataggcggcaagagcagatacgcagctgtaagggatacaatagacggcaagagcagatactgcagctgtaagggatacaatagacggcaagagcagatacgcagctgtaagggatacaataggcggcaagagcagatacgcagctgtttatccaaactcttccttcccacacccttgccagtagttgcaccctgatacggtttggctgtgtccccactcaaatctcatcttgaattgtagctcccataatccccacgtgttgtgggagagacctggtgggaggtaattgaatcatggggtaagtttttcccacgctgttcttgtgatcgtgaatacatctcacaagatctggtggttttataaaaggcaattcccctgcacatgttctcttgcctgccattatttaagatgtgcctttgcccctccttcaccttctgccaagaggctgccccagccatgtggaactgtgagtccattaaatctctttttctttataaattacccagtctcgggcatttcttcatagcagtatgaaaacagactaatacacaacctcacctcccagcctcaccactatgtttcagaagttgaccacccctttggaacaaagtcaggattggtctaggccaatcatgatgctcacaactctatgtggcactttgaacggatgctgccatatcactaccagcttcaggataaaggcaatagatggaggactggagagtaagagaactacaaagagcatgagatggagcccagcttaatgataatggaagctaacaaatgctttacttacaaaatgtgacataaagaatggaattttgcaatgaaaatcatatacaattatgtgtcaaggttattaaagattcatcatttaaagctgatactttaaggactgttgtgaatggctgcaaaatattaggttaaattatcacttgtctttggagacccatgatttatccactgaggctgaagaattagaataaaatagtaagaaaagtcacaccattggggtgtggtggctccttacaggagtgttgggtaaagatctaaaagcaagagatgggctcagactgaagatgacccacctgaaagcagaaaggcaaaatcatagagcttttgaaagtgaaaactttcttcctctatacctccccacacacacacaaaaatgaaaattgtctgagaatataatctttagagtcccatagagttttttttaaaaggcagtcttgtctagttcaaggtaaagacagtgcagaaacagggtaataccaaaggcttgttctttaaaatggtttatagaatgatcaaaatttggcaagtcttattcaagacaaaaagaaacaagttgcaaaaaaattataatgaatgaaaaagtgagcatatttaaatataggagcaatttaaaactctgacaatgaaatacaatctatgacaaagacaacatgacgtattatttatgacgcagtctataaatttagatgacatgaatgattgaggctatttgttgttttaaaaggcttaaaaacacataggtaagataaattgatcaatagtgaatttaaaatattaagaaacatagtagcatctacctctgaaaattgcatcatatctaaattgacaatatgctaaacagttgttaaacaaaattcccacattatataaactttttagaccatacatgaatacataatcctccaagttcattttacagaaatggaaaaaggaaaaaagccacttgtagacaaaacagaggaaagacagcagaataaacaaatgtataggccaatctcactaatgaacacaaacgttatgtattctaattaaaatattagcaaataaattcctacagagccagaaaataataatatatcatcactaagtgtgatctgttcaagaaatgcagggtttgttcagcactagaaaatctaccaagtgaatttactacattaaatacctacatgggagaaaaaaataagattatattcaaaagctgttttataaaatgtatcaccaaatcctgattttaaaaattaagaagtaaaacttttaccatactagaaatagaatggaacttccttgatagctatcagaaaactatagagcaagcatctcattgagtaaacattggaaatactctctttaaaatcagtaacgagaaaaaagtacttactatcacattgttaataagcattgtatacagcccctaatcaattcaccaagtcaagaaataaaaaattgtacaaatattggaaacaagtaataagaaataaattgtatactttatttgttggaaaggataaagaaaatcccattacttttagaaaacagcaaagatgaaattttctatgctttattgcatgctagcaatgatagaacatataatagatgataagatctgcttcacagtagccacaaaactataaaatgcataaagatgacccaaataaaaatatgtataaagcctataggaaaaaaactataaaattttacagaaggacataaaagaagatttgaataaaatgtgaactcagccgtaatcagaataggatggctcaatattgtaaagttaagaatactcccccaaattaatctgtaaatctaccacaatgtagtaaaaaattctattaatattattcatgaaactcaaaatgcttcttataaatttcatttagaaggggaaacatgccaagagaagtttgtataagacaaatggggaaggaagagagagatttgcctactatattttaaaacttataaaaatataataattaagaaaatgtaatattggtataaaaatagaaaaagagatcctggttcaacaacaaacccatgggaatttagtgcatggaagagtagaattttgaattgttgagaaaaggatgcactagcaacaaacagtgctggataaattgtctaccaataagaagaaagaaaattaaattcttaccttccataatttacaaaaataaattcaattatatataaatttcaaaatgtaagaaacaaagttacgaatatattagaagaaaatatagaaatataagaacacattgttgtgatttaatgttaaaataggaaaggtcttctcaaagaagacataaatacatgtgtataaatataaaatatcacacaaatgtcataagaaatgaatcaataagtttaactatgtgatatttaaatcattctaccataaaagacgttaaaccatgttaaaggcaacagtagtagaggaaataatatttgtaaaaatatatacatatttttgtataagtatctttgggtgattatgtgtgtggggggtacatatacaaatgtatgtttatacgtaatgtatatgtttactgtttaaatacaggtcatgtatattcatcttgtgtgcgtatatatatttatgcacatataaatcaatcaaaactacaaaaaatccaaaagaataatgggtaaaagatttgaacagacaaatcaaagagttagaaaaacaaacaaaagatatttaactttggccgggcgtggtggctcacgcctgtaatcccagcactttgggaggccgaggcgggtggatcacgaggtcaggagacagagaccatcctggctaacacggtgaaaccctgtctctactaaaaatacaaaaaattagccagacgtggtgacacacccctgtagtcccagctactcgggaggctgaggcaggagaatcccttgaacccaggaggtgaaggatgcagtgagccgacatcacgccactgcactccagcctgggcgacagagtaagattctgtcaaaaaataaaagaaaaggaaaggaagggaggggaggggaagggaggggaagggagggatgagaggggaagtgaagagaggggaggggaggggaggggaggggagagaagggaagggaagggaagggaagggaagggaaaaaaatacttccctacaagcagaaaaatgtaaatgaaaataacagagatgacacatccattatatttcctactaaatgggcaaaaattaaaagtttaatatcacattttaccatagatatgaggaaagttctatctaagggatctcctttggcaatatattaaaactttaaatatacgtaactttttactgcaatttcatttcttacggagtattacagatatcccacatttacccaagtgaacatggaagcatggatgtgacacaacgaacagaaaataatactgcagtttaacaggaaggaaagttttccaaacatattacattaacaaataagtttgtagaacaatatatacagaacctctgatttttataagaatgtatgtatatatacatttatgtaaatatgcagccatgtaatgtaccccttttctctatcactcttgtcaatttagcctgaaatatattcctcatcacatgttcctttgagatttttatctttctatttgcttactatccaatgactctctcttctgaccagaatataggttccatgacagcaggatttatattaatttcatcactgatatcccctcagtacctggaatagcagttgactcataagaggcccagcaagggtttttcaaataaatgcaaaaagttatatggcattaattaactaattgattacacagctggtgagcaattaggattggtgacactgtaatgaaatatttgtggttatgctcaataaaaccccaatgtctattaacatgcacttatacttttaaccatatatttacagattagaatatatgaatactcattacacgctctttgggcactagaacttgtagtagcctttagaataaacaatgtatctatccatgcttggtaagtacatttttttttttttcaaaacagcttattgggaaagaacacagctgaaacaagtgtttagaattaccaaaaagcaaaaaggtgattttttttcctaacaaaatgaaaattctggcaagtgtataagatgaaaaaatcattttgttttacatactaagagaattgtactttttgaaagtcatcaagcataaggaagttaatatcaaattaagaacaaatgtatcattggtccctacagaagaaatacagtatgtattgatgacaagtatgttataactttggtggggtggagggaaggatttctaaaaaggattcaaagaattaacacattttttatgattccaagataagactttgcactttttttacttactgccatatatgtggattttgttgatctaaaataatcaacacacatctttgttgaaatattatctattattctctaaaactgttcataattatccagaataagtgatagtttgtgtttttgcatgtattactgactcttccaaaaagacatgtctcttagatttcactagtattttaggtaatagctttaaggaatatgttacattctatatttcagtttcttagaaatgatgttaggtacatagcacttaccctgactataaggatttgtcgccatttgattattttgaggccaagcattcagaatagcacaccatgcatgccatgcaccccttcttttatttaactacatttaaaggattcttaccatttttttcactttttgaaattataactacttagtagaatgtctttattgcataaatctctgtaatctttcctgggactcctgaaatgcactgatgtcatctcctcaaataaagcagttaatgagatggcaaatcttgcttgctgattgctgtttttgtttattcttcaaataatttttaaatactttgttcaccacttcttaagggatagtgttgattatgttcttcaataagcaatgcttttattcttgctttctaaaagtgatacagatgagctttgttttaatctcattattatgcccctgtaaaacaattatttagagactaagaagaagtaatctgaaaggaattgtgatattttccaaaccttggaatttcttgtgtttattgtagtaattatagctatcatttattgtgtggttactatgtaccacatattgtgataaaaaacttgcatttcttgtgtttacagcaatcctaaggtaactattattaaatattgctacccctattttgtagatgaagaaatgaggtacagagaggttaactgactctcctatggaattacagccagctagaggtggaatcaagatgttatccaattctatgatagaattgtaacagtattgctcaaaagaagagtgtttctgtggcaaattagcttgaagaaagtgtggaaattctatgtctgggtggaggtttgagcagattatgatcttttaaaactagggaggaacttgtcagttcacactgaactctaccatcgtttttgtataatcagctgttgagttttactttctttagcttagagatgcacaaaacttcccaaagatggtaatcacttctagctatgagtcatttctctcaccttctgcaggaactaaagaaactcttgtcataattgcttgtcataatttcttgccattcataaaaagccaataatgcatttttgttttacttaatacattttactttacagtttataaagcacaagcagtgtgcaaaatgcagggaatgcttaggtacgaggtctagcaccgccctcaaagtagttcacaatcaagtggagaagaaagacctatgcacaaataatgcagaagaataaacaaagtcaaggtgaatttcagtcaagtggagggtgtgtgtgtgtgtgtgtgtgtgacaagaacagcaaagggatgaagagtataagattagtatggattcatcaccagctcactttcaaataagaacagcaacgatttgcatggtgaagaaggaggcattttagctcaagtctgaagtccttgactaaggttatagcagaagatgactttgggtgtgggttaagctgggtgtgggttaggctttgggtgtgggttagggtgtaccactttatattttctgatttagaatgttctctgcctatatgaatacattataaaagctacaggaaggagtcacatacatatcacattctactatgaaaatagtctcataaatccataattttaggtaattttccaaatattttacagtgatatttcttagtgactgaagcataaggagtgcaatgcatgcttgaggtaggagtatatgagccttaagtgggaagacatctggagatgaatgtaatctgtattggttttgatgttttaaatctgtttgccactacacatctgtaatgtaatataataaatataataaaacttctatgtgaaccatgtctctccaggatatgataaagatttaaaatggaagaacttatcctttagaggagttagaaaaccacaagattttgcaatgtacttttcaatgataggaaagtattttatagtcacaaaatcatagagtgatgtcattgttgctaggtgtctcccttcgaaattttgaccgaataacctattcatctctgtcccagctatgtgcttgatttgtgttttgcacattgaaataacatgcactaaactgaccatcataactggtgatttggaaattctgtgtgtgtgtgtgtatatatatatatatatatatatatatatatacacacatacacacacacagaagatgtgtgtgtgtgtgtgtatggttgtatgtatgtctatgctatacatatatatgtatgtatgtatacacatacatatatatgtatacacatacatatatatgcatacacatacatatatatgtatacacatacatatatatatatagcatagacatacgtacacccatacacacacacacacacacacacacacatcttctaacaagtacacattattactagaggtgatctcatctaaaagaaaaagccatggaatgaacgtaagactttagacagatattcctgatatatgtgcaaaaacatggcacttaaaattatgttagtggattaatcaccagttttgtaaagtttaataccaaatgacagggaaaacagcaccgggtttggcaggcagatggagaatgaaccgttacgtctcatccatctccaattcctatgattatatgattaaatattagtgtccagagacgagcaagggaaatgccagcccttgaaataccaagtgtaggccagaaaagactgaataaatacttcactgagacaaatccagaagatgaataaagtggccaaaaactggggtaggagagggctctttcccaggtagctaattagaaatgtctcaggaacttgagttgaatgaattggaagaaaaagtttactcaggaaaaataattttgaaatacaattcaatagcaagaagtggtttttttgaacaaatattattttctgccacttacattttatttattactatgctgacacaaagtagatgaaagaataatggatagataagcaaaaagtctccttctaagggactttacaagagtattacaaaattatagactccatcccacccgatagtgaaaaattatttatagcagtcttctcaaaggaagagacagatagaggacaagaataatatggaagcttcgtcaaactatatgtagcttctgtccaaaatgttaatacacatctcagtggcaaggagtgttttcccttctctttttcattttgagaacctgtatcgtaaatatactagcatgctggatacctcagcaaatgcaaactctcactcagcatttcccctatctcagggactatgtatggcaatttatatatgaggttaatgcctgcattagcactagaaagtaggtaatataattaacccaattttacagtcacagtaactgatgcttacacagcttaaagaatctgaccaagataacaggtttagaaagttgtagagaaactaggactagaaccattgtcattctgacttcaaagtctatgcttttatccattatctattaaactatactaagtgttgatggaggagaaacaaaaatagaaattgaactgaaaaatttaaaaagtgttaatttacagccccccccaacacacactcattgtattgtaaaatttttgaactttatattttcctgatgccacaatatccccacaaacaggctgtgaggtgacctagtgactttcaaacacagcaatgaaatcccctcatattttttgctcctccatcctaacccctaatgaaggcacttggcttccaggcatcactctctgcacccccacctgcttggttgatccctctgcttgggagctgctcccatatggccctgcatggcttgctttgcctcctgtccctatgacctgtgagtaaataaattctttaattgaatatgcctctctgagtgcaatttcctcaggtgtgctggaatgatcttttttaaaatttacttatttatttatttagaaacagggcattgctctgttgcccaggctggagtgtggtggcatgatcatggctcactgcaaccttgacctcccggattcaagcaatccttccacttcagcctcccaaagtgctaggattacaggtatgagtcatcatgcctgacctggaataattttcaaagagcgcagaagggggacctatatatatgtaatttcatatgttttatatatttgtagtatatgtataattacattatatttatatattttatatattatatgtaaatataaatagaatttttattcaagttcataagaaacatggcctctttctaaatattgttatttatttacatatgcctccacaacaatactcccagaataaatgtatagatgaatgctaatgtttttatcggatttaaattccaatgcctctatttggagctagacctagataaaaggaagtcagttacatgtttaaggcacaaaattttaattatcttaaactttgtagaaataaatttttagaaatttataaaatcatagaaaaagttgacaattttcttattactattaccaagaactgatgatgctttacatcgtaagatacttgctttaatattccattgtaagaagtggggaagttccttcatttttgtttccataccttttatgtatttcttgcctctctaagagataaaaatattaatactatcatacttttcctcatcttcccttactctaactccattttttttattagtgttaaaattatgatgttgatttcacattatacatgtttatagcctttatattgcgttctataaaaatccttctcagagtcatttgttgttatttctatatttaaataaatccaaatgctaattgcaagcgagtttatcatggtgtctttattgttgagcttttgtcttgatttaccacctaactgattggatttgttgtccagcaggttgactctttccaaaaaagactgttacaacgtttcctgaatattttgtattggagaatttctgcctactgtctggtttttttttttttttttttttaagacggagtctcactctgtcatccaggctggagtgcaaaggcatgagatcggctcactgcaaccccgcctcctgggttcaagcgattctcctgcctcagcctaccaggtagctgggattacacatgtgtgccccatgcccagctgatttttttttttttttttgtatttttagtaaaaacgggggtttcaccatgttggcaaggctggccttgaactactgacctcaagtgatcagcctgcctcagcctcccaaagtgctgggattacacacgagagccactgtgccttgcttctgtttactgtctttatatttgactgacatcttaatcagatataatattcatagttaaaatgctcttttgtcagaatttggtacactttttcttttttctagtgtggaatgaggttgtagaggagtgagaggccaccataagttttctctttaaggtgatcttttttttctgcttacatgggtaacaaaacaacatttttaaaaattattattatattttaggttctgggatatatgtgcagaacatgcaggtttattacataggtatacacgtgcgatggtggtatgctgcacccatcaacctgccatctacattatgtatttctcctaatgctatccctcccctaacctcccaccccctgacaggccccagtgtgtgatgttctcctccttgtgcccatgtgttctcattgttcaactcccacttatgagtgagaacacacggtgttaggttttttgatcctgtgttagtttgctgagaatgacagtttccagcttcatccatgtccctgcaaaggacatgaactcatccttttttatggctgaatagtattccatgctctatatgtgacacattttctttatccagtctatcattgatgggcctttggattggttccaagtctttgctattttgaacagtgcagcaataaacatgcatgtgcatgtgtctttatagtagcatgatttataatccattgggtatatatacagtaatgggactgctgggtcaaatggtatttctggttctagatccttgaggaatagccacactgtcttccacaatggttgaactaatttacactcctaccaacagtgtaaaagcgttcctatttctccacctcctctccagccatctgttgtttcctgactttttaatgattgccattctaactggtgtgagatggtatctcattgtggttttgatttgcatttctctaatggccagtgatgatgagcttgttttcataagtttgttggctgcataaatgccttcttttgagacgtgtctgttcatattcttcacccacttgttgatggggtttttttccttgtaaatttgtttgagttctttgtagattctggatattagccattgtcagatgcataaattgcaaaaaatgttctcccattctgtaggttgcctgttcactccaatgacagtttctttcactgtgcagaagctctttagtttgattagatcccatttgtcaattctggcttttgttgccattgcttttggtgttttaatcatgaagtctttgcacatgcttatgtcctgaatggtattgcctaggttttcttctagggtttttatggttttaggtcttacatttaagtctgtaatctatcttgagttaatttttttatgaggtgtaaggaaggggtccagtttcagttttgtgcatatggctagctagttttgccaacaccatttattaaataaagaatcctttccccattgcttgtttttgtcaagtttatcaaagatcagatggttgtagatgtgtggcattatttctaaggcctctgttctgttcaattggtcgatatctgttatggtaccagtaccatactgttttggttactgtagccctgtagtatagtttgaagtcaggaagcatgatccttccagctttgttcttttcacttaggattgtcttggctatatgggctcttttttgtttccatatgaaatttaagtcattttttctaattctgagaagaaagtcaatggtagcttgatggggatagcattgattctacaaattactttgggcagtatggccattttcacaatattgattcttctatccataagcatggaattttttccatttgtttgtgtccactcttatttctttgagctgagatttgtagttctcctggaagaggcccttcccatcccttgtaagttgtattcctacgtatgttattctctttgtagctattgtgaatgagaattcactcatgatttggctctctgtttgtctattattggtgtagaggaacggttgtgatttttgcacactgattttgtatcctgagactttgtatcctgttgcatttttatttctgccttaattttgctatttatccagtagtcattgaaaaggttttcaatttccatgtagttgtgcagttttgagtgagtttcttagtcctgagttctaacttgattgcactgtggtctgaaagactgtttgttatgatttccattcttttgcatttgctgaggagtgttttacttccagttatgtggtcaattttagaatatgtgtgatgaagtgctgagaagaatgtacattatgttgatttggggtggagagttctgtaggtatctattagatctgcttggcccagagctgagttcaagtcctgaatatccttgttaattttctgtctcattgatctgtctaatactgacagtggggtgctaaagtctcccactgttattgtatgggagtctaagtctctttgtaggtctctaagaacttgctttctgaacctgggggctcctgtattgggtgcatatatatttaggatagttagttcttcttgttgcatcgatccctttaccattacgtaatgtcctcctttgtctcttttgatctatgttggtttaaagtctgtttttatcggagaataggaatgcaaaccctgcttttattttgttttacatttgcttgataaatattcctctatcctattattttgagcatatgtgtgtctttgcacgtgagatgggtctcctgaatacagcactctgatgggtcttgaatatttatccaatttgccagtctgtgtcttttaattggggcatttagcccgtttacatttaaggttaatattgttatgtgtgaatttgatcctgtcattatgatgctagctggctaccttgcccattagttgatgcagttttttcatagtgtcaatggtctttacgatttggtatgtttttgcagtggcagatactggtttttcctttcatatttagtgtgtccttcaggagctcttgtaaggcaggcctggtggtgacaaaattcctcagcatttgtttgtaaaggattttatttctccttcacttgtgatgtgtaatttggctggatatgaaattctggattgaaaattattttctttaagaatgttgaagattggcccccactgtcttctggcttgtagggtttctgcagagagatctgctcttagtctgattggattccctttgtgggtaacccaatctttctctctatctgcacttaacattttctccttcatttcaaccttggtgaatctgacaaatatgtgtcttggggttgctcttgttgaggaatatcttactggtgttctctgtatttcctgaatttgaatgttggcctgtcttgttaggctggggatgttctcctggataatatactgaagtgtgttttccaacttggttccattctccccatcactttcaggtacaccaatcaatcataggtttggtcttttcacataatcccatatttcttgaaggctttgttctttctttttcattctttattccctaatcttgtcttcatgctttatttcattaagttgatctttaatctctgatatcctttcttccacttgatcgatttggctattgatacttgtgtatgcttcacaaagctctcgtgctgtgtttttcagctccatcaggtcatttatgttcttctctaaactggttattctagttagcaattcctctaaccttttttctaggttcttagcttccttgcacttggttaggacatactcctttagcttggaggagtttgttattatccaccttctgaagcctacttctgtcaattcatcaaactcattctccattcagttttgttcccttgctggtgaggagttgtgatcctttggaggagaagaggcattctggtttttggaattttcaggctttttccgctggtttttcctcatctttgtggatttctctacctctggtctttgatgttggtgaccttcagatggagtttttgtgtggtcatcctttttgttgatgttgatgctattgctttctgtttgttagttttccttataacagtcatgcacctcttctgcaggtctgctggagtttgttgaaggtccactccagaccgtatttgcctaggtatcaccagcagaggctgaagaacagcaaagattgctttctgccccttcctctggaaccttcgtcccagaggggcacctgccagatgccaactggagctctcctgtatgagatgtctgtcaacccagaatgtctcttctcctccaagtatcacaactcctcaccagcaagtgaacaaactagatggagcatgagtttgacaaattgacaaaagtaggcttcagaaggtgggtaataacaaattgctccaagcaaaagcaacatgttctaacccaatgcaaagaagctaagaacatcaaaaaaaggttagaggaattgctatctagaataagcagtttagagaagaacataaatgacctgatggaactgaaaaacacagcacgagaacttcgtgaagcatacacaagtatcaatagccaaattgatcaagtggaagatatcagagattgaagatcaatgtaatgaaataaagtgtgatgacaagattatagaaaaaagagtgaaaaggaacgaacaaagccttcaataaatataggactatgtgaaaagaccaaacctacgattaactggtgtacctgaaagtgacagggagattggaaccaagttggaaaacacacatcagaatattatccagaagacatctccaacccagcaacaggccaacattcaaattcaggaaatacagagaacaccatattcttcaaaaaaaaaatttcaacccagaacttcatatccagccaaactaagctttgaaagacaaaagaagggcattacataatggtaaagggatcaatgcaacaagaagaactaaccatcctaaatatatatgcaccgaatgcaggagcacccagattcagaaagcaagttcttagagacctacaaagacagctcttattattttgaaatatgtcccatcaatacctaatttattgagagtttttagcatgaagggttgttgaattttgtcaaaggccttttctgcatctattgagataatcatgtggtttttgtctttggctctgtttatatgctgcattacatttattgatttgcatatattgaaccagcattgcatcccagggaggaagcccacttgatcatggtggataagctttttgatgtgctgctggatttggtttgccagtattttattgaggatttttgcatcactgttcatcaaggatactggtctaaaattctcttttttggttgtgtctctgcccggctttggtatcagaatgatgctggcctcataaaatgagttagggaggattccctctttttctattgattggaatagtttcagaaggaatggtaccagttcctccttgtgcctctggtagaattcggctgtgaatccatctggtcctggactctttttggttggtaagctattgattattgccacaaattcagagcctgttattggtctattcagagattcaaattcttcctggtttagtcttgggagagtgtaagtgtcaaggaatttatccatttcttctagattttctagtttatttgcatagaggtgtttgtagtattctctgatggtagtttgtatttctgtgggatcagtggtgatatcccctttatcattttttattgcatctatttgattcttctctcttttcttctttattagtcttgctagtggtctatcaattttgttgatcttttcaaaaaaccagctcctggattcattattttttgaagggttttttgtgtctctatttccttcagttctgctctgattttagttatttcttgccttctgctagcttttgaatgtgtttgctcttgtttttctagttcttttaattgtgatgttggggtgtcagttttggatatttcctgctttctcttgtgggcatttagtgctacaaatttccctctacacactgctttgaatgcatcccagagattctggtatgttgtgtctttgttctcgttggtttcaaagaacatctttattcctgccttcatttcgttatgtacccagtagtcattcaggagcaggttgttcagtttccatgtagttgagcggttttgagagtgagattcttaatcctgagttctagtttgattgcactgcggtctgagagatagtttgttataagttctgatcttttacatttgctgaggagagctttacttccaactatgtggtcaattttggaataggtgtggtgtggtgctgaaaaaaatgtatattctgttgatttgtggtggagagttctgtagatgtctattaggtccgcttggtgcagagctgagttcaattcctgggtatccttgttgactttctgtctcgttgatctgtctaatgttgacagtgaggtgttaaagtctcccattattaatgtctgggagtctaagtctctttgtaggtcactcaggacttgctttatgaatcttagtgctcatgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggctcagtagatcttcctccatccttttattttgagcctatgtgtgtctccgcacgtgagacgggtttcctgaatacagcacgctgatgggtcttgacactttatccaatttgccagtctgtgtcttttaattggagcatttagtccatttacatttaaagttaatagtgttatgtgtgaatttgatcctgtcattatgatgttagctggttattttgctcgttagttgatgcagtttcttcctagtctcgatggtcgttacattttggcatgattttgcagcggctggtactggttgttcctttccatgtttagcgcttccttcaggagctcttttacaaacccacagccaatatcatactgaatgcgcaaaaactcgaagcattccctttgaaaactcgcacaagacagggatgccctctctcaccactcctattcaacatagtgttggaagttctggccagggcaattaggcaggagaaggaaataaagggtattcagttaggaagaggaagtcaaattgtccctgtttgcagatgacatgattgtatatctagaaaaccctattgtctcagcccaaaatctccttaagctgataagcaacttcagcaaagtctcaggatacaaaatcaatgtgcaaaaatcacaagcattcctatacaccaacaacagacaaacagacagccaaatcatgagtgaactcccattcacaattccttcaaagagaataaaatacctaggaatccaacttacaagggatgtgaaggacctcttcaaggagaactacaaaccactgcttaaggaaataaaagaggatacaaacaaatggaagaacattccatgctcatgggtaggaagaatcaatatcatgaaaatggccatactgcccaaggtaatttacagattcaatgccatccccatcaagctaccaatgactttctttacagaattggaaaaaactactttaaagttcatatggaaccaaaaaagagccctcatcgccaagtcaatactaagccaaaagaacaaagctggaggcatcacactacctgacttcaaactatactacaaggctacagtaaccaaaacagcatggtactggtgccaaagcagagatctagatcaatggcacagaacagagccctcagaaataacgccgcatatctacagctatctgatctttgacaaacctgacaaaaacaagcaatggggaaaggattccctatttaataaatggtgctgggaaaactggctacccatatgtagaaagctgaaactggatcccttccttacaccttatacaaaaatcaattcaacatggattaaagacttaaatgttagacctaaaaccataaaaaccctaaaagaaaacctaggcattaccattcaggacacaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaatctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtccttagtagggacacggatgaaactggaaatcatcattctcagtaaactatcgcaagaacaaaaaaccaaacaccgcatattctcactcataggtgggaattgaacaatgagatcacatggacacagaaaggggaacatcacactctggggactgttgtggggtgaggggaggggggagggatagcactgggagatatacctaatgctagatgacgagttagtgggcgcagcacaccagcatggcacatgtataagtatgtaactaacctgcacaatgtgcacatgtaccctaaaacttaaagtataataataaaaaataaataaataaataaaaaagaaaaaaaaagagacctacaaagagacttagactcccaaataataatagtgggaaactttaacactccactgtcaatattagacagatcaatgagacagaaaattaacaaggatattcaggacttgaactcagctctgagccaagcagatctgatagacatctacagaactctccaccccaaatcaacattatatacattcttctcagcaccacatcgcacttattctaaagctgaccaagtaattagaagtagaacactcctcagcaaattcagaaaaatggaaatcataacagtctctcagaccacagtgcaatcaaattagaactcaggattaagaaactcactcaaaaccgcacaactgcatggaaactgaacagcctgctcctgaatgactactgggtagaaggcagaagtaaggattttctttgaaactaatgagaagaaagacacaatgtaacagaatctctgggacacagctaaagcagtgtttacagggaaatttataatactgaatgcccacaggagacagcaggaaaatctaaaatcgagacccaaacaccaccattaactacagaagcaagagaaaacaaattcaaaagctagcaggggcaagaaataactaagatcagggcaaaactgaaggaagtagagacacgaaaaacacttcaaaaaatcaatttatccaggagctggttttttgaaaagattaacaaaagagcccactagctagactaataaagaagaaaagagagaagaatgaaatagacccaacaaaaaatgatataggggatatcagcactgatcccacagaaatactaactaccatcagagaatactataaacctctgcacaaatgaactagaaaatctagaataaatagataaattcctggacacatacaccctcccaagactaaaccaggaagaagtttaatccctgaataaaccaataacaagttctgaaattgaggcagtaattagtagcctaccaaccaaaaaaaaataaaaataaaagcccaggacctgacagattcacagccaaactctaccagaggtgcaaagaggagctggtaccattctttctgaagctatttcaaacaagagaaaaagaatgactcctctctaactcattttatgaggccagcatcatcctgataccaaaacctggcagagacacaacaaacaaagaaaatttcaggccagtatccctgatgaacattgatgtgaaaatcctcaataaaatactggtaaacagaatccagcagcacatcaaaaagcttatccaccatgatcaagtgggcttcatctctgggatgcaaagctggttcaacatacgcaaatcaataaacataatccatcacataaacagaaccaaggacaaaacctcatgattatctcaatagatgcggaaaagacctttgacaaaattcaacagcccttcatgctaaaaactctcaataaactaggtattgatgaaatgtatctcaaaataataagagctatttatgacaaacccacagccaatatcatactgaatgggcaaaagctggaagcattccctttgaaaactgggacaagacaagaatgccctctctcaccactcctattcaacacagtattggaagttctggccagggcaatcaggcaagagaaagaaataaaaggtattcaaataggaaggcaggaagtcaaattgtctctgtttgcagatgacatgaatgtatatttagaaaaccttatcacctcagcccaaaatctccttaatctgataagcaacttcagcaaagtgtcagagtacaaaatcaatgtgcaaaaatcacaagcattcttatacaccagtaatagacaaacagagagccaaatcatgattgaactcccattcacaattgctacaaagagaataaaatatctaggaatataactcacaagggatgtgaaggacctcttcacagagaactacaaaccactgctcaaggaaataagagaggacataaacaaaaggaaacacattccatgctcatagataggaagaatcaatatcgtgaaaatggccatactgcccaaagtcatttatagcttcaatgctatcccatcaagctatcactgactttcttcacagaattagaaaaaactactttaaatttcatactgaaccaaaaaaaaagcccgtatagccaagacaatcgtaagccaaaagaacagaacagcatatttttaaactggctgttgataattttgcttctgtagtcgcctatggctaatttttttcttatttttaatagttttgtacttcactattataaacagcatgttatgaagatctttgcacatgcatactattatacataattgaatataaatttaaagttaattttagaagtcttattacctgaatagtgcacatgcattacaaatatttacaaatattacaagttgccttctataggggtatcattgtcaactcccattatcaatgtataattgtacatgttgccccaccccaataaatacagtgtattaatttttcagcattatagatttgctgagtaaaatgtagtatcttatttaattttcatttttcttattacgagtgaagtttagcccctgtttatatttaagggtgttttacattcttttttcagtttgagtttcatactctttacccatttttattgaatattttctatttgatatgtaggtattactaatatattaagaaaattaatactcccaatgcttgcaatttctcataaaaatattttcccagtttatcagttgtctgccagctttctgcatagcattttgtgatgcaaatatttaatttttatatccaattttatcaaacatttttatggctgctgggattctgtcatggctaagaaaactgttttccattccaatattataaccttttcccattttttcttttaggtatgtttatggtttcatgtgagaccttagacaagttacctaacatttctgtgctcaaatgtccttattgatagtggggacagtatcaacaatacattcctcatagaattctgtggtttaagttacttcataaaaggaaaataaacaattattagccagacgtggtgactcaggcctgtaatcccaacactttgggagggtgaggcaggaggactgcttacagccagaagtttgagatcagcctggtcaacaaaagtgagaccttgtctctacattaaaaaataaattagccaggtgtgatgttgtgcacctgtaattccagttattcaaaaggaaggggaaggagaacagaactctctcttcaaatcttcaaaaaatagttaaaaacgaaatttaaaaacttgcacactgtgagaacttaaaaagggatagctatcttactgttattgaataatcctgttttcatcactggtatgcacaacgtcatctttatcatatactaaatttttaaaactatttagctccatttctacatgtttcacgtgacgaaatcagtggtgtttctccaagctcctatattatcttcctattatggccctgattatattattttgtatctattgtttgtctagattgttatcattggactacaaattatttgaggaggaagattttattgttttctttgcacacccactgcctacaaactaacatagtaaatttacagtaaatattttttaaaaattcaggtctataaaggcatctgtaattgaattcacccaaaatatttcaattcgacgtagccaaatttatcaaattctctctttgatttttcccttctgtgtcctaagaaatcttcgcataagccaaggtcacagagatttttttcctttgtattttctagacattttgttattttatctaatgtttaagtctatgacacatttcaatttatacttggtatgcggttaagagtgaaggctgaggttcattttattttgtgtatattgttcttcaattattctagcaccactttttaaaagacaatcctttccctaatgaattaccttatggcaaataaactatgcatcattagacttacatatttcagatctttgtacctttttgtaaaccatttgacagtacattcaaatggaatgatttttaaatggagataatttttttttttttttttttttttttttttttttttttttggtgagacggagtcttgctctgtcgcccaggctggagtgcggtggcgcgatctcggctcaccccaagttctcctcccgggttcacgccattctcctgcctcagcctcccgagtagctgggactacaggggcccaccaccacgcctggctaatttttttttttttttttttgtattttcagtagagaccaggtttcaccgtgtcagccaggatggtctcaatctcctgacctcgtgatccgcccacatcgtcctcccaaagtgctgggattacaggcgggagccaatattttttaaattaacctcaatgttttcattattttctcattgtcttttcagttattttaattcaactttttttttatttgataatgattcataggccggcagtaagatgtaacaaaaaagaaaacacattgaaatcagaaagtcttaggttcaaatgcccactgtgccatttactacctgtttgtgggttatttatataataacctgtaacctcagtttctttaattataaaatgtagataatttctatttcctaaggttatatggaagattacttaaaattactaatgtggggatggggtttacttactaagcatacatactcaattacattataggattctaataaaagaaatcctgccatggcttgtatgcatttttttccaccaagattaggcactgatccagcctacacttttcttacttatttaaagacactagcaatgagaacttgcaatttctctgttcttatattgctttacttttgccttgtccctcaccgaaatgatgattgatataattttggtgtctgtgtactgtaacttctgttgtttcgcatagaaacaaaacaatagagatatcttcagacataaaataattaggtaccctacatctttttgcaaagtttttaatatataaggatagaaccatgccaaaaagaccaagagtaaagttacaaaaaataaaaagacagattacatcatatttctccagattccattgctggcattcaggaggtaaggtttctatattgttgggggcacagttagaaagcaaataggtggtcctgggacctactgtgagttagctaccctgaaagtttaagtgctctggggtctgggtggctacacattgatcagttgaatgaattaaaataggtataaaactcttgggcccaggcacatttgctcctacttgtctgatcataacacacagaaagagggtatgttctcatcatcatttcaaagtgactaaacactatgaaagcactaggaaaatcaggatggtggagaccacagaaaatttcttgaacaaggaggcttaaagccagtgattgtgaaatctgagcttaatgggcctatatcagttactttttccctggcaagtagggaaggcaatcaggattacttcagaaagaaaacgatgatttatgcattcataaccatgggaattgtcacaaattttggtagaggcaaaatactggattgctgcttggtcttcaatgaaattatattatccaagccctctaaacagttaagctacatgagaagaggaaatggcttttaattaataatcagtattttctacataaagcatacttgagccaaactttcataataggtctggggtaatctgtcaaaaatattttaaaagagcccatgttgatttttaagagaatggcaacattcttatgatcaagtataatccataggaatacctataagagaaaaatgtatagggatgagacatttggaactattatttaaaataataaattattatgacaattttttgaagataattgtaatttcatatacattggaaagaaataatacaaagtgatcccatggaccatacccctatgataacagcactcaccaaagtagaaatagaagaaaaactcctcaatctgataaaagccatctcaaacaccagctgacatcatgcttactagcgaaagactgaaagtcttcccaccttagacttggaacaaagcaaagatgtgtgttctcaccattcttaaagataggactagaagttctaaccacttgcaatgaggcaataatagaataaaaagcaatcaaattggaaaataagtagtaaaactgtttctattcccagataacatgatctttttaatataggaaatccttaggatacacacacacagacagaaaaagagagagagaacacaaataaatgatttcaacaagattgcaagatataagatcaatatataaaaatcaatggtaattctatactagcaatgaacaatttgaaaataaaattaagaaaacaattctttttttatagtataaaaaagaacaaaacacttagaaattcaacaaaagaagtgcaaacttatgctctcaaaactataaaacatagctgacagaaattaaaaatctaaatagttggaaaaacatttcatgttcgtgaatcagaagactaaacagctgatagtagtatttcccacagtagttctacagattcaatgcaattcccatcacaatcccagctgacttctccatagaaattaacaaagtaattctaaattcacatgaattgcaacaggccagaacagccaaaacaatcttgaaaaagaacaaaacaagaagagtcagacttcttggtttcaaaacctactacaaagaaatattcatcaagacaatgtggtactggcatacgatagacatatagatcaaaggaatagaactgagagattcagagtccaaaaataaactttcatatacatggtcaagtgattttcaccaagattactaagaccctccattcactaggaacaggatagtcttctcagcaagtggtgctgggacaactacatagctaatgtaaatgaatgaagttggaccactacctcctaccgtatgtaaaattaacttgaaatggaacaaagacctaaatgtaagagctaaaacaataaaacactttgaagaaaaaatagaaatctgacagaccttggatcaattaattagtttattacctatgacgataaaagcacaagcaacaaaagaaaaaaataaattatactccatcaaactttaaattatttgtgctgaaaaaaatagcattaataaaatgaaaagaaaacccagagaatgagagaaaattttgcaaatcatatctctgataaaggactcatatccagaatatgtaaagaactcttccaactcaacaataaaagacaagccaactgtaaagcagggaaatagtttgaacagccatttcttcaaagatgtggacagtaagcaaatgaaaagatttgcaacatcatgagtcattagggaaatgtaagccaaaacaacaatgagataccccttgaaaaataaaaagggttggcaagaattcgaatatgttggaaccctaatgcattgctggtgaaaacgtaaatgagtgaaaccaatttgaaaagcaatttggcattcatcgaaagttaaacatagagttaccatacgacctagcaactctacttctaggtatgtaagagaattgaaaatgctatgtccacacaaaaacttccatgtgaatgctcatgcaacatttttctaagtggttaaaaaagtgaaaacaactcaaatgttcatccattgataagtagataaaaaagtatgatcacatattccatagcagccatgaaaagaaatcaaatactgatacattctattgatacaacatagatgaatgtaaaaaatatgctaagtgataacattcagacacaaaaggtcacatattttacaattccatttatatgaactatccagaatatgcaaatctataaagatagaaagtagatgaatggttgccagggattgggaagtgtgaagaatatatagtgattactaatgagtatggttttgatttgttttgtttcgtttctttaaggccaaaaaagttctcaaatagattgtggtgatggttgcgcaaccctgtgaatatacaaagaaaagtaaattgttcatgttaaaaaggtgtatcctatggcatgtgaattatatcccaataaagctgttattaaagaaatgaagtagtaataagtggtaatagaattaattagtatgtttcgagttaagcatatttgtatgggaagatatattttcaataaacatgtggctttattttatccagtggttttcaatatcttctttatactctacattatttacatatacaacaaacttgtgtaatatttgttacattctattaattgtgaaacactgatttagtttgctttataccacaaataaagctagaaaattatcttgaaaatattatgcagaagtagattttactacaaatggctagataattgaagcatattttatctataaatataagaataattttatttttctacttgatcctgcatctgtatttaatgcaatttttataaaatcctgaaaattgaagaattaaatatggtgacaagacacgattttgttgaagggaaaaatctctctcagattaaatagtacattttaaaatatgaatgcagctggatgcagtggctcacccctgtaatcccagcaccttgggaggctgaagtgggcagatcacctgaagtcaggagttcaaaaccagtctggccaacatggtaaaacctcatctctaccaaaaattcaaaaattagcagaacatggtggcaggtgcctgtaatcccaggaactcgggaggctgaggcagaagaatcgcttgaacccatgaggcagaggttgcagtgagccaagatcgtgccactgtactccagcttggatgacaagggcaagactgtgtctcaaaaaaaaaaaaagtaaaatagaataataaaatataaattcattctacacatatagaagttcctctatgaacatttaggttctaaaaatatgtgggtatgtgttgtccctatgcccattaaggcatataaaagctatagacataggcatattcatgaagttaaatttcttaaatgaatgaattttgatggcattgaatttgttttgttttctcttttaattgtaataataaagcttggcttagcagcttcaacaatctcacagattttgcacttattaggaaagataaaattggtagtcataaattattatacatttggtacaaatgcagcaatcatgctacagactgataaaagcaggaagaccaacattacaatgatacacacaactactgacaccatctctggtgtcaggaagagttgacttgctttagctatggaggggcaattacatatataattttattttcctatagagcttcaaagtacacaaaattctgtagaccttttcataccatagttatatattgtgccaaaaatgtgctagtcagtaaaaaatgaaaaatcaaactttccaattgagtcatatactaaatttgtctttgtcaattgatgtttattctacagagatttatttagaatggaatattccaatctgctaaaacaatttcttatttctgttgtgtgtgtatctgtggtaaaaatcaaagcttagtgtgtctgcatgcagccaaaagctgccattgtgacagcttgtctttcattttgtaacattcaaccacttattgtacaccagctgattttgttatcctgacctgcctgaggagtggatattactccttagtccaaatgcattctacaccatggagcctcaactggcactataaacttaattaaatactgtcattgaaaccagctgtaaactaagtaataaaagcatttttatttttctagctggagcccagaaaatctgacaaattttggatcagagtaatagacatattttgggcatgcctgtccacaaaatgtcactgttgaaggactggacttagagagcctgttcaaatctatgacccacctccctaactaccttcagccaactgggctgtggttttcacctgatctaagttaagctggtcagattcatctggggtgttgaaggacaatgggtagctgagctaataacactgaagattgaggggcttaggctgtgtttttatggtaagccataatggaccatgtccaaatagatgagggagagtaagaagcaattcgcacagagataaaaaataaaacagaaagaagaaaaggttgtgtggcatgaaaaaagatatgcgcagttttgagaattgggaaataaaaacaggcagtcttttgttttttcccaatgatgttttctgtacttgttgccctccataaatttctagatttctctgtatcctttatttaaaatatcactaggtggggttttttcagtccttgcaactcaaagctatttaaccagaatagtcaggaaaatagtgcattagagttagtatatttaaattaaaagtttcaaaagttctcctgttaaaagtttagacacatttcttttctttttaaatgaaaaactgcaatagcatctttttatctcagtagggaaacaccttctctctccttagaattcaagcaataacaattctgtggggtaatgattattctagatgcatggtaccatgtaaattaatctattgctttggctgcactgctccaaaaaacagtgctgatgctgagtgcacagaatgaaaaaattaattagccagactgcgaaatcaaataaatctcacagtggcgacctttgtgtagtagaataaggaaaagcattaagttcatgtaacaaccttggtagaagtaaaaccaagcttaaatagggccaagtgttcttataatttaaactggatcgtatagtccaggcccacaagaaagtcctggcagagaaaattgatcttaagggtctggtcaatagcaaactgttggtctttgactaaaatgcagtcttcttcattaatgttccaagaagaaaaacaacacagagaaaataaacacactgatttcttctcctgtacaaattatctccctgtactaggttaagccacagaacacgaggcagttagttcatcttgttgctctgagctttcaccgctgcagtttgtcttaggcctgcagctgatactcatcatctttcacctctacttctcattctagatttttctcacattccgcaggttctgttactgtgcaaggtgtctttgctaatggagtgacacggaacttcatcagcaaggggtctgagaccacagtcagcacagagttctcaggttgtggctgctttcctggtccatttaccattaaaattggccagcagagtaccaagagaagtacctaagtgtcaaacttcttcttccctgcaaaccacttaccctcacgtgtcataacagctctatttccttttcatggccacagtcaactacccctaccgttgtaatgattcctttgatgccctgagagttccttggtatgaggagcctaaatgaaaagatggcagacaaagctcaaacctcgtacttaaataggattctaaccctatctcttgtagaagaaacaagacctatagaagcacagaacctaagctcgtggagaagaaagcacttctgtctcccctctgggcccttaatgtcatgtattctacttaatgggcacagggtgatagaatctgtggaccccatggttatgtgtccactgccagagctactttgctgtaaaatgagtccatggctgtgtttgcattgctatgaaggaattggtccatttgcattgagcaaatggtaagccctcctaaggcgcttttccatgtgaggacttgtgtgaagaagccagcagacattctcaatccttcttttttttttcttttctttttattattattattattattattacactttaagttttagggtacatgtgcacaatgtgcaggttagttacatatatatacatgtgccatgctggtgtgctgcacccattaactcgtcatttagcattaggtatatctcctaatgctatcccttccccctccccccgccccacaacagtccccagagtgtgatgttccccttcctgtgtccatgtgttctcattgttcaattcccacctatgagtgagaacatgaggtgtttggttttttgttcttgcgatagtttactgagaatgatgatttccaatttcatccatgtccctacaaaggacatgaactcatcattttttatggccacatagtattccatagtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtacacacccagtaatgggatggctgagtcaaatagtatttctagttctagatccctgaggaatcgctacactgacttccacaagggttgaactagtttacagtcccaccaacagtgtaaaagtgttcctatttctccacatcctcttcagcaccttttgtttcctgactttttaatgattgccattctaactggtgtgagatggtatctcattgtggttttgatttgcatttctctgatggccagtgatggtgagcattttttcatgtgttttttagctgcataaatgtcttcttttgagaagtgtctgttcatgtccttcgcccactttttgatggggttgttttattcttgtaaatttgtttgagttcattgtagattctggatattagccctttctcagatgagtaggttgtgaaaattttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatgggtagccagttttcccagcaccatttattaaatagggaatcctttccccattgcttgtttttctcagctttctcaaagatcagatagctgtagatatgcggcgttatttctgagggctctgttctgttccattgatctagatctctgttttggtaccagtaccatgcgttttggttactgtagccttgtagtatagtttgaagtcaggtagtgtgatgcctccagctttgttcttttggcttagaattgacttggcgatgcgggctcttttttggttccatatgaactttaaagtagttttttccaattctgtgaagaaagtcatcggtagcttggtggggatggcattaaatctataaattaccttgggcagtatggccattttcatgatattgattcttcctacccatgagcatggaatgttcttccatttgtttgtatcctcttttatctcattgagcagtggtttgcagttctccttgaagaggtccttcacatcccttgtaagctggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaacagggacaattggacttcctcttatcctaattgaataccctttatttccttctcctgcctaattgccctggccagaatttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccaacagtacctaatttattgaaagtttttagcatgaagggctgttgaattttgtcaaaggccttttctgcatctattgagataatcgtgatttttgtcattggttctgtttatatactggattacatttattgatttgcatatattgaaccagccttgcatcccagggatgaagcccacttgatcatggtggataagctttttgatgtgctgctggattcggtttgccagtattttattgaggatttttgcatcaatgttcatcaaggacattggtctaaaattctcttttttggttgtgtctctgcctggctttggtatcaggatgatgctgacctcataaaatgagctagggaagattccctctttttctgttgattggaatagtttcagaaggaatggtaccagttcatccttatgcctctggtagaattcggctgtgaatccatctggtcctggactctttttggttggtaagctattgattattgccacaaattcagagcctgttattggtctattcagagattcaacttcttcctgggttagtcttgggaaagggtatgtgtcgaggaatttatccatttcttctagattttctagtttatttgaatagaggtgtttgtagtattctctgatggtagtttgtatttctgtgggatcggtggtgacatcccctttttcattttttattgcgtctatttgattcttctctctttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgtttttctagttcttttaattgtgatgttggggtgtcagttttggatatttcctgctttctcttgtgggcatttagtgctatgaatttccctctacacactgctttgaatgtgtcccagagattctggtatgttgtgtctttgttctcattggtttcaaggaacatctttatttctgccttcgttacgttatgtacccagtagtcattcaggagcaggttgttcagtttccatgtagttgagcggttttgagtgagtttcttaatcctgagttctagtttgattgcactggggtctgagagatagttcgttataagttctgatcttttacatttgctgaggagagctttacttccaactatgtggtcaattttggaataggtgtggtgtggtgctgaaaaaaatgtatattctgttgatttgtggtggagagttctgtagatgtctattagtgcagagctgagttcaattcctgggtatccttgttaagtttctctctcgttgatctgtctaatgttgacagtggggtgtcatagacaacataacaccctagtgacaccagattttgttaaccatctctatagctcctcataggtcaggtctcctggtagtcactccaaccctttctaacctagccactcgtgaagataatttgcactaatgttacttccaccagataactactagtttggatttctataagccccttagcgactacataattctgttcagtaatagtgtctcctacagtcagccatgcctagagaggacatctaccaaagcgtctcattgatgctgctgctctatcagcaatgcattccttatcacattggtaaacagaatatgtaataggcttgtattcatttgggtttagattttttgttgctgctcagcatgtttttgagattcacctatgttgttgtatgcaacatatacaagtatttctttttctttttattgatgaacagtattccattctatgtaagtatcataatttgtatccattcacttgtttatgaactggtgggttatttccagttgtaaggtattaaaactaagcatctatgaatcctatatatatgtgtgtgtatatatacgtcttttgtgcgtacatgtttgcatttctcttaaggaaaccccaaggagtgttactgccggttcatatgacaagtggtacatatttaactttttataaaaataaaactggcaaacagtttttcaaataaattttactgttatacattctcagcagcaatgtatgaatactccaggaactgcatattctcaccagcacttggtactgtaggcctttttaattgtagtcattctcacgagtatgtggtcctatttcattttagttttcatataatttcctggatgattcatgatactgagcagagtttcatgtacttattggctatattttattttgtgaagtattttttcaaatttttgcccattgtggtggggacagtaatttttctattgagctgtaagggttgtttatgtattgtgaatataaaatatttgagatacgcacacatacacacagtacacacagatgtatatatgatttgctttatattttctacatgctgtcttttaaagtacagatgttgttaattttgaggatgtgaaacacatcgacttatcttttctaatttgtgtcctctgagaaaactctgcctaatccaaagtcacaaagattgtctcttataatttcttttagaagctgtagctttagattttacattcaggattataatccattttaaattcatctttgttcattgcctgaggtaagtgttgaagttcatttttccatatcaacacccagctgtctcataagcatttgttaaaaaatctattcttcactgcaccccaccctaccaatgcccctgccactgaaataccatgattactttttaggaactcaattgaacatatctgtgtggtctagtttgggacagactattctgttccttccatgtatgtgtctgtctaccttagatcttgattaccatagcataacagaaaatcttgaaatcacgtagcataaggcctctaactttgttctttttcaaaaaaattgaggtcactctagatcctttgcattccttgacaaatttcgtaatagtttctcaatttctcttccaaatataaagtctgttagaatattgactgaagttgtactgaaggtatagacccgttttggagaatatcttaataatattgaatcttccaacatagcgttatggtttatgtctctcttttaaaaaagatttcctttcatttctcacaacattttgtacttttaagtgtatagatcttatagattatattaaaattttctctaataagtgttttgtaatttttgagctatcaaaaatggcattagctaggagtggtggctcacatctgtaattccagcactttgggagtccgaggtgggtagaccacctgagcacagcctgggcaatacagtgatacctcatctctccacaaaaaataaacaaacaataggcatggcggcatgctcctgtagtcccagctactcaggaggattggctgagcccaggaggcagaggtttcagtgagctgagattgcaccactgcactccagcctgtatgacaaagtgagactctatctcaaaaacaaaacaaaacaaaacaaaaaacaagaaaagacaaaatatattttaagaaataaattataaaaaatgacaattgctatttaaatttagtttcctaaatatataaattatatataaaaatacaattgtttctatatcttgaccatgtatactgaaatgtttctaaattcacttattagttttaatggcttttcatattatggattccttttttgcataccaatcatgctgtctattaataaagttttacatcttctttccaacttgcttgcctatggaccccatccccaacccctcgcacccactaagtcatccagtaaaatgttgtatattaaagcagtgggaaaaggcatccttgtctttttcccagacttaaaaggaaaataatttagtctttcatcattaaactgtggtgatatgttagcctttattgcattgtggaagttttcttttatctctagttcactgaaagtttctatcataaatggatattgaattttatcaaaattctttactttgcttgttcctattgagatgattataccatttgtctttactctgtaaatatagtgaattacactgattgattttcaaatgttaaactcaatttgcagtcctggggcaaaccccacttggccattttataatattttctttatgtattaccggattatactttctaacattttgttaaatatttttgcatgtttattcttaagcaatattgatctgtagctttcttgtctttttctttctggcttttatataactgggaataacctgatttttatgtaaccagaaattattattcctcaatgatcccccttcatcatttaattcaaacaatttctttagaagaaagacatctttttgacatgagagaaattatttcatagtaatattagccctaaattttttgttccaacaaattttgagtttagagcataccttcattttaggattgtaacttagaaatgaaagatcaaaaaggtaggggaaggtgattattgactctttcctaatctgaatggttttttatctaagtgcttgaaatatttttactatgtgattatacacacacacacacacacactcgtattctcttgaatcttctccagttgatactgacattctgtgaaagaaaacagtactagctattgtgcccaagaggatatgagagagatttctttcctatccccttgtgacttgtaggaagtatagagaagcatctaaaatgcttactctcgcaaacagaatccagtaacttttacccatgattgattttcctttctctgttactgcagctccgagtgggacagacattggtataccagcactaggcagcgcagctgcggacacacagtgacaccgagtaatgtggcaggcctccttttaagtacatcaagtggaggcccagacagcaggggcacaatttaaatagagtcttcctgatgcaacacctttcagactctgaaagaggcccttttttaggaggtgtgacactcatattagataaggcaatcgtaactgtaaataaggcatactccagaggactgacaatgcttttcagaaatccaattacatgctcttatttggtgttagtgcaaacagaaaaataacaagccaacttatttcatccccaccgtgatttcctcaaggctaattaaagtgcactctgctgatgcctaaatcattcaactccaggcaatccaaagatttaaagggacaaacacccaatcaatgcgtggctgtcagtaagtggcattgtgtttggaaatgggcacaataaagtccttcattaacttgaatgctggaaactccctgtgaaaaaaaattggtctaacaaatttactgccatagatttatgaactagacttcatcactctgcataaagaactgataagtgatcaatgattcttcacaacatatggcataatcaatacgaatttggggaggagatagaaagacattaataatgcgtattttatgtacaggcctgttcctaaagattaagggcaccataaatcacacaggagctgagtaaagctagaataaaaataattactttagtaaatgtagtattcaaattttagaattagaaaaaatatctatattatcttgggtggctttaaaaagattttaaaatatttataaggtttttatttcatggtaaggttttgggggatgttgttggtagctttttcccccagtcattttgcttgtcactttattaataattccaaataatgacaaagaaatatatttgtatgtctaaattactcagaactattttcaggaaaaaacaatattagccatgccctagggcacactgttaggaccccttgattccattatcaagtaggtctgtttagctctctcctcgttcgttactgaaggtcaaaatttatgaatgagcccttctgtattaccataaaatgtgcactccagatttgtgccagagattaaaatcttaatctcataactcctcttcaaagcttagatctgaaaattagaacacctaactgatcggctgcccagcattcacttttcttacaacatatcctcacgaaggagcaaattcaaattgtgttactgtgtgtttcttgcagacctgaatgaggtttgatagtatgacatttgcttgtaatgaggaataatgcgtaacaatgttcactacatcacatagggtcttctctatgaaagctcatgggagaattttccatcattccagtagcaagaaaagttaattttctcctgaaaaaaaatggtttatatttgttgtaacaacactctatcacaacagaaacagtttttttacttttaaaagtaattttatattggttacatgttaaaataattgttgataccttgagctacataaaatcattatgaaaattaattttagctgtttcactttttaactttttaaatatgtcttctagaaaatttacagttacatatgtggtgggcttgcatgacttgcattgtttcttttcaacagtgatctagagaaagcttggtcatggctttttttttattatactttaagttttagggtacatgtgcacaatgtgcaggttagttacatatgtatacatgtgccatgttggtgtgctgcacccattaactcatcatttaacattaggtatatctcctaatgcaaatatggacttatagatcaaagccatgagttttagaagtgtgttttaacattatagtgttataacattaatatgatattgttatattataaaattataatactgtaatattatcaaattcttataatactgttatacataatttttagccatatcattattcaaatataaggttcgttgctgaagtgaattactaaagtccaccattcagagaccttcaatgagttttcagacttagaaaaaaaaagaccgtgcagtggttcacacctgtaatcccagcacattgagacattgagatgagagaatggcttgaacccagggattcaagaccagcctgggaaacatagtgagaaaccatctctacaacaaaataaaataaattagctgggtgtggaggcacacacctgtagcccctgctaattcaggtcagttaggtaaaaggattgcttgagcccagaagttgagagcttgaagctgcagtgagccatgattgtgccactgcactcacagggtgagacactttctcaaacaaacaaaaagggaaaaaaaaaaaagaaaagaaaaatgatcattagttgttacttcagagcttcgggtttaaaatagcatctagttagcaattatgcattcagattttccatacatttggctgaactatttattatactacatgaaaagagaaaatttaaaaccacctagaaaacatgattactgtataatatgattttttcatttctttggagtttttggatgtaattcaaaattatagtgttgccttacctgaactgttgaaattgaaagctaatccattatctcctccttcccgccaaccaacagccattaaaaaatagtacatctgtatctactaaaatacctagacattccattttgatgaaagagtgcttgtttttgaggaaacccaaaacctctctttctgtatgtggttaaagattgctatacctggaagaactatgtttcaattaaggcaaacagctaaggcttaatgcatcaggcaaaggatattccaacaaataaaaccaagtacacaagagtggagatagcctcactattcatgaattctggaacttaatctgtacagagcaatagagagtgaggcagaggatatatatcttaggtcattttctgctgctataacagaataccagagactgggtaatttataaacaatagaaatttatgttttcacagttctggaggctgggaagtccaaagtcaaggggccatacctggcgagggccttcttgctgcatcataatgtggcagaaggcatcagatgggtgagacagagagagggaaggggggtgaactcctccttttgtaaggaccccactattgtgataatgccatttatccactcatgagggcaaagccctcatgacccagtcacctcttatatgtcccactcctcaacactgttgcactggggattaagtttccaacaaatgaactttgggggacacattcaaaccacagcagtataggagaagatcaatcagaacagaattgggccaaaagatatggacaacagtctctgagaaggggcttcaaacagaatttgtgaaagagtgaggcaaatccatactcatcatttggcaaacactgagttttgatagatagagttttctgcattagacagtgaaaaaacaacaataacaagaatagtaaaattaacataacattttcatataaacagaaaggaaaatgaaagggcattctaataatccatattttaaaagagaaatctgaattaagaacccacaagaaagaattccaagagacaatttagtatgtgtttaaaaacagaagattgtttttgagacactccacatttttattagctttcattgcaagtaaaaagggagaattttatttgtttcatttgaaatttaattattggacgccaaacaggaacagctccagtctacagctcccagagtgagcgacgcagaagacgaatgatttctgcatttccaattgaggtaccaggtgcatctctctggggattgtcggacagtgggtacaggacagtgggtgcagtgcaccgagcctgagctgaaacatggcgaggcattgcctcaccagggaagtgcaagggggcagagaattccctttcctagccaaggaaaggggtgacagacagcacctggaaaaccaggtcactcccaccctaatactgtccttttctgacagtcttagcaaacggcacaccaggagattatatcccacacgtggctcggacggtcctacatccacggagcctcgctcattgctagcacagcagtctgagatcaaactgcaaggcagcagagaggctaggggaggggcacccgccattgccgaggcttgagtaaataaacaaagcggccaggaagctcaaacttggtggagcccaccacagctcaaggaggcctacctgcctctgtagactgcacctctggaggcagggcatagctgaacaaaaggcagcagaaacctctgcagacttaaatgtccctgtctgacagctttgaagagagtaatggttctcccagcaccgagtttgagatctgagaatggacagactgcctcctcaagtgggtccctgactccggagtagcctaactgggaggtaccccccagtagggggagactggcacctcacacggccgggtactcctctgagacaaaacttccagaggaacgataaggaaacaacatttgctgttcaccaatatctgctgttctgcagcctccgctgctgataaccaggcaaacagggtctggagtggacctctagcaaactccaacagacctgcagctgagggtcctgactgttagaaggaaaactgacaaacagaaagaacatccacaccaaaacccaatctgtacgtcaccatcatcaaagagaaatggtagataaaaccacaaagatggggaaaaaacagagcagaaaaactggaaactctaaaaatcagagcacctctcctcctccaaaggaatgcagctcctcaccagcaacagaacaaagctggacagagaatgactttgacgagttgagagaagaaggcttcagacaatcaaactaccccaagctaaaggaggaagtttgaacccatggcaaagaagttaaaaaccttgaaaaaagatcagatgaacggcgaactagaataaccaatgcagagaagtccttaaaggacctgatggagctgaaaaccaaggcacaagaactacgtgatgaatgcacaagcttcagtagcccatttgatcaactggaagaaagggtatcagtgatggaagatcaaatgaatgaaatgaagcatgaagagaagttcagaggaaaaagaataagaggaaatgaagaaagcctccaagaaatatgggactatgtgaaaagaccaaatttatgtctgattggtgtacctgaaagtgacggggagaatggaaccaagttggaaaacactctgcaggatattacccaggagaacttccccaatctagcaaggcaggccaacattcaaattcaggaaatacagagaacgccacaaagatactcctcaagaagagcaagtccaagacacataattgtcagatttaccaaagttgaaatgaaggaaaaaatgttaagggcagacacagagaaaggtccggttacccgcaaaggaaagcccaacagactaacagctgatctctcggcagaaactctacaagccagaagagagaggaggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctacaagagctcctgaaggaagcactaaacatggaaaggaacaaccagtaccagccactgcaaaaacatgccaaactgtaaagaccatcgaggctaggaaaaaactgcatcaactaatgagcaaaataaccagctagcaccataatgacaggatcaaattcacacataacaatattaaccttagatgtaaatgggctaaatgctccaattaaaggacacagactggcaaattggataaagagtcaagacccatcagtgtgctgtattcaggagacccatctcacatgcagggacacacataggctcaaaataaagggatggaggaagatctaccaagcaaatggaaaacaaaaaaaaacaggggttgcaatcctagtatctgataaaacaggctttaaaccaacaaagatcaaaagagacaaagaaggacattacataatggtaaagggatcaattcaacaagaagagctaactatcctaaatatatatgcacctaatacaggagcacccagattcataaagcaagtcctcagagacttacaaagagacttagactcccacacaataataatgggagactttaacaccccactgtcaacatcagacagatcaacgaggcagaaagttaacaaggatatccaggaattgaactcagctctgcagcaagcggacctgatagacatctacagaactctccaccccaaatcaacagaatatacattcttttcagcaccacaccacacctattccaaaattgaccacatagttggaagtaaagcattcctcagcaaatgtaaaagatcagaaattgtaacagtctcagaccacagtgcaatcaaactagaactcagggttaagaaactaactcaaaccgctcaactacatggaaactgaacaacctgctcctggatgactactgggtacacaatgaaatgaagacagaaataaagatgttctttgaaatcaacgagaacagagacacaacataccagaatctctgggacatattcaaagcagtgtgtagagggaaattcatagcactaaatgcccacaagagaaaggaggaaagatctaaaattgacaccctaacatcacaattaaaagaactagagaagcaagagcaaacacattcaaaagctagcagaaggcaagaaataactaagatcagagcagaactgaaggaaatagagacacaaaaaaccctcctaaaaatcaatgaatccaggagctggttttttgaaaagatcaacaaaattgatagaccactagcaagactaataaagaagaaaagagagaagaatcaaatagatgcaataaaaaatgataaaggggatatcaacaccaatcccaaagaaatacaaactaccatcagagaatactataaacacctctacgcaaataaactagaaaatctggaagaaacggatgaattcctcaacacataccctttcccaagactaacccaggaagaagttgaatctctgaatagaccaataacaggctctgaaattgagacagtaattaatagcttgccaaccaaaaaaaagtccaggaccagatggattcacagccgaattctacaagaggcacaaggaggagctggtaccattccttctgaaactattccaatcaatagaaaaagagggaatcctccctaactcattttatgaggccagcatcatcctgataccaaagcccggcagagacacaacaaaaaacagagaattttagaccaatatccctgatgaacatcgatgcaaaaatcctcaataaaatactggcacacctaatccagcagcacatgaaaaagcttatccaccatgatcaagtgggcttcatccctgggatgcaaggctggctcaacatacacatgtcaataaacataatccagcatataaacagaaccaatgacaaaaatcacatgattatctcaatagatgcacaaaaggccttgacaaaattcaacagcccttcatgctaaaaactctcaataaattaggtattgttgggacgtatctcaaaataataggagctatctatgacaaacccacagccaatatcatactgaatgggcaaaaactggaagcattccctttgaaaactggcacaagacagggatgccctctctcaccactcctattcaacatagtgttggaagttctggccagggcaattaagcaggagaaagaaataaagggtattcagatagaaaaagaggaagtccaattgtccctgtttgcagatgacatgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggaattcttcaaggagaactgcaaaccactgctcaatgagataaaagaggatacaaacaaatggaagaacattccatgctcatgggtaggaagaatcaatatcatgaaaatggccatactgcccaaggtaatttatagatttaatgccatccccaccaagctaccgatgactttcttcacagaattggaaaaaactactttaaagttcatatggaaccaaaaaagagcccgcatcgccaagtcaattgtaagccaaaagaacaaagttgaaggcatcatgctacctgacctcaaactttactacaaggctacagtaaccaaaacagcatggtactggtaccaaaacagagatatagaccaatggaacagaatagagccctcagaaataatgccacatatctacaactatctcatctttgacaaacctgagaaaaacatgaaatggggaaggcttccttatttaataaatggtgctgggaaaactggctagccatatgtagaaagctgaaactggatcccttccttacaccttccacaaaaattaattcaagatggattaaagactagaaccataaaaaccctagaagaaaacctaggcaataccattcaggacataggcatgggcaaggacttcatgtctaaaacaccaaaagcaatggcaacaaaagacaaaattgacaaatgggatctaatgaaattaaagagcttctgcacagcaaaagaaactaccatcagggtgaatagggaacctacagaatgggagaaaatttttgcaatctactcttctgacaaagggctaatatccagaatctacaatgaactcaaacaaatttacaagaaaaaaacaaacaaccccatcaacaattgggcgaaggatatgaacagacacttctcaaaagaggacatttatgcagccaaaagacacatgaaaaaatgctcatcatcactggccatcagagaaatgcaaatcaaaaccacaatgagataccatctcacaccagttggaatggtgatcattaaaaagtcaggaaacaacaggtgctggagaggatgtggagaaataggaacacttttacactgttggtgggactgtaaactagttcaaccatttgtggaagtcagtgtagcgattcctcagagatctagaactagaaataccatttgacccagccatcccattactgggtatatacccaaaggattataaatcatgctgctataaagacacatgtacacgtatgtttgctgcggcactattcacagtagcgaagacttggaaccaagccaaatgtccaacaatgatagactggattaagaaaatgtggcacacatacaccatggaatactatgcagccgtaaaaaaaggatgagttcatgtcctttgtagggacatggatgatgctggaaaccatcattctcagcaaactatcgcaaggacaaaaaaccaaacacctcatgttctcactcataggtgggaattgaacaatgagaacacatgcacacaggaaggggaacattgcacaccggggcctgttgtggggtgggggaagtggggagggatagcattaggaaatatacctaatgttaaatgacaagctaatgggtgcagcacaccaacatggcacatgtatatatatgtaacaaacctgcacgttgcgcacatgtaccctaaaacttaaagtataataaaaagaaagaaatttaattattgaaatgaccaactgtccagctttcattgttaacactagaagttttagtagacttctgcttgtgtttggttctatgaaataatgatatgatttttatgatataactagttgtataattagaatttttcttattttatgaactatagtgtcttaaacagtatgtactttggaacacacaactagtgattaattagaattttgctttattaaagcactagttacctaataaataaatatcttttcagcatggttcaaaagctggtcagaataaactagcaaggaaatacaaaaaaaattgactgaattgtagaagatattgtaaattagaacaacacatctaaaatggctcttacatttgtacttatttgcatatattagcatttaaccagagataaaattaggaaacttttagttgtaataatacttgaaaatgattgtataatatagttttgttgttgttttctttcgaacttctattttagcttcaaggggtacatgtgcaagtttgttacatgggtaaattgcatgtcataggggtttggtgtacagattattttgcacccaggtaatcagcataatatctgataggtagtttttcaatcctcatccttcttccaccctccaccctcaagtaggtcccagagtctattgttcacctctttatgtccatgtatactcaatgtttagctcccactaatcatgaatggaagatggttagtgattttgatgaagcactcatcaaaatcaatcataagtcagaacatgtagtatttggttttctgttcctgcaattatttgtttaggataatggcctgtagctccatccatgttgctgcaaaggacatgatttcattatcttttatggctgtatagtatttcatggtgtatatgtaccacattttctttacccagtccatcactgatgggaatctaggctgatttcatgtctttgctgttgtgaatagtgctgcgatgaacatacacatgtatggagacacaatatttaaattagataaatctgttagaatctcaatcatattatacactaactaaacagtatcatcttaagcatgtaatttaagaagtctatgctgagtttacaattttggaaagcaggaataacaatgaatacctcacagtttcttggattttaataactacaagtgccatatagagtggcatagtaaatacttgataagtggtaattaatattttggtttaaaaccttttataaaaaccttctttcatcttcataagttcaaagagacatggtctctttgaaatagaaggaagcaattagttaataagtacctgagattataaagaacaaaaataaagaagaaaagtagataagaattaaagtaagctaaaaatgtaattctaggacaaatttatattagactgcttcttctgattagaaagaaaaaaaaattacacgtgaataatatccaccaaaacaatgacaataagccatgtaagtgacaaaatcgtaaagaaaatccaagagttaagaacactaacaagcctaaataacctcgatttcagaaagtgacaacactgccgagaaaaaaggaaacccatttttaaatccctgccagagtgttgaaaatgatatacatatcataaactgaaggtaagtgaaagagagacattaaagatcagccagtcttttaacagtgttataattacatgtggctgaaatgaagaagagattcctaaaaagcccttaccattgagggtttctaccttaccgccaattcctcttatcaaccagaagcaagtacctcaaggtagtttgccaagaactagggtcaaggaataaaagctgagagagatgtagtgactacagtcatggaagaaaagctgagagagatgtagtgcacagatagggtagcaagagaaatttcctcatggcaagttgaacctttgcaagtgcaaagcaggctatcaaaggttgagtgcggggcagcagaggagttgatacacctctgtggaattctgaaccttcattttgtgcattacagccaccctccaaggactgaggtcatgacataatagctgagataacttccttcaaagctctcttagtcttcagtgagtacaatgaagtgacccaccaaaggctggaggcaggacagcagagtgccaagaaatcttctacggcagagaaatttggtgaaagaactggtgaagaaatcctcagtgactcaaaaatctgggatacaggctgaaaagcagggagaaatctcagatagcttagaaatggatcagctaaactgcaaagcatgaagaaagttctggaatcttgtcaatgctcagatcccaagtcctactgaaggggattttttttttctctgcaccgtaaaatatgtgaagtagtgaactgaatatgattgaaactgcaacaaagactagactagaccaagttctactttaagctacattgtagttccccatattgacatcaaatagaagaatggttaccatttgggggaaataaatatcacttattgattctgtactatttgtacatacagaatatccaatatacaaccaaaaattccatggcacaccaagaaggaagaaaataaattacacatggtcaaaagggaaaacgttccattgaaagatactgagaaatgacctacatgttgaaactatcagacaaagactaaaataaatataatacatatagtaaataatctagtggaaaggatggctcacctgtgtacctagctgaagcatttcatctgagggacggaaagtataaaagaagaaaagaaacatttttgaaataacaaaaatcaattaattagaaaaaagacaaaaagaacatcaacaaagttaaaagtttctctttcaaaagaacaaaaaaaattataaaagcataacaacactagtgaaaaaaacaagagagtaaacacaaaactttaatatcaggaaagaaagaaacatttcatagcttatagactcaaaaagaatagggaaagtaatgaacatgttcagacagtaagtatgacaattttgattatatgaacaaattcactaaatttgggtttgtcttcttgatttctttcttggctatatcattactggtgaatagaaacattgctgatttttatacgttgatttttgtatcctacaactttactgaatacatttatcaagtctaagagttttcagtacattctttagttttctctagatataagatcataccatccatcaccaaaaagggacaacttaacttccttttttgtagtatttctttctcttgcctgattgccctggctaggacttccactactatgttgactgtgagtgttgaaagtaagcaaccttgtcttgttccagttcttagagaaaagactttcaacttttccctattcagtatgatgttacctgtaggtttcacacatatgtcctttattattttgaggtatgttccttctttgcctagtttgttgagtttttatcatgaagagatgttgaattctatcaaacgttttttctgtatttattgagatgatgatatagtttttgtctttcattctgttgatgtgatgtatcacatttattgatttgcatgtgtcgacccagccttccattcctgctataaatcccacttgatcatgttttactatcttttcgatgtgctgttaaatgtggtttgctagtattttctggaggacttttgcatctctattcatcatggacattggcctatagttttgtgttgttgttgtcactttgtttggtttgagtatccaggtaatgcagtaattctggcctcataaaatgagttatggagagtttcttcctctttgatttttggaaacagttccaggaagattggtattagttcattttgtatatttagtagaatctggctgtgaatttatccagtcctgggcttttcttgctattgttttggggagacgttttattgttgattcagtctcactactcaatgatctgttcaggttttatatttctttctgattcaatcttagtaggttttatgtatccaaaaatgtatccacttcctctaagtttttcagtttatcagcatatagttgttcataatagtccctgacgatgttttgtatttctgtggtaacagtcgtaatgtcttgtttttaattttttatttcgttcatctgggtattcattcttcttttcttggttaatctagctagtggtttatcaattttgtttatctttctgaaaaaacaatttttcattttttagccctttttattgttaaagtttctattttatttatttctgttctgatcattattatttcttacagtaatttttggtttgctttgcttttgcttttctagttccttgagtgtattattagactgttagtttgtaatctttctacttttttaatgtagagatttatttctataaatattcttagcattatttttctgtatccatctattttagtatgttatgtttctattttgatttgttgcaataattttttaaaatatccatcttaacttcttcatcaactcagtaatcattcgggagcatgttgtttaatttccatgtaattgtatagtttctggagtttttgttggtattaatttctggttttattccaccatgatcagagaagatacttgataggatttcaattttcaaaaatttgttaagactttttttgtagcctacaatatagtctatcctggagaatattccatgtgctgatgaaaagagtgtatattctgtagttattggagagaatgttctgtaaatatccgtaaggtccatttggtctaaagttcactttaaatccaatatttcttgttgattttctgtctagactgtccactgctgagagtgggatgttgaagtccctgactattgttatattgtacttttgctatctcttttgctctagtaatatttgttttatgaatctgagtgttctagtatcaggtgtatatataattactgtaccctcttcctagattgatccatttatcattatataatgaccttctttgtcctttttttaaagctgtttttgccttaaagttttttttatttaagtgtagttattcctgctcaactttcctttccatttgtgtggaatatctttttctgttgatagaggagttaagatgaaatcacttaggcagatagtaaaggtatgggagtcctcagtaaggcttttctttttaatgaaaagcagccccaaatcattttctaacaaaagcagcctgtaaagttgagctacacacatagacaagcaaactggcagcttgcacagatgaatgctgacaagaaatagggactagacatgttcaagatgatggctccaccttaccttctctttgtcacccacatggacagtaagaaacagacaagatggcaacagccaaggagagagttcacttgcataataagattagggtggggtgaccagacttccccatgcactatgtaaatgtcatacctgatggaaccaatctgtgagccctatgtaaatcagacaccacctcctcaaaccagactataaaatctggtgcaactgctgccagccgctcctttccactctggggcccctctctctatagagggagctgtttctctttctctttctcttctcttctgcctgttaaacctctgttcctaaacatctcatgtgtgtccatgtcctaaattttcctggtgggcgaggacaaacccagggtatataccacagacaatgtagccactttaccattactttactttttagtctatgtgtgtttttacgggtaaggtgagtttttgtaagcagcatatcattggatcatggttttttcatccataaattcagcttttctgtatattttctgcagagaatgtaatccatttatgttcaaggttattcttgatatgtgaggctttgttcctatcatattgttcactagggtttttgttgttgttttatgtatatttttgttcctttctttttctcttactgtttgaccttgtagtttgttcactactgaattctttcaaacaattacatgaaaattaactcttatataatctcttttaaaaaacagcagatgaggttaactttcccaacttattttagtaggccagcattactctaatgccaaatgctaacaaaaatattataagaaaggaaaattataaagtaattgttctcatggactcagacacaaaaatctttaataaatttttaacaaacagagtctattaatgtacaaaaagttaacatattataaccaagtagattttattctatgaatgtaagtctggtttgataattaaaagtcattcactactatacaccacattagtagaacaaaagagaaaaacatatgataatctcagtagatgtaggaaaagcacttgacaaaatttgacatccattaataacagaagctcataactcgtaataaaatgatgttttatggatctcataaaggccatctaaaaaatagataaagtatccttggatccctctactttgtgaagaaaggctgaatgtttttctcttaaaattcctctactgtatctcctagcctttacaatgatgtaagaaataaataaataaagcataaagaattttagaaagaaacaatattttccttatttaatgaaaatattgaattcatgaagaatcaaaaggaatctacaagcaaactagtagaactaagtgaatttagtaaagttacaaggtatggttagcaggcaaaaatcaatcatattacataatggaaataaaaaattataaatgatgtttaaaaacaatactattcaaaaagtttaagatgccttaaattcctaataatatatctttcaaaaagaaaaagatagcatgagcctttacataaaaaactacagataattgatagaattgaagaagacctacataaatgtagatataaactatatttatgaattgacaatataaatattgttaaggcagttattctccctaaatggatatatagagacactgcaatcaataaggaacttttagcagaatattttttaaaaacctaacaacttaaccctgaaatttatgtggaaattcaagagaatctaaaaacagtactatctaataaaaatatattgtgagatacacaatttaaaattttctactagccactttataaaagtaaaaatgaactgtaaagttaattttaataatgcatcatattaagccaatataatcaaaatattatcatttcaacaagggatcaatattgcaaaattactgagatattttacatttttttcaatctatgttttgaaatcagtgtatattttatacttgcatcacatctcaatcaggacagctgcattttaagtgctcaaagccacattgggcagatggctaacatattggacagcatagatctataatatgcaaaacaatcttgagagaggaggaggagaaagagtaggaagtggggaagaagagcaagatggagaagaacaagatggataaagagaacagatgtgagaaggagaaagaaaacaagaaaaacaggaaaagatgtgacggtctagcccaccccattctgagagtagcattagcataaggagagatatataactgaaagataatcaaggctctagaaacacagtaatattcccatacatatatgatcagttgactttcaaccaagatgacaagtccattcagtgggaaaggaaaacttctattaataaatgattttggaacaaatggacagtcatatgatttttttaagccttgaattctaactctgtacacaagaattatttttaagatggatcatagccccaaatataaaatccagaaatataaatctttctaaaggaaacagaaggctatcttcacaacttggaataggcaaatatttcttggacagaacataaagcactaaaaatagaaaagaatttgataaattggacattgtcaaaattaaaataaatgttaaaattagaaacacactgtttagaaaataagaaggcaaaccaaggaccaagagaaaatattctcaacacattgacatgacagtgtcttgagaggggcagaaaacaaacaggaaggaacaagtctcttcttcctcctcagccttcctgtctctctccccatagcaattcctgctgggagatcctaacagggagccatctagcaaaggggaaatgtgggctcagagtctcagcaccaacatgacaaagcagaacatgaaaggatgggtctgaagttgagagacaagaccttcacttctagcacagacatacataaaataatggtgcatcctgtaagtgatgacatcttagatgcaacaaaaaagctgtatataattatatactgtattgctatcattacattataaactggatataattataatttgtctagaatgtaatcttttctctaataattaagaataaggaaagcagtgtattgtggtttagaacaaaacttagtataatataaaatggatatttctgccctctaacttcagagtatgttttcttgagataattgaaattagtggggtacaagacagtaagctcctgacctggttatctattcttattattcttatctatctattcttatgtttcttattaacccaagaaacaaagcccatgctgccactttggctggtcaataagcatcattaactgtccagccatttctcgttcttcacttcccatctttcccctcttttctgtatttgtactttcttcttagaaatggaattagagatgaaccaagaggatatatgtgattcccacaggctgtgagtcagtcttttaccaaaccatctaaatttcttctttcctcagtaaaacacagtgcaaaaatttaacagataacttcctatgcaaatataattgtgaaacatcaaaaccagccacgatgaaaggcatcaacattgctggctgaacattttaatctatcaataaaagcaaagaaatgtttaagagactgctggggaaaggaaggacgtgagaatctctctttctatcccctttgtcattctagtcagtatgtacccatgtgccttacgccagttttggcagctgactaatagaactgtacaaatattggagaaaatccagaaactaatgatgaaagtattttccagtgataaaagggtaaagaagattaaaattactgattggaaaggtaatctagaatgaaaagcagacaatccaagatataaagctgagaatggcgtgaatgttattagcaaagtagaaaagtaccagaaagatctagcagactaaagttcacagtgagttagcactgtactgcttctcctttctactggcagcaacataaataaatgtgacttaaaattataaatgtgtcatccatttacatatgacaaatttttctcatccctaacttattttctgcctaataattgagacggcattataaactgtgtccatttttaatgtattttaataagaagaatactgtaatcaagatggaaaattgaactgaaatgaaaagccttcatccctacaacaaacatatacaatgaacaaataaagcatatatttttttcaaaatatgtaaatacagatttaagttcaaaaatcataatatgaaaagtccaggtgccagaacaaaaggaaatttccactctaagaaggatctgagtcacgggcatgccgctgtataccaggctgtgaggtctgcctgtgtaagcctagaaactgaggctatgcatctcacagtcaggaaaaaataaacccgcgttttctctacaagtgatcctctggatatgaagggaaagaggcatccaagggaatgcagaacccctaacttgcaccattccacatgcggaaattcacattcttgcactacgtataaaatcaatacctaatataaaaacctataagacactcccagcttcctttttaaacacttgtaattcatattttatttatttatttatttaagacaaggtctggtactgtcacccaggctggagtgcagtggcatgatctcggcccacagcagcctctgcctcctgggctcaatccatcctcccacctcagcctcccaagtagctgggaccacaggcatgcaccaccatgcctggctaatttttgtattttttgtagcaacagggtttctccatgctgctcaggctagtcataaactaatgagctcaacctatctgcccacctcggcctcccaaagtgctgggattatgggcctgagccactgagcctggctgtatgtatatttatttctatttgctccataaaaaaaaaaatgcactagagtgactgggagtatgtacgtgcatgtatgtgtatcctttaattgtcactgtgttataaagcaaagaatcaccaaaaaaagagaaaatgagaaaggtggtaacagtgaaaattaactaattaattaataatttttaatttgagaagcagaatgatcaacggttctactctgggagagagaaagggaagtagatgaatctcaagctagttgtagggacaggagaccacctgatttgtaccataaattatcaaaaattctcaagaatttgcagcaccagtttcctactcctattatgcctattcttgaacaaaacactcaaggtctctaaaagtgtttacgtcataaagtatgtctacctcatgaatgtttatcccctcagactcctcaatttctggaatactgtgagtcagccaggaaactcgggaacccgaccaacccaaagaataggcctaaggtaacattcacttagaggtctccacaaaatggctcagccagatcattctttgcagatgtccaaagtaggcaagtctcaattccctacaccaagttgccaaagaactttcaactgcctcatgttaatttgagtagatgaacaaggattgtcaggcacttgaaacaagccacaaacacagagaaaatataaaaacagaaaactgagactacaaagaaaaaaataacgataaaaacagaggaaaattgtaaataccataattaatatacttatagagatagaataaaataatatatgtaggaatcaaggtatttaaatattgcatatttacgaggaacagagaacgtaactaaacaagttgtaaaacagaataaagtgtaaacagaatataacgtcaaggaaatctcgagaaaggtctggcatgcaccagaatttgtcgctgtgtgtaaatgagggagctatggcagtacagttattttcaaaaaatttatattgttgaggggctatcaagaatagctaaaaactgtagatactcacagagactctaggaaccaccattccactctaaaggtaattgcatttctacattgttttataaagtctcgttttgaatcttttaccgtcttcacatgaaccgaaaataatttgaatatctgaaaatgtaccgcaaacacaaaacttttgagaacatctaccatgaattgaggtttgtcattacctacaaagagtatcccaattttgatggcagtggcagccagtccggagcagccgctgcaaagaccccagctgcagcatgggtggcccatcctgggctgtgctccatggagctggcaggagtcgggaacaagtgggagtcccgcccccttccaaattggctggacaggagccccaccctcctgggcacagctgcagctgcccagcgcggctgtgcacctgcgcattcctgtgctttcgggggctagggaagactcctgcctttgcaggctcagaagtgtctgctgccgctgcctggtccctccctgctcccggcgcttgctccaattttggagtaaagttgagactgagcccaggcactgctgcaacctagctgggtgtgcccacgtttggggcagtgctgacacgccagccccctgccgcatcacccccactctgcactttgggtgctaatgaacatgggagggaggccgaggaggaggggctgagagcagcttggcgctggcctacaggcaccccttggcatggacagcctgggtacagtggacagcatgctgatggtgggaggcagacaggtccctgggaggaaaggggcgggtccctgatgaaaccccaccttcatgccagggacggcctgatgcctgggggccgggttactaattctgggtagagtccaccgcccagagtgggaccttaaggtgctttttccaagcccactcagactgcttatggaccaaccagcatgcacttcctcccttctgagcccataaaaacccccaacatagctagacccacacagatatggggaagatctgcctgcagaagggagctaaccactacatgtctcctttccactgagagctggacagacgtcttgacaacccgcctgaagaagggagctacctactgcgagtctcctctccactcagagctggacagatgtcctgacgacctgcctgaggaagagagctgcccattgcgggtctcctctctgctgagaactggatagacatcgtgacaacctgcctgaggaagggagctacccactgcaggttccctctccacagacagctggacagacgtcatgacaacctgcctgcagaaaggagctacccactgcaggtctcctgagagctgttttgtctctcagttaattaagctcctcttctcctttttcaccctccagttgtccatatacctcattcattctggactcggtacccactgaattgtaggactgaaagagctgtaacacaaaccgggctgaaacacatcaccctgctcaccatgttgctggcaaggaaaaggagagaagagctgcagcccttcagggagcccacacgtaggggatccctgagccagggctctgacactctctctggggctctgtggttcctggcatctccaagcttccaggctccactgcatcccccctcatccagatgtggtgaccagcagtggaagccacatgcagtacatctggtccagccacagcttcacacggagctggcacctgtgcagatgcctggagctacttgccctggtgcagcagccagtgtgattgactgtgcatagtggccagatgtcacactcactcacccacacatccctcgctgctccatgcctggctcacccttggcagctgcgggatctgggctggtagcatgagccaagcacagcctgccaggcttagtgggcagatcgagcccagtgggtgcaagcaatactcaggtaaaaggcaccactggccacagaggtttctggctggcgaagcaacaccccaagacaacttcaagacaccccatgacaacttcagtgtttgttattcacaatattctatgtcttgttcccagcgcaaattttgtgcattaatcctcactcttaccctgccttattcacggatgactcaaaattactgactgttctttatgtatctttgtattatcccctaattaccacgtaaagtatctttatatatattacacacaactattcgtgaataaatgaataaatatttatgaataaacaaatgagtcatattgggttaacccaatttaagtccctaagttaattttgttgtctgtgtaaagcattggctaaagacaatctctacagactagcaaacttattatgaaatctattctgtgcctactatgtgtaagacattatctatgttatccacattatatcatttaaatcacgggctgatcatagcagtgtttaacttctgtggttttgaatggagaagagcaatagagaatttgttaaccactatctgggtcataaaaatgggtttctaaggaggggtatcactgaagaaatgtaaaatgcaagcttagttttcaaaactctgtcctgattttcaaaaaaacactgttaagctttaaaaatcgcctcatgcatcatggaaaacagaattaaaaagctaaatattctaccagaacatggaacttgagtatggactcttgtgtaaatgaatataagtgttattaaagatgttttacttaaaacaattgaaaaacctcatctgtatcatggaataatcacttttgaaactatggaaagtttaagtcatttggaataaaattatttgttaaaattgatttcactcatctttgggactaggggaaaagtgatatataaaatgatttccatcaatatccaaactatggagattacatatagtcagttgtctgtaaagtgaagctattcatgaaaatggaaattctaagtattcttcacccttaggaattttgatgctatcaaattttattgaaataaacacagagatttattccaagtattgaaatatattcattaaagagctcagtaggataaaaagaatactgagactctcctgtggtttctgttttctctaaatgttaatacttgtcacagtgtatatcctgcctactataaacactaaggttttcaatcatttcctggaatatcacttaccagtggatccaagctttctcattgtttttagcaaaatgtagctcagtttgtatcttttgattttcttcagtattttaataataattattattatgtaatatttgttataaaagtaattagatcaatagcagtgaccattattgattctttcactgtgctaggaattggacttagcacgtcacacatatatcatttaatcttcaaaacaaccacactctgaatatatccaactgccaaatgtattggtttcttattgctactctaactacagttatcaaaaaaattaatggattaaaatatacaagtttattatcatatagttctggaggccagaagtccaaagtcgtcttactgggctgaaaccaaagtgttaacacagctgtgtttcttccaggaggctctaggagagaatctgtttctttgttcgatctctagaaactgtgggcagtttctagaaattgcccacaatccttttgctcacggccccttcccctatccccaaagccagtgacatcagacagagttcttctcaagtgattgtctctttggttcttcacagtcacatcttcctctaactcttttaaggatcccctgatcacattggctctgcccagttaatccaggagtctccccatcaccggctcagctgattagcaaccttaattctatctgcaagtttaattccctttaccatgtaacctaacatatgaaaaggctgtcgggattaggacatagagattttgggggagccactattctggctatcacagcagacaggaaagataaagcatcataattaatcccaaggccaacagcaagcaagtggccatgtcaggaatcaaacctagctctgtctgatcctataaattctccctccatattatctcaaatacagtttactgaatgaccaactgaaatttcaaaagaaataaaagaaaaaaaaggaataaagaaaaattcaatcagcctttgggcaattattaaacatttagaaaaatccagttacttgactatagtatctttcacttctcattcagttgtttggtacaatatagatcacgacctctgatgaagtcccatttgcttctcttacttatttacacatcttgaaccatcagaatggcagatgatcttctattaagaaaatatgcagtgtaagcaattaaaaattgtaattgatgaacttagcatttataaactggctagaatcacacttaaaaaaaaatctgtggattttcaatgttaacatcttttatatagcagtttcctaccatgacctacaatactacaaaaaattgttgctgcctgacatgggtatacttgaggcattgtaataagtaggattgttctttatggctctgccacttgccagtcatgagaacttgggcaattgacttaactttcctaaatgttggattctgtatctgttaaacaaggatcattatggtgtcattggttagagatgataaatgtacattacagtataccgttcactgcatgtcctctgacacaatataagtaccaaataaatgtcatccaaattatttttccagtttttagcaatttatttggacacataataaatcacattaattgtagttattatttttttcagtagcaacatttactcatccgaaccagaccttcttgagtggcttatatttcagtatcatttcttgcataatttttcaaacttcatatagtttgtaaaggaaaaggaatatataaatgaattacaagacagcatcattatttcctttttcttattttttattcagcatctattgactttacaaatccattttgaggcataaatctaaatgagtggcattttcaaatattagataatgaaagcttatttgtggtcattgttctctggtggcagttttgactttctgccccatagccttcactaaactgcaaaactcatagaagttattagtgatgatccagtgcatttgtttcctggacgatgaaactccaaattccagatgggattattctccattttatgcctgtccagctctggaatttctacagccattatcaatgtaaattaattgcagttgattttaaggttacaagtgacataaagctcaatattcccttgtccaaaattattgttattgaaataggaaatgccctctttgtaacattattttggaggctagcctccatttccatggactcatcacaccatgtattagattggcataaaagcaactgcttttgtaccaacctaataaaaggacattggctctgtttcaactccatggcttgttttgaattttttttttttttgacatctagtttcactcttattgcccaggctggagtgcaacggtatgatcttggctcactgcaacctccatatcccgggttcaagtaattctcctgtctcagcctcccaagtagctgggattacaggtgcatgccaccatgcccggctacttcttgtatttttagtagagacaaggttttgccatgttggccaggctggttttgaactcatgacctcaggtgatctgcccacctcagcctcccaaagtgctgggattacagacgtgagccactgtgctgggcctgtttttaattcttaaagagaaagtatgccctcactatttattaccaccattgtaacagttacccttcctgtaggaaagcactaattgccctggagaaaatcaagatatttgtaaaaatcattgttgatctcaaattagaaacaattataaatcccaaagagaaatatatgtacacatatattaggatgattacatataatatatatataggcttaaagtgatacaatgttagatgatattttaattctaagtatcaaaggagggatcttagtttcctgggctccatgggggtgggacccacctggcaagccagaccacttggctccctggcttcagcccccttttccaggggaaattaatttcattttttgtatctttcccatccctccattattgtccctatttttttctaaaagaattgtctcagaaacagaagtcctctgaactgaaaattgtcacgttcatattttttcacacattgttgcatgttatagcaacattttatataaaaacattgtgcatattagtaaaaatacctcttttttataccctctgtaatagtcactacataaagaaatgaactgaatgcggattcaaggtggccgattaggaatagcaccagtctgcaggtcccagagagactgatgcagaaggtgggtaatttctgcatttccaaatgaggtacctggttcatctcattgggacttgttggacagtgagtgcagcccacggagggtgaactgaagcagggtggggtattgtctcacccgggaagcacaaggggtttgggaattttctctcctacccaagagaagccatgagggtctgagcctgagaaattccagcacagatgctgtgctggtcccatggtcttcgcaaccggcaaaccaggagatcccctccagtgcctaccccaccagggccctgggtttcaagcacaaaactgggtggccaattgggcagacacaaaacttgctgcaggagctctttttttcttccataccccagtgaggcctggaaaaccagcaagacagaaccattcactcccctggaaaagggggctgaagccagggagccaagtggtctggtttggcaggtcccacccccatggagcctaggaaaccaagatccactggcttgaaattctcgctgccagcacagcagcaatctaaaatccacctgggacattcgagcttggttgggggaggggcgtccgccattgctgaggcttgagtaggtggttttacggtcacagtgaaaacagagcttctgggaagtttgaactggacaggagcccactgcagctcagcaaggctgctgtggccagactgccaggtgtctcctctctggacagggcatctctgtgaaaaaggcaacagccccagtcaggggcttatagcagacttaaacatccctgcctgaaggctctgaagagagcagcagacctcccagcacagcattcgagctatgctaagggtcaaactgcttcctcaagtgggtccctgacccccttgtatactgaatgggagacacctcccagtagggggccgacagacacttaaacaaaattacaagaaaaaaacaatcccatcaaaaaatgggcaaagcgtatgaacagacacttttcaaaagaagacatttatgcagccaacaggtatttcaaaaactggtcatcatcactggtcattagagaaatgaaaatcaaaaccataatgaaataccatctcataccacttagaatgatgatcattaaaaagtcaggaaacaacagatgctggaaaggttgtggaaaaataggaaagcatttacaccgttggtgggagaataaattacttcaaacattgtggaagaaagtgtggctattcctcaaggatcgagaactagaaatatcatttgacccagcaattccattactgggcatattcccaaaggattgtaaatcattctactataaagacatatgcacacatatgtttactgcagcactattcacaatagcaaagacttggaaccaacccaaatgttcatcaataatagactggattaagaaaatgtggcacatatacaccatggaatactatgcagccataaaaaaggatgagttcacgtcctttgcagggacatggatgaagctggaaaccgtctttctcagcaaattatcacaagatcagaaaaccaaacactacatgttgtcactcataagtgggagttgagcaacgggaacacatggacacagggagggaaacaacacacaccacggcctgttggggtcggcgggctaggggagggaaaacattaggagaaatacctaatgtatgtgatgagttgatgggtgcagcaaaccaccatggcacgtgtatacctacgtaacaaaactgcacgttctgcacatgtaacccagaacttaaagtatatgtatatttatatatgtatacatatattattatatgttgatatatatgtatacagatattattatatattgatatatatgtatacatatattactatatattatatattatattatattatattataatacatattttataatatatattatatatattatatatttttataatatataaaaacataaaaatttataatatatttataatatatattatattgtataacatatattatatattatatatattatataatataatatatattatatattatatataatacatataatatatatattatatataatacatatattatatatgtatacatatattatatgtatacatatacatgtatacatatacatgtatatattattatatgtattatacatattatatatttatacatatatgtatgtatacatatataatttatatgtgtatatatacatatataaataatatttttatatataaatttaacttatatataaatttatatatatattaatatataaatttatatatatattatatatgtatacatatatatttatatataaatttatagtttacatataaatagatatatttatttatatatttatatatttatatatttatattttaatatgtatttatatatttatatagttatatataaattatatgtataaatatatatacatatatatggatatttatacatatatatttatatttatacatatataatatattatatatttatatttatacatatgtatgatatatttatattgatacatatatattatatatttataaatacattatttatttatatgtataaatatttatatatgtatatatacatatataaatatatgtatatgtacatataatttatatatgtacatatacatatataatatatatacatatataaattatatgtacatatacacatatataatttcatttatatatttatatttatacatatatattatatatttatatttatacatatatattatatatttataaatacattatttatttatatttatatgtgtatatatgtacatatacacatatatacatatgtatatatgtatatacatatgtgtatatatatacatatgtatatatgtatatacatatacatatataaatttcatttatatgtgtaaatgtacatatacatatataaatttcatttatatatgtatatatgtacatatacatatataaatttcatttatatatgtatatatgtacatatacacatataaatttcatttatatatgtatatatgtacatatacacatataaatttcatttatatatgtatatatgtatatataaattaaaatatataaatatataaatatgtaatggtgagttcatttctatatatatttatatatttttatatatatttatatattatatatatgtatagatgggaggtgattcaaaaacattgaactaaatgcagataatgaacatgtttccatttgttctctactatagaagatgagatatatatttttttcttatcatattattttcctaaaggacatataacctaaccaaagtataggggccaaaggaaaacatttccttcaccttctaagcatccactgaaaatcagctcacaaaagacagattaactggagagaaggcatacaaacttattaacatgcatacgaggcagaaaaatagcaattacccacccctcagtggggttcaaaaacttacatatcatcttcaggctatataaagactgtgggcttggatcctggcaaaattgtttaagggaaaggggagaagaggattttttttttttttttaagataaggtcttggtctgttgtccaggccagtctggagtgcaatggtgcaatcatagctcactatagcctcaaactcctaggttcaagccatctcttgcctcagcctcccagtagttgggaccatgcctggcttatttttaattttttatagatacaggatcttactatgttgcacaggctgctcttgaactcctgggcacaagaagaggaattctgttgagggacaatgaatgattattagggagaatgaaaggattggggacagagattggcctgtaaatatttctctttggaatttacatgaacctgagcaacagacattatcttgtgaaagggtgtgttcaggtgtggttacattctgaatcttctttctttaatagataacgagatacagggaggggactgaatcttctttctttaatagataacaagatacagggaggggaggaacaaaacaattgttctctatggtgggaccttactgtctttatataaataggggaaagggctcttctagtgtctgctgatgtgtaagagctttaacttaaaatattcattataccagggagccatattttggggtgaaattccttgcgctccttcagaagtaaactttagaaaacaaaacattatgtggaatttcataactagcttcagctcatccttggctcttcccctttgtctatggatattaggtataaatcccctcaagctagcttctccttgcagttttgaggtatttaacagtttttcatcctgtgccttaattttagaccaagagaaaacttttaagagtccaaacccagcagctcacaaacaaggaaactggttgtagcccaagtgacttagccaagaaaagagcagatctactgcagaaggaatatcatagccaaagtttcttcatagtgaaactttttggcattgaatgctggcttcacccactacagaaagtagagacttatacttaactttaggtacttattgtgcttaactttgcaaagcctcagttttatcaaccataaattaggatcaataatcaaaataccaccctgctaagggttttatgagaactcaatgaagaaacctattttaaatgttttttagatttatgtttattcacatttttactcccttccaaaaccccaataacaaggcagaaatgtaatttttagaaaacataattgcacaaaagctaatatacacacacacacacacagatagcagaactatatcatctatctatctaactgtcaaaagtgaatggaggatccataatttacttgatagtgaggaataaactaaccacaagacttggagtaaccagctaccacagtctgagagggtgagaatatagccaaaatggtgaccaattgttacataaaccacagagaatagaagaagaaaaaaatcccaagggttttcagacccaatgtcatgaactggatggcaatacgtataaaaagatagaaccacaaattttcactcctttcacctgtagctagcaattacccgtagaaatggaggttgattctctggagaaattgatgcaggatactttcttcaccacttcgtgggagttgccagaggggtgcctcatttattcagcctatcccacacaacccctcacagaaggaggtgtgcgagccaacaagtgcaggaagcagccactttagcacctgcacgagtgaactccattcactcgggtccactgggctccactccttgcaggagggagcacacagacaagtgagtacaggcactggccactttggcgctggcagaagtgaactccatgcaggccctgcaacagcgtccagatggggtgtctgcgaccccaaggccccagagggcgtggtacaatgctctcttagctctgccgtctgcagaaagcagtgtgttaccagctcagcaggccctctgcctcatcacatggggtggctgccctccaccagcgagggtgaagggtcagtgtgatagcctttttgggtacccgcacccggtgcctcctgaattcttattcagtgaccaagaggaatgaggtcacatggacaaactgaaggataatgagtgttgagaattttattgagtgatgaaagtggctctcagcagagaggggagctggaaaggggacaggaagggaagctccatctcccctgaagtcaaattgcctttctgcctctctcttccaaaggcaagttgcctcatccacccactgtctcaaagttgcctcttcttaacatccagctgcttcttcctgacatgctgccacttctctctgccaggtgagtctgggatcttcataggcacaggataggggtggggtaggctataggtagttttggaaaaggcagcatttgattggtaaaaagacattattcaaaaagaaccaatcaggagcgagcaggcacacagggatggaagttctcactttgggccacaggtttcaggctcttcggctcaaaggtgaggttttgccagggacctgcccttgtctgcctagaatctctctgcttcctgcctctatcaaaatgggcctaaataatgataggaggtggggcttagaaatgaaataatagggccgggctcagtggctcacgcctgtaatcccagcacttcgggaggtcgaggcgggcggatcacgaggtcaggagatccagaccatcgtggctaacacggtgaaacccatctctactaaaaatacaaaaaaaattacccaggcatggtggcgggcgcctgtagtcccagctactaaggaggctgaggcaggagaatggcgtgaacccgggaggcagagcttgcagtgagccaagatcacgccattgcactccagtctgggtgacagagcgagactccatctcaaaaaaaaaaaaaaaaaaaaaaagaaatgaaataatagtgtagcaagttcatcttaatgataaagactgaggcaggaaggggaactgagaactgtgaatagagaaggggaagagggaaatagcaaatgcaaactttcagctgtgatgtgtgtagtagtacaatatcgaatataataattaaaaatttcattttattagccttggaaaagccacacaaaatattttttgaaggagtagtaaaccaaagataaaattcttagcccctagaacaatctgagcagatcccttctcttcaccaagagcattgcaaagttgacctgaaaaactagttcaggccatgatggcaagggggatcagacatacatcattataccctcctccccttgtggaattcagcaaaagctcaccatcattaacatcaaccagaccttaagtctgataagaaacatttacaatctattttccctgaagcctactacctttatctgcataataacactttggtctccacaaccactaattgtaacccagaaattcctttctattgattccaggtctttagataacttaactctttcaactaattgcgaattagaaaatctttaaatttacctcagtggcctggaagccccccactttgagtggtcccacctttgcgggtctaaccaatgtatatcttacatgtattgactgatgtatcatgtctccctaaaatgtagaaaagcaagcagtagtaccccaaacaactgggggacacgccatcagaacctcttgaggctgtgtcacaggtatgtccttaaccttggcaaaataagctctcaaatttcattaagactgcttttaggtacttttgtgttcacagggtgtaactgtttaacccttttaaaaaatgactaaaaactcttttacattgttaatttagtagatgaacacatgaccaagatatttctggggttgtttgttttttgttttgggacggagtctctctcttgtcacccaggcagtagtgtagcagtgtgatctcggctcactgcaacctctgcctcctgggttgaagcaattctcctgcctcagcctcccaagtagctgcgattacaggtgcccactaccacgcccagctaattttttaatttttgtatttttggtagagatagggtgtcatcattttggccaggctggtcttgaactcctgacctcaggtgatccgcctgtctcagcctcccaaagtgctgggattataggagtgagccgctatgcccagctgtgctatttcttatatagtttccactctggggagtattctttgaggccaaatacatgacttcttttccatatttatttattttataagtgtttgacgaggataagtgaggaatctatatcttctatagaggataacaacacaaatatgtatttgcaggtatgtttatgtgtataaaacatcaagctggttgagtctcttatccaaatcattgtgtgtgtatatgtgtgttcttacttttttatttgcttgatttttagttactggaaggcatggattagaaaattcccctatattgtatttttttatcaagtaaaatgagaaagtaaatacctatcattgggtgattccttaaataaatcatgattaattacatattataatcattaactaaagaccatgagatctgtagtgagggaatgggagagtttcattttctattaaaaaaaaaaaaaccctgcagattggagagatacagccttcaatgcaaaacaaaaacctgctccaaaggggaggtgaagtgttagattatcaaggcaaaaaccacagggccggggagggaggcaggggaatcaggagcagagacttgattggacgaccttcaggctcaaatcaccagtctctctcagttgattggttccaggtggtttgctgctgctgagttgggaaatttccagtaggaactggtttggtttggaccacctgtaacatttctaccaagtgtctgacactagctacctggagatagcatcagatcaagtgtcccaggcagtccaaaccaaaccaagtgtcacaaagtacatgattgccccttcactaagctgcggccccctgattttgtcttaactttgaacacctcagccacatggaatccattttttctgctggctgggggcatactttaacataataatgtaatataaaatatgtagtatatagtttagtcattataaacttttatatgcacagtgtatgactaaataattatatccaactataatgaaatataaagtagccagtagcaaaatagacatagatcttttaataaggacgctgccaaaaatataaaagtaaatataaatataaaggtaaaaataaagttacaaaatagaattatagatattgtataattttatatttaagtaaatacatgtacatgcatgtatacggttgcacagttatgcacagaaataaatttggaaggatatgccccaagatattaacaccggtgctttaggatttgggggatataagtgatggctactttttcctttattctcctttgaggtgatctgacttctataagtatactttactttaaatttaaacaaaaaataataaaactggactgggcacggtggttcatgcgtgtaatctcagcactatgggaggccaaggcaggtggattacctgaggtcaggagttcaagaccagcctcgccaatgtggtgaatccctatctctataaaaataacaaaaattagctgggtgtggtggcgggcacctgtaatcctagctacttgggaggctgaggcaggagaattgcttgaactcgggaggcagaggttgcagtgagccaagattgcgccactgcactccagcctgggcaacaagagtgaaactctgtctcaaagataataataactactttcattttgaaaagaaatcactaggtaaatcggttgtcattaatcatgttccaaagataataattacttattaaatttactcttgtgtatccaaaatttcataaattaaacagaattaaacataaattaaaacagaaaaactactcatatgcattcgctcttgaaggttgctcaaatgccaaacacaaaagtcaatatgtcattataaaagataggaaaaaccgaagtgttttcctactctgacagaactcaacacaacacttctgacacaccagatgtgtgagagttgtttctctacacaccaagcaagtctgcaggggacaccagttgggtgttatctaattcaattcaattctgacactagcttcctggagatagagtcagattccacaagttaaaggctcagtcctacaagagttctcccttatttcatatgccagttgcaggtaccagcttgttttacctgtgattctgaccaacaggttagggctatgatttataagattcccaatctccttctcagattcctttaatttgctattggaaaataaaaataaaatcccaagcggccaggcacggtggctcacgcctgtaatcccaacactttgggaggccgaggcaggcagatcacaaggtcaggagatcaagaccatcctggttaacacgttgaaaccctgtctctactaaaaatacaaaaaaattagccgggcatagtggtgggcccctgtagtcccagctactcgggaggctgaggcaggagaatggcgtgaacccgggaggcggagcttgcagtgagccgagatcacaccactgcactccagcctgggcaacagagcgagactccgtctaaaaaaaaaaaaaaaaaaaaaaaatcccaagcaccccaatcaactgagcaaaccccttgtttgtcttgggaaacaggaccccagggaaatttttaaaactgagttctaggccatgacaggaaaggaggttgatgacacctagtatgtcccttccttattaacctttagccagaatcctttcctaaggcatgagcagaagccagctctagaaaacaagaaaaggaggacacattcttttactgccttcagcccgtcatctgaggttaccaccggactcccgctcctctttgcagtttcagcttcacagctcaccagtttcacaatgaatcccttcctgaaaactgactaccatcccagatagattttggcagacttgaggaggttgctcagtgagggttttgtgtcaccttttgatatcagaagaccaaaaagtccaccctcagattacactaatgctgcgttttttaaacaagcaatccatgaagaggcatgaagctccattgagcatgttcatgtttctcatttcgtaaatattcatgagtcctcatatagctcacagaatatgtacacttagccaccctgctcagcataaattcctgtcttatgcttccctcccttgaagcactttcactggatgctatacttcccagcctaacagaaaggccaccctacaggctgcaaccctttatgaggaataaagctctcctttccaaatttatgaacctcatgatgattcagttgacactaggaaggttcataagtttcaggggaatcacgtagcctttcccaaaggttacagggtattgattaggcggttgaaactgccaaccccctaatcatgccttggtctttctgttgaccagcccccatcctgaagctatctaggggaccctagccaccagttatctcattagcatgcaaaagacactcttatcactttggagtttccagagggtttaagagctctgtaccaggaaccaggagcaggcagagaccaaaaaaaaaaattcatattacatcacaatatcacagaagtctatacctcagaactctgcaaaataccattgcaaatcctgttacttcctgcaaagtacttgtgtcatttagttaaataatccaataagcacattctcaagctgtagctttgtttatattttctctaaagatatgttcccaagtaataaaatatatttgctgttatatttgccaagttgatccttagaaataagtagttttttttctttcttaaaatgcattagagactatagatatttagaaataacttttatttagcttatatgggtattacctgatgcaataaattactatactcttttcacagaggagttttcattctataagttgtttactttgggataaagattaagtcatgaaagtgtatataagcattatgctagcatttttgatgacaaaacatataataaattgtattatttatatgatttttattttcatatgatgaggaatttaatttgaaatctgttcatggacttacatttcactactgaggctatattacctactggaaaggggctaagatagatgtttttaatttaattttctgactttttgacggagaatgctttgtaacttttacatgacatatatcagatcaaaatttactattcacattccacttagtaaaagtgcccaagccatatggtttctaggctctagtcttattaccacataatatgttcctttaatctcttctttagcactcaaaacaaaaatgcagaaatcccagactctgagtttctctgatcttgtatggtgaagggcccactcctatttttcttcaagtttttaaacagtcctagaaaacaggttttcatacaatagatcaccatttcagatttttttaatgtcaatattcatgttttctcaagcacagagttctgttttagtgcatttagttgatttacaaatgacttgtactgactaatgtataaaacatcttaataagagaaagggttttatcatgaaaactgtgccaaagtcctaagtccaatatctatcataaagggattaaagtcttaagtattacactgtcctctaaattaaggaagttatctcagctcaatttctagcagtttctgaatgtgatttaactggatatgcagtgattaaatatcttgttgctatccatttctgggaggattaactccatttaaatgaattctctttctcaatatttatttcaaataattccctagactatcttagcttatggtgaaataactcaggaagttatttcatgtggaaaatcaaaaaacttaaacttcaaatttcagtgttattaagcttttcttcttgagcaatctaatgatagggtgtcagtgctgggatgctaccaacaatgagaacacttaataagtcatgaatatgcaagatacaatagacagtgctgatttagaaatcttgagactctacctgatctgcttttccttaatttcattccagaaataattgctccaatccctattctgtacaataacctcatcaaagatgattttaaaacatctctctatattggatatattatattaataaatggatcatatcatccttatcatgttgctgatatgcagagaatccaggaaagatagttatgaaggaagggtacctgcgagtaccttccttcaaatattctaagtcaattgagagatttaaatttttgttgatattctattgttattgtcttcttagtgatatttttaaatggtttcaaatatggcaaaatagacataacattagatttaccatttttgccatttttaagtgtatactttagtggtattaattatattcatactgttgttcagtctttaccactacccatctctagaactcttgttatgttcccaaactaaaattcagtacccatcagatgataactccctatcttccccctccctcagctcttggacagaatcactattctactttctgtctctgaatttaaccactctaagtacctcatataagaaaaatcatagaatatttaccttttgtgaaaaggtaaatttgccatttacataatgcccccaaggttcatgcatgttgtagtgtgtctggagttggttccttccagtgggttcatggtctcactgacttcaagaatggagctgcggacctttgcagtgagtgttacagctcctaaagatggcacagacccaaagagtgagcagcagcaagatttattgtgaagagcgaaagaacaaagtttccgcagcatggaaagggacctgagtgggttgctgctactggctggggtggccagcttttattcccttatttgtcccctccccatgtcgtgtttctgtctatcagaatgcccttttctcaatcctccaatcttgctggttggtccattttacagagcactgattgatccattttacaaagcgctgattggtgcattttacagagcgctgattggtacattttacaatccccttaactgattggtgcattttacaatcctcttgtaagacagaaaagttctctaagtctccacttgacccaggaagttcagctggcttcacctctcagtagcacatgtcagaatgccctttttaaagggggaataatattccattgttttcatatatattttgctcatccgtttattcattgatgggcaattgggtggcatctgccttttgtttattattaataatgctgctatgaatatagtgtacaaatatctctttgtgttcttggttcaattcttttgggtatttacccagaatggaattgctggtaattctctctctaatctttcaaggacttgccatactgtttttgacagtggctgtagcattttacatttccgcagtaatgcacaagcgttctaatttctccacatccttgacaacatttgttatttccttttttgtttttttttataatagctattctaatgagtatgaagtggtgttactgtccttttgaggcggaacatatggagatgattctgttaaaaaatacacctggtcagccttagaactttaaataagaaacgatttctcaggtttttattatatatggaaaatagcacatagacctacttatggaatgccaaagttattctgaacctcagaccggttcattcattctttcaatgagttatattaaatgcttttactattttcctaccattgtgccaggcaatagtaagggtgctcacagtctggtataaaaaatcaacaactaaacaaacaaggttgccattatagggaaagtctttatggttggagagcatgagagcaaattaagtagcccagtctaaaaatcaggaacaactttctccaggaggtagaactaagttcacacttgggtgaatagaaggcagcaagaagggagaagaaactagaacatattccagatattaggaaccaacttcaaaatttcatttggcctttcctgacagattctagtagttcagagttcatttgctgcccagcacaataaaccagttagtaagttggaaaaatgacttactggttgcctcagaaactcacttttatgcataaaggaaatttgtggaaatgtacttgatcctattgatttaagcatccacatgttaatctggaattttctggcagaggtgtcatatgcccacatacagaattacatgctctctctcccaatacatgcttggctagagttttcaatgaaggaggatcccacagctaatgtggtacaagaaactgtattttcccccttcctgcagcttagaaacacaaggatcctgaagcttctggggcacagacatgcaggcatcacataggtgcaaccaagtatgtctccaaggtggggatggtgtttttcctaggtgcccctgaaaaatgagtgctggagatcaaacagaacacacaatacacacaatgtatcacaaagggttttcatacaagtactgggtgtggaggaaacagcctgggcaaaaccctcaaaataaaagatagctcaactcactaaggaacacaaaataacaaagtaccacaatgtgttggcttaatataacctacatttattttcttactcttctggaggctggaagtccaaaatcaaggtgttaggatcacattccctctgaaggaactagggaagagtcgtttgcctcttttcagcttctggtggtttccagcaatccctggccttccttgtcttgtggcagcatgactccaatctctaccttcactaccactgtgttcttccttgtgtctgtgtgtctccaaatgaccttcttatagggacaccagtcctactggatttaggacccagtctaatacagcattgcatcgacttatctcatttcatcagcaacaaccacatttttaaataaagtcatattctgatgttccaagtagccatgaatttgggactgatgttattcaactggtacaaatagaaccatggaacttcaggctggactatgacttttaacttcttcattcatcaaaaggaaactaaggaaacactgagggagctatttggttgtagtgtgatatcaaatgatatgatctgatgtgcaatatccgaagattattctagctgtatattaataagagacttaaattggggaaatctgtcacgataagccgtgggtcagatgctatgtgaaaagttaatgaaaagtctttcttatttatgcccttttcattctaggcattttttttaaatgcaaatagaacccatacctagtaattttgtagttcactgaaaaatttatgaattttctatattcaggtatagtaacagaagcatcccatgttcacttatttgtgtacttattttgcttctcatttaatagatatgtgctaagcacctatcacatgttaatcaataatgttaggcattgagggtgcaaaggtgaggaaaataatagatatgttcttatagtcaaatgggtatacagtaattataatcaaataaccacaaaacctaaatgcttaattaagagcagggacaagatctatgaagaaaaggtacaaacattttcataagagcatttcaagcacttatgaaatgcaaataggttacttcgtttggtttgtgacattgtgttataataggaattggacaagaaagtttgatcaggtatggtaggcagaattttaaggatggctttcccagatagtaaggatggcttccgagtcattcagacaaacacaaatctagcattgctatgaatggatttcaaagatgtaattaagatcccaagtcagtgagcctaaaatcagaaattatgtagatggtgctaacccaggcaggtaagttctttagaatcagagaattttctctggctagcaccagaggaggaagtcagggagatcagaagcaccagaaggatttcacacagcgttgctgactacaaagacgcagaagaccatgtgatgagaaatacaggtcatctctagaagacaaaactgcccccaggcaaagatccagcaaacaaggaccttagtcctacagccactagacatgaattctgttgacaatctaaatgagcttagagtagatccttcctcatagcctccagagaagagtccagccagacaacaacttgattttggactttttagaccctcagcagagtgttgaaccatgctgtacttctgacttatgaaaactatagataataagtgtgttttgtgttaagccactttgtggtcatttgatgtacaacactagaaaagtaattcagcaggtaattggggatggaagtgaatcataggtaactaatctaaagaattaatgtgctgagaggtcttagaaattgatttcgagtagcatccctttaaaggatttgaagtttctgcttcatttttgggaactcactacaaaccaaagcatatccattttaagatgacacaactacaaatttctttcttataatgagttgacatctatctttggtttccagctctggatccttgttctaggcttgaggattgctgaaagataacactcataaaagctgtggaaagaaaacactcataaaagctgtgggccgatgtgacctacttatagcaaaaatcactttagtattatctgtaaacaacgagagaggcgatgaagggaactgcacgggctacactactttgcgcaagtcacttcttataaaataaaccatttggtctttacaaggtaacagtgtccgttttacatttgaggaaatcagctgggaagggttaagtaagctgccccaaatcaatgagctattaagtggtggaaggagaatgcaatgctcctttgagttgcctgttactatacttgtccttctagaaaaggttatagtttcctggttgagtagtttggggggcattagataaagtggtccatttaatcattgatcggaactcctatatagagggatcaatgtttaaaagggttttgttattttcgtattcgtattttcatccagttaaaaacgttactgttatcttaagaggatatgtatattgcagcaaaggttaagttatgctattgaggcccactgaagagaagaacgtttctcagtcatagaaggtcagcaactccaaaatagaaagacatctgggaaccatttaataaactgattttttcaaatgaagaagataagtaatgcattcaattttatacatagtgccaatcccctaattactccctagattgctctggtaacaggagtgcaagcctgagtcttttgatatttgggggccatatttttggaaggttcattattcttcttcataactattatcacttcccattttacattttgtaaattgtgttctactattaccagttagctttcaccttattgtttggtcagttccattgggtcaggcactattgacatttatccagttttctttcttttaattccctcagtataatggctttgtcattttttaacaattttcaagaattatttacctggagattgatactttgaaaaactgaaattatcttctcctgtggagtaattttagtcagcttctatttaaatagataaaaggcccaatcatttgctttgaaatttgtccataacatgtatgcatgtgatgtgttaatttatttcattacagtggagtaaaagcaaaaagaaacatcacctttgttgaacttacaggatgctcttcccctttaaaaataaagctcgtgtttatttacagtaggcaatgctagttaagtcttggtaaagaggagaaccatgcatctgatattggcatacctttggaatgaaacatagtacatgtttaaacatatattcctttgtagctgtttctcttctctattcctctctctagacaagagatgaaaaatagattgtactctgcatgccacttctaatccattgattaggaatggctttcaaatgaaaatctgagaatcattctgagttcagggccttgttcaggagtgaagaatgtcattcatgattgactatcaagagcaccagagacacagaggaaagtgttggcatgcacaccgtgtacccacaatctcaacttttcatctcactgtttggaaggaggaaactggatgtgggtgttgtgaaaagccctggctcatctgatgattttgccaacctaaaatcaaaaaaaaaaatcaaatttaaagagagattatttgagcacaaagtttgaggacagcccacccagaaacaccaactcttaaagaatggaatcagcatcccaaagtagggaagttaaggcttcctttatataggcaaagacaggggagtttttagcaggattacaacattttttatacgaggttggcacatagttgtagcaatttaattggtgattggcactgtttcttttgaggaagggtaattttaacaaattttaatagaagctgtaatagtcatgggctttctgtcatctagtctaagcaaggaagaacaacaaaggggaaattaatctatatgaaggatcattaattaagaaggcaggaggtttttgtccctgacttcgtttaattctctctagtcattctataggacaacaaaaatgacaaagtgacttaatatgtaatctgagaaacagaaattataaccataagttataatttctcagatcacagtcaaatctctctcaaggcttaaggttttgaggggttccaacatcttttaaattctatttattttcacaatttctaagtgtcctagtctgagatgggaagatccttaccacattaaaaatcttcaagtttccagccaatgtactgagtgctttgcataaacaaatccaattaatccttcctacaccccataagacaggtaccatttttactttattttatcaatacggaaacaaagcacagaagttaggtaacttgttcaacttaacactgctaggaagaaacagagttgatatttgaacccacatagtttgagacttgcatcctcaaacaccccactaaactgaacacattcagtttttcaatcattattcagattgttatcattagaagatattaaaaaagatcaaattggttttaaatgcaattttggtaagagcctcatttaaatgaatgctattatatcatttcaaaacaatagtaaacatttcatagaactttttatcccagtatagccacaggggtcaatttcatagctttcctttgtcagttaatgtcagcattactcttttgttgaacttgaagaactaacttcaaactctgccactatattgttaatcctccacccccaattaaatatccttctcatgactatagttatatcaccttgccttgccttatagtgtatgattttatgatgatcatcaaatcctgtttattaagggcctctcatttttgatatcctaaaataaataggggaaacaggcacagttcttgtctttttgaaccatggatgctttggtttacttaattttcattttaattttataaaggaccattcaacatgtattaaagcataatgattttttcccttaatttgagaactctttgcaaagatagggggagatatgcattctattggactatgtgtttggatgtggaacccatgtatacgaaaggccaactgtattttctctgtttactctcaggtaaagaaactcagtaatagagggatcagataacctgtccagaatcaaataactagagaatttagagccaagcttcagacacagacagtgtgactcaaaagtccaaattctaagcaatttttctacattctctcttaactctgtatgtattagtccattttcacactgctataaggatactacctgagacttggtaatttataaataaaagaggtttcattgactcacagttctgcatggtgagggaagcctcaggaaacttaccatcatggtggaaggtcaaagagaagcaagcaccttcttcacgaggaggcaggaggagagagagagcaacgaagtgccacactttaaaaccatcagctctcgtgagaactcactcgctatcacaagaacagcaggagggaaaccacccatatgatccaatcaactcccaccaggtacctccctcaaaacataggaattacaatgtgagatgagatttgggtggggacaaacaaccaaaccatatcaccacactttacttctctgtcttcaaaagaataatcaggcagaaatacttaaagattgcagaatcagagaatatatcaaaaacagtagtaagaaaattggatagcaatcgaggtacacatggggaaaaatattggatgtctgggaaatgtcgactgctgatcagggtgaaacaggaagtgattgcaagtttttgatgaggggtcacgtgcaagagagactttaagtacaagatagtatgagcaagagcacatggtctaaagtacaagaaattgtggtgtcactaaaatataattatgtctccagatgagtggtggtattgaagtttttcatccaaactttctttccaagcaactgttaaagaaaaccagagttggatgttaattaaagtagtaaaaacaggctttagttccaatgggggaaagatatctcagtatagagttgggctcaattccaaatacagcatggataagtgggaatctacagccaaggaacaagttgggggtcagcggatgaaacactactaagaaaaaacattagggataggggaagataatagttaaacagacctaacctgattcttgctgaaggcaagccccattgatcagatatcacctggcgggtggtgggggtattctctctaaattggcttagcaggattattgccaaagctgaatgatgcaaagacaaacacagaagcccaaaggttgaagtctagttggaagagggttcagaggagcctcaccaatgtttgatcaaggagaggtttgttactatcttgattaagaatcaagtttcttaattatctttttttctaaagctggattattggtttgcattcatttttttctactagattcttagtcggctttccatttttgtagtgtcttatagagacaaagttaggaaaaatatgctatgtcagggctcagaaatgatatcccaaaatatggcgtcttggcatttgagaaaaaagcaaaagcaggaaggtctttctgactttcccctcacccttcttccctgaagcaaaactgtaagatcttctccttcacttctttcctaaagaccctcatgtgacaggtgtcctactctataccaagaggataaagtgtcacacaggaggccaagaacaatctgaacaaatagaccatgctgaattcccgtcagtttattaccatcagattataccctggtgttctccaattacatttttgtatgactggccataaaaaatatacttttccctgagtcttttggtcttcgtttctgaaggctgtcatgtcatataaattttaagttcatttatatgcttttcatttattctgtttcgttataggtgtgtccgccatgagtcttgcatggggtaatgaaaagacagtactttttctcccctataatttctggcacccaacacgaggcccaaacccaccacccagagatggagtcttatgctctatcactgagctagattcacctgcagcattttcccctctacagcagttatataaaaacacctttaaaagtttgccaaaatattttatcccatatcatacttggtgatattagaaaaatatgcttgatatataatagctttctttacaaatgacaatattttacatataatacatattttacatatgccatcaaagattttagcattataccaaatacatctgagcccctgtgttagaaatgagaattgaggagctaatttccaatacatttcttggcatagttttaactatttttaagtgaactgaaatcattttgaaacctaatctcctcactctccaacacatttatctatgtaatcttttaaaatttctggttttaatgtggatttataaagtcctgagtattacataaaaactagtctttgactaaagttgatgatcttatactcagtacaaacatatcttcaaactctttgagagaagattcctattagtgtagctgtcaacaacctacaataaagttgaatagaaagtacaattatgtgatcagtgcaaaaaaaagcaaagaaaaagaaaaatttgtacagcattatatatctcttctaaaacgcacttgattaatagaagcaacatactcaaatatttctctaacttgtaacaaagaagtttacaacaaccattcttgttcatttaaaaattaaattcaaaagaagcagaaaaaacctgaagaataaaaatgacacaagggaaagaaaatggaaaagttatttattaggaagataataatggttaccacttttatggtgctttatgcctgtgaatttcaaagctcttcattaaatgttagctcaaaggacttcacacatgttgtttcacttagtccttttctgctgggacaattaaagaccataaaggcataaaatgcaataaaagtcaccacttcagggggcaaaaacacaatgggtatattctgtgccagaccatattcccaataagcaggattaaattgtggaatatatacgccaggttggctctccacaggcatcacctgggcagtgatgatcactctagtaaatctggggctgacgacgggaagaaactcgatgaagaaaaaaaaaaagaagtcacaggcaagtattaaggataataaatgaacgggtctgttgggggcattacttcctcttgtacatcaattaaatatgaaagcagtagaccaacgtggtttggaatggccccttttgaattcttactctttgtgaatacagttacaaaagaggacctctgaggaagagtacttctctttgactgagatcattaactcccagcgcagaggctaggagaaaagaggatttagatttggactccaaagagaatttaaaagtacatccaatttccaactccccctaggtggttttcagcaacgaaaaactgtggagttttataatgtcagtaagtattaataagcttaaatgttcactgaactaaaaaaagtgaaatattagggctctacagagtagggcttggacagtgcacttgaagcatatgctcaaatcactttgaaagtttactgtctggtaaggaaaacacaaagctaacaaacacatatcatgtgctaatgaatataatttgggaaaaggtataagatattctattggcagtaacatctctgggacagttcttagatggaatttacacctaaaagcttcaacaattaattcttgtcaaaaacatcttggaaccttgaaattggatatttctataatcaggtcccatttaactcctccctgaagctacaccaccttctatgccctttattcatgtatatacatggaatcatcccagactttatttattcatttattactttttctgttaataaacaaggtcttgctctgttacccaggctggtgtgtagtggtgtgatcacagctcactgtaacctcaaactcctgagctcaagcgatccttcccacttcagcctctcaaagcactgtgattacaggtgtgagtcaccaatcctggcctttttttcatcaatgatagttatttttaaaaaatgttttttagtctgttggaaggatgtaattactttatgccacaacaataagtggtaacctcattgtaaagacagtggttaaagttggttgccatagcctcaagtttcccagctgctacccttatttcctcaatagtctattcttagcccagcccccagggtgtcctttctaatgtcctatcacatacagccagagtcccccactacaggtcttgaggatgaaagtgtccaatttctgaatcccacgacctcggtttttttccttctctcccagctcctaaacctcccaaggccaaagccaaaggctttgaaagccaagaaggcagtactgaaaggcgtccacagccacaaattcaagaagattcacacaccactcaccttctggggtccaagacactgaggctctggagacagcccaaatatcctcggaagagcacccccggaagaaacaccagccctggagaaacattcccctgaccactgagttcatggtgaagaagagagaagacaacagcacacttgtgttcattgtggatgtcaaaaccaacaaacacaggatcaaactggctgtgaagttctctgacgttgatgtggccaaggtcaacaccatgatatgtcatggagagaagacatatgttccattgactcctgctatgaggctttggatgttgccaacaaaattggaatcatctcatacacccagctggctaattctaaatatatatcttttcaccattaaaaatatatatttataatatcatgtcctatttctcctcagctcaaaacccttcagtggcactccattttattggtgtcaaagccaaagtcctttcaatggtctacaaaacactgtttggccaggccaccaaataccttgctagtttcttctagttctattctctctcacttggctccagtcacactgacctccccgccattccttcagtgcatgggaatatcccaccttcagaccattgctccaattcttctcattttgggaatgttctttacccagataatagcttgactaactccttcttttatgtctgacttggctcaacagtttaatctcaatgagacttaccctgaccaccctatttcatagttccaacctggattccagcattcctaatccccttactctgcacgacttcttttttttcccatggtactcaccacctctaactcattagatcatttatttagtccttaagttgactatttattatctgcctgcccagtataatgtaagatcctcaaaggcagaaacttgtctcttttgttcacagctcctagaacagtgccggggacataggaatgcctggtaaatatttgctgaatgaataagtgaatgaaaataacctgaaatgaatatatcagcatttaaatcttacttcaccctttaatcaaaggagcaccagccacatcctgtctattaagtatcattgggattggtcacctgatgatttgaactttctaggtttccaggtctacataacaataagcactcacaggacatattcattgtaaatggctctttcagcttggatttgtgagagataatcacgttgtaggattcattgtctctagggaaaaaaaagccattgaattacatgatgatccctgcctatttgtctatttgttggggttgacatttatatttcttttatttgtactttcttgtgcttaagctgttatttaaaaccaaaaataataggctaaaacaagccatcaaaaagcaaaggcatattgacttaatttggtatgcccataaatcatagttctgatggtgatctacttaaaggtttattttcagtggggggagattttcttttaacagggaaatggtccatgtgctggttatgtaattttaattaggctataattattcctaatttttctgtaaatctgaaaataaaaagaaacatgaggacaagacttcctactggggatcactattggattctttatttgaaactactgatattatgtgatcaggcatgggtttaatggcttgagataataggtaggtcacccacacacatgctttaggtatctgggaagctatgagcataaaaatacataaaggtgctgatgtttattataaatcagataaataataaatcttatagaagtacataaattattgttttctaatacacatacacagatgtatgctattgtgtgtaataagacaaaatttttttgacattcaaaacctaaccttataacttgtagctcgcactaaggagtgcctccctctcagcatggacaaatccaaactcgcactctttactatcaaaactgtccgctgctttctcaggctgttaagagttttcaacagaaaaactaaacctgattattccttaattttttcctcttctcattttgtaacagttaatttcccctcaaatcttttgcagctttcccttctctctgtcttggttctgcttcatagcacttggtttgtaagactttctcccatatagaattcctatctccagcctctcccccatcaatccaaccatcccattatcatggaagttatctttccaaagctaaaatctgagcatgtcctactccatactctatactcactggtgcaacatacacttatttattctcggaacccaacttatcttttctctcttgctccctccatcttcctgttttcccttgtcacagtatgctattcccagaatggtttgtgatgtctcctgtctgggtgtttgtgtgggcttttcctctgtcccagaaagcctatctctcattcatctcccaagcatgcctcaaatatcacttcttatcttaagccagctttattccaactgccactgacagggtttgccttcctccactgtattcccattcagtgtgcgcttctcaccttaggtttcacgtttctctccatgtgtgtataagaatatatataccaaaccttgaaactgcttatttatacacacacatagatctctagagctctagatctgtatccaatctatcagtatgtaatagatcgttattcacagatgtcgtatttgcaaattcacctgtattgaaattcatttgtaaacccaaaatcaatgctcgctgcactctttccaggccattcccaaaatgagcaaagaggagaaacatttgagtcactcatactgcacattcccagctgaggtggaataaggtaacactccactttcctgttttgggtctcatactgcgaacaagtgtttctttcctggtacatctagtgctccattttttttttttttttttacatttttgtgatttttcttggtgatttaagtgtttaaaatggctcccaagcatagtgccgaagtgttgtctaatgttcctaaccttaagaaggctataatatatcgtacagagaaaacatatgtgttaggtaagcttcattcaagcatgaattacagcaccgatggcaatacgttaaatgttaacatatataaacgtttaaattcatacaaaaatatgtattatataatctatctttaagcagaaacacaaataaggttatatattgatcaactgataaaaatgttataactggaggctcataagaacttaatctcatattttccctagaggcaaggatcagtatttactgtttgcagagactttataaattataactaatgtgaattacaagaatcaactgtatatatatgtatatgatcgtcccttagcattggtcggggattggttccaggatccctgcaaatactaaaatctgcagatgctcaagtcccttatacaaactggcatagtatttgtatataacctatgcacatcctcccgaacactttatacaatctctagattacttatagtacctaacacaatgtagctgttgtgaaaatagttgctatattgtatttttatcattttttgttgttgtattgttacttttttattattggtgttgttttagttttgttttttttttgtttgtttgtttgtttttttttttgcctgaatagttttggtctgaagttgattgaatctgtgaatgtggaacccatggatatggaaagctgcctgtatatcctttgcaagcaactggtcctcactcttctctttatttctagagtccagcagggtgcctgacatgtagcagatattcgatatatctttgaaaacaaaataaacaaaggaaaatgagacatgaagacattttagttgcaaagaagaaacttgcctttattgatttaagcaagaatcaggtttacaaaaaggcaattgtcagctcagaggagagctaggaaggctcaaaatggggcaggtaaaataagcaggagaaaatgaaggataatcagccagagaccagccagaatcgtgccccagaaacagtgtggtggggctaccagtgctacaaccactcaatatggcactccacagcttataccactttcatcaccagaatgaaatgtggccattcatatctcccttctgatgtcccccagaagtgggatttttcacaatccctgctcttgtgttttattatatctagatttaaattaccatatgggtaaggttgatgggtgagcctggtcgcatgcccataccctagctggctttttaatttccatagtaaacagagggctgccttctgctagaacccattcagacatttccaaaatatcagaaagatatggagtgtttcagatgctggtcaatgaaaacaataacgtgtaatgcaggttttttttaatctttaaacacccttgcattagtcctccatctccaataatgcagaaaaataaaaatcctccagaatatagtggctcccaacaatagcaatttaaggctcactcctggttctgtgaatcagctgtgactcacagggagttgcctgggggtttgggttcagatctgttccacgtgtctctcattctggcatcagtgattacctagggcaaaatcttctcaaaactgatagcagaagtaaaaaggccagtcagaaccctagatgtgctaaagcctctgactgcatgaacatagtcagtaaagttcattggctaaagcaaatcacataccaagcccaacatctgcaggcaggacatattattcacctactctggtgggaggtgctgcaaattcacatggcaaatgtcttggatgtttaattctatcacaggaaggaaataaattgggaataacaagcctgtctactactgtagtaacggaagtgttctaattttgtctagaacaattggaacgctgctgttgatattgtcaatattactgaaatcattttggtttataacattgatgtactaacattcactgtcccaagtgatcttccctttctgtcctaattgtatttaaaatatttttcatgacaacctccctccacctaatacaactcctgttttccagtctctcttgcttgctaaaaatcaagttgaatattaaggaaaaggaaattttatactttgtagtttgaagcatgacctaattttcaatgctttttccaaagggcaagcgaggtatataggggacacagccatacaggctctaaatagggattgcaaccagggctccacattagaatcatataagaatcacccacgagagatttgtttaaatgcttttgctggagggctactccgtatcaattatatcagacactgaggtagggtccaagtattctaacaacatctccaagtgatttgtaagcacattaaagtttgaaaagcgctgctctacagtaaaacggttggaattttaagcctgatataaccacatgtcggtgggttccaagccatgttgtttgacattttatttcctcattcgagaaattagaataatcaaatgtttaccttgcatacttgttcaatgattgtgaaatgtaacaataatgtaaaatatagaatgagaggcatgtaacgagtacaggataaaaaatagtgccttactagtattattatctcaactttggcctctccacggccttaggcaaattaagtttcctccccgggggaaattttatcatgtaaaatgatgaatgaaaattctctgattttcctttcttttctaacattcagcgatttcctggtatcccctagaagttattattccattattgtagaaataggttatttctttgcatgtatgctttaacataaggattaaaaataatagcaaagaaaatgtatgacatctctttttcttgagatatcttttgtgatttttttttctgcgttgtggaatctatgtttagagacatgcaatgtttaaatgtgatttggacagaaaggcaaaaggaaaaaaatagtttctatgtgttattagcctgggttatctagagaaatagaatgtatatacatataagtatatatgtataaatcataaggaattggcttgtgtggtaattatggaagctgagaagaactatgatctccagttagcaagctaaagacccaagaaagccagtggtacacttgcagtgtgagtctgaaggcctgagaatcaggagagccaatggtgtaagtttcagccccagtttgagtcaaaacctgggagaagaccaatgtcccagttcaaagataggcagagaacgaattcttccttcctctgcttctttgttctattcaggcctctaataaattggatgaatcccactcacagaggaaaggaaatctaatttactcagtctacagattcaaatgttaacctcctccagaaacatccttacagaaacaccaggataatatttaaccaaatacagtcatgcattacttaagtatgggacacattctgataaatgcttaattaggtgattttgttgttgtgtggacatcattgagtgtatatacacaaacctcgatggtacagtttactgcacacctaggctatgtggtgtagagactgttgctgctaggctacaaacttgtatagcatttgactgtattgaacactgtcagcaattctaacacaacggtaagtatttgtatatctgaacatatctaaacatataaaaggtacaagaaaaatacagtattatactcttatgacaccacagtcatatatgcagaccaccatcctggactgaaatcctttactgaaatgctttttctttccgaattttactttaggttaagggggcacatgtgcatgtttattacatgagtaaattgtgcattgccaaggtttgctgtacagattattttgtcacccaaatagtcagcataatacctgataggcagtttttcaatcctcatcctcctcgcaccctccactcgcaagtaggcagggccctagtgtctgttgttcacttctttttttttttttttgattcggagtctcgctgtcgcccaggctggagtgcagtggcgggatctcggctcactgcaagctctgcctcccgggttcccgccattctcctgcctcagcctcccgagtagctgggactacaggcgcccgccaccacgcctggctaattttttgtatttttagtagagacggggtttcaccgttttagccgggatggtctcgatctcctgacctcgtgatccgcccgcctcggcctcccaaagtgctgggactacaggcgtgagccaccgcgcccggcctgttgttcacttctttgtgttcatgtatactcaatacttagctcccacttataagtgagaacttgcagtatttggttttctgttgctgtgttaatttgcttaggataatgccctcttgctccatccatgttgctgcaaaggacatgattttgttcctttttatgcctgtgtagcatattatggtgtatatctgccacattttctttctccagtccaccactgatggacatctaggctgattccatgttttcgctattgtgaatactgctgcaatgaatatttgtgtgcatgtctttatagtaaaatgatttatattcctttgggtatatacccagtaatgggattgcagggttgaatggtagtactgttgtaagttttagagaaatctccaaattgctttccacagtagatgagctaatttacgttcccaatagcattgtgtaagtgttcccttttttctgcaaccccaccagcacctggttttttgctttttttgtgttttttttttttttttttgactttttagtaacagccattctgactgatgtgagatgctatctcattgtggttttccatttgcatttctctaacgattgatgatacagagcatttttttcatatgcttattggccacatgcatatcttcttttgagaaatgtctgttcacgccctttgcccatttttaaatgaggttctttttctgcttgttgatttaagttccttataaattttggacattagacctttgtcaaaagcatagtacgcaaatattttcttccattctgtaggttgtttgtttattctgttaatagtttcttttgctgtgcagaagctctttagtttaactaggtcccacttgtcaagttttgtttttgttgccattgcttttgccatctttgtcatgaaacctttgccagggactatatacagaatggtatttcctagttattttttctagaattataatagttttaggttttacattgaagtctttaatccatcttgataaaggaaatagcccagttttaatcttatgcatatggctagccagttatcccagcaccatttattgaacgggaattcctttccccatcgtgtgcttttgtccactttgtcaaaggttagatggttataggtatatggcattgtttccgggctctctattgtgttccactggtctatgtgtctgttcttgtaccagtaccatgctgttttggttactgtagccctgtagtatagtttgaagctgcatagtatgattgatgtctctggctttgttctttttgcttaggattactttggctattcgggctcattttttgttccatgtgaatattaaaatagtattttctaactctgtgaaaaatgtcattggtagtttgatagaaatagcattgaacctgcagattgctttgggccgtatggccattttgacaatatttattcttcttatccatgagcatggaatattctcccatttgtttgtgtcatctctgatttctttgagcagtgctttgtaattctcattgtagagatctttcacctccatggttggctatattcccaggtattttattcttttagtggctactgtgaatgggattgtgttcttgatttggatctcagcttggacgttattcatgtgtagaaatgctactgatttttgtacactgattttgtatcttgaaactttcttgaagttgtttatcatatctaggagcatttgggcagagactatggagttttctaagtaccgaattatatcatcagcaaagagacagtttgacttcctctcttcctatttggatgtcttttatctctttctccttcctgactgctcttgctaggacttcctgaaatgttgataccccatgcaggactgcatctggacacaccgtagaccagtcaagttgaaacataaaattaaccctcacactacgtgatatcattaaatcaaacttcctccctcttgaagcttctcagacttccaaacctgtagagaaacatttgctaagttaaagacatatgttttgccttatgttgcagttttcttcagtttttatctgtttctgtacaggttgcttattattgaaaatttttatccacaaaggtagttattgggtatccaatcttcatgctgtattttagttctcattttatgtttgccatccttcatggtatcaacatgcagtagaattactaacataaattagtaatgcatttttacatgttgttagtaattatcttatttcttactatgattaccatgtcataaataacatattgaatattgaaatacatacattacaactagaacgtgatctcccaagtgacggaaaacttgcctctcttatcctccaagcttatagcaaaggaccttgtcgatagtagcagttaatatccttaaatgaataaatttaatttttccatctctatgactaagaggccatatgaaatttaccaatatgaaaattgtatcagttctctattactacaataatgttgtgtaataaaacaatcactgtatctgagtagcatagaatatacattgattcctcacatatgtgcaggttagccagtcaattcatgcaggacagattgagtaggaacagctctgctcctcatgcattgatcataggattcaggatcaaagagaagcaactacccaggagaaccttttctcttggtagtgacagaatgcaagacagtaagctaaaacacagaaggcctcttaagacctaagattaaaaatggcatgctatcctccatccacatttctttggctaaaacaaggcccatagtcaagcccaaagtcaaggacagaagtaatacactctatccacaattagttcatgacagtggtgcagatacaagagagggggaaaagagaagaatgagagttagtaatttaatctacctaaaaagctgaagttggccgggcgcggtggctcacgcctgtaatcccagcactttgggaggccgaggcgggcggatcacgaggtcaggagatcgagaccatcctggctaacacagtgaaaccccgtctctactaaaaaacacaaaaaattagccgggcgcggtggcgggcgcctgtagtcccagctgcgcgggaggctgaggcgggagaatggcgggaacccgggaggcggagcttgcagtgagccgagatggcgccaccgcactccagcctgggcgacagagcgacactccgtctcaaaaaaaaaaaaaaaaaaactgaagttaagagaggtcatttaaagtcgggcacagtggctcttgcccgtagtcccagctactcacgaggctgaagcgaggagattgtttcagccaaggagttcaaggcagcagtgagctatgatcgtgccactatactacagactgggtgacagagtgagactctgtctctaaaagaaaaaaaaaataagagatgccatttaactttacaagatcaccaaattagttttccctacagccaatacttgaccccatattgccgctgactccaaagtttttaaacacttcactatgctgtgatcaagaatccacaaagaagccatttttggtaacttggtaaatattataccctctttttttgcagtgagtttagtacaagaaatataactaaattaaaacacaatgcatctatcaccttgttgagtatggggatcttacagctgcaaaggatttaattaaaagttgatgatttaataggcaggttccatctattgtgtactctggagggtgagattcaatttaaaattgggttccaaatttcattttggaacagcatacttgtcatcggctggcagaaaatatcccaaaggaaacagacatgtccctgaatagggagcactgaatcagacagccaagagcagctaaaaagttaaacaacaaatattttatgtactttggttctggttctaggaagttctaggcattcagttgtagatatttaattgcaggttttttgcccacttttctcatgccaattgttcttaaaacatacatttctttggataaatacgatttttgtatctattttttaaataacaccatcattccttgatgcaacaaaatacaagttaataaatactgcaaagctaaaaaatcccctgtaatttttagtcaactacaggttgagaatgagaaaggaatacaggatcattacttatgttacaatctcaaagtaccacaaggtttgggccttgacttcatctcagaaatgttctcaccttttaaaatgctctttctcttagcaataactatgttatgtggtaagtgtcctctactttcgcatttattgtctgcctgaaattggtacacatttatgaaatcattattcttgctgtctgatctacaggaaactagggatcattaactacccctagtagctgattcttggcttcctttcttaccatgaaatatccttaaattgtaaagggtttgagtttatagatagaaatttgtcaatctctcttttccaaagaacaaaaatcacaatgtgttgaatgaatattagtgtatttgtttgtagatgcacactctcatgcaccactacatcctcaagtgtatataatacatctagagaataactaccaatattttaaaattagaactttgccttccctgtcattccatttttggcaagcatttaaaatgttgattttctacaaacctgaagtgtgtttgttttattgccagagaaatgtacaagttatattagaggcaaaagattaagatagtgtcttttacaaataggccaacgagattgccatgctgggataggctcatttccaaaggctgtgccatcattcatgatggctatgatctgcctgtgctgactgccacctatcacactgccaagtgttccctgggccagatcatcaccaccaatgctgaaaatcaagttttagtcttcctaatttccaaatttccataagtagtgtcaacattttaaaatctctccaaataaagtggtcttgcatgtgtgaaatcacagagtcagaaagagctttatgatgttgccttcacagaaccagatgcaaattaacatggcattgctcttaaaatgtaatggttgcttccagtgctgcggcctacaatttgcgtcccagaatggaagcttcaggggcccctactgtgaacaccagccacatgtcaaaataactgaggtgacctttcaaagccaccaattttgttttctcttaaaaaataaaaaaaggcttttcctcatgcagtatgactagtagtcaagccaggagctaataaaaaaaaatcctggaagaatatataaataggaaaccagaattataaatagaatcaaataattctgtattcaaaatttgcttttgccacttacaagctgtagacccatgggcagagactgttagtgtttagttccttttctgttaaatacgatatgaattctggaggttagcatttattgcacacttactatactgacacatatgcagagtgatttgtaggtattttcttatttactccattcaatgattatagaatattaatactttccccattgtttacaaaaatgggcttacagaagttaagcaaaagcacaggcagaattaaatagtaaatgcatagtatagcatatgagtcagttctcacactgctataaagaactacctaagactgggtaatttataaagaggtttaattgactcacagttccacatggctggggaggcctcaggaaacttaccatcatggtagaaggcaaaaggggagcaaagcacattctcccatggcaaagcaggagagagagagagaaacgagaagtgccacacacttttatacaaacagatctcctgagaactcactcactatcacaaaaatagcaactgggaagtctgccctgataattcaatcacctcctaccaggcccctcccctgacacatggggattataatttgacatgagattagagtgacacagagccaaatcatatccttccacccctagcccctcccaaatcttatgtctttctcacatttcaaaaccaatcatgccttcccaacagtccaccaaagtcttaactcctcccaacattgactcaaaagtccaaatccaaagtcacatctgagataaggcaagtccattctgcctatgagctgataaaataaaaaacaagttcgttgcttccaagatacaatgagggtacaggtattgcataaatggtcccactccaaatgggagaaattggcctaaacataaaggctacaggccctacgcaaatcagaaacccagcagggcagtcaaatcttaaaggtccaaaataatctcctttgactccatgtctgacaaccagggcatgctaattcaagaggtggacacccaatgccttggactgctccacacctgtggctctgcaggataaagccctgttttcacaggctggtgttgagtgcctgtggccttctaggcacatggtgcaagctgcccatgggtctaccattctggggtctggaggtcagtggccctcttcccacagctctactaggcagtgcccaagtggagattctgtgtgggggctccaacatcacatttcccctccacactgccctagtacaggttctccacgagggctccaaacctaccacagacttcagcctggtcatccaggcatttccacacatcctctgaaatctaggcagaggttcccaaacctcagttcttgccttctgcacacccaaagacccaacaccacatggaagccaccatggcttcaggcttgcagcctttgaagccacagcctctgaagccacagcctgagctgtacattggctccttttggccacaactagagttggagcgtctaggacactgggtactatgccctgaggcagcatagagcagtaaagccctgggcctggcccacaaacccatttttcccttctgggcctccaggcctgtgatgggaaggactgctatgaagatctctcacatgccgtgtagacattttctccattgtcttggctattaacacttggcttctcttaggcaaatttctgcagctggcttgaatttcttccccagaaaatttgtttttcttttctaccacatagtcaggctgcaaatttaccaaacttttctgctctgcttcccttttaaacgtaagttccaatgtcagatcatctctttgtgaatacatatgactgtatgctgtcaggaccagccaggtcacctcttgaatgctttgctgcttagaaatttcttccaccggataccctaaattatctctctcaagttcgaagttccacaaatcgctatggtaggggcaaaatgccaccagtctctttgctaaagcatagcaagagtgacctttacttcagttcccaatacatttgacatctccatttgagaccacctcaacctggatttcattgtctgtattactatcagcattttggtgaaagccattcaacaagactctaggaagttccaaaccttcccacatctttttatcttcttcttagccctccaaactgttccaacctctgcgtgttacccagttccaaaatcgctttcacattttcaggtatctttatagctgtaccccattcccagtaccaattttctgtattagtccattttcacaccactataaagaactacctgagactgggtaatttacaaagaaaagaggtttaattgactcacagttctacgtgactggggaggactcagcaaacttatcatggtggaatgcaaaggggaagcaagtcacgtcttacatggcagagcagaagagagagacagaaagaaataggaagttccacacactttcaaacaaccagatctcatgagaactcactcactatcattagaatagcaaggggaagttcgtcccatgattcaatctcctcccacaaggcccctcccctgacacatggggattacaatttgacatgagatttgggtggggacacagagccaagccatattatatagcaattggttcatagcaggcgttcaggaaatactagtttaggagattccattcttccactacttaaaattcttcttaagctgctcatactaatgtcattcagtgttggtcttctaaaaatattagttcagccatctttagcttatggatctgactattccagttactttcaatttcaaggagtccaatatatgttgcaaaaccagaccccttgcacattaatttattacaaaatatttactgatcatctgtagtatgttaggcaagggaaacttagtagagcaaaaaatagttgagctccttgctctcatggaacttaattcgagcagggaaaatggaaaacaaatgaaagaaatgagacataaacaaggctgaatgctgacaatgggagagagtgccacttcagatgcatggccagggaagacttcatttagggatgtattataagtttgccaaggctacacaggaaagtagcaaaaaccaggtggcttaaaaaacagaaatgtattgtctcacagttctggaggttagaagtcctagattaagccatcatcctgcatggttggtttttttctgagggctgtgatgaagactgttccaggtctctctcctagcttctggtagcctcaggcactcgacctgtagactgcaccctccacgtgtcttcactgtctttcccctatccttagatccatgtccaagtctccctttttataaggacaccactcatattgagttagagtccaccctaatggcctcattttaacttcatcatctgtaaagaccctatttccaaattaggtcacatccacaaatactgtgggttaggacttcaacatctttggtggggggcagataaaatccaactcataacagagggtgagatttaaaatatgtgccaaagaataaatacctgtttggtgagggagaagcatgctaggtagagaaggagtaaaaaggacttaaaagtactcactaaaaacaggtaacaaaatgttcacatagcactaataagaaacccaaattggaaactaaccaaatgcttatcagcaattggatgaatacactgtagtacagtcacacaatggaaaactattcagcaagattcagcaaaccacagatcttgggccaaatgtagaccactgctggttattgtaaataaagttgcattggaacgcagtcgctacctcaattcatttatacattatatatagctgttttcactctataactcagttgagcagttgtggcagacaccacatgacccaaaaaactgaaattatttactatctgccccgttttaaaaaaacatagttttcttacctctacttatagcagataaaagatcatttaggaatattacacaataacatgaatgaatctcacaggcagatacaatttcatgccaaacaagttcaacacagaagattagataatatacgacctatttataataaaaaaataaacaagcaaaagtaatttctgtggttagaagtcacaacggtgattattcttgctgggataaagttactagaagggaggtagtgacaggagagtgtagggtggtggggtaggagagcaggggacagggggtttggggtttccaggaatgattgttcggtttctttatccaggtgcttgttacatggatgtgttccatttcagtttgtgaaaattcatggagatttgtacttatactcaattttgtgtccctatatagtaaaacgttgtttttatattttaaatattaaaagtaaataaagatagcaagctttgtatatttctagaactaaaaagaggctgaccttggatatttgaaacattagatatattggaattaagattttaatttgtgtgattgctgttctttattcagagctgaaaaaaaaagaactttcctcaatgatggacatgttctacttggggctgtctaattcagcaaccactagtcatatgtgtctgttgagcacttgaaatgtaactgctgtaactgagcaactaaatttaaattttatttaattttatgtagttattttaattagttcaattttaatttatttaaatttaattagtttaatttagccccatgtggatggtggctactgtctcgcaggcacagctgtctctatcctatggcacaactctctatatcccatgcattctcctcaccttgatctaacccccacatcctttctcaggttcatgctgtgtaatatctagaaaaataaaaataatctcaggttctatcatactccaaaaacaagtgcatctaatgtttttaggaaatctaaaattgcttttctaatttgtgcatgttttattttcatagggtgtaaactgaatgactaataaagagcatagatttaatggttccttgggtttattagctaacacacttgactttaagattctcttgcctattacaactttataaatctttttaaaagggtgttgttttaatgttgtatatctgtacagatataggaaatggaaaaaaattaccttctgaatcagttgtgccctcaattgcagtagtgttaatttgaggcatcttctctttggtgccaagaaaataacagataatagatattgtacattgaaaagaaagttatggtgttcagaaaggccaaatcaatggaaaattctaagctttatgtggataatatacctcaaacataccttttatggacatttgtaaaagtattttaatgatatttttaggtgttttatgtttccaaaacacatacagtaatcataaaatgttcattcaaacatcatttcaaatatagacacaaacacatttataaaaacaaggaaagagaactattcaaatttggaatagccaatcatgttactatgagggtttaccacttcgaagttgtcagcttaaagatacacttctgatttgggacagacttttttaatataaaagtttaaattaagataatctattaaattataactccttgaatcaaaaaaaaatccaatgaaatcacctttggaagagttcattttttagattaaaggcaaatgacaaaagtaaagaagttaacaccataaatatatctaaataactcttattgtcttatatatgtctataaataaatagtgatatatgagaatcagttggtagttctttttctgatactctaaaatatttaagtgtcctctaagcaaaaagattaaaatgctgcttcataaagtttgttataggagtcatattgtgcttcaatttttaaaaatcagcttgtttctgtggtgctcattatgggtgaaaattttgcgttatgtcaaattcattaaccatgtcctgaccaccatgtactaacaggaaagtggtggggtggcggggagtgcacacgcatgttcatgttcactcaggggatcgcatgtatatatttatggttatgtggaaacagtgattactttctgtatttttaggtgtggtgggaaaaactgacgaatgatctgtctctagaagttctgataatacatgcagtctattgatagagaaggacttcccagatgaactgaagcattttttagcatcagtttataattctctgactccatcttcaagcacacttagaatagattggatgcagttggatcccattatataatccattagtgattaaaaatgggttagcaggccaggtgtggtggctcatacctgtaatcccagcactttgggatgctgaggtgggtggatcgcttgaggtcaggagttagagacaagtctggccaagatggtgaaaccctgtctctactaaaaatacaaaaattagccaggcatgatggcaggtgcctgtaatcccagccactcaggaggctgagccaggagaatcccttgaacccaaggggcggaggatgcagtgagccaagatcgcaccactgcactccagcctgggcgacagagcaagactgtatctcaataaaaaagggggggttaaaagtccttattttttttctgaaatgaccaatttactgttatgaaccattcaaggagtgctggtgaatatcacggagccagtgaacacgccaaagaacgtatatgtgtcagaacccaggactgcctaagagtgtggatgcactagcaagctaattacaaacatttattttttaaatgtagtttcctatattttcctagagccaccaaagcacacagacagggattccatctaatatagtgattcctagtttactccctattctgtgaaaataaaaggcaaattctgatatatgcacaactttgttacataattcagttatttatcttgttttggtaacatgtttcattcagatatttgcacacatgttaaggcccattgcccaaacaaatcagaaaattaaaattatgggaagacatatttgagctgatgaataatagggaattgaaatatcgcatatggcagcacattgagaccatgctacttaactataaagattcatgtatcctttggtgtagtctgaataaattggtctaaaagtagagatgtttgcctgaaccattctcttctgagagaagatttcaagctttcctctctgaaggtgaattcacttgggcgaccccatacactccctctctgtgtcatggcttgctctcttcctttaacctcttcaacttttatccatacttgcatctcaagtgaatactactaaaagtgttttgtgatcctttgccttcttgatctcttgtttttattacatactttaggcacacaatctaattcatgcattattttctgggaaattattctgtaaacatcagatttctcttgcataccaaattataaacttgactgagagttgtatactaaaagtgatccttatctgatacatgtgtaggtttggttatttatttttattttttacttatctccatttttttttgtctaaagaatccaggtatgaccacagtatttacttgtgttctttcatagcacttgaaatggtgctaggatcagagcagcaatcaataaaagataataatatttccactgagagaaacaggagtaaaacatgagcaccaaaatccctccaggcttcatccatgacaagccattggagatggcatggcccagtggagaaatttatggcaaacacaaagtatttgctctgtgcagaaatgccctagtccctttctgctcaatggagatgtcaattatttacataaacatcatataacaacttattgacttcaagattgtaaagtaccctattaatgttttaagcatttccctttattttaacacaagtaaattatttaggcaatgttaaaatgttttatgctttgactaatgagtagagaaagtatatgtcatatcttattttaattggctgtttaccttatcctgtggaaattatccatttattatttcagacataatttactatgcatatactccctgacagatctatatgccatttttacacttgatctaatcattaagacacataactgtgcagataattgttacttggaaattgttactttttcttcagctatgtttccaccaagaggcaatgccaaatttttaaactgtctatttccttcatgtaattgacttggctctttgtagagaaggcttgtcataggtttctcaccaccttacattttcagatgacatgttttactagtataaagtagatcacaacaataataagttcatagatgaagttcataaactaatatctccccagtcaggctttgtcttccatagctgtgtggactctacaggaaagaaatgactccaaaagcaataccccatgtgtcatcctcataattcatctcaattccatcctatcaattaaagatattccctatgataaaacggactttgattcaaggcttccagctatttttaagagttgtattagtggcatataaaatgaaagctcattcacctcctccttctgtctttgtgtagcaactcatatttgtgcagttcataaaggtttatttagtaaatgtagtcctcacaacaccggtgtgaaatgggcagaacaagagtagctctattttccacaagattcagatcaaaactatgtcttctaatgcctgtataactttttggaagacaatacacagaaaaagaagtaatttcatctctaaagaaaaacattctgcaactcctactggcaactaatgaaagtcaagggtttccatttcaagggtcttcagactatagtttcttggtaatataaataattaaatcatgaattaaaacaactataatacatgtataaaaatatttttccttcttagatggaaaatgtctcctactgtgaagtacacaaaatctttagttattgtagttaaatctcaaatgcctaaaaaaggtcacataaaaagtaagagggttgggtgtaatacagtggaaggtgcatgcatttatagttatctagggcaaacaagtctcatttaagagttttcacaggtacactttttaaaaacactacacaatcatgttcctaggtatttacccaaatgagctgaaaacacatgttcacacaaaaacctggacatggatattcatagaagctttattcataattgccaaaacttgaaagcaaccaaaatgcccttcagtatatgaatagacaagtaaactgggacacgtagacaatggaatattattcagcactcaaaagaaatgagctatcaagccatgaataaacatggacaaactcaaatacatatttctgagtgaaagaagccaatgagaaaggctacacatcaatgattccaactagatgacactctggaaaatacaaaactatggagacagtaaaaagatcagtggttgccagagcttagggactaaggagggatgaacaggaggagagcacacgattttagggcagtgaaacgcctctgtatgatgctataattgttacagtggggagctagttggggatgagtaaggcaggaaagggctccccgacccacccacacacataccagaagtgttgggtgaccatggggtgatggtcagacggttgttaactgtctctctaaagtaataactgctcacagctggcaccagggaaaggcagtctcctaatagataaaaaacgcctgaaactggtgatcagcaacttcccaataagatctccagagttgggagaagtgacacaaaccacacaagtataccaacatgtaaaaccccaagtcaaaaggtcaaaccacacagttgtctttcaagttgcctgcttggcgatcttccacgtgtactttcctttctctgattcttgctctaaaactttttaataacctttctctcctgctctaaaacttgcctcggtctctccttctgccttatgcccctcgtaaaattctttcttcttaggagcaggaactgaggttgttgcagacccatatggatacaaatattttctaccactaacatgccgtgtgactcaggtaacttccactgttaacataatggtggatgcatgacattatatatttgttcagaccaacagaatgtatacgccatgagtgaattctaatgtatgctatggacgttgggtgataatgacatttctgtgtaggttcaataagtgcgacaagtgtatcattctggtgaggggtattaatagtcaggtaggctgtgggtggtcagggaaagatatatgggaaatctttgtaatttagctcaacttttctgtgaacttaaaactgctctataaataaaatttattcaaaattaaaataaaaaacacagtagtcaccaaagagaacctacaagctctctggtgattaacctctagctagaatctaagtgaaaaatggatttctgtcttacctcaggatagaagaatccacctttctcttctatttaatgggtataaaattatttgagaaatagcttatgaaatttaaaaaaaaaaacaacttatagcaggtaaagttatcatttgggagtaaaactgagtggcttttaagaactacaaaagatctcttttcagccttttgcctaagatcaagtgaagaactacaaaaggcttaaaattctttccaggtattttaggaatcactaaagtgcataaggacaagacttttatttttcaaaaggaagaacaaaaaaaaacatcaattgcttgtacctgcttagggagaataaatctctcagtgttaaattaaatctagctagtatcagaagtttttgcagatatttaaccttacaatttaaatgttcactgaaggacttcttgaaacattagaaggaagagacctctccttgccccaaagtccaatttctttgaaggttatatagagtttcacatttctatagaatgtgaaactcaattttgaaaaacaaaataactcaattttgaaaaacaaaatgaatattgaatcaagcgtaaatagtcaaaagtgagagaaagttaaaggtgtacatggtgtgatatctttgtatagcacagagggtgatataatggtatttgcattcaaacaaaaatgggctcaaactcagcctctcctccttgcttacatcgtaacactgggtaacttacccacccacgtggagcctccttagcctccaccagaacactgtgaacacaattattggaggaacctgcccccaatatttcaatgtaggttctttctattttctgtaagtgtttggctggtctgagaaatacagagaaagagtataaagagaggaattttacagctgggcctatgggggtgacatcacatattagtaggaccgtgatgccacctgagctgcaaaaacagcaggtttttattaattacttcaaaagcgggggggggtggggtgtatgaacaaggagtaggtcacaaagatcacatgcttcaaagggcaaaaaaggagaacaagatcacatgcttctgaggccaataaagatcacaaggcaaaggacaaagcaaagatcacaaggcaaagggtgaaatcaaaaactcctgataagggtctatgttcagctgtgcacctattgtcttgataaacatcttaaacaacagaaaacacagttcgaagggtctatgttcagctgtgcatgtattgtcttgataaacgtcttaaacaacagaaaacagagttcgagagcaaagaaccagtctgacctccaatttaccagggtggggtttcttccccaccctaataagcctgagggtaccgcaggagaccaggtcgtatttcagtccttatctcaaccgcataagacagacactcccagagtggtcatttatagatcccccccaggaatgcattccttccccagggtattaatattccttgctaggaaaagaattcagtgatatcttccctacttgcatgtccattgataggctctctgcaagaagaaaaatatggctctattctgcccgaacccacaggcagtcagaccttatggttgtcttcccctgttccctgaaaattgctgttattctgttctttttcaaggtgcactgatttcatattgttcaaacacacatgttttataatcaatttgtacaatagtgatcctgaggtgacgtacattctcagcttacaaagataacaggattaagagattaaagacaggcataagaaattataagagtattaatttggggaactgataaatgtccatgaaatcttcacaatttatgttcctctgccgtggctccagccagtccctccattcggagtccctgacttcccacgacacacaattctgcatgtaatacaataaatacagttggaatgaagattcaatgtgaaatgctgccctaagtgctgggcttatgcatgcatggctgataggtaatatggtagtgactacattgagtatgatgtgacaacccaaagtaaacttcattttgtttggaatattgaggcccagaggagagatatgttccacaagaaatggcaaactggatgctggcactggtggtgcattgcttcagaataatagaattgacattttcatttcctgaattaatatgaatccactgcagaagcatggtacctggaacatctagaaatgttggttgggtggcatgttactgaatggaattagtagatcctctccatgaagaaaagccactctttcttgccactgtagatccctgttcaattcctggcattttgtgaccgtctattccttcactcaggtggggctcatagaagtgatcatggtttatgttaactttcattgctgttaaaatttaatcctgtgatgatttcaattaaacatttattaattggaataccaaatcccattttattttttatttttaaaatttttattgctaagctttctcatcatttcctatttattttatccatttgaataggtgttaattttgtatatctccatttatattgatatagagtgaaagatataaggaagtaccctttaccttcagatgtctatgtgacgtttttattctttaaggaacaggtaggagcatatatcaattgcattttcaacaactgagattacaacaggtctttaccattgtatgtataaattggatgaattatattacattaattacctttaattttctaagctaacacatattaaaatatatgtatacacacataatggtgaatttgataggcaaaatagtattttattattaactgctttattggttagatttaaactgattttttaaaatattcagatggggccaggcgtggtggctcacacctgtaatcccagcactttgggaggccaaggtgggtgggaaacctggggtcaggaggttgagaccagcctgaccaatgtgatgaaactgtgtctcttctaaaaatacaaaaattagctatgcatgatggtgtgcacctgtaatcccagctactcaggagactgagataggaaaattgcttgaacctgggaggcggcagttgcagtgagccaagatcatgccactgcactctagcctggatgacagagcaagactccatctcaaaaaaaaaaaaaaaaaaaattcagatgggaattagctagctcccaagttagctccaaggcttgggagaaagaaacaaaggctttccatagcctcaaaaaaaaataaaagttttttttttttcagatggagaattagaggctttcagcattcctcagccacttggaaagagcaagacagtgcataaagatcaattctgtgagctttaattcaagaaggaaaatgggattacactggaacggtaaagaacataccagacccagaggggaggatgccagcaaagagcccctctgatggcacctggctgataaaagtgaatgaagccccagtacatgagagggaaacagagcttccctctgtgactcaccttaccactgcccatccaagcaacccagggctacggagagctctttgtttctcccaagccttggagctaacttggggcaaggcctggagacactgtgagagaaagacacctggaaaacctcaggcatttctccagacctgggacagagagcaggacaccatatttaatgtggtcacatacaaactcagccattttttggtgacttggcagcatggccatgcaggcattttcatcttgggccagagattgaagtgcccactctggaatgggtaggagcctccacagtcagaacttttgaaagtaccacagaagtaggggctggaattgtgctctcccccaccacaagcctagaccaggaggagaactgctaaagctgccattgttcctgagtggtgataaaccagggccagattggcgacctgaaaccagtcttaatgagccattgctgggttcgccagcctgcccccctgagatcatggtgcactgggtcactctccactccatctcctggcagaaatccaagcatttggagcacccatttgcctggatccacaccctaagttgcctcatccatcctttacagagatcctggtacagggaggccccctctcttcacacccaggcaggtctccaggcactcagggcacccactgatctggttcatcaacccaagccatcctacacttcctggacacggattgtgattaatcaaggccctcttcactccatgtccaggcagatctccagatgtctggagtaccagctctcctagatcagcagcatgaggaggcctgcccttcctgtgcacagatgctggtccaggaaagccctctctgctacatagccaggcatatctccaggcattcaaagtatctgcgtatatgcttcagtagcctaagtcacctcatccctcctgtgcagggattgtggcacagggcagttctctccactctatgcccagatggacctccaggcatttggagcacctattatcctagattagcagttgaggccactcctcaccccttcgcaaagagcctggagctgaggacgtttcccagctccatgtgtaggcacacttctggttgtctggtggccgttcactggattctccctcagtgcaggtgtttgtgcctgccactgggggacctttggggagccctgcccagtccagctctgctcatcatggcgcctgccacccaggagttgagtagggagtttaggccactgtgcatagaagtaattagcccattgcctgagcaacagagagcttctgacagtaaacaaggatcaagtatatacctaccctgctggacgcagccagctcttacctataaacaccatttatgggcttgtaggtcaaactgcaaagcccaatataaagccagccaaaagaagtgtatatggctatagaagcaaagccaaaaaccctattccatattctctacagtcatacccactggagagagggaggggcacagagagaaagagaaatttaaaaacactattatagggaaagaaagaaaatgaaataacacctcgccaatgtgaaaataattacaaaaattagaagtgccagcatctcctgatgggaaaaaagcaaacacaaaaatttataccataaacaatttgagtgtagtaacatcaccaaacgattaaactagctcttcagcaatggtctctagccaaaatggaaatgacatttaaagaatttgaagtatggattgcagggaagctcaacaagatgcaagacaaggttgaaaatcaacacaaagaaacttctaaaacaatccaggaaatggagaaacagataaatattttaaaatgaaatcaatcagagcttctaaaattaaaaaactcacttaaggaatttcaaaatataattgaaagccttatcaatacactggaccaagcagaaggaagaatttcagagtgtgaagaccttcttttgaactaactcaatcagacaaaaattttaaaaagaatttttaaaaataaagtctttgagtaatgtgggattatgtaaagcaaccaaacttacaaattattggtattcctgagaaacaggaggaaaagcaaaggtagtaattcaataaactttccctaatcttgctaaagacatccagatacaagaaatttagagaagacctgtaagatactatacaaaatgaacattaaaaggcatatagtcaccagactgtccaaggtcaatgctaaagaaaaaaccttaaaggtagctagagaaaaaggtcagatcatgtacaaagagaaccccacctggttaacagtggacttgtcagcagaaactttacaagctaagagagtttgaggacctattttcatcattcataaagaaaagacattccagccaagaattttgtattcctccaaactaagctttataagcgaaggagtgataaaaaattttccacacaagcaggcactaggggaattcattaccactagactatccttacaagagatcctcaagggagttctaaacatggaaatgaaagaacaatatctgctaccacaaaaacacacttaagtacatagttcacagacgccataaagcaaccgtgcaatccaaacaacaaagaaaccagctaactatttcatgatagtatcaaaagctcacaaatcaatattaactttgaatgtaaatagtctaaatgcctcacttaaaagacaagagtggcaagtgagatgaaaaaaccagacccatctgtctgctgtctttagagacccatctcacacatagcaatgcctatatgctcaaagcaaggggttgaagaaagatctaccatgcaaatagaaaacaaaaaggtgcagggattgctattattatttcagataaaacagactttaagccaacaacagtaaaaaaaaaaaaaatgacaaataagggcattacataattgtaaaggagttcaagtcaacaagaagacaagtattctaaatataaaatgcacccaacacaggagcacccagattcataaaacaagttcttctagacctatgacaagacttagatagccacataataatagtggggtatttcaacaccccactatcagcattagacagatcacaggggcagaaacctgacaaattcttgacttaaactcaacacttgaccaattggacctactagatatctacatccatcaaccacagagtatacattcttctcatctgcacagcaagcatattgcaagatcggccacatgcccagccatataacaagtctcaatgaatttaaaaaaaatagaaaaaatagaaatcataccaaacatttactcttgaaccatataaacacagaaatcagtaacaagaagatctctcaaaaccaaacagttacatggaaattaataattttctcctgaatgacttttgggtaaataatgacattaaggcagaaatcaaaaaattatttaaaataaatgaaaacagagacacaacataccaaaccctcttggatgtagcaaaagcactgttcagaggaaagttcatagcatgaaatgcctacctcaaaatcttagaaagatctcatattaacaatctaacatcacatctagaagaatttgaaaagcaagaataaaccaaccccaaagctagcagaagaaaagaaataactaaaatcagagtggaactgaatgaaattgagacccaaaatacatacaaagaatcaataaaaccaaaactttgtgctttgaaaggataaacaagatctatagagcactagctacattaaaaaagaaaaaaaatgagagaagatccaaataaatacaatcagaaataacaaaggtgacattacagcctatcccacagaaatacaagagattctcagaaactattatgaacacctctatgcacacaaactagaaaatctaaaggaaacaggcaatttcctggaaacacaccatcccccaagaatcaggaagaaacccttaatggaccaatattgagttccaaaattaaatcagtattaaaaaaaacaaccgaaaaagccccagaccagatggattcacaactaaattctaccacacattcagataagagctagtaccaattctactgaaactactccaaaaaattgaggagaaactctttcctaactcattgcctgaaacaatcatcacacttaaacaaaaacaggcaaaaaagacacaatgaaaaagaaaagtacaggccaatacccctaataaacatagatgcaaaaatcctccacaaaacactagcaaaccaaattcaatgcatatcaaaaaattaattcaccacaatcaagtaggcttctttcctaggatgcaattttggttcaatatatacaactaaataaatgtgatactccacataaaaagaactaaaagcaaaaatcatgtgatcatctcagtagaggtggaagaagcttctgataaaatcccaccatctcttcatgataaaaaccctcaacaatctaggcatgaaaggaacatacctcaaaataataagagctgtctatgacaaacccacagccaatatcatgctgaataggcaacaactagatgcatttcccctgaaaactgcaacaagacaaagatgcccactctcaccactcctattcaagtggtattcatcagagtaatcaggcaagagaaagaaataaaaatcacccaaataggaagagaagaagtcaaaatatctctcttcatggagggtatgactgtatacctagaaaatcctaaagattttgcctaaatttggcacctggaactgaaaaacaacttcagtaggatacaaaatcaatatacaaaaatcaatagcactcctgtacaccaataacgttcaagctgagaaccaaatcaagactgcaatgtcatttgtaattagccacaccaaaaaaaaaaaatgtctaggaatacatctaaccaaggagatgaaagatctccaaaaggagagttacaaatcactgctaaaagaaatcatagacaacacaaccaatggaaaaaacattccatactcatgaattgaaagaaataatattgttaaaatggccatactgcagcaacattctatatattcaaagctattcttatcaaactattgtcatggaactagaaaaaaactaatctaaaattcatatggaaccaaaaaaatagcccaaatagccaaagcaataccaagcaaaaagaacaaatccagaagcatcacataacccgacttcaaactatactataaggctatggtaaccaaaacagcatggtactactactggtactggtacaaaaacacatagaccaatggaacagaatagggaacctagaagtaaagccacacacctatagccatctgatctttgacaaacttgataaaaataagcaagggggaaagggctccctattgaataaatggtgcaagaaaagctggcaagccatatgtagaaaaagaaaactggacccctacttttcaccatatacaaaaatcaactcaagatagaccaaatatttaaatgtgagacctcaaggtataagaatcctaggagaaaacttaggaacaccattctggacattggccttgggaaggaatttatgactaagtcctcaaaagcaattgcaacaaaaacaaaaattgaccagtagcacttaactaaagagcttctgcacagcaaaataaactatcaacagagtaaacaaaaaacctacagaataggagaaaatatttataagctacgcatgcaacaaaggtctaacatccagaatctataaggaacttaaacaactcaacaagcaaataatcccatttaaaagatgggcaaagtacttgaacagatgcttctcagaagaagacgtgcaagctgccaacacacatatgaaaatatgcctcatgtcactagttatcagagaaatgcaaatcaaaaccacaataagataccatctcacaccaatgagaatgactattattaaaaagtcaataaacaacagatgctgatgaggctgcagagaaaagggaatgcttatacactatcgactggagtgtaaattagttcagccactgtggaatgcagtttggagattttgcaaagaagttccaacagaacttccattcaatccagcaaccctattactggtatgcatccaaaaaaataacaaatcatcctaccgaaacacatgcaccctcatgttcatcatagtactattcataatagcaaagacagtaaattaagctaggcacccatcaatggcgaataggataaagaaaatatggaacacatacaccatggattacaacacagccacaaaaagaatgaagtcatgtcctttgcaacaacatggatgccactggaggtcattatcctaagcaaattaatgcttaggaacaaaaaaccaaatattatttgttgtcacttataagtatgagctaaacattgggtactcatggacataaagatggcaacaatagaatctggtgtatacttagagtggggagggagagaggggaggaagcttggaataactattgggtactatgcccagtacctgggtgatggaatcattcataccccaaacctcagcatcacacaatatacccagataacaaacctgcacatgtatcccctgaatctacaataaatgttgaaaaaaataagaattcaatttttttcaaaactttattgccctaaaattatgttgtcaattagtttatgcgttttataatatttaactcttttcctaaatgtcatttattttacactagagtgtaaaatgaaaaattagatttggctcatttatttgtttcaattttgcaagcatcattagatgaatattttactctcattcactgttatttgatgctcctttatcacatactttatgtgtgcatgggtatgtctttgtgtgtctctgtgtgtatgcatcaagttacttttcaggttaccagttattatttctatgttcattctgtatatttattgctatgtcaatatactccctaaatttctgtggttttacaatatatttcctatttatgtatgtattttgatatcaaataaaaactcatttaattttaacttttaatattttccttgctaattctttctatttattttgtctctctgaatattaaaatcatggtgtcagataatcttcccaaatctcaatgtattcatacaattgaattaaactatatatttgagaatttatatttttaaaattataaaaaattataatatacagaaaagaagaaaagataaggtaatactcatttacccatcatctagattcaacaattattagcaatttagcatacatatttttaaatttttgtttataatgtatatttatatgtgtcctacacacatccatccatacatatatatacagtgtacatactataatatttatgtgtgtcctacacacatccatccatacatatatatacagtgtacatactataatatttatatgtgtcctacacacatccatccatacatatatatacagtgtacatactataatatttatgtgtcctacacacatccatccatacatatatatacagtgtacatactataatatttatatgtgtcctacacacatccatccacacatatatatacagtgtacatactataatatttatatgtgtcctacacacatccatacatacatatatatacagtgtacatactatatataccttttatatatttatatgtgtcctacacacatccatccatacatatatatacagtgtacatactataatatttatatgtgtcctacacacatccatccacacatatatatacaggtacatactataatatttatatgtgtcctacacacatccatacatacatatatatacagtgtacatactatatataccttttactcacacataccctaaaatatctaaatcatgacatttccctcttaaaaactgcggcatgtgtcccccaaaatgagaacactcccttatttgaccattattaggggcaatttcaataataataatgctacttatatcttgagttctttcagatttggaggtaaatgacagtatatgaaatatttcatgtatctctataaatactgatataaagagagagatataaataactgcattttgtgatcagatttctatgtgactttctttaatcccattgagaaatggtattgacatacatcggctgcattttccacatctgagcttattacttagttttgaatattgtttctacaattagatgcattatgtaaataacctttactttcctgagctaacacctatgctgtggtggtagatgatttctttattgttctagagacttagctactgatattttatatagacttttgcatccaaattcataacagaatggcccttggtatttgtcctcttcatgctacattgggcaaattttgagctcagcaattcatttaacttacaaaatatatatgttggctttatttcttatgtattttagattcatttgtggagtataagaattatattctttacattatctaaaaacctgcctggagatatcgagctgtccatctatctacctcaagatgtcaccaatagatagacatacacatatatatgtacatatacatatatgagatatatatgtgtgtgtatatttaaacatataacaaaacttgacatctttacatatgcatacacatgcatgcacaaagacctctcacagttccgtaatccggggcattttatgaataacaatgttttttcctgtttctgaggttgtctcttcagattttctacttcttccaaagttcattttgaccatatatgtctcctgtaatgtcaaatatcattttaaaatgagattaccttatgtcaacaagtattttcatatattcatttataattcacttttagctccttgtatgttctctttccctcttcatccctggtttatttagtcataagttcgtatatacagatacttcccaggtgtggatgcactctcaaaacacaaaacaaaatttttaaaaaaatgagacgttactggagaagatttttttatttttttaactaggaaaaacattaaaagcatattaagcgtaactgaatatccaataattccccatatctaggaaattatatactgtgtaacaattttgaacaaattatatattatgtgtcttagtgttttcaggctgccataacaaaatactattgtctgggtagcttattaagatcagaaatttgtttctgacagttatggaggctggaaaatccaagatcagggtgtcaggacagtttggttttagcaaggtcccccttccaggttgcagactgccgatttttcagtgatagaagtgatagaaggaacaaatgagctccttagagcctgttttacaaggaaactaatcacatttatgaaggctctcctctcatgacctaatcacctccaaaggccacacctcctaataacatcaccataggggctaggattttaatatatgaatttgggggcacacatttagaccacagcactatgtaatcaggatatatacatatggtgccccatttcctgccactgtatcttatattgaagataccacctaaacagatgcttactttctaaatacctcctatggatattggaggatattctagttttaatagcagattattttaagtattttcatagtgtttctgaaccataaaataaatgaatctgggattgtttagttttgttggtgaatgttaaaacaaatgacagagctttataataaatacctgggcagcaaaagcatatgaaaagaatgagacaaagtggggggtcaggaagtgggaggaggagctcataaagacacaagtgaaaagagactgtctttatgttctctcttttagttgcattcccagatcttatcacattttatggaccctgaaatcctaatgtgaggacatctgtttaacagccaatgaatcaaacaaatgattcccagggggctctaacagctcaaagtttgccttgcaatttgtatcaagtgattttaagtagattcgctatctaaacatgaactcccgtaagaaagcattgcttatgcctatggggggcgtttttgctgtcatgaccctaggaccaaatactgtcttaactacagagccaactggacacttttggacagctgtagaaagtagaacagttttgcaactaattttactgattagtctaaacttaaaccttaccatataataataatctctaagggctttctttagatcagtggtcagcaatttttttttttataaaggtccagataataaatattttcagctttgccagccctgtggtctctccccaaactactcaactttgctcctagcatgaacacaaccacaaacaatatgttaacaaatgaatgtgcctgtgttccaaaaaaactttattttaaaaagacaggcagtgggctgcatttgacccagagctatagtatacttccccccgccgcccacctccccacccccaccccgtttcaagcatagtctgggtggtttattcacaagcaaagtcaattataattggaataattgcagtaatatttaccaccacagaaaagaaaaggtgttttaacttgtcttactcagattccaaatctgtctttctcaacattccctctcccttacgtatgtaaagtcagacagcatggctccttaagaaggagaaggaggaagagaagtggcagcaactatgctctcttgcatttgattagaaataaagactccccaaattatgtgtttatggaccaatgtacctacttcattttatataaataaagcactggttcccccagaacgtctctaattctggggacagttcagcaatatttaaagactctttctaagatattttctagtaatttatatagcccaccagtatttgtatgttcttttgtcctaccaattgtttccataaaaattgcctaattatgtctgtcttaggaaagttctcacattgctaagaggtaaatatttgtacctttgcaacctgtaactgtactacaggcaatgggccctttcgaactaccttcaccttctattaccttaacctctttatccctataaacaaggactgtaggccattcccacagtaaataaattttagtgcaggcactaaaatcagactgcctagggttcaagtacaaactacatcacttacaaggtgtgaatagaagaccatccagcagcaacagtgaaggcacagaaaactactgtaagtctgttgcagtaactttggaaacagatgatagtggtttggaccatacctcgagtgctggtagaaattggtcataatacggctatgttaaaaaataaaacttaataggttttctcagtggattggatgcaaagtgtaagagaacaaaatgattgatgaatacactacagtttctggtcagaggaacaggtaaaatggaagtgacatgacctgagctggtgtaggttatgtaagggtaagtcttgagcattggggataaagaaagtaggtgttttattttagatatagttagtgaatatgacggttttatgtttcagcttgactacgatacagtccccagttagtcagttgaaaactaatccagttattcctgtgaaggcattttgctgatgtgattaaagttcaaaatcagttacattcaagtaacaaagattatcctacctaacctgggtgggcctcattcaatcagttggcggggcagagctgagaattccatgaagaaaaacaaattgcttcagcagacaatagctagagcccttgcctgagagttccagccttctctccgatctctgattttcctatccaggcctcccatcatgtaagtcaattccatgcaacaaaatttctgaaagacatctcttactgattttgcttctctggtttgatgctgactgatacatgattcagtgaagacttagatatctatcagtcttgagttggaagagaggtctaggctggagatagagatttgggactcatgagtgtatacaggttaattataggcttgagattggatgtgattatctgtataatgagtcgggagagaaaagaaagactgagaacagagctctggggcacactgcaacatggaactaaagaaatcgaaaagaaattgaaggagtcaggactacccagagatgtttgaaatgagctcaaataaagtagagttctggaagccaaatgaagaagttgagctacttgggaggctgaggcaggagaatcgcttgaacctgggaggtggaagttgtaatgagccgagatcacgccactgcactccagcccaggtgacagtgcgagacaccgcctcaaaaaaaaaaaaaaaaaaaagagagagaaaagaataaatgatgaagtgaaaaatgtatggatttgaccagatcaaaattagggattttttttctacgtgggacaccttggagaaaagtagtctggagaaacagagttcttaatatctaaaaccaacgtcaatgtggaatacacgaacgagtggctttaaatcacaccacgaacagcaaagatatcaaatttgaaagaaaaaagtattttaaaaagtaatttgctaaacaagatactgtatataaggagatattctatgtttctagtagtcaggaagaaacgaatattaaaacaaccatgaagtattattttatatctatcacattgataaaaattaggatgtgagatcattttaactgccagtgatgggcaaaaaaatgaaaacactcaggacccagctggtgagatataaagtggcacagactttctagagaacaatccatcagaaattaatgaaattaagtatgcattaatgtaatcccactcctggtgttattccccaacctcctaacttgccagcctgaagaaaaactcatgcataaattaatatggtggcaagtacaggatgtgctttgcagcactgttttacgcaagcagagaaatgaaaacaacctagatgccctgctaaggtgataaatacagtggattctttcagttggctataatgcaagagaaataatgaatgagagttatatacagcaaaatgaataaatcaaaaacaaaacatctaatggaaaaaataaagatgctagttcagtattctttatgtgaattcgcacaaggaaaatcatgtttttaagaaactacagatctcaggtcgtatattaaacactctctagtggctgtttctgtatggatagatagatggatagataaagacagtaattttaaaaaataatgagaagaaacaaatcttgcagagatgatgattatggtttctcatgaactgcagaatatctgagtttaaaaactgttttaaattttttctttaaagaacataccaacaatcaccattccaaatcttcactctaccattattcatgtgattagccaattgtgctctcattgaaaagaacctttagtttttcttccttattggtaaaagactcctctgttcagctagtaagaataacacacttctcagtaacctccatgctgatctctgtttactctctggtcattaaacaggagctttctctttctaattaaagctttccctgacagagttgccttcgagcaggtgtactgaagttcctttgaaatgatgaaatgggagaagcaagtgagtctttatattttcctttttaagttgccactgttctctcacagtattagatggcaatgcctaaacatctctgtattttgactaatttataatttcaagtaatagacaaaactactaagtgtaaaggcaaaactctaaagcaattccatgcaatctcaaaaaaatctagtgccaatttctctaggtaaattatggttcctttaccaccataatttataaatatttgatatttccaatgtgcaataaactaggcacatcatgtgaaacttggtataggaggaaatgtagttttaaaaaacactgacatactcagaaaactgtcatgtaacattcctttcccagtgacctctaaaagactttttctaaactcgtttgatttgtgttatctaaaatgttgcttccttcctctggccttctctcttagctttgtgactgtcaatgggggatttactttgaatgtccctacaagttgattgattaatacgacaatatagtctaggtcagaaactgccaccaaggctgatgtattgattgcactatcaactgaaatactgaaataacattatgtagaaaaacccagttagattttttttttaatctgaaaacatattaccgtgaaagcaacagaggtaggaaggagcatctcccttgacctagcaagccttatttaatacatgtcaaaataaatgatgcagtcaagaaaacatttaatatgatcaagcaatgcagccacctataggaagtttcacacagtgaggcatgggcagaaatgccttcaggcttacataaagatgggatcattattggatgtgccttcaaacaattaggctgataaaagttgaaaatccattttgagcatctgattttggccccctgattatcctgaaatgtgtccaaaaggcaagacccctcccccaagtgcatccagtacgcaaaacttcaagccaaagaatatataggcgtatatttttttgatacagggtctcactcccgttgcccaggctggaatacggtggcacaatctcagctcactgcagccttggtctcccagactcaagtgatctcacatcagtctctcaagtagctggtactacaggtgtaggacaccacttctgactaatattttgcatttttagtagagacgagatttcaccatgtagctgaggctggtctcaaactcctgggctcaaacaatgcacttacccaggcctcccaaagtgctgggatcacaagcttgagccaccatacatggcccaaagattatatcttgagacttaaggtttaatgttatttcccctgttaggttctgggacctgtccctcctttcttctttcctgtttctccatttatagtgggcatatctgtcctgggcctgtcccaccatttactttggaagcacataacatgtttgatttcagcagttcacagctggagaggaatttgccacagggtgaatcatcatacactgagtctcacccacatctgatttaaataatattaagatacaatttttgactttaggctttgaagtagatgatggaacaagagaagactttggggactgctgggatataatgtatatattttgcacttgaggacagaaattttggagagacaggtggaatgctgtaaacaaaatgtttatatctcctctaatttgattatgttgaaatcctacctttcagtgtgaggtatttgaaggtggagccttttgagaggtgattcgtttatgagggcagagccctcatggatgagattagtgccattataaaaaagacacacacccctcccacttttgccttgtaaggacacagccatctataaactggaaagcaggctcttaccatacaccaaatctgtaagcaactttatcttgaacttcccagcctccagaaccatgataaataaatgtctattaattataaattatgcagtccttggtagttttctatagcagtctgaacagacacaccccaatttcaaaatttcatagaaaccattaataatatgcaggaaacttaaaattccttcagggtcaagaatatctttaccagaaaagtatagagtatctacatctccccatctttcttctcaatttttataggaaacacagaaacaacaaactaacctagtaggatggttttttttctctactacttactttatttaaaatatgattttaactctactaatttcacaataatttaaaactcagaatcacaaagaggactcagctccataccacttagttcttgccttaacacattaacacttagagccaaagacatataatatctaggctagttttttttaatgtagtataaatatggaattctactgcacaaaggaagtatgaggcagaagccaaaatgtacgcagaagagcatagtagtgccgtgggcagggcagggagggtgtattagtccattttcacactgctgataaagacataccagagagtgggtatgtctttataaaatttataaaggttcacgctgctggtaaagacataccggagactggttgatttataaaggaaagaggtttaactaactcacagttccacatggctggggaggcctcacaatcatggtggaaggcaaggaggagcaagtcacatcttacatggcagcagacaagagagagaatgaaagccaagcaaaggggaaaccccttataaaaacatcacctcttgtgtgacttattcactaccataagaacagtatgggggaaaccacctccatgattcaattatctcccaccaggtctctcccacaacacatgggaattatgggagctacaatacaagatgagatttgggtgggagcacagccaaactgtatcagagggacagaatctggtctgtaagctgcttggcccattcactcttcctctgccctaactcctcccccaacaaatggaatctcaagatctttacaaaccatatttttcaagttgctggtttgaatttattagatatgaattaaatacctccaaaatactccttctatttcctaaaatgctaattcatatttgtttatcttaaaggatatagaataaagaatcttcatttagagggaacattaaaaacatatagtgcatgatattttattctatcaatcacccaacaatttttttaataggtctggagcttatacaaataaatgacagggaattttctggtaaggttttttcccatgacagagtcaccttgtttgtgtacaaaccagattcaagagactatcttgtatgttgcggttcttgtcacaaagggcatcttaatgccccctccagacctagtgcctgcagagaaggaggcagtctcttagtccccaaacagttggcttgttatctctcattccctaaaggggattatctgtatgtgtttgcttgaatatatattcccagaagtcttcatcactgtgttgaacacaagtttaatttcatgactacagattctgacttggggaaaaatattatttttagatatcagtattaaaaactatggtattatacgaggaggttgatatcactttactgtggatgccaaaataatttatcacaaatttggaggcataagacaatagaaaattgctgtgtcatgattcaggagaccagaagttctaagtcaaggtgctggcagaaccttgcattctctggtgcctctaagagagaatctgttctttgcctcttccaacttccaatggctgccccagccttctgactcatccagtctcttccttctgtgtcttctccttttatgtgtttcaattatccttttgcctttcttttataaagaaacatttttggatttagcactcacccagatagcccagaatgatctcctcatctcaagattcttaattacatctgcaagaccctttatccaaatcaggtaacattcacaggtatctaacattagggtatgaacatatgtgttttgggggcctctattcaacctactatagtctgcctctctctgtctctcaaaaaaatcacattcattctatctgcaaaacacattcaccctatcccatcatcctcaaaagcctcaacccattaaagcatctaccttaagtttaaaatctcatcaaaatatcatcagctagaaagtcccaaatctcattatctaaatcatccaaataatctatgagcgagactttgggtatggtccatacccaaagtatgtttggggtatgggtcaagattgggacaagttttctctccatctgtggacttaagaaactggaaaataaattatctccttaaaaaatacagttgtgggataggcatagaatagacatccccttcttaaacggagaaattcgaatgaataaagagatggtcagtctaagtttgaaatccagcaagataaattctattggatttcaaggccaataatatttctctgtggcttttctacgttctgggcccatgactctgccaccctctgtctctgctctgacagctttacactcagagtcattctttgtcttgaggagtatcacatgtttgtaaccaagtagctgtattagccaatttctggcctgtggtattccaaaaggccaacagcttttcttcatttcatcccctgtgctactgttccctccaggctggcaggtttctcctgatatcacattttcaaaagccatgtggttcttctatacatggcaagaggatccactccattagacaagagagttctccacagctcatttctaggtaacctcatttcaattcttggcttctgctgagatggatcagtgaagccatgaatttcattcctaatttcttcagcaaaacactgtccagccacacccttgggcactaattctagaacatgctttcgcaagagtaaattttctaattttaatatcgttttaatctggataggacaaaaacctctccaaacatcaagtgttgctttctttttgcttaatagtttttccctcaatttatctctttcctctcatattttactataagcggcaacaagaaagcaaggcacaaccttcaacattttgcttggaaatctccttgcctaaatatccacattcattactataaattctattttccataaaaaattaaatttaggcaagtaaattacaattcaaccaagttttccatcacactatacagacacaccttgtcttaaattgagggtttgtggcaaggatgggtcaaacaagtctatcagcactatttttccaaaagcacgtgctcactttgtgtcactgtgtcacgtgtcacattttcgtaattcttgcaacaatattcgaaacttctccttattttcatatgtgttatggtgatctgtgatcagtgatctttgattccaattcactgaaggctcaggtgatcattagcattttttagcaataagtttttattaagatacgtacattgtttttatcgacataatgctattgcataccttatagactatagtataaacataacttgtgtatgtactggaaaaccaaaaaattcatgtgacttgctttattgcgatattagctttaaattttgtggcagtcttgaaggaaatctgtcacatctctgaggtattacctgtaataaagattgcctttcctccagtttccaatcatgtgttcctcatttctttctcaatccttaccagcaaggtctttaatattcatatttctaccaacattgtgctcatgacaatatatgtattctctacgacaacagaaattttctctaccattcttctcacttccttcatagccctcaccagaatctcctttagcatctgtatttctgctaaccatctcttcaaggcaatctagtttttgtctatgttgcttccccaaattcttccattctttacccattcttcaattccaataccacctccacatttataggcatttagtacagttgcaccctacttcccaataccaagatctgctagtttcctaaggctgctattggtaataaattaccaccaacttggtagcttaaaaacaacagaaatttatggttgcatgattcaggaggccagaaatcctaaatcaaggtatcagtggacccacaattttctgggggatctaggagagaatccactctttacctctctcagctcccggtagttaccctggctctccacattcctccaatctctgcctccacaatcacgttgcctcctcttattctgcctgtgttatcctctcttctgtctatgtcaagtctccctctgtttccccttataaaggcacttatctttgagttaggacccacgtagataatccagaatgagttccttatctcaggattcttagtctaattacttacgttaatagtcacagattttgaggattaggatcaggacatattctttttggggacacctatggtaactattagaaaggtcaagttgtttattttttactctgaaataactggactttgaacatgtgaaattcctctggagtttgataatcatatgattaataaaggtattgatgagaaaaatagggaacgtgtgaaatatagacaccatatactagagttaaggttacttaaagttctggataaatcaaaacattatattaaatctgcccctagatttgaaatgttcattatgtgagataaaataaaagacctgaatcactgttgtatttacagaagccaaataatttctataaggaacatacatatttcaatgactgtgtgaatatgtgcgtgtggatgatggcacacgccatgctcattgtccaggatttgaaccagaacgcccagtaataactggagtatatgtggagtgggatatacctttaggacactgctgttacttactcctttcttttttctcagattgaatcaaggcctaattgaccttattcaaagtaaaagaatttgtgattgaatagtaattttcccattaatccttttatgattcaactaacttattataatcaggtcccatctctcatatgtaaaatttagaaaacttcaggagttaagaccagcctgaccaacatggtgaaactccatctctataagaagtttgatttaatcataattaagactcattatttgatgagtcagacttgatgccttccacagagttgtgcttatttgtcctctcttggggtgctctaggtctatgctcactgctattgaacacataaaatatgtttattggccacttggtgtatttagggcattcttgaaatgatggtcaaagatgcttattggaagactctgaaattcaaagatgtggaaaagacataaagtgttagtgatacaggagctgaaaagaaattatgtaggcagatagtgacggtaagagagtcctcggtaaggtttcccttttaataaaaagcagcccccaaatcatttttttctaacaaagaacaccctgaaaaatcaagatgcagacatagaaaagcaagctagaagcttgcacgggtgaatgccagcagctgtgccaataggaaaagatgacctgggggccaggtgtgttcaacatggaggctccatctttccttttcttcatcaccaggtgtacagtaaggaacacacaacaggtagataacccatctgcttaataaaagcttaagatggggcgaccagcttctctgcacgctatgcaaaatggcacaactggtctgaccaatctctcgtcccctgtgtaaatcagacactgcctctccaagctcatctataaacccccatccatttcaccacagaaccagaagacccacttgggagcccctctctttctgcaagagagagagctttttcttttcctttcgcctattaaacctctgctcttaacctcattccttgtgtgcccaagtccttgatttccttgccaacgaacctcaggtattatctagatgaacgacaatgcttcattagagccaaactcaagaattaatatcctaaaaaggatattcagaaaaagtcagtatggagaattcaaggagagcttcatatctttgaattcaataacatgaatatttaaatttatgtaattatgtgtgtattattccacattgcattaagagatccttcagtccactgatcctcagagatatgagatggtcttattgggttagtaattcactatagttatatagactctgaatatatagacagagttctccaaaatagaaaagtaaatacatgtcaatataatgagtcttcaaaagtaatccaaatgatacagtaaatgtaaatgaatgaaaccacatttatatcacagagcttcatactaaccgattttcataaatttaccaaagtgctcaaactaattacataactagaggaaaaatgtatatttactgttgtataacctaaaatgtgtgtagccctgttgagtctgagtacaaagaataatgtttcctcctccaattaatattatgaaatacaaaaaaatgcattcattttctctgattgacagccccaattttggatatatattctaactaatggaatattgcaatacatgactcaattacagttgttcagttgtctattttgtaaagtgagaacagtttgaattatatatgattttattgtgtatgtgtcatggtatctcaactgacaacactaccattggtaaatttggctctaatgagaaacttatctacatgcatataaccctatccaattgctcatttcctatctattgttatttgtggaagaaatggaaatgccttcatacttgcatttgacacaagagtacatttaaaattgaatacggtctcaaaccaatggcatataggccacatctatgcagtactaaagaaacaaataatccctctatccctaaactccatccctaaaataatctttctccaccccaaaaaatgatttaaaaagggaaaaaaaacaaaacaaggctggtttctgatttcatataaccaataaggtgctccccaaatatttcattttagccttgtccaaatttgtggacaataccatattttatatgacagttttcagcaaactaaagtgagttgacagatttcagttcttccatgtgtctaattgttcatgccaattgatatgaattaggtaagaccaaagataaatactacacaaatgctactggccagctttcagttaatgaaatagcaatataaaggcaggcttggacttaattatttatctaaagagtctcaaaatgtttcactgcctaacattttcctatagttggggtagcaagcactatagagaagagaacaaaagagtattgagatgctcgttgaagactagattgtttttgtagtaatgggtgttgtctcactacttagttgtatgagtgtatgcaacttaacctcttggggctcagtttcctcatacctaaaatgaagaggccaaatacgatgatcaccagcattcttgaagctctaacattacctggatatattgatcagtctttctgctaccttattaaagctgactcttcaattcttgtgtcattctagcaacttcttagagactttaggaacataaattctaagctaatatttttccaggcacaataatcaatatcatgaattgatatttacatagcattttgaaactagtaaaaatcaagtaagttccattaataaagattggttcaggtttacacagatatagattgaaagggatgttattccaagattctgtgacctagtgctatttctactagaccacactgcttcttcctccatgaaagaaaacaagcaccaagcactacctgaatattctttatttttgcatttttttcaaacttgaggttaaattagaaaaatattattcctcttgtttggggcaagaggttgagctacaatggcattttaaaaaatgaaataagatattttggacttaaatataatggtttatatttagttttctagcaggcaatcacaaaatcccttcaaagattgttcagaaatccattcgtgtatgcatgcaatttgctgctgtgcataggcaaattgatttttctatattcacagtgatgcatagtttgtcattttatgagtaagctgcattgctgaattgatataatcaataatcacaaagattcattggctaccttttgttttcataatgcagtatctgcaatgaataacttgacagatcataactagtgaaaatatttgccatttatacgaaaaaccatatgttattctgaaaattactattcattgttaaatattccgacttaaaaaacatggtggttcaacagtcagaaaaatattacacagatcacagctatttaaagatgtctacaagaacatgccattttggtgtatttcagaaacccaaatgcatggaaaaacctctgaccaatgttatttttcagcatctctatcctctctagcaatcatccaacatgaattcatatagacaaatggaatgcttttgagagttaaacatgatagaaattacttacaaaagtcttatttcatatggagaaggaactttaaatttgaccaaaacatgtgttaatttagccacatttaagttgtttttgaagtgagttttatttacttctcctaagtcattaaataaagtgaaattgtaatgaaagggtttttacaattctttaaaatgatttcatatattcctttcatcatttttagtttatccctgttagtgcaacttagtatcaaatataaaatgaaaaatagctttattttatattgactatattatttatgacatgaaaatagtatctgcttgcaattaaaattcattcatattatgcaaaaccatttattaattcattcagttttattcattctttcattgattcatttatttgttcaattatctaataagtatttataagcatcaactatgtgtcagattttatcctaaacagaaaggtaggagtgaacaaaagtcaaaatccttattcttatggaatttacaatctagtggaagaagacagaaaataaacaagagtatcatgaggtaataaactttgtcaatataactaaagcagaataagagcagagggagtgatatagtggggttgtgctatttttcatagcgaggcaaaagagggcatttctgataagatgatacttgaaaagagacccagatgaaatgagagcacaggctataacaaaactgcatttttttggtataatgctgctaatcctctaatcagcttaatatattctctaaattacactcagtaattagtaaaaattaatttttgttgatcaataggatgaatgaattgattcactattatgagattctgtaagttggaaaatgaggttgggtccttacatatatttcacctccttgattcgttaacatttttaaaatatatagttatttcagattaaaaatataatgaaacagtaaaaatgtcattttgcatcataattaattgaatattgttaaatgaatgaatggatatgagttaattactagataccagagttggaagggcctataaggaattatgtaagaatcatacaaactcttcagtaacagtgatcattcaattttttttttctttttttgagacagagtctcgctctgtcacccaggctggagtgcagtggtgtaatctcagctcattgcaagctctgcctcccaggttcaagcaattctcctgtctcagcctctcaagtagctgggactacagacatgggccaccatacccagctatttttgtgtttttagtagagacggggtttcaccatgttggccaggcgggtctcaaactcttgacctcaagcgatctgcccatctcagcctcccaaagtgttgggattacaggcgtgagctgcttcacctggcctcagtgcttttttaaaaaaaatttattttaattgtccaggaaccatgaatttatatcataaaataatctacttagtttttcaacagcttcattaaatagaatattatccctttaattgaactgatatttagttctcttaaaagtagagagaacgtctaccctttggatttatacaaatataactctggtgagctaggtaaggaatgctcacccttaggttagtgacattcctaaagctgataatatatgctacctgctgtcattactattcctggactctctggcaagcagtatgggatacttgagaagtaggtcgttcaccaaattaagctgcagctcttatttgcctctggttcatattccattataattctcagtaggtcaattccaactatcctcattatgtgtcaaataccttttgatgccaataacatcaaggctaaaatgatggtaggtcaacccagttcatgacagtacacttgaaaaggacattttccatctttttttcctgctttcttgatctcaatcctgaaaggtctaataccatattgctcattcataaacataatgtctctttcactcaccttacaacaagtaagcagatgctttgcaatgatgaaccttgattttgctttgaaaagcaatgtagttatgctttatttttacctcatacaagtgaggaactgatgcatatggtaagattttctataacactaagtccatggcccataaaatgtgattttaaatgtcaaaaacttttttataaatagcatttttaaatggagtccataaataagatctttctttcttcaagtataatgattttactacgatgttcctgttgagcacacttttgatacaactatgcctatggactcctatactgtttatccagttctgctgtcttgttctattgtgagatacttggaaagatagtgaattcctcatccctggaggcattttttaatacttggtgaaatcacagtagaagaagctcaagcactggatgcaggattgaacccaatgacatttaatttcactgataacccaagatggtaacatactctgctgtcactatatcataatatctgttgagagggaaggggtaagggtttctagactttatgtagactgtgtggcaatcctttgccctctcagagaccttttaacatttcaaacctattttacttgtttccctagctttgtttcattaggttgagactgtctgtatcattgagaccagctctcatctgcaggtaaacaaactgagggtctctcagggcttcattctactctgccagcatgagttcattatcataatgtttttcattcatgttggacacatttcataggagttagatccattgatttcactggaaaataatcattcatattattgattttgtagctcacaggttctgaccattatccttgggaaaatatacagcattgatagttacctgtcaaccaaagaacatggaggttttactctatcaaatactgactaactcatcttaaaataattgccaatattagcactccttcaggtagaaactcttagaaactaatttgaaagaaaaatgagtaatgggatctttttgcgtaaataaaaattgctctgtgtgttgccatctcagtgaaatgtagcaatttacagctttgtttttaagaaagatcacagaaagcaatgagcaagaaattgtttccaaaaatggtcagttagcattgttcccactttgattttccatggtaatgagtaacataacttttaatcaaagatttgctagccagtcatattgacaaacacatcctgagttcaattcttcaaaacagaatataggctgctctatatgcaaacgagggagagaaggcaatatgaacaagatcaaaatacaaaaagaaagagagataaccaaattctgcaataaaggtgatgaatttatggtataaatctctttgatttgagggcctattgagcaggaagcaggattctgtgggaaaacaagacgggtagtgtatgcattatatgctttagaatgtggtgagaaaaaactacatagggacattagcctattcagccatccctgccacctctggtcccctgagaattctaactgcctttgccaagtgatttagactttcaataatgtctctccatgaacaatgggaaaatgcaacacagtggtcagctcgtttctggcaaaccaatgtaaaactgttaatgacacagtacaccaatgacaaggctttgataattacataaagccgaggtctcctgttacactttgactgaagaactgcaaaaataaagccactatgaaaatgaccaaataaaacatgttgaaaatgaggcaggcgacttctctcgtagacgacattaaaaagcatgaagagaagttactgggatcaattgaccatagattgtcctagtgttgggccctgatagacagctttgatgttgaatgggaagaagggaaaggaatatgggtggtatgaccaggtcaagagcatagacaaaatcattccccattttagggcaaactgtttagagatgaggggagaagaaagaatgaaaacagttgaacaaataactctccagaaatttcttcctcttttcagaattctggtattgctttctcttcttaaccatattagtctcctatacccatgtatctactcatttcagtacatagtctggcctaaaagagaagtttgcattggctttcagctatgggagtttggtttatacacattgttcatacagagagtatgaaacgagagaaatataggatgaagaaatatgagagtatgcacaataataaacataataacacattgcggtgtcactgaaggtatagggttaacaggtgcagagagacagaataacgtttacccaaagtgcacctgctatggagtctcactaccctaacttgaatactggattcatcattatatgtaagtttgattggtaacaagttctttatgttctttgagcctcaaccttcttgtctgtaaaatggtgataacaatcatgttttgcaaagattaaacgagatatgtaaagctttcttaaagtgcttgtactttttaggctctccatcaatggtaactgccattagtagtagtggcagtagtagtaatagtagcagcagcagtagcagcagttgaaggaggaggaaaaggtagaaacattttcttgcaggatgtagtaagctactttcatgttgcatttgtaggatccagaattaaaagtggaacaacccagccaaaaatacataggaagatgacaaattacaaggttgagcttaagggctgccaaattgccttgcctctaggaaacgacagcaacataaaagactatatcctgcagcagccagtagactgggaaagccagaaccatcagtgccttctgccacaggccagccaatccaccaggtaccagaagcatgttcctctgcaaccactgtgtcataaataacaggaacaaggagtataattttgatgtcagattggaccacaaacacacataatgtatacaaattaaaaatgttaatttaatactgttatctgtcatccaacaaaatgaatccagcaaaaatgctggattgtttctatataatccaatggttgatttttcaaatactattactctcttttctatcactaacagaggaatttattttgctgattttttttagacttcacagtctttgatattttctttttttctttaacaaatgttcataccacttttgatgtcctctgccacattgcatgtacagaatttttgttttacttctgcaatgagctaaaaatatactcatcagcaaaatatacgtagctttaacttcatgtatctgttttatcctgaggaatacaaaaattgttgaaaataaataagatgctttcatactaaggtgaaatttatctgtttccttttcaaagaaatacgtgtgacatccatcttttggagaaaagtaaagcagaaaggtaagataaaatggcccttgctggcttatttattcacggaacgtatggggatggagtcacataaactagcaccttaacagtctgtattgttgcataagaggcaaacttagaatccaaggtagtaggagaaaaagtaagaggatggggatagattttaacctgtccttgaaaaataagttctctatctcaagagtgacgcatttatctccatttaaaaggcgaagggtgagtctgagtatgtgaccttgggagacatgctgaataatttttaatgtccacagtatatggcatatcaacaataatagcttcatttgaattaccaagaaaaaaatagcagctgaatccatatatcaaagaatgactcattctggattttcttactatattttccattaaacaccctcagcttcatgtaatcaaactctctccatcacatggggatgcttttttaggacactttcccgaaaaatagatacctcctctctgaacctccagttttggggaaataattatgttgtattttgtatagctcatgtatttctttgtttgttttcttttcttttttctttttttttgtttttgtttttgagacagagtctcattcttgtcacccaggctgaagtgcaatggcgcaatttcggctcactgccacctcagcctcccgggttcaagcaatttgcttggctcaacctcccaagtagctgggattacaggcacccatcaccatgccctgctaatttttgtattttcaatagagacgggatttcaccatgttggccaggctggtgttgaacccctgacctcaggtgatccacccaccttggcctcccaaagtgctaggattactggcatcagccgccttgcccagccagctcatgtttttaataggctgtttgttttagtttccataaacttagtgggttaaaacaacataaatttattatcctctagttctggcagtcagagtatgcactggagttcactggactaaaataaagatgttggctgagctgcatttttttctggagattttggaggaaaatctattttctttgctttcccagcttctagaggccattctcattttttggttcgtgatcctgttccatggtcagggcctgcaatggctgttcaagtctatctcacatcacataactctcacactgattgttccctttattcttccacatttaaggacccttgggattccactgggcccatctggataatgcaggataattgccccatcttgaggtcagctaattagcaactttaattccatctgctacgtaaattcccagccgtgtaatacagcacagtcacaggtgatagggactgaggtgtggacaaccttgagaaaccattattctgtctgctgcactattccagatgttaagcccagtgtttctctcagttaaacttcacccaatactgcttattattctccctggaaccacatggaagaggtgtaattcatcttccacaaggcactctggaataggtaaagacatctcccatgtttccttagcctccaagtatatcaggtattttaatcactttgtggatcatgcagttttgcatcttttctctgtccagaaataaataactacaacaaaaacaatacgtaaaatttattgagcaatgtgctagattgagtaaatgtagacatacagttactcatttgcaagattttcacattgaactatcacaaaaccacaatggattttgtgctcctattgtctgcattgtataaatgcaagccctgtgagattcagagggtcaatgtcactcacccaagattacaaagacagaagaaatcagaggtgcaacttgagctcaggtctgccttactatagaagttgctcatttaaccatatgctatactaagggatatatcctattttgacagtgcttctctaaaattatagttcctagcactcaatgtcatgtctcagacattttctctgcaatgtatgaaacaattttgtcctagaaataggtcaacgaaccactgaattttgaacagcagaaacatagaaatagagacttggtctgctcaaaaacagttctgctaggagaaatgatattatacttctctataaaaccaagggttcatggagtgggcaaggagaaaaaatatatatatctctaaacagttcagcatttacattaactatgttgaagcataattatcctttttaacaacaatcttatgcaaattatttcagtcacaacatttttaatgctgaatttggctaacatatacaagcctatatacagaactttatcaaagagtcaaattcaaaataaatattagatcttaaaatgttactagcataattaatttttgccaaaactcacctgcacttagaagcaattcatcttaactagctctactcagtttcttaagagcagaaataaaacatgtgggtattttttttaataactcttactccctagtaagacaaaacacatttgttttattcttatgcctgaaatatctcgtgtagattcttaagattgtaacaaacctggaaattaggagggagatttgccttctgatcctctttccttagcagaaagagaattgtgggaaatatttttgccaataatttattttctttgatgtataaaaaaaaatggaggcagtaagggggtggtcctaaccctcagtatatataatttggctctaggcatgtagaaatcaaaagggagcataaatgtggtctctgacatcgaagctctatatcatgaaaggacacaaatttaaagccagtgatgatataattcagtgaaagaagcacacagcttccaaaaatcagttcaagtctttcctcttgtaacatttgaataaatactctgcatttcattcagtggtttatttaaacatagttattgagtacctgctgtgtgccaggtactatgctaggtataccgaggatttaaatgaattgttttttagggatacaatttttctctcattatgaaaagcacagtctagtaagttgaagaaaacaagtaaaatatatcttattacatagtagatggtattaagtgttaagaaaaaaacaaaaaacaggaaatacgggaaggaagtatagattgaaggaatcagtttttgaaagggtgacctggaaaagccttcctgaaaagaaagcatttgagcaaagacctaaaggagctgaggggttataccatgtgaataactggggagaaagaatagtaagtagaaatgccactgagtgggtgtgtgcctgaggtcttcaaagaaaagcaagaagacaagtgtggctggaacaaagaatgagatctgaaaggaagcggttaggttgatgggttggatcacgtaagactttgtagatatttgcaaggactttggcttttagcctatgtaagataaaattcactggaatattttgattagggaatgaactttatgacttatatattaacaatatcaccatagctgaatgggagaacagggtgggatcaggggctgccataatctagggaagaaaccatgatggcataaatcaagctgacagtggtggaagtggtgagagtttttgacttaagtgtagatttaaggttagagcccatgtgattttttttatgcatttggagatgaagcatgagataaaataaatggtgaaggatgacttcaagaattggggtttcaggccaggcgcggtggctcacgcctgtaatcccagcactttgggaggccaaggcgggcggatcatgagatcaggagattgagaccatcctggccaacatggtgaaacctgatctctactaaaaatacaaaaattagtcaggcatggtggcatgtgtctgtaatctcagctactcaggaggctgaggcaggagaatcacttgaacccaggaggtggaggttgcagcgagccgagatcatgccactgcactccagcctaggtgacagagcaagactctgtctccaaaaaaaaaaaaaaaaaaaaaaaaaaaaaacagaattggggttgcagaaactgagaggatttactatatgtctatgtgtctatgtaaatgaggaaggcaataggtggcacagatgttggatgggacaagcatgagctcaactttgggagacgttaattttgagatgcccattacacatctaagttgacatatcaagtaggcattgagatatatgagtcacaagttcaagggaaagggtccagacttaagatacacatttggcattgtcactttctgtaaagagttggtattaaaagccatgcagtagggtatcttcctgccgaagtgtgttatttagctccaaggctctgtttttgatgttgaggaggaaccagcaacgaaggcagaggagaatcagccaaagaattaggaggaagtaaaggatgtttcacatacagggtagtgtaatcaactgtctcaaatgctaaactgacataaaaacattccatgggatttatccatgcgacatgcattggtgaacaggacaagaagcattttgattaagtggtgggagcaaaggtcaattgcaatgggtttaagagagaatggataggcaggaatggaagcaatttttttttgtcaaaagtttccttaaaaagagggagtaaagaaatgaggcagccacggaggggtaaaagaagggccagatggttttctttataagtttactttttaaaaagaagttatctttaaagtctgtagcaataaaagcatatgtgtcctcaaataaaaaaatgacatttgaagatataggagagaatggtaagattttctgtcaacataacttaagtaagcaagagggtttagaaactaatgtcaagtggattagccttggctaggagcagggacagctcatccactataaaaggaaaggaagcataatatatagacaccgctgttggtaaagttgcagatgtggagtggagactgtggaagttccctctgatggtttttattttctcattgttaaagaacaaggtaattagatggaggttgaagatggaggatgaggtgacaaaaggtaaatgagagagggtagaaattatgatacaaaagagtgtaagcatggatggagtcaggaaatgtgctataattatcagtcttgaagactcatttaaggttaataatcatgaacttaaagtgataagatttaggatggttctgtgttttctggttatgttcagctgtaagatgtaagtgggagtaaatggcagattggatttattatgtgtggtaaagtgggaaaagccaagaaagttgaggatgcatgtaatagaatgttataaaaattcaccatgggttttattccaagtaataggctctcagtgtgggtctaattttcattgcagtggtcatttggtaatgtctggagacatccttggttgtcacaaccgggtgggcgtggtactgatatttaatgggtagcttttggggatactgcttaaacatcttataacacacaagtcagtccctacaacaaagaaatgctcagtccacatgtaagtgttgcaaggatgagaaaccttgagcaaagaaaaaggaaatgaggatatcaggagaaggacaaatgaagtagatcctggtgagacagaagaactgctggacttgggttagtaaaacgagtaaactgcaagtagaatagttttgtagccaaagaatagaatacttgaaattgagtttatatagaaaatgtacatattggtgatgacaatatcaccaagtgactaaagtagggtggaagacaatatgattaaaatagagaacaacaaggaaataagaagcaagggtagaggagggaccacttttgtggatattgacttcatggagaataataacagagaaagcgtgggagacattgacggtgagtcagcggtgaaatcttgaggaaataaggaaataacccaggaacttccagatgactgacaagggtggttgaattagaaggtaacatattaaaagctggaaagtttagagagaaaaattacatggaagtagcagtgaagaacaagaagatcatcaattctacttttatttttgtagagatgaagtcttgctttattggccaagctgttcgcaaatcctgtctttaagcgatcctccccactcggcaaccacacttttaagcttaagaataatgggtgcagaaagaatgtagccactattatcataaggcttcaggggaaaagggattctggggaatgggggactaggaagtttgagtaaaggagtgaaaagcaaacattatgaaagacaatatagaggattttactaacgattgattgtaaggtttcagaagttaggaaaataaagatagggtcaaaagtggaatgtgcaacgcagtgtggagaggaaaggacatgaaggatgatttgggagtgctggatttctttttgtgacttatataataaagaggggaaaattgtagatagttacacttatttcaaagcagaaaatgggggaggggtcaaaatgggaaagtgtaagaaatttgccaagatttgcagagttctgagctccctcttgacctcttgataagagatgtggagtcttatccctgccagttcacatgctgttgacacagcaccatattagaaactgtcgattttctggattaggaaataatttactccagtaacccttgctctttgagctgaaagaaatttgtgaattttaatggctgggatttcaacaatagagtggcttagttattctgaaagatatttcttcttcaaaaacattaaatccttaataaaagagtctctttaatcatttctgggttcacaatatgtaagaacggtatgctgaaaccaaagtgaaaaattgtgagcagcaagcaaatagcaagcttgagatggaaacaaggaaaatggtaatatcaagagtgcaaactatcgggagaacaaaactcagacaagcatcaaggtgaaggtgaaagtgaaacggctatggaagttcaggagataattaaggtattcgattaacattttaattaagaagcatggtaaagattgtgatggtaactactaaaataatacacccgtctgggacgctgggcccatggtcacaaggcctcagccttggggcctcgccctgctctaggccaagcgcggtggctcacgcctgtaatccagcactttgggaggctgagatgggcagatcacaaggtcaggagattgagaccatcctggctaacacggtgaaactccatctctgctaaaaatacaaaaaaatagccgggtgtggtggcacacgcctgtagtcccagctacttgggaggctgaggcaggagaatcgcttgaacccgggaggcagaggttgcattgagccaagattgcaccactgcactccagtctgggtaacagagtgagactccatctcaaaaaaaaaaaaaaaaaaaatagacatacaaaatgtaatttctaaaactttaggggtagggaggaaaacggaaaaataaaacaagcaaacagtaacttaataaatcaaaaccaatgaatatctaatggggtatattccccatgtcttttattttctgtaatttgatgctttgacatctgaggcttttctacccctgaagggactgccccttccagtgttagccaatccccagagacagtaaataattcacccatgaatgtgctcttcaaatgcaaaccaaccagtctagaatctaaaacccaaccacctcctttattgggcttccacattatgggtcaccatccacctgccataatcacccaaggatcagacaattagctagagcccctaagcccactgaaattattcagaatagccagtcttaaactcaattaacctgcctcacctgttccttcttatggacaccacattaaaggctcttgccaacaattttccctctctgcctcttcaccaatcctagtacatccctgcttggcctctcatggcacagcacagcccttcctcttgggatctgagtaacaaactatcttttcaatagcagtcatctctcctgatctcttgggtaaaccatacataagtaatggtaagacctacattttaaaacaaaaggaaataataaaaataaaaaagcaaaaaaaatcagactctagaaacaaatccagatacattcacaatcataataaatgaataaatcttctagttaaaagaagacaaattggataaaagaaaagtaaatctagctatgtgctctttgcaaaagtagatcaaaagtataagggtcagccaggtgtggtggtgcatgcctgtaatcccagctactcgggaggctgaggcaggaggagcccttgaacccggcaggtggaggctgcagtgagccaagatcgtgccactgcactccagcctgggcaagagaacaagagtccgtcttaaaaaaaaaaaaagtataaaggtatggagcagttaatggtaaaagaatgaaggaaaaaaaatacatatatatatacacatatacatatacacacaccaggcaggcaagtattatccaaaagaaaactcaggtatgtatcaatataagactaaaagttaagagagaaattttacaggattatagaaagttaatagttaactagaaaaacaactaaacatctatgcccctagtaagatagcttcaaaatataaaaagacttaataaatgttttatatatatatatatatatatatatacatacatataaatacacacacatatacacaaacacacagatatatgtctgtatatataatttttttggaatatgcctgtaaagcccagataataattgttattgtcagaggatactgtatactacctcactacttccaagtgtagttcacagagcaggaacattagcatcacctatgagcttgctagaactatagatttcacacttgccctagatttcctgaatcagattatatgcacataaatacttgggaagcaattatctgtcacatgctattttttaaaattatttttcttcctctgagtaactggttttttttcactttatttttacctgtaaaatcttatgtaagacttctgattttccctcccacatgtaaggagtttggaagttatcacttcaccctaacaaataaaaagctgaactaactaaaactcaacaactctttttacatcaagcagagaactgtgatctctgaggaggatctctggaagggcaaaccactgcctctccccatagctggaggagcagacaggcagactcaggtactcacaacttatcagagtggagacccatgaacaaaaacttttgcaagagctagtaacatgacaggaaaatctgaactgcaactgacaaactgctggaggttcagtgtggatacaaaattgttatctaatatatacaagaagtcttaaaacttagccataagaaaaagaacaatgctgctgtagtctgagtgcttgtgtggcccccactcccatccccctaaatacgtatgttgaaaaactaatcaccaatgtgataataggaggtgaaatcttcggggggtgattaagtcatgtgggcagagactacatgactagattggtaccctcaaaaaagagaccacagagagctacccagtctcgtccacaatgtgaaacagtgagaagctgcaggccaggaagtgggccctcaccaaacaccaaatctgctatacccttaatgttgaacttcccaaccttaaaaatggtgagaaataaatttctgtcgtttataagtcacccagtctacggtattttgttacagcagcccaaatggacaaacctcactttaaaacaggcaaaagacccagacaacttactaaagaaaatacatagatagcaaagaagcatctaaaaagatactcaacattatatgtcatcagagaattgcaaattaaaacaacaatgaaataacactacacagctattagaatggccaaaatccaaaacactgacaacactaactgctggtaaggatatggagcaacagcaattctcattcattgctggtgaaaatgcaaaaaggtactgccactttgaaggtagtttggcagtttcttacagaaataaacatactcttactatataatccagtaatggcactccttggtatttacccaaatgagatgaaaacttacattcacacacaagcctacacatgaatgtttacaggaggtgtatacagaattgacaaaacttggaagcaaccaagatgtcctttggtaggtgagtggaaaaataaacttggtatatccagacaagggaatatcatacagtgctaaaaaataaataaactatcaagctatgaaaagacatggagaaaccgtggatgcatattgctaagtaatggaagttaatgtaaaaaggctacatactatatgattccaactgtatgccagtctggaaaagacaaaactatgaagatagtaaaaaggtcagctgctgccaggagttagagggaagcaggaatgaatatggaagaacacagagtatttttagtgaagtgaaaatacactgtttgaaactataatggtggatacatgtcaaaagccatagattttttttaactcatagattttataacactgagagtgaaaacttaatgtgaactatggactttgggtgagaatgatgtgtcaatgtaggttcattgattgtaacaaatgaaccaaccactccagtgtaggatgatgatatggaagaggctgtgtgtgggagggaggggacagacagtacatgggaacaccttatacttctcatgcaatcttgctgtgaacttaaaactcctctaaaaaataaagtctatttaaaaagtcttgtataagatttaatcaactattatcttttaaaatgtatttataaataagtcagttaggatgtatcagtgttaattgttcaaataacaaaactaagaaataggaaaataaaagagccatgtatctattggttttggcatctgagcaagaaaaatattttaacaataaagacagttaacttatatgtaagtctcatgtttgcagttgataaaggtgatttcactttaaccttacttcattaacactatatatgagctacaaagataatcgaatgttgtttgtttatttcaaggtaaagaaactgaggctcagtgacttgcccaaaatgcaaagataataaatagaagaattgaaaaatctttacaatatgttcattacctttttactatacaagatagcagatagaagacaagctcaaaagcctaagattgcaattattcctagggtgcttttgacagtaagggatgatttgtataaaataattttttaaaaaaatgtttaacttaactttatatttactagtgggaatatttagttaccaacggtaacaggtaatgtaaaatgattatttggatgttcttggtaggaaaataataatcacattataaaatcagggctgaatttaattttgaagtcttaaaatggaagttaaatggtagcacaaagagcattcaacattgagctaagagcttacaaattcacagtctgattcattaattcacagcctggcattcatcatatgcctcagtttccactctgtaaaatgacaagattgagagtaaatgatcccaaggtttccctctagctctaaaaattctctattctgcacacatatggcactatattttaaagcacatacgcctcctgtgaagtgaaataaagtgaataagcacacggaaatggtacggtgattaaatttactcagagctaaaaatcattgcatattagccttacatatgaaaaaaaaacttgactaatgaatcaaacttgaaggatctgtcagtgtgcagttgtttgacacagaacaaggactgtgaaattgctgattttatcccagtgattcttgtatgggtcacacacagcaaaaagaggggtcagtaagtttcacattcatatatataagcttgtaaaaggaaagaaaaaggagtttcttttgacattgcaatgaactatatgagtcttaatgaacattactgttaaggcacccaagcaaattagcgtttccccacatgccttagcttgcaagaaattaaatttggcctaaataaattaaagcagtggacctgacacatctgatcatttctacctctcaattatttttcctttggtcaggttttcttggaagaaattattcattttgaaatgttgatattctggttggatctatctctgtgctgtatttttgcagctggagaagctatggactgtggatttcaagtgtgacactcactaagaaacccaaggagtcaagaacactattgcattcgtggggataatttcagaatcaggtttatccggaacctggatattcataccactactaagaagtgttgcaattcttttaggtatgatgagaaggcttttaattataatggaatccagtagtcagtggaaaactaaaggcatttgcggaagctgtccaaagataatacaccacaaagtaatgatatgtaacaataatcagattaaaattaaaagtaaaatcatatatataaatgaaatattaattatgccctgcatgatacttagcaaaaccaatgtcaatgtttatgattacggtgaacatttgtcaacactctacagaaacttcccagccaaatgagtgaacatatgcaaaataaaatggcataaaccagcatttctcaatcttggcactattgacactttgggccagatactgttttgtgcgatgctggatgttcagcagcatccctggcccctagccattacatgaaaatagcaccactacctctaagtcgtgaaaaccaaaactatctacagacattggcaaatgtcttgaagagggcaaaatcgcccctaggtgggaaccactggcatgaacaaggattccagagaactgaggtaatcacccctaagaggaagcttcctgcatcatatgtgtcaattaggcaatgagatgtggctaatctgacactggggctgccactaacactaatgactaaggaagcgtatattgaaatatgctggtttatttgtttctgttgctccttgtcctgagctccaacattataaatgagagtggtggttttatttattttgaacttgcctttgttgtgacaccatccattaaaatgcacagtaaaaagccttagaatttcagacccgtaactctcacttgcatacctagccgattggcgcaatatataatacagagcggttcattgcacgcttaaggaagcgtaacctatataggagggggatgaggggcatgccacattgttactgtaaggataaatagtataaatctttcctcaccagattcctccaacaggatgaataaaggtacagataagaaacaaagggatagctgtcaattattggattttgtgagtctttggcaatgtattaaactctgtcgtacatttactaaacataatctccctccactcaagaactaaacattagagggcagagattttcatgaatacatacttgaggcagagaaggaaaacaaagggaagggatagcttatcaatatgaaggatggagaagtgctgtagtaaggtacctgggaataagtgctgtgtctagatttgcttcacattttgataaaataattcaggttctcacataataactgatctaaaagaaatcatgtaaaatggaatatgcaagtttacagacgatattaaattcttctggatagtaacaagcgaatgaggataggctgtggaaagaactcgcaaggatataagggagagtttagaaacaacatatacgcctctgttactgcagttgttaagtggtacgtttaaagaaaaattgaaatgattcttatgaaataatactaagctatccattttcactatggagatgagctaatgtgatttttaaaatttgaaattattgggccaatgatttccaaagacagaaaatatcaagaaggatatttttaaatggaataaaatacagataataacaacaataccaaaaaaaaaaattctcttaacctccaacagaattatgttaaatctaaacctgtaagattttgttcctatgattgtctcttgtaaaaggcataatgaaatttataatatttttgcaataagcaataaatatgatcaagaaatttaagaatatttacatatgaatagactgcaaatgagaattctttccatctgcatggaaggatttattcaccatttataaagtcatagaaaatatgataaaaatagatatgaatttttcaataaggcctagaataaaagaacttgcagatactcattatagcttggaagaggtaacagaggaaaacaataccagatctgacattatacctaacatattgtgcaggctggaaaatgccctaattcaatgtacatcaaacacacatttattctttcattcatttattagactgttagccatggtcacattgaattttatattagagagaatattatgccttcctgcaaagtaaatatgaaatatttataagaaacaaatgagataatagatgtgatacatggctaaactgtaaaatgcaatgcaaatatgagctaaattgtgattgcttatgggtcagaacttgactttgactatggtagattattcaatgaccacaaattattctctaccctccctacatccacaccctttaggaggcacccctacactgactctgagcttggccttgtgacttgctttaacccatggatcgatagcaaatagagacttggaaagcactttgcattgaggcttgccttcttttgttctgcttggaattcttccactaccatgttaagaagcctgggctagcctgctgaaaaaagacatgtggctcctctcctcatcataccagccacaaccaacaatggtaaaacatgtgagtgagaacatgtgaaatcttccaaacctaataagtgatcatagacacatttgcagatccagtagacatcagtcaaggaaaccaaaatcagaatgttccaatttgcccaaagaatcatggagctgaatagatgatttttgcaagctagtaagttttgttttgttttacagtaaaagttgttttataaacttcctgctacctggaagtgaggtgtctttaaagacaattcaaagcttttgaattttatcttgtggagaagaattacagcttccttaatattttatttctttttaatttttataggtacatagtagatccatatatttatggggtacatgaaatattttgatacagccatgcaatctgtaataatcacatcagagtaaatagggtatccatcacctcaagcattcgcccttcgtgtttcaaacaattcaattatacttttaattgtttttgaatgtacaatgaaattatttttttactataatcaccctgttgtgctagcacatactacgtcttatccattctatctttttgtacccattaaccttcctccacttccctcccccaccccctgccacctttactacccttcccagcctctgataaccattcttctactctctatcttcatgaattcaattgttttaatttttagcccccaaagataagtgagaaatgcaatgtttatctttctgtgcctgccttattgcacttaatgatctccaattccaagcatgctgttgcaaataacaggatctcattctctttatggctgaatagtactacattgtgtatatgtaccacattttatttatccatttgtctgttgatggattcttaggttgtttgcagatcttggcaattgtgaatagtgctgcaataaacataggagcacaggtatctcttcaatatactgatattcttcctttttttttttttttttttttcagacagagtctcgctgtcaccccaggctgcagggcagtggtgcaatctcggctcactgcaagctccgccccccgggttcccgccattctcctgcctcagcctcccgagtagctgggactacaggcgccgccaccacgcccggctaattttttgtatttttagtagagacggggtttcaccgtgttagccaggatggtctcgatctcctgatctcgtgatccgcccgcctcggcctcccaaagtgctgggattacaggagtgagccaccacgcccagtgatattctttctttggagtatatacctaggagtggaacgggattgctgaatcacatggtagttctatttttagttttttgaggaccctccgaactgttctccatagtggttgcactaatttacatttccatcaagagtttactagaattctcttctctccattatttgtgatcacctgccttttggataaaagccatttaaactggggtgaaatatctcattgcagttttggtttgcatttctctaatgaccaattttgagtagtttttatataccagtttgccatttgtatgtcttttttgagaaatgtctattcagatattttgtccatttttaaaattggattattagatctttttttcctttcgagttgtttgagatctttatatgttgtggttattaatcccttgtcagaagggtagtttgcaaatattttctctaattgtgtgggttttctattcactttgttaattgcttcttttgctgtacagaagatttttaacttaacgtgatctcatttgtctatttttacttcagtttcttgtacctgtggggtattactcaagaagtctttgcccactccaatgtcctggagagtttctccagtgttttctcgtggtagttttatagtttcaggtcttagatttcaatttttaatctatcttgattagatttttgtatatggcaagagataggggtctagtttcattcttctgcttatgtatatccagttttcccatcaccatttattgaagaaactgtcctttccccaatgtatgttcttggaatcttggtcaaaactgagttcactgtagatgtatggatttagttctgggttctgtattctattccattgatctatgtgtctgtttttatgctagtactatgccattttctttactatagttctgcaatataatttgaagtaatgggattcctccagttttcttcattttgcttagcataactttgtctattctgggtctttcatggttttaaataaatttcagagttgttttttctgtttctgtgaagaatgtcattggcattttgaaatgaattgcagattaagtctgatctgtttctttgttgtttttctgtctagaagatcagtccagtgctgaaagtggggtgttgaaatctccagccattactgtgttagggtctattgctctctttagctctaataatatttgctttatacatctgagtattgcagtgttgggtgggaccatatatatttaaaattgttaaattctcttgctcgactgacccctttgtcattatataatgacctttgtctcttcttacagtttttgtctcgaaattgattttgcctgatgtaagtatagctacttctccacttttttggttcctattggcatgggatatctttttccatctctttattttcagtttatgtgtgtctttataagtgaagtgtgtttcttgtagccaacagatcattgggtctctttttgtaatctgttcagccattctatgtcttttgattagagagtttaatccatttacattaaatgttattattgctaaataaggacttattcctgccattttgttatttgttttgttttttgttttttgtttttatggtcttgtctttcttccttctttttttccgtctttctcctaatgaagctaattttctctggtgatatgatttagtttcttacttttgattttgttggcatccattgtatggttgttgatttgaggttaccatgaggcttgcaaatactatcttataacgcattgtttaaagttgataacaacttaacataatttacataaaaaacaagcaagcaaaaataaaactaaccaaaactctacaccttaacttcatcccccaactttttaaatttttgttgtttctatttatatcttattataccctgtcttgaaaagttgttttagttatcacttttgattggttcatcatttagtctttctattgaagagtagtttaaacaccacagttataatgctctaatattctgtgttcttatgtatgcttactactaccagtgagtttagggccttcagataattacttattgctcatgaacgttcttttttttttctgattgtagtaatccctttagcatttcttgtaggacagatttggttttgatgaaatcctgcagctttttttgtttgggaaagcctttatttctccttcatgtttgaagaatatttctgccaggtatactattctaggggaaacattttttttttctttcagcactttaactatatcatgccactgtcttctggcctataagtttgcactgaaaagtttgctgccagacatattggagctccattgtatgatgtttcttttctcttgctgcatttaggatcttttctttatccttgccctttgggagtttgattattaaatgccttgaggtaatcttcattgggttaaatctgcttggtgttctataacctccttgttcttggatattaatatctttaccttggtttgggaagttctctgttattattactttgaataaactttctacccctctttctccgtttcctccttaaggccaataacttacatttgcctttttgagtctattttctagaccctgtaggtatgcttcattgctttttattcttttttcttttgtctctttggatatgtattttcaaatagcccgtcttcaaactcactattttttttttctgctggaccaattttgctcttaaaagactctggtacattcttcagtatgtcaattgcatctttcagctccagaatttatgcttgattcttcttaattacttcaatttctttgttaaatttatctgacagaattcagaattccttccctgtgttatcttcaatttcttggagttttctcaacaaaggtattttgaatcctctgtctgaaaggtcacatatctctgtttctccaggattggtctctggtgccttatttaatacatttgatgaggtcatgttttactggacgatcttgatactcgtggatgttcacctgtgtctaggcattgacaacataggtatctattgtagttttcacagtctaggcttgtttgtacccttccttcttgggaaggctttccagatattctaaaggacttggatgttgtgatctaagctgtatgtgcattagggggcaccccaggccaataatgccatggttcttacagactagaggtaccaccttgatggtcacgtacaagatctgggagaattctctgtattacctacctagcagagactcttgttctctttccttcctttctcccaaacagagtctctctgagctgcctggagctgggaacagagtgacgcaagcacacctgtgaccaccactaggactgcactgagtcagacctgaagacagcacagcactgggtttcacccaaggcttgttgtaaccactccctggctactgcctatgtctgctgaaagccctggggctctataatcatcaagtgacaaagccagccacttctgtcttcctttccggtcagcaagtttccccaggccctgggcaggtccagaggtaccatccatccaggagccaaagactacactcaaaaactttagaaatttacctggtgttccattgtaccagggctaagctggcactcaaacctcaaaatgcagtctttcccctttctaaaggcagaggaacttcaacccatggccactgccatcacaggtccacaggctactgccaggctaccaccaatgttcccttaagggccaggggctcctcagtcagcttgtggtgaatgctgcatggcctgggactcacccttcagagaaatgggctccgctctggcctaggacaggtccagaaatgcctttcaagagccaaagcctagaatcagagacccaagagcctcttggtgctctaccaccctgtggccaacctggtacgtaagatgaaagaaaaagtctcctttacatttccctccacttttctcaagcagaaggagtctctccccatagtcaccacagctgggaatgtgctgagtctcacctgaagacagcaagtctcagagtccccccaaggcccacagcacactacctgggtatcactattggtttttcagggcccaaggtctcttcagttatccagtgatcaaatcggccaggactgagtccttcccttcaaggcagcaggttctcttctgcttcagggtatgtctagaaatattgtccatgagttagggccttgaaagtgggcttcatgactctaaccagtaccctgtcctgctatggctgagctgatatctgagatgcaaaacaaagtcctcctcactcttccctctcctgttctcaagtagaaagaatgggtctcttttagtaccatgagctgtgtgccaggggaggtgtggcaccaagcactcccctagacatcccagctggtagatggggatctcagtagattatataccccccaagtcccctggctctgagcccaggtcagcactaagactcacctaggaatggcagtcgttgtggcccacactgtcatttaagcttatttagagccccatagcactttagcctgcagtggcaggacttgcaagaactcaagttccaactgctaggatgggtgattcccctctggctagggatgacttaaataccccctccatgggcaggcatcagctgagttcattccagttttgctttctattataacagggcagcactaaattcaatacaatgtctcacaattacttccctctctctccctgaagcactcaaattctctctctgcaccaaatatcactgctgagaggtgagagaggggtggcatcagtgattcaagactgtttttcctacctcttcagtgcctcttttcagtaatatgtagttaaaacaatgtactgtgagtgcacacctgatttttggttcttatgaagatgcttttatgcgtgtagatagttattaaattggtgttcttgcagggggggacgatcggtggagtcttttattctgccatcttgttatgcctcctcccaagttacaccttctaaaaaacaacctccaacagggctttgtgagaaactaagatgataagacatgaaagtgtattgaaaattgtaaaaattaattctagggacaaaataacatagacttaattttctctgttcctcccctctaaatacatctaaatactctgaaaataatttaacagccaatcataaaaagactctgacatgtggaaaggatacattaaactataaaagatgctcgagacttgaggagtaacaccacagtgaatttcctggattttttttctttatatctcatatatcttagactgtggaccagagagggctgcaatctggaactgccaaaagacatagaaaaagaaaagaaaagaaatgaaaacaaaagaaaagaaaatgaaagaggaaaggaagaaagaaagagaaagaaagaagcaaagcttgctctctctgggaaaaggactatgaaaggaaaagcctaactttccttccatggaggcaccagcagagatagaatatgacagccactggcactaggtacgtggagaataggtcaagggagatgctctccaatcgtccccctcacaatggcccatggaagaaccctccatcctcaaagcaaaccagcaaatatttagtgggcattcaaacagagccagaagagccaagccaaccagattagcactgcaaggaattcaaaaactaagttcttactgggatataacccagaaaagtaggtcacaacctatatgctgaactgtcgagtccagctcagtcagggaggccctaacccagcagcactaaaggaattaaagacacacacacagaaatatagaggtgtaaagtgggaaatcaggggtctcacagccttcagagctgagagccctgaacagagatttacccacatatttattaacagcaaaccagtcattagcattgtttctatagatattaaattaactaaaagtatcccttaaaggaaacgaagggatgggccaaattaattgcagcaggaacacgcccttaagacacagattgctcatgcttttgtttgtggcttaagaatgcctttaagcagttttccaccctgggtgggccaggagttccttgccctcattcccataaatccacaaccttccagcttgggcgttatggccattatggacatgttacattgctgcagagattttatttatggccagttttggggccagtttatggccagattttggggggcttgctcccaacactgaacctaaacagaaacctcctattaaaataaaatatttaaataggatcaaaatgtcctaacttaatatttaaaatatccaagatacagtaaaaaaatcactcagtataccaacaaccaagaaaagtgaagcctgaatgagaaaagactatgagctgatggcaatactgagatgaatcaaatgttgaaagaatctgatgaacactttaaagaaatgattttcaactagtaattaaaatttcccgagagaaatgaaaaaaaagataaaacatcagcaaaaactaggaattacaaaaaaagaaccaaacaggaatgtaaaactaaaaaatacactaaccaaaacagaaaactcattagataggctcaatagcaaagtgaagttaaaagaagatagaatcaagaaatttgaggacagaacaatggaattcactaaatctgaataacaaagagaaaacagaaacacataatttcccaccacaattaccatccccaaaatgaacagtgcctcagaaaactggcacaataagaaaagagatattattggagtttcagaaagagaggacaaagaatttggggctggaaaggtattcaaagaaataatggctgaaacttcccaaatttgtggaataaataagattacagagtcaaaacctgagcaaacacaaatagggtaaacacaaaggaatccacaccaaaacaccttataattgaacttctgaaaaataaagaaaaaaatatttaaatccaccaggaacagaaaaaatcaaatgaacagatttctcatctgaaactatagaggctagaaggaattagcataacattttcatgtgctgaaagaattgtcatatgtaaattctatatctggaaaaaatagctttcagaaataaatgaaaaataaaggcattttcagatgaaggaaaactaaggaatttgttgcaaatagacatacctttaaagaatatctaaaagaaactctccaaacaggaaggaaatcatagcagaaggaggcaaagaacttcagaaaggaaagaataatggagtggtaaaatcaggggcaaatataatacactactgttctcttgatgagtctcctaaatcatatttgatgatagaaataaaaattaaaataacatctgttgtgtcactcaatgtatgcagagaaaatacttgaaacaactctctttttcaagtttggaatttaaagggacctaaagggcagtttgatgctccacttgaagtggttaaaggatgataccagagattgtcataactcacatttgtctattgttatactcaggaaattatagaaaactatataaagcaatacactcaaataaatcaagatcaaagcctaaaaactgctcaaaaatgcacttgaacgaaatatatgataaacagaagaaagagaaacagaagaaatagacagaaaacaaatcataaaatgtcagtaatgcaaatttaatgcaaatgtgcttttagaatgcaattgtttatgaaacagaacctgaaatgtgggcaactgctttaggaacatatcaatgtcttaatttgcattttgcttcaattttgctctatgatttaaatgatttttggtgacttacaagtgttgtttattatggtaagaacattcccttatttagacatgagtgagagctttttgatggaaaatgtcataacaaaatttaatttatttccaaatatatagaaacaaatgatggctttcaggtttcagggttcttatagatggatataggactacatacttcagttattttagtcttaatcccatgaagaagtacaatgatgcagaagaaaatgtgataaaacagttaattgagattaaaacaatgggatttttatttttacccaatgaattagcaaacacttaaaacgctgataataccagtgtctacgtgagttggggaaacattactctcttccactgttagtacagttatcccataggggaatttattagtatctattaaaatttcaaacatgcaggtcctataacccaacatatctactgctcacctatcctagaataacaagtgtttacagtgttcacatatgtacatcgaagatttataaaaacaaacattttgagacaacctaaatgttcatgaataggatggtgactaaatattgatatatctgaactacaggataatatataataggttttaaaaatgatgaagacctataaacactaatatggaaaggtatcggagtgaataaaacaaattgcaagacaaaatatagttaagatactatttatatttttaaaacacaaaaaaattatatatttctttatagatatatgtagatagttttatagaaagaggtctgtcatgatacatcccaaactgagatgcttagtaactctagggatggataaagaaaccaagattaaagatggcagccaaagatagattttttttttttgccttattgctaataatttaatttatgctagaagattacactaatatatagtttgtatattttaaaaatgtgttcaggtacaaaacacatggtttttaaatgtattcaaataatacaaattttaaagagctgcaaacaatctttaaaatctcaaatatgagttgcctgtataaatctgactttgagtatttttaaattcctctctttgttttcaggacacaaacttcttgacagcagactactaggacactgctggcagggactaggtcattttcaggaaggccctgctatgcctgtaggggttgccataggcacagttcatgaggctaacctagaaaagtgttattaggaaacaatacatctttgccgaaggatttgtttggaaggagagaagacagaaaatagtgcactgagtcaaaggttagaagagcaggtaaactgaaagttaagaatgaactgcatagtattccatggtgtatatgtgccacattttcttaatccagtctatcattattggacatttaggttggttccaagtctttgctattgtgaataatgccacaataaacatacatgtgcatgtgtctttatagcagcatgatttataatcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggtttcgatttgcatttctctgatggccagtggtgatgagcattttttcatgtgttttttggctgcataaatgtcttcttttgagatgtgtctgttcatatccttcgtccactttttgatggagttgtttgtttttttcttgtcaattattttgagttcattgtagattctggatattagccctttgtcagatgagtaggttgcgaaaattttctcccattttataggttgcctgttcactctgatggtagtttcttttgctgtgcagaagctctttagtttaattagatcccatttgtcaattttgtcttttgttgccattgcttttggtgttttagacatggaatactatgcagccataaaaaatgatgagttcaggtcctttgtagggacatggatgaaattggaaaacatcattctcagtaaactatcacaagaacaaaaaaccaaacactgcatattctcactcataggtgggaattgaacaatgagaacacatagacacaggaaggggaacatcacactctggggactgttgtggggtggggggcggggggagggatagcattgggagatatacctaatgctagatgacgagttagtgggtgcagtgcaccagcatggcacatgtatacatatgtaactaacctgcacaatgtgtacatgtaccctaaaacttaaagtataataaaaaaataaataaataaataaaaaagaaaagaatgaactgaaagtgacaggttgccagagaggtggaaccacatggaatagagcagagaaagaaggagataaagatacagactacagcctattcagagtgacttacaaatgcaccgttctggataggatgccgtggggcagcctctcagcacacatatcagctaggctaattatatgttaattgtagttatttatcctggttttataatataatttctctggaagttgttagaatttttattctaactttaatgttctgaaatttcatatacatatggaataaattgctttggatttttatttgttttattttccatttgatttaatttggttttgtaaatcctgctcaacactgagtagggtcttttttctaatctcctaactttatttctctataaaggaatattctctgttatctcttaaaatattggcagctccgtattacgactaatcttttgaaactctatttagatgatttttgggaacttctgggtctgttctccaattctcttcccttttattatttctctgtctttagtttcagctttataattaattctactgccacatacattttgcactttggcctataaatttcacaatttgtgtttttttatttttatagttctagttggttcttctttatatccacctagtcatgttatggaataaaataccatggctccaaagacaaaaaagactgtctcttttattctttgcgtaacttaccagctccaactgtggcctgaacttctgctatttatcattgagaagtgagaagatatagaattagccccactgactgaacactagtttcctgtaatgctcttcattgctctccggcattcattaccagataaccaaggcatgtcccggagtatctaatgtaaactcacatattcactattcatcctggggcgaggtccatagatttctgctgcctgtccaaagaagcataggttgaactatcaaattgcttcaatgatccagggaattaattgctcttaaacctcctcctacttttctatactgcagaaatatcacatctaaagtaacaatatttcttgatcttttgtgctgcaattatcctcttcagcttctacttcctaatgactgctcagtttctatttaccaataattgctcataattgccataattctcttgcttttttaattttttaattttttatttttttgagacaaagtcttactctgtcgcccaagctgtagtgtagtggcgcgatctcagttcactgcaacttccacctcccgggttcaagcgattctactgcctcaacctcctgagtagctgggactacaggcatgcaccaccatgcctggctaatttttttttaatgtatttttagtagagacggggtttcactatgttggccaggctggtcttgaacagctgatctcgtgatccgccccctcagcctcccaaagtgctgggattacaggcgtgagccaccatgcccagccgccttttttttgtttgttttttgttttaaagagtgtgacttttagggatcgagtacgatggagctgccaggtgtggttattttgccaccttgaaacgagaatgtatcatcttatctctattgattgccagagttcaagaactagagcaacaggggtctcagcttttagcagcgatggcttttctagggaatttatttaaagcacttaaaatgatgcagtgtagtatgcacaaaaatttcaaataattataacttttgactcagcaaatccacttctgggaatttgaccaatattgttaatgataccattcagttaagatgtttagttaaggacatttattgcaatattatttaaaatagcaaagtattagaagccatctggatgttctttaaaatggttaaatgcattttggtctatttttactataaaatattatgcaactattataaagaatgaagaaaacatgtgcattgtcttctaggtctgacaaaaatgtatcgttcggtaaaaatatcaagttattgagtaagttcagttataactgccccacaacctgcagcaagcagcccaggtaaccaactcgttatttagctatagacagtgaggctgctagctctttcagacttaaagaagtcaaactgcaatttctagttagtagttactagtccagaaagttaacaataagcgctgcaacaataggctcaaagcagccacgagttgactaataattaacaattatcctcgtttttgtcctcactgccaaattaggactactcagagaaagccaaatatgcagccctaattaatcatatagaataccctgcttctcattagtttgcctacagtttgcgcatgccaacagcctccgataaaggcacactggaaaccctccttttattcttcttccattataaagcttgcccacacctctgaaagcttgcccactcctctgcctggcttggagtttgccaaaacataaaggattgtggctgacacccttgccatcacaagttctgaataaatagtatttccttattctaatttggttggtcttcatttatttcccgttctgtaaagaacaatattgtttgtaaaaacaaatagtatgtacacaattgcatatgtttaaataaacaacataaaaaggccacacgtgattttgttaagaatgtatgcattagggatatgggacagcatgtattttattatttaaatgactaaaataaaaaagataacatgatacattcatctacgtattcatatagtttatttcacatagcaactaattctaataatcttaatactacagattttttttttttttttgagacagagtctccttctgttgcccaggctggagtgcagtggcctgatctcagctcaccacaacccccacctcccaggttcaatcaattgtcctgcctcaacctcccaagtagctgagacaacaggcgtgtgccaccacgctcagctaatttttgtagttttagtagagagggggggttcactatgctagccaggctgatctcgaactgacctcatgatctgcctgccttggcctcccaaagtgctgggattacagccaccacgcccagccaatactacagatatttataaagatatttgttatattgggtgctccatgtggctattttaggagtcatccaacaatggctcttctatgtgaatgccagttcaaaactaagagtccttaataggactaggaaataatttatttttgaactaaaaatatttagcttactgagaaaaaaaattaaatgccttcctgctgttcttttcaatattcgctgtgtgttttattctccagttagacttagacacactctaaaatatattctagttttatcttaagtattgctatatccaaaggaacaaataatgtttcttatcatccccttcctgctggacttcataatgcatttgattcccagctattaaccctggagacctgtgttcacagtcactttgtgcttaagaccttataggtttagtcatgtatagacattcttacaaagattattactttttttgtactgaacaatgtttgccaatattcccatgacttgcagctaaaagatgactagaagatcaaccagtcaaaccactggagatttcaactattctctggaaatactctttgcttatgggcgggggaaaccaccttgggaatatgaacttttaacagtatcttgtagtcttttcttgggagaaaaaaaagacctatagtttagtcgaccactgagccttaaatcacttcaaagtatttttcgatagcttttgataaaagggtgttgttataacaaattacagtcaattaaaatagacagtttttggtgaattactcagggaaactcgtaagttcagcactttgccaaatcatttgctagctacatgggtaacaaaaaatgcttagtgttgagataataaaatatgagaaaattgtttcattttcactcaaaactgtatttttttttcctcttgggagtcttttaaactaagaattataacttctatagatgaaataaaaccagttctataaggggttgtgaaccatcttatctcaaaggtatacttaaggttttctaatcattttaggtagagaaactatcaataatatataaataaatttttgatggataagtagaactccacattctacttatccctatagagatacaaggttttaactcctcctacaagaatctggaaaactcactcagccacagaattctggtactatttaaccagaattttagtattaaaattattttattaaaaagaaaaactgtgatgaaaagatccatatcaaatcccaccataactctttgcagtgactttgttggatcccaaccaccagaaacaagtattttacgttcacattttcttcttcctttccttttctttcttcccttttctttctttcttatttttaggacagactgtttggattggcttccatttatgaggatgggaggaatagaaaaagttcctgtctgtaatgaaggtgttgcacagattctgaatttatcttgtatttgattctgttccaatttaatctatgcattcctatgtcatttattgccatggtaactggatactcatctaaaatcacatcaaaattgagtgggaaaagaggaaatacttaactgaatataaattcttaacatgataagaaacactctaatattaaatgaatatttaagcaaacatccatatatggttattggctccctattccaataacgtaaacattgcctcagtttttttttacataacattattttcttctgattttaaagtaacatgtaacttttaaaaaaaacttataaaaaaacttggaaaatacagaatgcataggaagaaaaagcaccaatatttcccatgcgcaagtgtaactcttgccaagattttgaggcgtttccttccagctttgataaatgtatttattgatttagatttatttatttgatgtgaagagcattctgaagggatgacaaagaagaagatgtgatgaaaatatggttgacaagaaagaaaagagagagtaaaacagaataaggtttgtatttacttatttcattggggaaagattctaagaggatgtatcagaactactgactgcagctaacccatgcttaaactaacagtgatttatttatatatattttatatatatatatattttattttattttttttagatgaagttttgctgtctcccaggctggagtgcagtggcgcaatctcagctcactgcaacctccacctcctgggttcaagcgattctcctacctcagcctccccagtagctgagattacaggcacatgcttcaaaacccagctaatttttctaattttagtagagaccaggtttcaccctgttggccaagctggtctcgaattcctgacctcaggtgatccactcacctcagcctcccaaagtgctgggattacaggcgtgaaccactgtgtctggccgatttttttatattgagaattaatttgtccaggcataatggctcatgcctgtaatcccagcactttgggaggccaaggcgggtggatcacaaggtcaggagctcgagaccagcctggccaaaatggtgaagccccgtctctactaaaaattaaaaaaaaaaaaaaatattggccagtcatgatggcgcatgcctgtaatcccagctactcaggaggctgaggcaggagaattgcttgaacctgggaggcggaggttgcagtgggccaagattgcaccactacactccagcctgggcgacagagcgagactccatctcaaaaaaaaaaaaaagaatttttgcctgcttaataagggtattgtggtagtagaaaagatttcatgtgattactcaatgatgttctcatcaaggacatttatatattaccatgccaacatccttaatgggctgacttctcaccccatgctgccaaggtgacttctgaagcccatgacttactacttggcttaaggcaataagacgcaagaaacaacacgggccagtggcatctgttagttttatcaggaaatcagaagttttccttaaagctttcccaacaggtttctcctttcattttgctaaatcaagttaaatttacacttatatctttattagacatcaatcactgctaatcaatgctgtcttccctaccaaaatgaaggttatgaaaatgagtattaacttcagggatttactgttaatgttgttgttttcagtgtgtctggggaaaataagcaagggagcaaatgatttggaattctatcaccttgctagggctactgtaacaaagtaccacagttctgcattgtagtccaaaatcaaggtgtggacagggttggttcctcctgagggctgcgagggaaggatgtgtttcacacctctctcctccgcttgtagatagccatattttctccatgtctcttaacatcatctttgttccacgcttatctctgtgtccaaatttccccctttcataaagaaaacagtcaaatggaccagggtcctctgtaatgacatcatttaactttattacctctgcaaatcaagtaataaatgaggtcacatgatgaggtaccaggggttagaacatcaacaaatgaatttttctcggggcataattcaacccataataggaagtgtcaatgtggataggtggggttccttattctatcttcttgtggagaccgcaggcccagaaatgactgagctgtccacactcttcacttattctgagagcatgcatgatgatagacaatttgggataaagggttaggatggccacagcccatgaattcaagttgaatctgctctccagggccctacctctgaatgccatctagcctctgtatgtactcgaccctgtgggtctccacgggataccttggcacagctgaataaggtacttcctgaacatatgggattacttttttaatgatccaaagaatacctagtgaaaagaattcaataattaattgtaaatgcctcatttgaatacttactgatcaagaaaatcatgttgaatatcctaatatgcctattatgagttttgaatattgtccaaaagggaatgccgtggttactggaggttgaggtaagaaattaaattggcaaatttctttgtaatgcaagaaatcttctcatcctaaaaagaaatgaatatcctcattctctaaagacagacagacagctgacattaggtggtggtataggatttaagtaatatctatatttacatagtcatgaatatgtaacttataaaatgtatatcctacattttacttatttttaggagacttatataatgcatatatcaagtaattaaatattgctatccggaacatgagaactatcagttttaagaaatgagttactgaggtaaaattcatataacataaaattaaccatttttatttgaacaattcattgtatttagtatattcacaacttgttcaaccaccacttaaatctattaatagttctaaaacatttccctcacctcaaagctaaaccctttatccattaagcactttctctctaaccccttctttcaccagaacgacattctgtctgtagcagtttatgaattctggatattcatataaaatggaatcacacaatatgtgacctttggtgagtggtttctttcaggtaacagaatgtttctgaaattcatccctgcctagcatttgggctgtttcaccttcttgctactgtgaaagtgctgctgctgaaacgtgtgtacctgtgcttatttaagtatccattctcagttctttgggtacatacataagagtagaatcctaagatcatgtgataattctatgtttaactttttgaggaactgacactgttttccacagcagctgacccattttgcattcccatagcaatgagggctccaattggcccacatctttgccaacacgtgttactgtctgttgttgttatttttatggttattacagtgatcccagtgtgtaagaagtggccgctcactgtgattttgatatgcatcttgctgatgaataatgatgttgagcaccttttcatttgcttgttggtcattcttataccttcttcggataaatgtttattcaagtcatttacttatttttccattgggttgtctttttgttgttggagttctaagggttctttacataatctggatataagacctttgtaagatacaagacttacaaatatttactcccattccacaggttcccttttcactctttttgtagtgtcctttgatgcacacaagttttaaattttgatgcagtctaattcatccttttttttctcttggtgcataagtttgttgtttttttttttaagtaacacacataccacattcatacaaatggaaaacaggcagtcattcttgaaaatgggataataggataatccttcagagtatcaggatgcatattcataagcatataatcagtttttattttgcctaaatatagtcttcattaactggaaaaaatttatagcattgttacttttatcatatacttgtaatcaaaatgaaataaagatagaaggatatatagtatctctctctaaggtacataatataaaatataagattcttttatttattcatgcatcaaatatttttgagtacctaaaatatactatgattataagacagaaaatttccaacctccattgagcttatattccagtaaataaatgcaaactaatgaaataaacaaaaataaataaattcaggtagtaaataccatgaaaaaataaaatagggtaatgactcaacaggtgaactatttttactagggctactgaaaatgtaacaattgaactgagatgtgtattaccataagagacacctaagagagaatcattccaggctgaggaaattaccaaggcaaagttttgaggtgcaaatgaacattgaattttccagtgatagagaaagggccactatggctcatggagaacatgaagtttaccttggagaagacagtggtggacctgatacgtaaaagaaaaatgcctgtcatttgcttaaatggagattacccgccatttaaataactagagttattcaataaccatttactgggcaggaggctgggcatttaacaatctgatatttgttcagagtaaaggagaagaattgggggtggggagtggatctgagaagagatatataaaatataagagacaccacctttattctttatggaattgtaatccagtaagaattttctaaaaactcagctaaccataacacaaggcagagaagagttcaattaaatatggaggtttaaatcagagaagtttcttaatctagtatttgaagtataagcaggattgctatagttgtaagaaaatatttaaatcaaagggaaacaaagcccagagacaagaatgagcaaggcgtgtctgggaaatggagttgtgcattggagatcagaaggtatttggagaaaacacgtaggatataaagacaatggcattaaagctggaacctatgtgttttatggctttttaattaaaacagatgcagcactcatttatttcttatttccccaacagaatccaactctgaatgtgaggtttgcttgaaaacaccaaagaaatatcgaggaccagttctccattctaattagctctctaagacctggaggctctctgggacacaagtcagtgggacttcagtttcatagactttatgcccatgaagagccagtttttgaagattctctaataacttgaattctcaaatttagattatgaactcttatcataagattctaattcaactatcaagctgagacaaattaaatctgtatctttggtaggcagaattctaatatggtctccaagattccgactctccagcatacataccttgtataattgtcttcacttgagtgagcctccaagttgtgaatataatgggacagtctctcattcgattctgttacattacatggcaaatggtgaggggataggcatttctgtgattatgttatcttacataagattctattgtagcccaccagagagaaggaagacagagagatgtgctgctgccagccaggaaaaagcaaacatccatgttgcctaagggggccgtggagcagggatctgaatgtagaatgtggctgacagctagaagaagccggggagctcagtcacacagctacaaggaagtgaatcctgccaaagtctgtaaagttgaaagagaaccccaagcctcagattaagcggcagcctaggtggacaccttgatttcagctatgtggttatggggcaaattgttgtatctggacttctcagtttctgcaaaaggactggagtcttttttccttcaatattaacatagtgaggaattcctaaacctaggaagtgtgttccaatactgggtgttatgggctgaattttgtcacttcaaaattctggtaatgaagtcctaatccccagtatctcacaacgtgtctctatttgaagataaggtgtttaaaaagttaattgacttaaaatgaggtcataagagtgagccctaatccaacatgactcacgtcttctaagaggagattaggacacagacacacacaaaggaaaaaccatgtagagagacagagagaagacaaccacccatcaacataccacaaagaggtctcagaagaaatcaacctcgctaacatcttgatctcacacttccagcctccacagttgtgagaaaataaatttctattgtttaggccacccagtctgacatggtttgttatggcagccctagcaaactaatacaatgggcaactaaacaagtgacagttatcctctgcacaatccatattagggatgaggagtttgaagacctggaaaatgtgacttagtcaatgtcacataaattttgccaaaaaaaaaatgaaagcattgcatttttaactagagtaagcatacaatctattatcctaactggtatattttggagaatgtttttggtactgtgaataattatgatgggacaagggttataaaccaggttgtacatgtaataaaaagtatcctaggctccctgaaaaagcaagcagttctctcttcagtgggttttgtttaaaatactgtattttacctggaattgaagatgtataataaattattaacaggatgttgccaaatcctattgcctcctttgtgtgtatccaaaggagaaatttctaattttagtaccaaaaataattgtacttctcctgaacaattaattggcttggtttatcttttgtagactatggagggtacaactgactttatttccaccttcaagttaggttgctgggaagcttagcccaaatttgcatactgatgcaaatgtaaagatcagcaaaatatgccattttcttggtctcatttcctgttgtcatctttttttaattttcctttcacctctgcctttttttttaaaatcttgtaatgttttaggtatccttgtaagccaccttaaatcttctggaataaaattacttatataaaccaatcaatcactcaacagtctgatctcattcactatcactgttcaaactttcttttgctgctctattccattaataaaatctacaaatatattccgtctcattagatcatcctgtttgcacgctacgtgtttatagctagtaggtttccaagcctacattcagtcacgtggagttcttaaggttggatacaaatgtagaaatataggaactacctggaagaagcccacattgaattgtaatatctgcacatcgttttttagttaaagtaaatgaaaagtaattttttctcctaaataaaaactgtacaattatatgatttaaaaaaaaaagaacattttctaaactataacaacactataggttgtaattataatgtgccactttactgaaattatcctggatcaaaaagaataattctacatttattacattgtactctgtgtaccattactaaatacagaatttcacattggtctactccagacatacaactgttgaaatatgggaaaatgagagcaattcattggcatgatttcaacaaagagttcttgctgtgttattcttcctggttacattttttctcagacatttaattgtaacacacctgccttatttctcagagatacacagaaacaggatctcctagtgtgtttggttttggactaggactaaatgagcaccagcatttccattgcaagtctaccttggatagctaccccctacttctaatttcagctagataaagaaagagaagtaaactttgctatatccctgctttcattcggcaacacacaggttttgagactttcttatattcagtttttggggaaactatgtgatgcagtatgcctgaatgttaagtacacactgcaaaatatgaataagaaggaagtcattatggactcaattgtgttcctccaaaatttatatgaagaagctctagcttgcaatctgactatatttggagatagggcctttgattaattttaaataaggtcatgagtggagccctaattcagtagtttttgttattcctcatacgagttagttgttgactgggagctgcaaagattaaaaaaaaaaagtcatccttcatggatgttcctgatcttccaacgtggtttcttttaactgcatatttcaaaacacacatttaaatacacatgtacactgggaaagctgaaggacagagaaaaggccacatgagggcatagcgagaaaatgaccacctacaagccaaggagagaggactcaggagaaaccaaacaggctgacaccttgacctttgacttccaacctctagaactgtgagaaataagcttctattttttaagctacccagtctgtggtattttgttagggcagccttagcagactaatgcagagagaaaataagactaatgaaatatacattcataatgattttatttaatactatgcaaattaccttacatttgaaatctaatgacagatctaagagtaggcaggctatgtgttctcaaattccttttataaaggagaatatagaggaaaaaccatttatctgttattactcgcacgagtcagttgttaactggaagctgcaaagattaaaaaaaaaggcatccttcatggatgttcctgatcatccaacacggtttcttttaactgcatattttgaaactcacattcaaatacacatgtacacttgtttatctacatagaaaatgactgattttatttggccctatgtgattcttttcacccagatataacatagaactattggcactggaaaaatatcttcattcctatgctgctttgataaggtagacttaaaataatggcagatacctgtccccatgacgttacagggccttacttcaaggattcaagagtgctctgagaattacagaggtcttttatttaaatccccacaaagtagacgaagagtgacaaacttttgtaatggatccaagacagggagataaaagttgagaacaatcggtgcaacagagtaaaacaaaatgccgcatgatatatgttgaacacaccaatcactgtaagccggcactaatttacttccagccttctagatgtatttgtattcattatattcaaaatgagtatgttaaaaattgtaatttaaattctgttttggatgaccagccacttgcttatgatttgatacattgtgacacttttcattttttataacaatgctcatggagccatttttaattgtactgtaaaaagacttaatttggcccagacagcgatgaaacaccactttctgagtaggcagagttctgtccagtttttatatcttatttacctctgacaggagttgccaacaggggcaaaccaaatacattagagctggctgctgttgtgtcatcttacataaagaatgagacctttttttaaaatgagaaagcttatttttgatagtttagggggaaaggttatcagtatttgagaactacttgtatgtttggtttaaatatcagaagcaaaatggaaggatttgaccaattttaacaaaatttcaaaaagaaatgagtttataagttggagtttaatagcagcaaagtattaaaagtagattaagctttaatgagcataaaggactaggcacaggaaccagatttttatccactttgacactagaatctttagaatcaagtgagaagaggcctagattgcctagggcatggcacccctgttctatgtgttttccctggaaggatggaactagaaaaccaggcaccatttatgacccttccctctaccccttccctatatctatttcatccaaaaatgtggttggtttccattttctctgccaattacctggacttctacaagagccatttattggtctccttacttcctctcttgtttttgccttaaccccctaccagactgaaaccagactaaagcactaatctggtcatggacattaaaagcttttcatagattcccaatggtcccaggacaagcactgcaacctttcacatgacctacctggcctgagtggtccagcacctcccctcataccacgcttcttccccactctgtgacatagctacacaggtttcctttcaattatttaaaataactttctttccttctgcatggaactttttacatccagttcctgctcttaaaacactgcccaccagtcaccttcatctaattaacctgaactcttggttcacatctctgctcaatcatcatgtcctcagaataatttcatattcaaagtaggcccatttcttcttatcacgtgctctcaaagaacctcgtacttctctgtcctaccagttttcacagctacaatcttgcttttatatgactataacatgcatgctcagctacaccactgtagactcatgtacactgtcctattccagagcctagcatagtaacttgaacatagttggttctcagtcatttcattaaaagttaataaattttaccttggtacatttggcgactcattaaaaatttaaaacctttagctttgttccctctcattctaacataattcggtacacatagtaagcacatgcaatttttaatgaaaatttctataccctagggaaacatgatacattcttaatttacatcttaaagaacgtcagtgatatgaactgaggtacttacatatgtcttatggtatttagatattggtgtatttcttttaattattattttaattgtctttcttattgagtcccctcttaagtggagtttaaacagttatgcagctatattaattaaaagattattttgtcccaaaagtcaaagcttgaattttgtcaataatcctttatgtattaattacacacgaagttctaagaaacataatcttgctttaagagatgtggcttgtcaatttagcccaattccagtgttagcaaatattatatagagatttttttaaaagaaacaatgagcatatccattttgaagtatgtagtcccatagtaaagaagataaaaggccaaaatattgttcttaataatataaagagtctaaaaaatagatcagtatgaatttgcaatgcttttcagttaatatatattttagttgagttacatttatttgagcatgattaaccgacttaggttagaaagcagtgcagatatttgtttgggctaagaataaacagaagagatagggctttaaacagattttaggtttgcagtccttgaagcaaatggaatgctgttatgggtttcacattcatgttgcataagacaggttaacttgtgttgtcatttagttttctctgtttttatctgcatcttataccatcctccttatttatatggaccatatatgttatttatatggtccttttgcgataagtacttttaaatcaagtcataaattctgtactcatttaattatttgacatttgggacattttcttttcttacctccctccttatagggttcataaaatgagtgttttattcataaactggcaaagagaataaattatgatgttaccataatttcacaaggaagttacaatttacagataaaatttcacaataacccaatattctgatctgtgtttgaaatgtaggccagaatttcactgtttttcattagtgaaatattcattcctccatgtccagaggaaaaatacattttgtcttccatgtagagcttatgctactgaatttagtaattcctgataagtctcattacagcaagcccaccttgcgctgagttgggttaacttaattgtggctatctttacccatgttaacagcaacactggaaataatttaatatagtctggggcacttcacccattctgtgaactccagataagtcccagatgagctacagaaaggaagcaatatatgatcaggcaggagggctacacttattaacagcaagtgttcagactgctactgggtagcagaacacaaactgcataaatgatcccttctctcattcatttcctggctgtctgactatgtctgttgttctaatgcatatgcaatggccactcgtgtcgccataaagcccattattgtttcttcttaaggttgacaatttttgatgtttttcattttgtaagcttttgtctgcccaagaggtggacattactattatcattttgtaaataacacaaataggttaattttgacctatgctagatgttaggattcttaacctggatcttgggactgtagacccataggtggtggagagactgtgaatccaaagatttaacttcttcttcctacttggttacatgagggagagcagggcttttgacactcaggactcattccctcttctaagtttgtcctcagtggtccctaagactcttctattttgaacactctctgtttctataaagcaagctgcaatttaaaaaaaatcacacatgtgtaaattttttaggtctataggctatttctgtaccactaagcctttgctaacacatcctttcatttgacctcctttcagaaaataatcactaccctgcatcttttctaattgctccatttgccttttttaatgttacaggtaaaccagcattaaaggagctgtagctttctcttcattttttttttcccactgctattggagatagttgtctcaaaggtcaagttaactcctaaattagttgggcaaacatcgtatctataggccatttaaaagaagcactaatgtctctacctgaagaacagaattgggtcatcagctacattagtacatcataggcaatttttctttcacatgctggaaaagaggaaagaggcactagaaatgcaaaatcttccatgattagtttgtgctctggaaaggaaaatgtggacctctgaagtgattagtttgtgaaacattacctttaaaagctctgtaaatcatgacaagttttgcagatgctccttaattctgatacccgaaaatcatcatggaagttatggattttacaatacccgaacatccaagtggaaacgattctcaaggctcactaccgtgtgcctccagagctggcacatgctttgtcaaagccctcaatgccctcctttcccatgaaatatgaacaaggaactcctaaatctcatcatgactcactgttgattttaagctgctcaaaattcaaatgctactgaatttaataaaattttttaaaaattataacattaatagggcaatttaaggtagactccagtttttggagatgcacattattttcaggtgtttcatttcttctctgcctagttaattttatgagttccttgtctattatcaccaaggaggactatgactactggagaacgcaccattcttctctgtactcagaggggaaggaatgaccagttttagaacctacgggatttgaatctattataaaaataaatagaaagaaatatgggtgaaataaagcaagagcagttaaaggacagttgaaagttaggaaggaaggacctaaacttctccaacaacaaataagacagaatccattggcactactcacttagtagaaatcatggtgagaagatataaaagagaaaaaattagataaatagatagatagattgaaaaatgccatagtaacatttaaaaagagttgtgaacaggaaaacggaagcaaaactaaccatatcgaaataaagacctaaataagacttcaaagcaatagattcatttaattgattttaattaaaatcaattaaaataaattgattcaatttattttaatgtgcctagtaattagctcagtgcatgactcatagttaagggttaaattgacacatgaatgaataaataaatgaatgtttctaacctaagctaaagagatcatttattttaataagttctatgccttaagaacaaaaaaaacttgcttataatgtttttaaaatatatactccactgtgtttcctaaagttttctacaacatacaaaccaagaactgttgatatttgtagtagagagtttgtatatattttgttcattaaataagaatgagaggaggaagggtgatagagagggataaatatcccagtgagaacgtgaaggtagacatgaggaatgtgagggctgttgccccagggtttgaagccaacataaacattaaaaccatttaccacattctgacattaagctccttaattgcagcgtccagaaaggtgacgagatgtgaggcaaaacttctgctgctttcttcttatagaatatgctacaggtttcctttataaatcttgtgtcaattggtgatcacttagctcaaaataagaccaaaccaaaataaataaaccacttagcttgttatgaccataacattctctcccataaaaaaaaaaattcactccagattgtagcctttcctcttataagacaacgatctgctgatgaagctacatttctcaaaatatttcacctcagccactgagaaaatcccttcccatcagttctgtcatcaccacgcacaggtgaggcagcatggtggcatgggtaaaagtactggctctaaagccaaatctgtcaccaagttcccaccaggattacatgaatgactaacggaaattatgtagagtgagctgcaaggcacatagtaagcatgcaatcaatggtagaatttattaatattgtactaacccagtcttcatgtgcaatatctactgatgtaatatatcactttatctgttggtggtacttttattctgaagagcactttcacatgcattattgaatttgggaggcaaggatgcatctagttagcagtttaacctcaaacagtcctgttttgaaccctgataccatttatcttcatgaccatgggtaaagtcattcaacttctctgaacctcagttttctaataagtaaaattaagattataacaattcttgttttatatactagttgtaagatacaaaggaaatgcttaccataatacctgtatttatcgtggtatgttgtctttatctgttcgggctgctatcataaaatgccttggactgggaaatttagaaaccaaagaaatttattgctcacagttctggagactgggaagtccaaaacctaggtgccagcagatttggtgtctggtgaaggcttgctctctacttcctaaatggtaccttcttgctgcattctcacatggcagaaaaaatgaacaaggccccttaggcctcttttataagggcaactgtaatgaatattcttacctttatggagccctatgacctaatcacctcctgaagtctccacctctattgagttgcagtggggcttaggtttcaacatatgaattttgaggtgggaggacacaaactttcagacaatggcaactgcatacattattgttgttattattgcattcaaccttataatcgccagtcccaaaacaattccgctgcttggatatgtcaatacctctatgactcaacagatctaaacttaatgtatcccataagctaaccttcctcctaaattggtattttcatcatctttccaaatatacttatttgataagactttatctcatctatcatattgaccttttatatcgatgaggaaaaaatcagagcgtttatgtgggttgccaatggacacacagtgattagagagaagtgagctgatttcaggactgaattcagagctgtttttttccctccgctgctgcagtttcctgttactttttagtgttacacaattgcaataggtcatctaccttagtcatcctttaactttgagtgaataactataagaattacacatatttttcatcttttgcattgacaaagcatccagtctaacaaaatctctcccatggccttgtaataaaatgtgctttaaaataagtaccacacaaccattcattttgggatatgaagtaaacataatgttggtacctgctgagtaaattgtttttcttaatgctatgtctttgttacttttctccggtaaacccaaaggttgatgtactttaatgcaatgatgctaaccaaatgcacaagtaaatgacaaatgcaaagcacactgctaagtggtacacatgcattgtcttgtactagaatacagttacctcccccacaagactaagcattctccccataaacttctttcctatttaaagagattagttgcattgatacctaaaacttatttgttatctaacacataaacaaaatctgttacttacacaaacaccacctttccgatatacacacacacatacatacctaagtctcacaatgtaatgcttgggaaagtaaaaataattagctctacatatcactcatagtggctttattgttccttgtgaaatcaacatttaagcatttgagacaaagcccactttatgcaaggactgaattagtacgttgaattgtgtgttggactagagtttcttgggtttaattagagtttttgaggtttttttctagtaaagcataaagctccaagagtaacaatttgctggcaaaatgaaaatactctcatgcctatcctagatcctagatgttacagaccagaaaaataatgttttaaaatgatagaataaatactcaaaacaagagactggaaccaaaatgatgctttgccagagggtctgatttctaccccttcccatttcttctgaatccgtctctcaaaggtctgcaatgacctgaacacaaaatgcccttttgtcctcagacctcattttctctccctctgagatggtactgcatactgtttacaagtccctttctctttaaaccctctcttttatacattagttcattcctagaatgtcctatatcaagatgttctatgtgccaggcacaatgttaggtgttaggaatacaacagtgaacaaaacaggcaaaaatctcagctttcccaagcactgttttgcccttttaaacatcttcaatgtacttgcccctccaagtttctacccttggcctcctcttttcacttggtgctatctaccaatttcacctcattcctccattctgtcatttctcaacgtttcctttctgcaaaagatactcagaattacatctatatgtccttcatctctcaatattctccacgttcaaaatggtgccaatgtttagatacagctgcacctctgtaactcaactgaaatgagttccaaactgaacttttcccccataaattaagcttcttgcaaagaaagtttctatttctgttatctttccaaatacccatgtataagaggactctgtctcttgtctgccgtatctcatcatgtctcatagttttggttctgtatctgtgataacattagaattcattttcattctctagccacattttgactaatttaatattttccggagtaactttcctatctaaaattgttcatttttccagtccaatccatgctttttgcacaatgaatcatagtctgataattttcgcaggcttctcaaaagccttcagctgcttcttgtgatttaatagataaatgtctggccttccaatcaagaccttctctggaggatctctttctggcttctcctcacaacttccatattccaccatctggtgacataaaactactcacctattatccataaagcgcccatgtattctacttctaattgtagtaatttcattgttcctctaagctggaatgtcagatttcctactctcttcattaaaattatccacgtatactatagtaaagatagtatcctcccataaagattttcataattttcctaaattacaagtcatctttccttttaaattaataatatctatagaatctatgttaagattataatatcatctactcaattggactagaaccatgcacctacatttgaaaaataattcatttaatggatttggaagaatatatgaagaaaaaggcacaaaatgagaagtacaagaaatcagaatcctgatgccaagattacaccaaaaatttcatatttttgcttttatcattagtgtctatttctattgctaccactctcatgtggcagagaccataattaatggtaagatgtcctaatatatctaggaccaaaaaaaattgaatttccagtgaaactacctttgctgaactaatcagaacccatgacactgcttatggagtttctaaataaatctactttcaacgacacggcaatgaccttaaagtgttactgcagagaaaaggatttcccgagacccactgaggaacggtactatttcctatcatctttaaaaatggaaatagccttactgatatatactatcaagttattacctatttactgtaaataaaaatctgaaaatacctaaaatgtgaagatagaagtgaaaattatctataatctcactaggctgctataatcactgtgaagatttgatatctctttctaggatatttgttctgcaaatacatacataaatattttaaaaaataaatgaggtctaacagtacatgctaatgtggaccctgcctttttcacataaactatattaggagcatattctcctatcagtatatacatttaaacctgcatcttcatgttcacacacttacagtgtatgacaacccacaatttaattactcatctatccattaacgaacatttaagaggtttatattccctttcaaaactttttctttaaattcagctattaaaacacttcactaaacaccttgaacactcatactagaaggatgaaatatgaaagtatagagatttgattctttaagagatttgatcggttatttctttcccaactaatctaaataatcttggtagcttacgatggacacattgttatgtgcttactgaccatttcagggttttttttttttctttccttttataattgcttatccttgtgcatagctttttcttagaggggttattctctttttctacttgatttacaaaagctccttatagtgtcattactaattcattttattgcatatatgtttatcatttgactcttaatttgttaatagcaaagctatggataaatatgttgtcatataagtgctttaatttcaaaccagttatatctcctaatcttatacatttttttttcttttgagacagtctcactgctcccagtctggaatgcagtggcgggatcaaggttcactacagcctcgacctcccaggctcatgtaatcctcccacctcagccttccaggcagctgggactacaggcacgtatcaccatgctcagctaactttttttgggggagggggcgggagtgggggagatggagttttgccatgtggccgaggctgttctccaacttctgggctcaagcaatcctcccaccctagcctcccaaagtgctggggttacaggcatgagctaccatgcacggctaaccttacacttgaaggtttgccctgatgccacccttagaacaactttccttatgatttccctgattaagccatatagtattcattttggtataaagtgcaggggagaatatatctttgtttctctccaaatgattagcaaattgcatcatatttattattatactaacccaatctttctcattctagtttaaaaatatatatttagcccctttgtcagctatcaatagagctgttacttatagtggcacagatactggaatgttgttattttatctttataatacactataatatctaatagggcaaatatcctcacctccgtgagagatgggatgccatctctcctaagtctttttgcttgtttccagattttttgtatctattttgttctacagttgaccatcaacttttcagaatgagaacttctgattagtaccctcaagtagaactatgcctcgtgatcctacatcaaccaagactatgatactgaccaaaatgccactttattaatttttaattaaaagttattgtcagaggtattagaataattcacattctttaatcagcagattatcttactatggttaagtcaatgatttcttttcaatgagaaattttcatcttaattatttaaactccattaacttcattctctccttttatgcagtacatgggaaattatgattggaaaatttcctagtgagcagagaatcagatgatgatgacataaatacataaaaatggtgaattgaatcagagttaccttgatgcatccattacccaatacagatggtcgaagcgatggaatgagaatacttggagtgtgtggcacaatgttcactggacaatagacaatgaatgcttagatgggcactggtgatattagctgtggtattaaatctgtgcttctttgtcaagtaagacttccagtgggttcattcatcaaacagcccagtcttgctatttcagtgagtgttttctctttgtatggttttgctcacataagatttagtcccttgctactcaaacatgatctattgaccagcagcatcaacattatttaggagtttgctaagctgtcaagtgccaccccgtatctactgaatccaaatccactttctcaagtgactcatttgcacagtaaagtttgagaaacactgactattccataacgaattgatcttatagtttaacatccaaaacaataatcataaatccctagtttcagattcataggagcaccttactgtgacctccatgttatgacaatagtaagtaccatggtttgtgaataataaatagcagtaacccttatttaatagtgaaaatgcaaacagccatttatacctagcaacaggtcctgcattctagttacctggtatggttaggctttgggtccccacccaaatctcatcttgaattgcaatccccaggtattgagggagagacctggtaggaggtgattggatcataggggcagttcccccctgctgttctcatgatagtgagtgagttctcacaagatctgatggttttattagtgtttggtagttcctctcttgctcacctcttctttgtcctgaagctttgtgaagaaggccatgtttacttccccttccatcataattgtaagtttcctgaggcctcctcagccatgtgaaactgtgagtcaattaaacttctttcctttataaattacccagtctcacatatttctttagagcagtgtgaaaacagactactacattaccctttcgagttatggtataaaaacattgtcagtgtcaagaaaatgatgacaattcgcaattgttccatgtttgtacattttttcttatttctcctaaaatagtttaagattctcattttgcatttcatgtcaagttctgaagttgtcatattccactgtacagctttcctaagctttgtgtgactaatccaacatatgtgacaacattggtttcatttttaataagttcttaagtccttaaaaaaggggagaaaataatagctaaagaaagcaagtcttctagaggagaaaatgacatgattcttaaataaggttttgctagagtaacgtctgtgttatttagtggatctgggactcagaaattctgccaaagaattctttgtctctctaattcacttggttagctttcagaaatgctaacaactattgactagactttcacagtatgtcagtctttccaaatgaagaaaatggagggtaagtgagctgaacgtgttctttgcctagggatgactgtaggatgtttattgaccagttatgtcattaatcactttttatttcaactgactaagttcttctatggtgtatgagttaaaagctaaagttgcttaaaagtattgagagaaggaaaagaaaacaagaaaaatacctagaggtggtgtgcagttgaagctatttctgtccttacagagtaaagcaaattatttcaaaatgttcaagaaatataggtgccatggattttctgcaaaaatacaggcacagaaatcagagacttttgcaaacactacactttgaactgccaaaacaaaaacagccacatggcaacatccttgtccttttattattgtcagtgaatctagccttgaagaaaaagtgtcaggtaaaattccaagggccatctgcgacatcacaacagggctttagggtagaagatagatagcagttctgtggatacaagatccctatataagttctctcacattggataccatatctaacccaacttcattaaactccatgaaaagcattgtgatttgcgcatagtaagtgcttgaataatattttgttgtaggaagaagaaagaatgagcaaggaagggggttaacatgttctattaaataaatgggagtgttccttgtaatatgagaatctcatttttacttccaagacccgtccttgttcccagacactgtcaactttctcagttgttcacagttaatagagactattgacagagaatcgtagaaaagcttattgatatcatgaagctcactgaggttgaagagcaaaataatgaaatatctcaaatcctctcaaaggagcaaagttataaaaagcttcatatagagatgaagatcaccctctcaccacattgcacgattttctttaagctctgcacataaccgccaacttcctcctgcccctatcaatagccatgattgtgggatacagaatgagcccgactgcgaaaatgaacttttcactgagttcaggatgtttttcctgatggtctcacttgatagcttcatctttttgttttatgtcttcttggcatatttatgttacccagaacctccccattaaggttccaaaattctccagagggatgtgggcactcccatttccttagaattaggaaagttatattgtgttctcctccatatcctcatagccagtaaaaaaaagttaaataaattaaaaattacaaaaatgaagcccacatttaaaataacttgaattaaaggaatgtaactctatgtaactctaaccataaaaaaagacagatgaaatgttgtaaggctgaagaacgtatcaatagcaaataaattaaccaacaaaggatactaactcaaggttaataaaaagaagtagaaatgtcatgtattaagggaaggttcttgacctatgcatacctaatgttcatttttgcagaagtaaacttttttagattacttatttttatgaataactttaataatacacactaagttttgaaaagtagtaaaacctaagaataaccataaaattctacttagcttttagtcactcatttatttctatcatggctagtacaaaacttgcctcttgtatttatgataatactttctcagtaacttaaagcctttcagcatttatgaaaacaaatcatcgatttagagctacgagcatgctatgcacagaggccaggtttttgcaatttaattctgcagacgtggtcttcatcaacatattatacacaactattaagtgactcggtgttttcttaacaatgtactaatgatcaaagttgttataatgtcatttcttccacttcgtgtcaccagaattggaaagatttaaattgtgcatgaacgaatatcacctacactattggaagttggttaatcagatgtccactcttggtaccttatcccatggaatgcccaccataacccaatataatgctctcacagattaatgttcacacagatgcttatgccatgaccttcagaacctcagactgtttacctacctgtatgtggtagacaatgctagctctcaccaatgtttttaattccagtatatcaaaagtccatttcccagaaacattgcagtgcctgattctagaaaattggctgggaatggcagtatgtagatgtcaatatgtgtctctccaaggtcctcttttcctgccacagcaaaatgtgacagtctcctgcaaaatggagatggtacaaacctacaatgttgagtaccacatggcagagagtcgccctggagagttacccagacccagactgtgaaaaagatttttcaattgtcttaagccactgagattttggtgattaccccagtgcaacctagattttcctgactaaaacagtaatacaaatcttttattttactatgttatattcttatatctattcccataatgacagacttctgcagagtaacttgctgggatttccagaatagtctgtcttgatagaacataaatttcctcttatatgaaggtaactctttcatccctgacctcttttctaggctctcagcagttgagataacctgcccaaattggaagaatattacaatcagaagggggaagacatatctgggtcctaaactgtgacatgtgaatatttcagaaatatttctgaatatttctattcacatactgacatgagggtcttttcctttgtccaagtaggatttttgagttgaacattttactgatattgttctaacataattttctgcctacttgtgctctgctgcaaaaatgggtcactccctaggaactctaagttgaaccctctttacagcgtttgatattagcaatcggctattccctgcttctgtgacagtatgacaggtttattctgggatgataaattgaacgagttcatccgtatttcacacacaaacccctaatgaaaaggttagcaattcattgtttgaatggaggatggattggagagaacacgtttgtgtgtttttgagggtgcctgtgctttagatccctcagggaacactcaaaactggatgtcagcatttattctgtgaactctttgggtgttttctgttgttgttgttgtttaatcatagcttaaaagaaatgggattcagttagatcctattagcaatttctagtgacaaccttctttctcctttttttctaaggctaaattgatacttaatataataataattattttttgtatgggtatgcagacgtgaatactggaaaaggttctttgaagaggaacatgatgcctatcattgatctgagccaggtaaaattatccatagaatcttgctccctctaaactctgaaaggccatctattcccaagaaagatcagttgacacggacttttatccctgcaggagatactagcttcacagcccaaagagagaattgttcaggatctggaaagacgagacccttgctgtctttgtttccctccgtcccagcttctaacattgcaggcacctcacaggaaaaaaatacaaaaagaagacttgatcaagctccaggtatggaaagtattttcacaattgtaagatgagaaagatgggcaagactgaaaacacatccctttaatgtttagaaaatgatcttcctctgaggttaacctttacaatgtttcctgcatttctcctctagtctcatacttgatctcagtttgtatttaccatgtttttagctttacacactgtagtaggcagaataatggttccccaaagatgtccaagtcctaatgctggaaactgttaatatgttacgctactttgcaaaagtaggactaagcaggtaggataaaattaaggactttgacatggagagattatccaggattatttccttggctccagtctaaccacacgggtccttacaatttcagaatctttcctggctatggcgagagagtcatctgactacggaaaaactgccagagacaggcaacattgctgtcttggagacagagggaggaggccatgagagaaagaatatgagaggtttgtaggaagcggaattggcaaggaaacaaattttttcctagaggttccaaaaaggaaccagccctgacatcttgatttcagaccagtgaggcctatatgcgattttgaattacaaaacgataacatgataaaactgtgctgccttaggctactgtgtatgtggtaatttgttacatcagcaatagaaaactaatacatacaccaaaactgtgcaaatgagttcttattattgtatcttgaaaacatcgtcctttgggttatctattttggttagttatttagaagatgagattccagtttaccagattccaaagcctatgtttatttctttttgtttttgttttccctactttaccgtgttgtgtctcatttggtatacaaaattaatcatgcattggtttcaataaattaagcatcatcatccagatctgacacatttgatcagacagcgaagcagcataatgctcaggtgaagagaaggagattttgaatgtggcagattcctctagaactctggctctgccaattactatctctatgtcatttggccactcaacttctctgaacttcagttttttcatctgtaaagtgaaaataatatttgtagctgttttgtagggtgtgagaattactgccttaatacatgcttttgagaattcttagcacacagcacttaataatgctaattgtttttatggtggtggttatatgtcattatgattcgagtcacgtctcacacgtaagcaaataaaaggaagatcattttgattagtcacagttttgtggcctcagtgtggattctctttttcaaaaacggcttttccttttatgctgtctgatcagcgttttatgagtctccagatcaccccctctgggtgctcacaagttattttatgttcaccatcctcctttcccatcacaaaccttgtgttcccagtttctgaaagattccgtgctttaccctaaatatctgataattgacttgcaaagaactgctacttcttagtgaatctccacccacgcaggtaaaaccagaaccctctattaacacaacccttatgatgtctttctcctattttgtacagttatctcgaccacaaacgataaccagggcccttgtaacattacaacagaattacaaccatcctgaaaaacttatgggaaaaacgcctgattcctctcagggacaaataaatcccagactcaggacaactttgctcactttgatcagcatgggaaatttttatcatggaaaagccaaacatcatttctgtgaggagttagagactctctagacctgacttctgttttaaaatcatattaacagattcctttgacagtctcaggatgtgatccatttattaaaagtctgttatcattgtggagtgcaatgattagcaaagtctttgtagctaacaggagacaaagatatcagtgtgatggcaaatttagagagctgtgaacttattctggttttccttgtggcagggcccaagagcgcttccttctctcccctgctatttaattacatccatctcataccaattgtgaaatttgggctgcagaacaattatacttttgctggttaggccaggctgtatttcgtcaaaaaaaatttaatatagtaatctgagttctgtctacagcaaaaaactgagctttaataatcacagaaaaaaaagaaagaaagaaagaagaaaataggtaggcttctgcgcaaatcccattttttataaaaagagatctactgggaactttctgctcccttgttggcttctagatatggaggaagtttctaagaaagagtaggaatgatctttggaagaatgtaaggagaatgagtttattggtcaatgcgttaaacctgtaaaatggagatatttggcatgctggcccaaagaacttgaatttgaatctttacaacactacttagaaactgtgattttagaaaacttaaataccttttatgggtttcagtaatttcatctgtaaagagaaaaatactacctgctctattcaacaggggtgggagaatacaataatacaatgaccaggaaagtattttatgaaatataaagtagtcatttaatttgagggtttttttttttttttactacatgtaaaaataaatatcctatttctggaactgaaagagacattttaggttatctagacttaatccttaatttcacagtgcaagaaatctatctagagatgagatgagtcaaccaggtttggagaatgagtcagtggcagaaggatacaagcacatttacatttttagctaaaagacacaagctctgtcacttactacaggcagaaataataattcccaattcatttggtaaagccagcattgccccaataacaaaaaaattacaagaaaactacagactaataactttattgaatacagacacaaaaatcctgaacaaaatgttagcaaatcaaactcagcaatatgttaaaaggataacaaaaaccaagtagagttcatgcaagtaacgtaaggttggttgaacatttacaaatcagtcaatgtaattcatcatattaacagagtgaaaaacatacaatcataccaacacatgcagtaaaggaattcgacaaaattcaaacccattcataacaaaaaagaaaacctttcaaagaagtagagagagcaggtgtaatcatgaaggtgattttggatgagagtaacatttaaataggtagactttgagtaaagcagattgtccacaatgtgggagggctacctccaatcacttgaaggctttaatataacaaagactgacctccccagggcaagctgttggtgaaagataaacacatagaaaaacagagcagaagaaagaacacctagaaatagacccacataaatataataaattgaactttgacaaagacataaaggcaatctgatagaaaaaggacagtcttttcaacaaaagctgctgaaagtattgggtatctatatgaaaaaaaaaaaaaacctagacacagaccatacactttttacaaaaattaactcaaaatgaatcatagacttaaatgtataatgcaaagctgtaaagcttcgagaagaaactgatgaccttggtggtgatgtgtatttagatgccataccaaagttaggtttcatgaaagaaacaattcataagttggactttattaaaattaaacatccagagcccataaaagataataaaaacaagtcacaaatgtgagaaaatatttaaaaatcacttgtatcccaaatatagaaagaactcaaaaattaataataaaaaagcaaacaatccaaatttttaaatggtcaaaagatctgaacagacacctcaacagaaaaaagttatggctaaaatccaaaaaactgacactatcaattgttggcaggcatgcagaccagcaggaattctcaatcattgctagcaggaatgtaaaatggtaaaggcaattcggaagatggtttgatattttcttacaaagctgaaatcgacttaccaacaactgtactcctaggtattcatccaacctacttgaaaatttatgtatatacaaaaatctgcatgcaatatttatagcagctttatttataatcaccaaaaactgcagcaaccaagatgtccttcaataggagaatgtataagcaaactacgctctatgcatgcagtggaatgagttatcaagccaggcaaaaatataatgaattaacgcgattgtgaagtgcaagtcagcctggaaagctacacactacacggtctaatgtatatgacattctggaaaagccaaaactgtagacaaagtaaacagatcagtgcttgtcagggtcacagggagggttgaacaggttaagcacgagggaggcagattttttaggaaaattaatgtactctatgataccataatggtggatacaggaaacagttcatttgtcaaaatcaacggaactctacagcacaaagaatgaaatttaaagaaaaaattatttatggggctaggggactccaagatggaatgcagactgaccagaaaaaaattaactgtattaaaaaagtatggaataacctcactgaagagggtaggagaaaagatactgacttaagtaactttgtaaataagtagaaaccataagactaaaagcaaaaaacttttcttaagtactgtactctgggtagtaaaattgtttcctatgggggttcaggttaactattctgaaaccagtatacatgtatgctgaaatggaacaattaagtaaattgcctgcaggtggtgggagataaatttctcattgttggaaggaaaggctatagagaagcaaagggggaaggctagaatgattcatgtgatactagatcagtttgagacatcagtatgaactcacattgacttaatataagtatagatggaaacatacacacacacacacacacacacacacacacacacacacacacacacttgccaattgaaagggcctggaatctaccacaccctagcagcaacaatgaacctaaagtttttgtttctaatatcaattaaagggactagggctctttgaagaaatgtctgattctagggccagaacatggactatataatctgaacctggaggttttttgtagtgctagaaagcaaggaaatactaaagcacacacacaacaaagggacacaggaatcaacctaaagaaatcccagtggccaaagctgggacaatttgagcaacagaataaataatgtggcattattttataacccaaagtataaaatatctgtaagcccatgctgatacaaacaaatgattgcataaacaaataaatagggaagacaaggcgcctctcccatacggaagaatcccaaatgctttatgtgtaactctcatcaagggggtgatgcagaactccccaccctttatgtacagcttgagtatagtgacttcattccagagtgaacaatatggaaaacagggcttggaagagtaactttacaaggaagaaatctgataaacactacttcagccaggtgatcaagttcaagtcgatgatgaacttgaccattaacaatgataagtcatgttgatagcacataccctaatgtgatatgatgaagacggcattttacctctgtagtactcctctataaaacagtaacatcaatgtaaccacaagaaaaacattagctaaatcaaaattgaaggtcattctatgcaatgcttgaccagcacttctcaaaactgtcaaggtcatcaaaatcaaggaaagactgagaaactgtcacagccaagatattggtgcattagtttcaccaagattattggtgcctcaatactggtgcatgagttgacaaatgtaccacactaatataagatgttaaaaataggggaacctcggtgtggggtatatggattttcacaacttttctgtaaatataaaaccattcaaaaattaaaagtttattttaaaaatatacatgcttcccaccacttaataactgtggtatcaactgtattactttaaactctctgagaatcattttcctatttgtaagctgggataatcctgctgcaaggattataatacacgtaaattccctatcacagtgcatagcacatagatgttaataaacattagttctttttcttctctttccacacataatactatgcatttcaaaatacatctgttctatctttttaaagaagggttcattactattttaaataaaatcattttctcaaaaagaatatttaatatcgtggcacaatttaaaaactagtttttggagattcctagtatatcgcaataacataataattgcaaggagcaaatacaatctgtctctattttatgataaattgtctatagtaaaaaatggactgttaattgcataactgaagttatagcttatcaaatcaggccatcaacattaagcctatgattgattccctttttagggactggagcaggaagatgtaagggcctatttagagttgactaagctaagaaagacatggaggaattacatgaggacccaacatttacagagacagcttcaatataaaatatgcaaagatgcaaatttaaacattacctggagaatttcagggtgtaagaccacagaacattgtttcagcaaagggagcagtaacatgatacagttaaataatagaacactctaattatctagaaataagtttgaaatgcctaaggtaatagtgcctgcaagctcatagtattacagaaataattccatttttcaaaattaaccaccaaatttgcatgaggaatatccaaaattgaaaaaaattgcctggtgttgaaatatgcatttttattttgatgttaaacctttcgaacacctgctttaacaaactgtctccaagtgaagatgtacatatgttatgtattttatgtcataaaatattagaaaaggaattatactggtaaagtgaccaatatattatatgtgagaataacttaacgttttaaaacacttccacatacatcacttgtttcttctcaacaacctcattttgagtcacatttggctccactcccattttatagataagtgaatgtaacctcaactaacctcattacacaagcatttattgtgaaactactaaacgccaatgcagtatgctagctgccaggtgtacattcctaaataacactgacatggtccccaccactgggaaactcaactccagatgactttgttttatcatgtcacagaccaccctgacagattagtggcactgccagattagtggctgctgcacatctgataggatccccagaagacgacgctgctcccaaagacttgggcatgtcaagctcgacccttctaaaaggtgtgtggcaaactgatgactgcaccccagaaaatgttgcctcagctccctgttaatctttcttctcttcaaacaggggataccagcagtgctcaagctcaggatgaaaaaggagaaagtaaattttcttctctcttccaccatgcaaaccacccaccaaataacccagctttctcaaatgtttaacatggtagtaaatttatcttccttaattctaatatattttggaatgaaagattatcttttggtcaatggttaggtctattatgtacgaagaactaacttgaccaatattttcaaaagccagacaatggcaagttgaaagtggtaatgcaattattcccttaaaccttaagacaaaggagaacaaatgcatttatttacatgaacaaattttttattatggtgtttgaagctcacactttttattttaaagcatatattaaaattggagctagtcatttgagctttgaaataaacatttcaggacaatagatgcacacttgatgaaaagctgacctttgcagtacatatcgacattcacaaaaaaatggaaagatattgacacagtgcaaacatttttcttttcttcttttttcttttattatactttaagttctagggtacatgtgcacaatgtgcaggtttgttacatatgtatacatgtgccatgttggtgtgctgcacccattaactcgtcatttacattacgtatatctcctaatgctatccctcccccctccccccaccccacgacaggccccagtatgtgatgtttcccttcctgtgtgcaagtgttctcattgttcaattcccacctgtgagtgagaagatgcgctgtttggtttttgtccttgcaatagtttgctgagaatgatggtttccagcttcatccatgtccctacaaaggacatgaactcatccgttttcacggctgcacagtattccatggtgtatatgtgccgcatttgttaatccagtctatcattgatggacatttgggttggttccaagtctttgctattgtgaataatgccgcaatatacatacgtgtgcatgtgtctttatagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcacatgtctgttggctgtataaatgtcttcttttgagaagtgtctgttcatacccttcgcccactttttgatggggttttttcttttaaatatgtttgagttctttgtagattctagatattacccctttgtcagatgggtagattgcaaaaattttctcccattctgtaggttgcctattcactctgatggtaggttcttttgctgtgcagaagctctttagtttaattagatctcatttgtcaattttggcttttgttgccattgcttttggtgttttagacatgaagtccttgcccatgcctatgccctgaatggtattgcctaggttttcttctagggtttttatggttttaggtctaacatttaagtctttaatctatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtagtattatttctgagggctctgttctgttccattggtctatatctctgttttggtaccagtatcatgctgttttggttacggtagccttgtagtatagtttgaagtcaggtagtgtgatgcctccagctttgttctcttggtttagtattgtcttggcaatgcgggctcttttttggttccatatgaactttaaagtagttttttccaattctgtgaagaaagtcattggtagcttgatgggcatggcattaaatctataaattaccttgggcagtatggccattttcacaatactgattcttcctatccatgagcatggaatgctcttccatttgtttgtgtcctcttttatttcgttgagcagtgctttgtagttctccttgaagaggtccttcacatcacttgtaaggtggattcctaagtattttattctctttgaagcaattgtgaatgggagttcactcatgatttggctctctgtctgttattggtgtataggaatggttgtgatttttgcacattgattgtgtttcctgagactttgctgaagttgcttatcagcttaaggagattttgggctgagacaatggggttttctaaatatacaatcatgtcatctgtcaacagggacaatttgacttcctattttcctaattgaataccctttatttctttctcctgcctgatttccctggccagaactaccaacactatgttgaataggagtggtgagagagggcatacctgtcttgtgccagttttcaaagggaatgcttccagtttttgcccattcagtatgatattggctatgggtttgtcattgatagctcttattattttgagatacatcccatcaatacctaatttatggagagcttttaggatgaagggctgttgaattttgtcaaaggccttttctgcatctattgagataatcatgtgttttttgtctttggttctgtttatacgctggattacatttattgatttgtgtatgttgaaccagccttgcatcccagggatgaagcccacttgatcatggcggataagctttttgatgtgctgctggattcggtttgccagtattttattgagtatttttgcattgatgttcatcagggatactggtctaaaattctctttttttttgttgtgtctctgccaggctttggtatcaggatgatgctggcttcataaaatgagttagggaggtttccctctttttctattgattggaatagtttcagaaggaatggtaccagctcctccttgtactctggtagaattcagctatgaatctgcctggtcctagccttttttttggttggtaggctattaattattccctcaattttagagcctgttactagtctattcagggattcaacttcttcctggtttaagtgcaaatgtctttaaacagtcatttagcctgtccattattccaaataattaggttggtgcaaaagtaactacggctttaccattaaaagtaataactggtttgattcatttcatttatattagcttgtcagttcattcaaaatcgttaaactcctgctggtgtgcaagcacaaaatggtgtcattgacttatttgggttctcaagtgtacggtaaacaactgaaaatgggcttcatggccctttcaccaactagagaattaagcatccacaggggagaaagtggtttgaaaaaataaaagcacagccaagcaaaaaatgtgttttgatttttaagtgcaaagtccaaatttgttttcagtttgtctctaaacctctttcagagtttttctcctagaacctcctctcccctgtgggatcatactgaacaatgttttgacgtctcagtcatttccataacagcagattacagaaacaagacaagcagtcaaacaagtaaaatggtttgaatttaaaaacagttctggatcactacgaagacagacatggaattgtaccctgcttgtggagagaaaaactactgatcttttctttttactgttgataattcattgaaggaaaaaccactatgactttgaaatttactcttattgtgctttttttaaaaagttatgttgttcctgatatccttacacatttttaagttcctttcccacctatcttttcttcctgccattccatcccattgtgattcttgctaaatttgccagttggaatgtgaaggctaaattatcagtactgatgtgtcagtatcactcagagaaaaaggtgccaatatttcatcctagcagtcatcattcccataaaaaaacacactttgttgaaaacaaactagttgattatacaaaacctctactaagataattggttatttacatttacaaaaaattcaatatagccaaaatattaaggaagctgaatttattgaagagtttattcacaacaattaaacctggttgagtacgtatgcagcctcagcgagttactcataatgggaagagcatggcttctggaatataatagaccaggattcaaaccctcggcctaaaatgtacataccgttagcctcaactgtaaacaaaacttatatataaactctttgagccttaattactccattgaggaaatgaaaataataccaccaaaggatataatcatgtgctgttaaaccaaaaatttgaaaagccatgatctgcagcatttgtcagttccatggtgtaatactcacacaatggccattttcaagctagcaacgtaacatcaatgaatgaggacttgggaagagatgcacagaatcagccctcaagagccaggatgaatcagtttcaacatagaaagttcttacagcaaaatgatccttaatcttaaactggcacagtaatagtcattcaataaatagtttttattgttagtataattattagccaaattcacaaggataagtagcctatcaattcatacctgatccaaaaaacaatgaaacatctagacaataattgaagttctatatcataggtacatatggaatattactgaccttgggcaacactgtcaccctaagcctaaaattattttactttttcttttgaacacaatggaggcgttaaatcatgtggatatcagcttttctcagttgatgtttccaaattattggtcccagattatcaagacccattgaattgaaataattgcaattatttcatcagagtattgaaggtatgtatcgacagtgtggcaggcaatccttgcatatatagaatcagcatggtgtcaaagtgtactggcttaccaggtttatgcacaggttatcataaaccagagatttattatgggaagaaaaagtaatatccaaacaactgtacatagctagagtgcttcccccttttattgtgtgcttgataaatcatttattatgccagtgaagataaagcaaaatttacatgtccctcaagtgttgttgtctgtagtaaataatgctgattgaactatgcatcaaaaaaatgaaagtttataacctcatggaatacatgcaactttgtctgaatgaaaaatggaaggttataaatcacagataaccacattgtgaaataaaatatgcaagacctcccttacatgagatggagttctgtcctatttatttgcttgattgtgttttggcaactataatctttatggcatagctggtaaggccaatcatgaggaagtcagctccaaacgtatattaaggatttattttagtcacctctgcttctcttctacttggggtgggggagtcataaatatggcccgcccatacattaaattgcttagtgagccatagatttaagctgagaaaaggaaaagcgaactcatatattattaaattccataaaagctattaaatcagctaaggagcacaataatagaaaatgagtttaagaaaaactgagttttttattttgatttcacttgaggaagaaaatatagatgctagagctggttttgctggaaaagtttccatgttgcataaatatatagaagaaaaagctaattctaaagaaagagaatgcattttaatctttaatcatcttcttgattttagtaggcccaaatttgaatgcttagacaacaggcattcattaggaggtaaatatcaaatacccactttatatgaaaacaaacaaaaaaatgaaaaaaaaaacggaagaaatttagggtaaaatggcagatgagacacaatcccaggtttcaaggaatatgcaatcaagttagggagcaggggaataaggcagtatatctaaacaaggcagaagacaagtgttgcaagagagctacaaacactgctatatgaactatcaaattcacttgtggaatctggttaggattttaaaagaactgactgttactgggccatgaaaataagatagaattttaacagatgacagttggggcgggagaagatcattacaggtggaagatatagcaaaagaaactaaacatgggacatgaagggaatttttttttttagaataagaaattttccaataagcacaaattccaagttacattagacttccaggactggttcaaggttgtgaatgccaggataacaaatcaagaaacagttaacttaaagagtaggagaccggtcacatggagcatgactgatagaactaaaaaggaagcctgtctaacatttctgtattccccttgggctttcagaagtccttcttgatcccagctctctaacaagtaggtcaaggggttcacatgccataaaaaatataagcaggttcattgttcacttgagtgaaactccggcatacagtctgtaggaagtaatgagaacctccttactccaattatcattattctccccatgtgaaaaaagctttcttcctccttgcccggagcctgtacttctgatggagtttccaacagtgccaaacagcaaggcataattccattactcctggaactattcttacatatttatccctgctgatatttgtgatctgaaaaaggtagtttgaatacagatgagcccatgtgatatgaatataggttttgttttgcatcatttgactaaattaaattctaaccagaataacaaaactccatttttaaagtggtgtattcaaacacggatttggtctagttatgacgtagcttagctcatgttgctcataaatatgtgtaaactgttcattatctcatgccttcctaaatccctggcttgttagaataatctagtgagacaagatatacaagaattttgtaaaatgtaaaattcaccagtattaggcttgttagagcaaaaaaaaaatttcttggtttgtagattcagtggaaagattattgtaggttttaataagataacattcagtgtgaaaattacaaatgagaagaaatgtaaaatttttgtcatctgtttgcatgtgatttcagtttttccatgtaaataaacatgtacggcttgcccaagttcacacgactaattacgtatagaactgggatctgactttcttcacaccaattcatcaggtcactttttcctaccataaaaatcttacctggttgataatacaaaacactgctatttttcttgcttcatctaggctcaagtttcttagtaccaggtaccaaaataccagattaacgaggtcatccaaaaaatggtctttatggcaaaaccatatgtaagccttcaaaattccaaaatgtattttaaacactacttactgaatcatctcgcaattaacacgtaccattctgtttgcagttcatagcactttattttccctgaatgctttacagaactttatagagctttataaaacttccatcttcttgagtgcagtattcttagggaccagtgatatttgttactgggtgaaattcaattgtctccattttatttgatgttgctaagataacctcacactcaaaatcacatgaatcttcttattttgaatattattcagaggaaaacttggtttttttgttttttggcaatgtgtttttttaaaaaataaaaatagcaaaattctattttggactatccctccagtggttattttcttagtttcaattgactgtttgcagtatgctttctctatcacttcccaacttttatctgtaagattaaaatggttgctgtcactttaaaagtgaatgcaccactagggaatacaaaactttttctttaactattaaactatgcaatccataataccattaaataatttaattaggttgaaaatgatcatgcataaatatattataatgattttataacatagtcatattttacatttatgaaaagtatatattgagataactagaaatatgcaaatagacataaatatatatttatgtctagtaaatataaaataagaccacatgtaccatatgtaccacatcatacatcaaaaaatttgatatgataaatatcaaaataatgaatctaaaactatttcctagaaaaatgtaataagtaaaatgcccttataaatatatttttgaggcaaaaatctaaaatcatattttagttaaaaaaatacacacacacacatacaaattatctatgcccacagttcactcattctattattgtttaatttttttcagtgatctctcagaggcctttatagattctgaatacaagtcttttgtattgggaatattatccagctttgtggcttgcattttcaccctcttaatgctacgtttgatcaacagttctcaatttgatgagctccaatttatcaatcttattttgattgagcttttggcaccttaagaaatattttcctctcctaccttatgtatttgactacaatggtactgtccactagtcatgcgagattacagagtacttgaaacacggctagtccaaagtgagatgcaagctaagtgcaaaatacacactgaatttagaagactcagtatgaaataagaatgtgaaatatctcaaataattttatattcatgaaatgtgtttacattgcttaccttttcattcattttgtccctcttttctatgcttttatttaccatattaatcatcgttattttaaattctttggctaactctaatatcagtttcatttgtgggcatccaaggtttgtgttatttcttttctctttttttctttttcttttttttttttgagacagggtttcgctcttgttgcccaggctggagtgcaatggtgccatctctgctcactgcaacctctgcctcccaggttcaagtgattctcctgcctcagcctccagagtagctggcattacaggcatgtgccaatacacccggctaattttgtatttttagtaaagatggggttttgccatgttggtcaggctggtctagaactcctgagctcaggtgatctgcctgcctcagcctcccaaagtgccgggattacaggcatgagccaccaagcccagcctgtgttatttcttgatactcacatttacatctctcttttcatgtataaaaattaaatgccatgtattatatataaatgaatcagagatttatgttaccttccaccaactagtagttcaactctcctctattaagcagagaggagagggggtggtcactttaatccattaaaggattgagctgggttggggtgggctgtcattttagtaagacttagtccaacactggtatgtctctgttcctcaggtgtggtggtgcttttgtttgtgaacctggcatgtctctatcttctcagttctaaaatgacaagattgcctttagagattggagcttagccctttatctcctactctatgtgggcgtcaaaatatgcaaacttttcgtttaaggaaagtctcaccctctataggaactttgtttcctaagtattaagacacaacagcagattttactctgcttttctgtgccccagctacccaaaactcagaaaacatcttgcagagataactggtcctatgtttggttctcctttagtttctcattcatcaagccagcctcttgctggtttctctattccatgataaatcctcttcatggaccaagactatacttactgaaaattcagaaacagcagattcccacaagtaaaaatagttggttattgttagttttcatatgaaagtcttctctcattggaagttgtggtaggtagaattttaagatggcctccaagctttcctacccctggtacacatgtcttgcctatctctgggcccttaattatgtaggattttactcctgggactaggttgatatggtttggctctacgttcccacccaaatctcatcccaaattgtaatcctcatgtatgaggggaggggcctggtgagaggtgatggaatcatgggggcggacttcccccttgctattgtcacaatagtgagtgagttctcatgaaatctggttgtttgaaagtgtgtgccacttccccttcactctttctcctgcaatgtaaaacgtgccttgcttctcctttgccttttgccatgatagtaagtttcctaaggcctcccagctatgcagaactgtgagtcaattaatcttttttttatataaattactctaagttagttcttcatagcagtgtgaaaacgaactgatacataggttatgttatatcgcatggttaactttgagaaagggagactacccaggtgggccttatgtaatcgcatgagtcctttaaaagcacagttttccctggctggctgcagaagggaaagtcagagacaagtacttggccacacctggaaaacaggaaaaacccatgttgtaaacagccaacagacaggtatgcctcaaggaggtgaaagtggtttccagccaacagctacagaaaaactaggacctgcattctacaaacacaagaaaattaattctcagaacagccaatgagactgttaaagtattccaagccccacataagaagtacagccccagttgacaatctgattttagtcttgtaagaccccaagcaaagaagtttgccatgctgggcacagacttctgaactataaaactatgacttattaatgggtgttgtttcacaccactaaggagaagatagtaatttgttacacagcaatagtaaactatttttacttatttagtaaactacttttactttatttaatcttccttaattattcagttccttaataccttataaatatataaatacatataataatttatatatttagtgtacctgatttttctgtagctacttacattttatgcaatagaagtctgcttgattttaaagtatataaatatgaagttgaagataatcactcacttatacacaattcaccaaatatctcacttctaaactacagaaagaaaaactatgcaaaatgcttagcatatttcttataggttttttccacacatataaatatagattggtaaatggataaatgatgaaaaattgatggacaggaaatttaacagaaaagaaaaattggggaaatgatcatataggttaactaatggatttaaattacaaattaatagatactttttatctattaggatacaaagcaaatgatgaactactgtcctaagccaaccgcatcaaggtatgtatatgtgttatatgggaatttaaagtcatggatagaaatatttgcctgtttgagtaaatataaagctactatatataatttttttggaatagatatttaacagatataaaattaggtttccgaggttcatctgtgattatataaatagcagtactctcacgaaactgaacctcctggcttcttaccattaataccacgttgatgcaaaatagataccaaataacagtaaaagtcattcccacagtatattgctctgtcaagaaaatttcgactgcttacatgaaaatgacataaaatcttttaccaattgattttttaaagttgtacttcaatgaatagttgtcacgactatattaaaaatacctatgactgttctatattattcactgcatgaacctgagattttgttctgtttttgacaatgctaaaaatgacatacctacctctgttagggaagggggcaaatattaactatttttaaagagaattattttgtgtaaacaactcttagatttatcaagctcagaaaagtagtccatcagccaacagtatctgttgagttcttactgtgtggtgagcagttgctagtgctggggattctgaaattgatatgcattcatacagtccttatcccagaggtttcagtatgtggttggtaaccggcaacaagttattacaaatggcatacacaggtaaaggaaattcaagatgtaatgaagacctataacaaagtaacataactgagtctgagggttcaagccagactttcctgagaaagaaaagcttaatctgaaatttaaaggataaaatggtattatccatgcaaagaggggtggtacaatcatgccaggcagagggagtagcaaaataaactcttggtgatcttgatgtagggaatgagggtgacaccctcaaagaactgtgagaagttcagtgttgagagtaagcagggcccaagtcttgcagagtcttgtcatcccgtaagtaccatatcatgtactcccccatccagtgctactcaaagtttggtcacagaacagcactggatcctgaaatattgataaccaatataaaatgaaataagttcagtcatgtggatgaaggctttagaatctcttatagcaattcgacccactaattttatgtccattgaatttaatgacaatgagaattcgtattttgcatatctttgtttttctctaacattttctacagtaatttttctgtatttatcaaattatctgtcaacaatgcatgattttttaaaatgatcttgtatcataatcatttgaaaaacattaccctaaagtaccctgattcattctaggtgacgttgacactggaaataagctggacagacaaatcataggttgataatggttagtgggaatgaaaattcttctctataaggtgctctgaaatgtataagacactttccagtttataaaatgcaaatgtatttttgatcctcacacaaactttgtgaggttgctacattcatatgtgatcaaaggtcacctagcgaataaatgacaaattctaccatcttggcttgctgatgaccaaccttagggactcatgtagaagacctgtgtagtctgctcatgctcacatgcttttcatttccattcatctaaactcttcgagacatgctaacgagctgaaattatgtgactttggatgcatctttcctttttcaagttgtgcattgtcagggtactaaagatctcaaatgtgctatggggcttcaccccaggaaagggagaagcagaaaactaaataatcagcacccagatagaattgacaacacaaatttgtcttctcctccctctggggaaaaaatcctgcagtctttgatttgtaaacaaagccatgtccttgatcaaaaaccgaaagatctaattgttagctattttaatatagcacaccaattatatttcatttctccaagaatgtgaaattgtgggatttttattcatcttcatctgtacagaagccctgatgtaaatcttttacacattgcttaacaaccacagaaatatactttgtatgggcaatccctacaacacttgaacttcatcccacagttaatactgcatctccctggcatattgtttacaagaatgaaagaaaacaagccaatttagtaacagaaacattataatccatggaaataagaaaaatgagtggaataggatcctcttgagacttcagtgtaattaaccaatgtttaagatgtataaatgctagtaaacttagaatccaagcccaataatttctccagttagaagtgcctgcttctgaagaaactacacaacacctagatcttaatgcagttgctaagaagtcattcaatagagtcggtagagatgggttcatctcctggatctaccacttgttagacattcgatcttgggaaaattagtatgtttctctaaaacaggaataataacagcatcaatctgatatataaatgaggtcatgcatataaggcatttattctacctaatctaacaaagtataaccacattgctgctgtggttattagtatctattacttcagtaacttatcacatatttttgtgataaagacatgtttttaatattattatctctccaaaatcaagatacttcttatagccaatggcacagcatagttttttctggaaactttttctattttaatattacataaaatgacatattacaacccatggtgttaatattatcatttcttagaaaccacattaaactcattttaggctacaaggagacttaattagaaccattatgcagaatattattaataaaacttcagttatttaaaactttcatgcaatgtttcttagaattcacagcttgactttattttttccaggagaaaatagaaatatttcttttttttttttttttttttttttgagatggagtctcgctgtgtcacccaggctggagtgcagtgacttgatcttggctcactgcaacctccgcctcctggattcaagcatttctcctgcctcagcctcccaagtagctgggactaaaggtgcccaccactacacctggctaatttttgtattttttagtagagatggggtttcaccatattggctagactggtctcaaactccagaccttgtgatccacccacctcggcctcccaaagtgctgggattacaggtgtaagccaccatgcctggctatttttttttttttttttttactttaagttctgggatacatgtgcagagaatgcaggtttgttacataggtatacatgtgccatagtggtttactgcacccacccacccctcatctaggttttaagccctgcatgcattaggtatttgtcctaatgtactccctccccttgctcccacccccgacaggcctccgtgtatgatgtttccctccctgtgtccatgtgttcccattgttcaattcccacttatgagtgagaactaacacagcttaactttcatgtgcaacttctactctgtatcagggagacaaaggtttattttcttatcatgaattaaacagagtttggcaagtatttaatgagttgtgttgctggatgctataagaactacaaaacataggacagactttccacccttaatgaacttcttaaaggaggcatatgtctacatgtaacatataaaatagtttcatacttacaataggcactgaatcaagatttgccaaaattaaccaaagatagtaaatgaaattacatatatagatagactactttggaaaaatttaaacacaggctctctgtgctctacagggtcacagaattttaaagcttgaagagatattagaaatcagccactttgtgaaggcaagtcataagtcatctggtctagctgccacactttaagacagggatcctgagctcaagataatttactgagattcacaatgtcctctgactgggaactgacagatccagagagcaaaatccatcttctgtctcaggatccagaataaatacgtaatttcctgagtagctgagcagagcacggtggatattagtgtcatatgtatattaggtgccatgctagaggaggtagaaggaaaggtagtctttacctgtgtggccatgtctaactaaaattaaagggaggtcagttgctgtggcttacaactctaatcccagtgctttgggaggctgaggtgagatcacttgaggctaagagttcaagaccaaccttggcaacacagcaagactccatctctggaaaaaaaatcttagctaggtatggtggcacatgcctgtaatcccagctacttgagaggctgaggcaggagaatccattgaccccaggagtttgaggctgcagtgagctatgatcacactactgtactccagcctggatgacagagtgagatcctaaaataatttttttcaatttattaaattaaaggaagtttcattaccacatggaaaaataagaagaaaatagtcaatggagaaaaattaggagttggccacagaattctggctgaaagtaaaacacgagcgaatgtcattaggtgaaagcatttgggaatgctgattttgtatgatttacaatagccaagacttggaaccaacccaaatgcccatcgatgatagactggataaagaaaatgtggaacatatacaacatggaatactatgcagccataaaaaagaatgagtccatgtcctttgcagggacatgggtgaagctggaaaccatcatcctcagcaaagtaacacaggaacagaaaaccaaacaccgcatgttctcactcataagtaggagttaaacaatgagaacacatggacacagggaggggaacatcacatactggggtctgtcaggggctggggggaaaggagagggagagcattaggacaaatacctaatccatgcagagcttaaaacctagatgatgggttgacaggtacagcaaaccaccacggcacatctatacctatgtagcaaacctgcaggttcagcacatgtatcctagaacttaaagtaaaattttttttaaatgcagattttatatgcaaaaaattcctgaatattgatgatttcatatagtgaaacctaatacattgttgcacacagaaaagagtcaagaaaacaaactggttttgttagcacctcattcctcatctgaccctgtttaccttttagttttgtttggggtctctgtagccagggcagttagggacagaaccttaaggaggtgtctccatgaattactatgtaaattacatagaggagtaaagcccagactgtcagcccaaaataacaatgtgagttacagagtatctgcatggaacccaacaacagaaggacactcttggcatagacttaaaggtcaactggcagcaccaagtggccttgaacatgaagtatttttaaataggaaacagaaacagtagatcagtcaaaataaatactaggagttcccaatatacttactggggacgtgcaagaggtggagtgtccttcaagaatatgagggagcaggagacattgcattgggaatattattgtcatcactaacatatccttgcctacgatattggaatatattcagattctgtcagtcttacctccctttctctgtctttctccctctcacacacatgcacgtgcgtgcacacacacacacaatcctacccatacactatattgccaatggttctttttcaatggtggcaatataggtttcagacttttgcttgtcagtctgttctgtattttatatagtaacacatgctacttttaattttaaactatacaaatcaagaggttttaaagagttttatccacgattaccgcatattttatgctaatttttaaaatacaaaagtaatatgttaaagactaccttaacatcagaatttctctttagatatgaatgccactgtatcctgataatactaaacacagtgaggatattacacctgcctagtacatttatgattttattgctgatattcattctccatgctaatctgcaggaagcattattactgctgtattttataaataatgctcttatttgtggtaatgcttagcagaaatgtaagaacttgcaaaatattttagattttaaatttgtcttcttcttaaatgctgcttttggtgctttataaaggtcacaactacattttaatgttcactacatgtaaatatgggaaagtgcgagaaagccaattagatgtgttctgttttatttacagagtgcttgcagctctagtttgctcactatatcaacaccttgtcagataaattatgaaagtttattcattcattcaacaaatatatatagtgaacacctactatgagcaaacaataatggcctttactggaaacaaaatttacatttaaaggtaattctagctgcacagaacaataagaagccatataatgtgctagttaagggcacagaactcaagtaagtttacctagttccaaatattagtttcatcatttataggtgatttgtgaacttagaagaattacataatctctgtctcaggtagttatcagtaaaatgaggataatattatctacatggttggggtgttatttgcaatgaatgagatcaattatgtgtcacatatagaaaatgctatgttttcagtgtttggtttccctgatacactcaaatttttgttgaaattatcagtagacctactgttttctccagaagaaatattggtgattggataaatgaatttagaaagtcatgacatttcagagctggaagaggatttattgattacctaacaaccccatcattgtacaagtaagaccacaaaaacacagagatacaaagtcaagtagttggtaagtttccaagcttgattaaatcccacttttagggctgcgtgcagtggttcacgcctgtaatcccagcactttgggaggccgaggcgggtggaccacttgaggccaggagttcgagaccagcctggccaacatggtgaaaccctgtctctactaaaaatacaagaattagccaggtgtggtggtgcacacttgtaatcccagttacttggaaagctgagatgggagaatcacttgaacccaagaggcagaggttgcagcgagccaagatcatgccactgcactccagcctgggtgaccaagagatacctcatctcaaaaaaaaaaaaaaaaaatcccacttttatgacttcctgaccagcattcttagaatagatgccaattgcatgtccactcattcattctacaaatatttattaaacagcacttcccatggcaagcactattgctaaatacaaatgacacttggacaaatcagatgggttacttatcctctaaaggttcacattatattggggtgcacatgtaaatgcatagtgttatgtgtgctctgataaaatatgaattggtggtagtacaatgtgggagtgatagtacaatgaagtcagtgaacaaatctatctaaaaattgtagaaaggcttacacgagatataactcttgatcatgaatgtggactaagtatttagacagaggtctatgtgtctgaagtattaaacaggaagggggaaggattcattaaaagaaaaatataaaagacagtgagtgaccaaatggtgaaaggctttgtatgctgatatggtttggctgcgtctccaccctaatctcaccttgaattgtaataatctccacgtgtcaagggcgggaccaggtggatatgattgaatcatgggggcactttcccccatactgttctagtggtagtgaataagtctcatgagagctgatggttttataaatgggaattcccccacacaagctctcacttgcctgcagctatgtaagctgtgcctttgctcctcctttgccttccaccatgattgtgaggcctccccagccatgtggaattgtgagttcattaaaccctcattttctttataaattacccagtctcgggtatgtttttcttcacagcttaagaacagactactacatatgccctgatatatagttttgtattttacttctaaactattcacaaggaaataaattaaatggaaaagaaatgattatccaaagatatcatagaagaagcaatgtcatgaagagtgaagttcagattaaaaagatttgctatacccaaagcaaaatgagtgaacaaagatggaaatcagaaacaaccttcataatattattttgtttcatgcacttaaaaactgtcctccataagcatgggcaaaggtttcatgacaaagatgccaaaagcaattgcaacaaaagcaaaaatgggcaaatggggtctaactaaactaaagagcttctgcacagcaaaagaaactatcaacagagtaaaatgacaacctacagactggtagaaaaaaatgtgcaaactatgtgtctgacaaaggtctaatatccagcatctataaggaccttagacaaatttacaagaaaaaaaacaaccccattaaaaagtgggcaaaggatacgaacagacacttcttgaaagaagacatacacatggccaacaaacatatgaaaaaagctcaacatcactcatcattagagaaatgaaaatcagaaccacgatgagatactattttacaccagtcagaatgactattattataaagtcaaaaaataaaatatgctggagaggttgtggagaaaaagaaatgcttttacactgttggtgggagtgtaaattagttcaaccattgtggaagacagtgtggtgattcctcaaagacctagagacagaagtaccattcaacccagcaatcccattactggatatatacccaaaggaatataaatcattctattataaagacacatgcaagtgtatattcactgcagcactattcacaataacaaagacatgcaattaacctaaatgcccatcactgacagactggttaaacaaaatatggcacatacaaaccatagaatactatgcagccataaaaaagaatgagatcatgtcctttgtagggacatggatggagctggaggccattatccttagcaaaccaatgcaggaacagaaaactaaataccatgtgttctcacttctaagtgggagctacagcatgagaacacatggacacacagaggggaacaacacccactggggccaattggagggtggagggtgggaggacggagaggatcaggaaagataattaacggatgctagacttaatacctgggagatgaaataatctgtacagcgaaccaccatgacaaacgtttacctaagtaacaaacctgcacatcctgcacatgtaccactgaacttaaaagttagaaaattttaaaggtatcctaaaggcatcaagtatggcagaaaaaaaattaagtttataaaaataagaaaataagaatgggttatcattatccaatgcctctctacaaattaaggggctaggtctgcagagtgttatgggtgaaaggttgttgtaattgacaaattctgtacttaaagatattatccataaaatttgaaggcaaaacaaaaacatatctgaaatgtacaaaagttcaggaaataaactagataacattcctgaaaaaaaatcactcaagggcaaatttcaagtaatctaaaaaaattcaaaataaagaccacacaaataaagatgtagcagcaaaatataaaagattaaagaagttattaaagcaagttaaagagaaaattacaggtaagtgacttctgtaaatatggatataaaatagctcttgtcttaaggaaattataaaatatcatatttgcatataataagataaatcaaatacatatataaagtggaccccgcatcataccaaagggaggagggaaatcattctgatgatgatggagatatataattagtagaattaaaaacaggctttgtgctgttaaaggatggcaagaccaaccactgaatagacaagattttctaaagctgaatttattgcttattatcataaagaagaacactgacagtcaaacacagtctttccaagcagaaaaaacttcaagtcatacatagggtttttggaaagcatgatattccgagattggtaggttttcagaggtataaggagttgacgtcatcagtaaaagtatggtaacttgggtgagaatgcctttgattgcttggcaccccaaaggcgtatatattggagtgaatctgtttctgagtggctaacttttggtagcaagagtctgtcactgatagtttgtcattgatgggctataaatgttatcgatcaactgaactgctttaaaactgattttgccgaagcgggcggatcacctgaggtcgggagttcaagaccagcctggccaacattgtgaacccgtctctactaaaaatacaaaaaattagccaagcacggtggtgcatgcctataattccagctactcgggaggctgaggcaggaaaaccgttcgaccccgggaggcagaggttgcagtgagctgagatcatggcactgaactccagcctgggcaacagagtgagactctgtctcaaaaaatggtaataaattaaattaaattaaaattaaactgattttgatgctccctgtagcatgactaccaaagattccatctttgcctaaagtatgtgggaactttccattttcaataactaccaagttaccaaagggggaaaaaaacaaattaaattgaaaatctataaaatgttaagaaactgtatgaacagaaaaaataagatgacagttcaaatatttttgttactttcattggtaatgttataaacattcttattaaaagaaaattattctgatcagcaggggaactccagttctcgaaatggcagaaaagattgtgctggattaattctgcgaccattaacatgtataatttccccacaagatattaaaataaactgcctaaagctattgacaagccaacaaaaacaggcaaaactgtaggggacacagttcttgaaagaatgcctcctttaaacagctttacagtgaaagagatttcctagtttcctgcaacagaatgagattagagtccaaacagaaagcagctttactgagctgaagagacagaaagagtttagggtaaccctggaaatcagagaaagctcctgaaaagaagggcacacataggaataaccttaaattctgcatataagtccctcaagtgcttggacaacattaaataacatgtattcagaggaaaaattcaagaaacctagaaggaagcagtaggcagttaggaggcagagatttcagcagtcgcctgatgctaagaagacagttgatatgtcaagttctgtcaagctagtatagcttggtgaacacactgggctttcccctaacatcgcagcagggccttgtcttacaaatgagcccaggactaagaactatacaaccttatggttaagaataaaactaaaatataaccatcataaataagcctagaaccaagtctctgtagagtcaaagtaatctgttggtgatttaattgcctgcctgcaaaaataaaacttgtgtcttttaggcaggtaagatccagaggctcctcaatgccctatatgcaataaaaattactacacatacgaagcgtgagaaaaatatggcctataatctgaagaaaaatgtagccagtagaagcagatcaacagatatccctgatgtagagtgcttattataaataggtttaattttttacaagagagtaggacaaaatttataaaacaataagaaacattagagaaatgatgctatcaaaagtcagataatattccagatttaaaataaaatttaaaaaaattattagatggacttggtccacataaaaaagaaagaattagtaaactttaagacaagttattagaaattaaacccagaaagattgaaagaaaatcaacgggacctgtgaaatgtaaaataatatcaaacaacctaacatgtgtgattggagtagcggaagaagagaaaagaaaaatgacacagaaaaacatatttgaagacataatggctgcatattacccaaatacagtgaaaaacacaaatttaaagattcaagaaattaagcaaatcccgagtatggaaaatagaaaggaaaacaaatgaaagctcatcaaaagtgaaaatgctgaacaccaatgttaaggagaaaaatgttaaaagcagccagcaataaaagaaatattacatattattctgttccttttggaacatggttaaaaataatggttgtcttttcatcagaaacaaaagagtcagaaagacaatacaataagatctttaaatggctgacagaaattttaaaatgtcaacctacagctctgtatgtagcaaaaaaataaccttcaacaaaaggtgaaatggatatattgtaagataaataaaacctaggagaattttcaccaacataaaagaaacactaagaaaaatttaagctgaaaaaatgataccagattaaaaaatcatgtctataggaagaagtgaatagcaccagaaatacatatatgtagaaatttaaatgacttatttcttattttgacattatatatatacatatatatacacatacatatacatatatatacacatatacatatacacatatatacatatatacacatatatacatatatacacatatacacatatatacacatatacacatatatacatatttacatatatacacatatacatatatacacatatatataatatgagattctgggattttgtaacatgtagaagtaatatatatgacaataatagcacaaaggaagaaggagcaataaagagaataatcatataaaatcattcaattgtgtatgaagtcatataatgctaattcatggtagcctttcataagctaagccatatcccccaaaataacatgcaaagttaaaaagccacttaaggctgggtgtggtggctcatacctgtaatcccagcattttgggaggccaaggtgggtggatcacttgaggtaaggagtttgaggccaacctggccaatatggcgaaaccccgtctctactaaaaatacaaaaattagctgggcatggtggtgcatgcctgtaatcccagctactcaggagtctgaggcgggagaatcacttgaacctgggaggcagaggttgcagtgagccaagatcacaccactgcactcttgcctgggctacagagtgagattcaaaaaaataaaatataatcataaaagtgctccatatatccaaaggcaggaaataacaaagaaaaaagggacaaatagaaaaacgttctattcttcaaaattgcacttaatataactggacaaaacattcttatcaaaacacagaaattgtcacactgggtagaaatagcaggatctatccacaagctatttacaagatatgcaatttaaatatatagaggcaaaaatgttggaagtaaaacaacggaagagtatataccatgaaaacactaagaaaacagtatgagcatagtttggtggctcactcctgtaatctcagtgctttgggaggctgcactgagaggattggttgaggcttgtagttcaagaccaacctgggcaacatagtaagacccattctttacaaaaaatacaaaaagttagccatgcattgtggcacatgcctctagtcccagctacttgcgaggctgaggcaggaagattatttgagcccagaagttcaagtttccagtgagttatgactgggccactacactctagcctagttgacgaagcaagaccctgcctcttcaggaaaaaaaaaaaaaaaaaaaagaaaaagaaataaataaatatggtatggttttattcatacaagaaaatgtcaactttaggacaagaaattttttgagaaaaagaaaatattttcataatgataaatggttaaatttagtaagaaggcctaacaatgtgaaatgcacatgcaattcaaaacggaaattctaaaggtgttacgcaaactggcagaactagagggaaacataatgaacaaatccataattacacatagggattttcacactcctattttttactgataaaacaagaagacatgaacataagaaagaatagaaaacatttaaacaatattttcaaccagtgaccaaattggtatttatattactcatagacaaggaatgacatttgaaggtcttgggtgtgagactttacaaggtctataatgaagatagggtaataaaaatacagtgagtagaactgaaaagttacggaagtgtgaatatgatggcatgttcagagaacctcaaatgtacagttaataattctagagataaatctggaaaagttggtaaagatgcccatggaatttggcactaaagaacttttggcaatttttaaggaaggggaggatcatgatcagatcctttttaggaaagtatagaggaaggaaatatgggactatttaaaaaaaataaacataatacatgggccaaatatggaccatttataaagatgtgaaaagaccagagatagagccattaaacaaatgtcaatacatttcaaatgatgaaatcatacagtctgttctctaatgacaacacaaataaattaaataatgaagatatatatagtctaaatatttggaatttaatttccaaattaaattaaatatttcaattcttctaaatatccattagaccaaatattacaaggaaaattaaacttttaaaaaagatatataaataaactaataagctactcagtatcacatgtcttaatgtatcacttaatagaaactggattctcatattgtttcttcattcagttcattgtgacaagttgtgttggttgagacagctgaataaaacagcctcatacagatatatagctggaaaaggaaggtgttcttttgaaaaccctttcagctaatgtagatattgttcttttatatcaaaactcaaaaactgatgaaacctgagaagttagttacaatacagattatgaaactgttagcaaaacaccagggtttaattctaagttatgctgctcactgtacagaatgccaatcactgagacaacacatgctgccaccaaggagaatggtaggtcagcctcaggctcatctccctgactgaataaaactagggcacttatacagggaggaaggtgggaaaacaggaactaaggaagggtaagaaagcaatcatgatggatgaaggatctagaccctcattgtctggatgcagggatctagtgagttttaatctcttgcctgagggttggtttcctgaggaaggaacacagataagacaaatgtaagtttcaaattttaaaaccaaaggtcaatttctatgtttattcaaaaaacctgcaaaaatcagttttatgggctaattatgccacattcaaaatcatactgcagcacactgaatgttggcctccaataatatatatgcataccttgatccctggaacttgtgaatattactttacatacccaaagatatgattatgttaaagattttgagaggaggagcttaccctggatcatccaagaggaccctaaatgcaactgcatatatctttataagacagaaatggagaaagttttcagacagaaagaaggaggcaatgtggccacgggggcagagattggagtgatgtggtcaccaatgaacgaattgctggaaccaccagatgctgggaaaataagtttctttcctaaagtcttcagggggagcaagggcctgctgaccccttagtttcaaatatcaggcctccagaaataacagagaatacatttgttattcccagtcaccaagtttatggtaatttgtagcagcagcactcagaaacaaagagacatatcaataaacttttcacattctgttacattaaaatccattggtctatcttgaactttgaatagatctttcactcaagcgtgattttgtaacatcattcattgtttatgtgcaaaacattggttaactaagttattcagatgttccaatgttgacacatttcattgtgtaatatcaaaagccacatatattatcaacaccaatcttatcaaacacatctttaaatattgagaagctggtggttacaagatttttaaaattcaaatatttgcctgaaggttcaccttttatccctggtaaaacatactgtcaagttgttttccttgaagtgacagacacacttgatttttgaaaagtgtctaaaaaaaacccaatctgaataaccatagacagtcatttttattaagtaaaaaatgttgttccatggaaaatgcagccaacttcacttacaatttaagtattctatttgtcaggatagccactgaacttcagaatgcacctgtagtgatttatgtggactgcccattttttcacaaagaatattaaaaatgagtgtactcaagggtcaaaatttagtacaattagcaatttttactgtttcatcaaggacatttttatatgatgctgttatgtttactgtttcttccttttgtttttgactgtgagtacacagcagagaaaaaaacaataactattagtgcagtttgttgccactgttttgattatgccaaaatgccagctgatttatttttcccaccattgcttttgttgcatccgtgcaaatgttcacatgaaggaaaagacaaataacaccttagcattattataaaaatatttctggtctttttgaccccccaaagggtttcaggagctccccccacctcccaggagtacatgtgttccacttcgatactgatgtaaagcaaattgttccattgcaaatgggatttaagatggtagaaccactttggaaaattatgcggctttgctttttttttttttttttttttttgagatggagtctcactctgtcaccatggctggagtgcagtggtgcaatctcggctcactgcaagctccgcctcccaggttcatgccattctcctgactcagcctccagagtagctgggactacaggtgcctgccaccatgcccggcttttttttttttttttttttttgtatttttagtagagacgggctttcgccattgtagccaggatggttttgatctcctgactttgtgatctgcccacatcggcctcccaaagtgctgagattacaggcgtgaaccaccacacccagcctatgtggtattttgataaactttaactacctacctaccttaggactcagcaaatctactctgactaatatatcaagagaaatgagggaatatgtccataaaagatttgtccacagatattcataatagcttcttatccattataactgaaaattagaagcaaataatgtccagcatcaagtaaacacgttaaaattacgttatatctgtacaatacaatccttctcaaaaatcaatacagtgaattactgataaaagcaacaaaataagtgaatcttcaaaacgttaatttgagggaaataagtcaggctacaaatagatatgttaggtatggttatgtttatgtaaaggtcaaggacaggaagacttgacctgtggttatgaaatgagaagagaggttcttctaggaagtgtgttgactgggaaaggacatgagccaaaagtttctgtggtaaaagaaatgttctctagcttgacgggcatattgattatacaccaaactcaccaaacagtactcttaagaagcatgtatttcactgtacgtaagtcatacttcaatacagttcttaatttcaacaattacttttattatttatttttatagtctggaataaataaataagtacacacacacacacacacacacacacacacactatatgtacaaattacatgctatcaacaagatacatggaacaaagtggcctggagagactagaaggaaaaagatgggcaaacagagcaataaaaatacaataaaaataaagcaaagattctaataataatatcaaaggagagttcaagataagcttttcagtagataaagttgctctctgtggtgaaacatgcaactaacaacaaaccaaactgtggtgagatttttaggcacttgataacctaatatgtaaatatataaattaaacatttagacataaagtcagaaataatttcctaaaagtttttaacacaatctttcagcctttgacaaatgaaataaatggaaatagaatatatttgtgcatatatatgtcattcatgtataaatatatataccaaaagcacaacccatagcatatgaaatgtagagatagtagcaaatctttaagcatttaactgtggatttaaatatttttaaatgcatacttagaaatttaaagatagccagaaacataaatttaattgaacattttaaacatagtctttaatacaacgagtaaacaaaaaatgggcctgagtaatgtattaatagggtgtactttatgtgtaactgtatttcaaatcctaaatcctatattaagtattgcaccttctattgaagagccaatggaacatttaaaatgattgctcatatatcaagccataaagaaaacaccaataaattcctaaaagtagaaataaatccatcctcattcgcttcaatttactactataaaacaacaaactaataacaaaagtactatttgttttgttttgtttttgagatggagtgtcaatctgtcgcccaggctggagtgctgtgacacaatctcggctcactgcaacctctgcctcccaggttctagcaattctcctgcctcagtctctcggctatgcaagtagctgggactacaggcgcctgccaccatgcccggctaatttttgtattttttttctatagagatggagtttcaccatattggtcaggctgctcttgaactcctgacctcaggagatccacccacctcggctttccaaagtgctgggatgataggcgtgagccaccgcgctcggccgtaatatcttaactagatttattttaagacatagaccttcaaagcaattttcaaaataaaaaaacatgctattcttgttcatagcagttactgcacaacacaaaacatgaattttgaaaaacatatctaagaaacaaaaaggattcaattcaagaaggaaaaatagacattcatcactgggattaaaattatgtatcttatttcctctaagttgaaactttgctttgtccaaaagttgattgtaccgttagtgaaaacgtattttttacagaccaaagtaacaagggaacttagttaaaatgattagactttgaataacatcaaaaaactacaaataactgtgtaaggagaaggaatttgtgctggtgttttgaatactgggaagtgtaaccttacaactgggcagcttgtagagagagagttagaaaattatcttccaggccgggcgcggtggctcacgcctgtcatcccagcactttgggaggcccaggcgggcggatcacgaggtcaggagatcgagaccaccctggctaacacggtgaaaccccgtctctaccaaaaatacaaaaaattagccaggcgtggtggcggcgcctgcagtcccagctgctcgggaggctgaggcgggagaatggcgggaacccggggggcggagtttgcagtgagccaagatggcgccaccgcactccagcctgggtgacagagtgagactccatctcaaaaaagaaaagaaaagaaaaagaagaagaaaattctcttccaaccctattccccccaccccaccctcctccccactcctcatgtataatatatcagggagccagactgggaagcgggaggaggaaatctcatctcagtctaatttagaggcatttgaatgatttgaagctccgctttagacgtctatcagcaaatgacaggctcccttgcccttccattgtttgtggatgagtccgcagtaaaaaaggctgacatggtatctatgaaaacaaaatactgcagtatacaaaaacagaagcttgacctcaaaactcacagaaagaaagccccctgataatgatttaccaaaggaacagaagtagtattagacaaaaatggcatcttcttttggctctaggtagagtctgtttgcattctatgaaaaaaaaaatagcagaaaggattttcagaaaacagaatgagatgaaatgttaaatgataggggaaagttttcagggaaagagtctacacaatagtagaatctgaattggaagctgaacaaaatgaaattaacattgtggaaaataaaattagcaatttggaaaatcctcttgaaaaggtcaccacatatttagataaagagatttaaaacaaatactcattaaaaataaaagagaaagattctaagcacagattgtaaaccaaaaggtatctgagacaggtctcaatcaatttagaaagtttattttaccaaggtcaaggacatgcccatggacctcaggaggtcctggcaacatgcacctcttaaaagtataaaagtataaaagatatacctggtctcaaggaggatgaaaaagaagaacatttgaaaaaattattaaatgataattgataaatgataccaatcaagaaaacctgcatgtcctaaggccctaaatcacagataaagatgaatccaaaaatccccccaataagcagcagcaaaatgtttgaattgtatttttaccttggtttttaaactttgcatttaaaaaaaaatttaaacttaaaattcacaagaaaacaattaattgccatatacacctctcagcaattgttaccttttacaatattactatatgctgtgttctctctttcttcctccaaaaataaggttattcattttcttacataaccaaagtgaaatgatcaaattcagaaaatttaacattgataatactaattatgaaatttttatttaatttcaccaactgtccttaataggatttctttgacccatttgtgacctaatctaggatcatgcatggtatttcgttgtcatggttctttaggctttaatccggaatagcttctcactcttttttgaaaaattccatagcacagacatttgaagagtacaggtccatcgttttgtaaaatgttcctcaatttgactttgtctggtggtttcgtcatgatcagtgtcaggctatgcacttttgacaggaatactgtaaatgatgtatgttcttctcagtgtgtcacatcaagaagaaaatattatcaatttttcccattactactaatgttaactttgatctttcggttagatccaaggtagagtctgccagatttctcagctgtaaagttaccattttgcctttgtgatttataagtaatctgtgcacagatatttcagacagtatacatacattcttttttatttgaattcattaaaattcactcactggtttgggcatctattggtaagtgttttctgcaataattgttactatgatggctgccaaatagtgattcacaattttatcattgcttctacatttactggttgtcactctactgtaggaaataggtcctccacacctccatttactttgtttacttatttatgtatttattgatcagcagtttcacagatcattttaatttaaagatgatcatccattattcttattttgatgttcacattgtcctagcttaggccagtgggagccctttcaggctacctctttgctctttcactacttgcattttaaaagttttatgcataccttcctgccaaagttgtgacatttttaatatgaagaagtttttaattttgagaaaatctaattcattttttttgtggttttaatttctgtgtcctgagacacatttgcctacacacaagtcacaaagattttctcctatattttttatctaaaagctttatagttttgtttttatatttcagtctataatacatctcaaattaatttttgtgttttgtgtgaagtagggtctaggtatattgctttcccaaaggacagctagttttcctaacacgatttgttaagattattcattttcctaatgaatttttgaccaaacaaatcaaatggacatctaagtgtgtctctagtttttagccctttattctattactttaatctatttattggttctgtgccagtaaaataataatttgattacagcatattatagttaatcttgaggttatgtagtgtatgtctcccaagtttgttcatctttctcaagtttgctttggatagtctaggtccttaatatttctgtatgaattttaaaagcagggttgttggattttgatagaaattacatggaacctatagatcaatttgaggtaaaattgacatcttaacatttagtcttctatcaacatggcatatttctctatttcttcaagtcttcttaattcctttcagtaggtaactaaactggacactatacatctttggttaaacatgttcccctataggtggtatcaaaaatgtcacttcatatctttcacccttagctgagctgctagcagtgtactctatacactcacggttcatggtgtagccttgagatatggggagagttaatacaccgatttaggggctctccctttccctctcctttccaggactacccttagtcttctgagaggaagtgtttgcttcaagttctaacctccagttcttgccaaaaaaggctgcaggttttctgtgggagttttaattggcagtgtgacactgactatgacctgccctcaaactaaaaattataaactccagaaactcactctgtgctctttcctttttctgcatgtcaattcccctctaaaatctcactgctcttcttcactccccagtgttttcacacagttgtttgtattgtgtctagagttcatgattagcaggaagatttgtcctgctggagctcacttagccctgctgcttgaatttcatttttgaattatgaccctataaacacacagggtggggaatgtaagaggttatctaaccacaaaggaaaacagagtgaggtgtcctcaggctactcttctacaaaacaaatgccagaaaggaaagggatttaactactgaatttttggcgaataatacataaacctaaaaatgtacatgcagtcatgatatcttccctgcatggtggtgaggttaaagggttcttagagatacatggacactgaaacataatgatcactgacacctttagggaaaaaaaaaaaaacactagcattttcctatcaaagtgtgaggcaagggccagcatcatcaacatcagttggaaggttattagagtgcagaatattagcccccactccagacctagtgaatcagaattccaattttaaaaatacttaatgtgtattttaaatttgagaagcacttctttagccatctgagattcagcattctaggatttctaggatgtcaatgccaaatcacacttttaaaatattatcatttctttaacccaatttagaagtcacaacaacataatctaaatgcaaagagcatcacgaagatattccttgatacaaaataattatcacaaaaatagaaaaagatgagactagcactaggaaaaaggatgtacagtcattgaatgtttagtgatgaagtttataataatgatatggtaaaatgtttactatgtcattctgaactgtaatgcaggaaacagaagagtagatgcaataacatctcaatgcccgaataaaaaataatcataaaaaatatcagatgtaaatactgttgacactggatagtgatgtgttccccactcatttacatatactttccaaatatgaatgcattttgaaataaggataaatacattttgagtaaccaaagaaatgttatcaatggagaattgcagagggccatttttgtgaatgtgtttcatcaagccatttacttcatgcagattctatcactctgccttagatgctacttcctttctagcccaaaggcagagtacacaaatggctcaatgtgacacaaaataatcagtgagaactagtgactgaaacattctaggcttttctcaattgctttgtgataaagagtaaattctgtaaccactctgagtgacatttctcatatttgggtaaaaatataaactttgatataaacaacataggcatgttataaaaattaatgagcctaagattcatgaaacccttagagcttgaaaatgggggaaaaactgtatgaacaaacacagcaaaactatggcaaaagtcccagcattgtaggaattttctgtttttaaaattattttctaaagtctcaaaagcaagggtaaatttgtgctgtatcacaaggagcatccaatggaacactccttatccctgggagtttattatctagtaagtattataaggtttgtagtttatgcccaattttctaaccctattttctaaatacacattgttgctaatttttgttgggcccacaaacacaatctaagccttccctctagtcttccagtcccttcttcctgggaatcattgatatcaattatagcctaccccactgccaattacaattattgcttgctgctgtttaagtacaaatgatctaattgtcatcaatttgcagttccaattacctggtcatatcttgccttaaggtacctcatctcactggcaactgtgaagttggcagggaggggaaattttacaggatttttcttaatataaatacaaaaggacaattgactactacttttcatatcactatgacaccctcagttgttcaagagttcctttcaagtcattaaatgttttcacaacataacaaaaaacacatatctttttatcctgagaagctttctggcctgttttatggatattaactgtcttgagaagctttctggtctgttttgtggatattaactgtatatctgtgtattagtctattcttgcattgctataaagaaccacctgagactgggtaatttataaagaagtttaattggcacacagtttcacaggacgtacagaaagcatggctggggagtcctcaggaaacttacaatcattggtggaaggccaaggggaagcaggcacatcctacatggctggagtaggagggaggggataaagtgggaggtgctacacacttttaaacacccagatctcctgagaactcactcactagtatgagaacagcaaggcagaaatcctcccccatgagcccatcacctcccaccacgcctcttctctctgaatattagttaacctctctgcaccacaggttctttatcctttctgttccttccaaatgccaaattattttatgccctaaggcctttcaaggtgctgttctccagataactgtttctccggcattactgagatcacagctcaaatatctccttctcagagagacctctgcccaagaataccctcaaatatagcttctcttctcaccccactccaccctcattatgctatgttctattgctgacttcatcagagttctccctaggaacacaaccaatataaatagaaagagagattgattataaggagttgactcacaataatctacagcatgggccagcagtgtggacacccaggagagccagtagtacagttgatgttcaaaagtaatctgctggagaattctctcttgctcaaggaggctggtctttgcattctattcaggcctccaactgattgctcaaggcccacccacattatgggggcaacatgttttacttttaaaagttctttgatttaaattttaatctcatccaaaaacaccttccaagctgacacacagaaattaaccatcacaactgtcctctttattttcttcagagacacctgaaaatctctaataaggatgagaaacgcattgttatctcaaagactgctatgaatttgtttattttctgcccttcccattcacttttcatataagcaccatgaaagcagggaccttgtgtgtcgtttttacactgatatcccttgcccattacattgaatgttattagggatatagtagacactgaataacctttctttgagggggggcgcgtggggaggaggcaaagtcttgctctgtcacccaggctggagtgcagtggtacaatctcagctcattgcagcctccgcctcatgagttcaagtgattttcctgcctcagcctcttgagtagctggaattacaggtgcacaccaccacgaccagctaattttttgtatttttagtagagacggggtttcaccatgttggccaagctggtctcaaacttctgacctcaggtgatccacctgcctcggcctcccaaagtgttgggattacatgtgtgagccaccgtgctcaccctgaataaacattttgagtgaagaaagataaaattggatgataatttttacctactttatagtactgctgtatttcattagcttttttttttttttatctatcagtaaaataccgggtacacatttagtacttgcaaaaatgtcagcctgtgggcatgcacagatacacacaccaaacacgtgtgaaaggaaaatatcttgccaccaaaatcactaggaaaactcaagccagcagggaactgcttagggcaaagctgcttcccattcttttcaaagtcactcctctgctcactgagatggaggcatatctgacatccaatcttttccaaaggattggaaagactaatcagaaactcaaaagaatgtaaccatttgggtatcacctatctctgacctggaagctccctccccacttctgcttcaagtcttcctgccttcgcttcaagttgtcccgcctttccagaccgaaccagtgtacttcttacatgtactgattgacgtctcacgtctccctaaatgtataaaccaagctgtgccctgaccaccttgggcacaggtcattaggacttcctgaggcaaaacaaacttgctaaattaactaagacctgtctcaaatttggggggctcacacactcaaagtatttatacatacacattttttttttctgattagtcggatacatatatgagattcctgggtactgaacaacagatgacaagcatgttaatgtgatttcccaggtatacctattttcctaccaattcttagctaaacaatccagattcttaacaatgcttgcaggcttttaactcaccacaaagttaagatggagaaatacactggcttgctttttctggttatatactggcacgtctattctaagaatatgtaagggtttggtctgtgcaaaaatttcgtgagcaatatcccacaaacacaggcacccatggcaaatatggacaaacagaatcacgtcaagttaaaaagcttctgcatggggaaggaaacaatcaacaaagtgaagacacaacccacaggctgggagaaaatatttgcaaactatgcatctgacaaaggatgaataaccagaatatatgaggtgaaacaattctataggaaaaaaatctaataatccaataaaaaataggtgaacgatttttatagacacttatcaaaggataacgcaaatggcaaaaaggcatatgaaaaggtactcaacatcactgatcatcagagaaattcaaatcaaaactacaatgagatatcaagtcaccccagttaaaatggcttttatccaaaagataggcaataaatgctggtgagaatgtggaaaaaagggaactcttacagactgttgttaggaatgtaaattaatacaactactatggaaaacggtttggagtgccagaaacaataagttcctcttcaaacttccttgttctttctggttgtgtaaacaaccctttgtgtctaattggtaatggacagcctctcccttcccgccaaattggccctattcaatttcaaacaatagccaatcgggtcagcttagattgtgcgatccaactctggccaatggggaaaggacacagaaacaggacctccattagggagaaaaacccttgccctaccctgcttggtgtgctcttgcaattgcatcaaatgcaggcagcaccctcctgcagaagtaaagttgccttgctgagaaattttcagtttaagtgctagttcttctttgcagcaccaagcgcttgttgctaacaatttggaggcttgtctgggatcccattctcctctggggaagggtcttcaataatctctcatgacgagatgcgtcccgctgccatattgtggtggcctcaggagtaagagatcgagacccaccaagcatgacaaataaacttggactctcagtaacatgggaagaaaaggcctacaaataggtaccatggtaaccaggtaactctgtgcacaaaccaaggtaagaaaagccacggggtgtgaagtatttctttggtggttgggacatcctctgaaagccagggaaataaccttgcagatcaaatagctaagcaagctgcctcttccaattttccatctaaccccctgtcttccccctccagctgcaatccccatcttttcccacgcagaccaagaaaaagcaaaaaaaaaataggagctgaggaaagcccagagggaaaatggttattaccagatggaagggaaatgttgtctaaacccctcatgagaaaaatactgtcacagcttcatcaaggaacccactggggtccccaagctatgtgtgacacagtccttagggtttatgggtatatggggatctataccctcactaagcaagttatacatagttgcatagtgtgcagaaaaactaataagcaaaccttaaagaagccacctttcggaggaagaaacccaaggctaaggccattccaaagcacccaagtggactacactgaaatgcctccaataggtcacactcagatgtttattagtaatagtagaccatcttacctactgggtagaagccacacccttcccaagtgcaacagcaagtaatgtagttaaagctctgttggaacatatcatacccaggtttggactaatagagaatattgattcagataatgggacccactttaccatgctcattattaaaaagttaacccaagcactagaaataaagtgggaataccatactccctgacatcaaccctcatcattgaagggtagaaataatgaaccagactctaaaaaaaccacctcaccagattaatcttggaaacccggttaccatgaacaaaatgccttcccattgccttactaagaatcttaactgccccttggaaagaccttggcctgtctccttatgaaatgctctatgagctgccttaactaaattctgcaactgaccttcctacatttgaaacaaaggatcagtttgttaaaaactatatacttggtctgtcttccatcctttcctccctcaggacccaaggccttctagcacaaactccacccttcaaattcccaattcagcaacaccaatccagagatcacatccttatcagaagttggagagagggaaagcttgaacctacctgtgaaggaccttatctggtgctcctaacaactgagacggcagtctggactgctgagaaggggtggacccatcatacctgagtcgagaaggcatcaccatctccaaagtcatggactgtcacccccagaccaaccctcgccagagtaacattaaagagaaaagcctaatctgtctgtccctttttcctcttttctttcctctagctgccctacatcttattattaatgtaactaagtcaaactcacctcaaaccattacttttgatgcttgtcttgttacaccttggggagacttgcgaagtcaaagacagctctctactctagaaaagtatctttgcccttcttggagcttctgagactgggcagattctgttaacgggactcccttagactgggaagattctggagaagattctgttaactgggaatcttgtcctccaagaacagagcttctctgctgtagctgatccaatgttctatggactaccaaaattcaaggttggacctccccaacaagtagctgtgtatccctaaaaccatacattcatttcactaaaggaagcatgcaccaccaactgccaataaaaccaatgtaatccaatacaaatttccattactatctcaagttcacaagattcttccccttcattaagtcgtttttatggtatgggagcagaagtcacaggagcagaccctacaagatattttgaaatgcatttcatggcctcctcattcccctcctccttctccatcttcttctccttctaaaccttctaaccaaactactaccctttccctacccaatagcaacgccaaagtggacattgtagaagttaaatatttaaagcaaactttagccattgaaacagggtaccaagatgcaaatgcttggctggaatggattaaatattctgtctgcacactgaacaaaattgattgttatgcttgtgcaatgggcaggccagaaacccaaactctcccctttccacttggatggtcctctgaccaactgggcatggactatatggtagccttcttccaaaaccacaaagcctagggcagtaaggcatatcaaaccctttcgttgctattcccagaagttaaaagccctgttggtcagcccctgagggccatctgacctccagctatcgatgtcaatttcatcttgtgtctctcaagacaaggggaaaacttggcattccttggaagcctaacagaatgcaatgaatctaagccttttcagaaggtaaccaatcagtctacccttgttcattcccaagcagatgtatggtggtattgcgatggaccactactgggtactctaccaagtaactggagccctctaatccaattggccatccctttcactctggcatttcaccaaccaaataaaaaaggatggtcacagaaaaagaagtgcccctcatgggtcttttgaccctcacgtttatatagatgctaccagagttccccaaggggtgccaaataaatttaaagcctgaaattaaatagccgcaggatttgaatctctattattctggtggtcaactacaaacaaaaatgtagacttgaaaaattacatttactataatcaacagcagtttgtcagttacacaagagatgccattaaaggaatagctgaacaattaggccctaccagccaaatggcttgggaaaataggatagcccttgacatgatactggccaaataaggtggagtttgtgtcacaattggagtccaatgttgtacttttatccctagcaacacagcccctgatggaacaattaccaaagcattacaggatcttaccaccctagcaaatgaattagctgaaagttctggaatagatggccccttttcaggtctcatggagagatggtttgcaaagtggaaaggactcatgacctcaatatttacttctcttgcaattgttaaaggtgtacttattattgtaagttgttgtatcataccttgtatttgtgggttagttcaaaggcttatagaaacagctcttaccaaaatctccctcaattctcctccaccctattcagataaactcctacttctggaccaccaagaagaacaacaaggccaaattatctcagaaaaattttaagaggaagaactataaaaacaagagtggggaaattgccagaaacaataagttcctcttcaaatatcctggttctttctggttctgtaaaccaccattcccacctaattggtaatgcacagactctcccttcccatctaattgaccctattcgatttcaaacaataaccaatcagttcagtttagattgtgtggtccaactctggtccaatggggaaaggacacagaaacaggagctgtgttagggataaaaacccctgccctaccctgctcagtgtgctcttacgattgccatcagacataggcagcacccttctgcagaagtaaagttgccttgctgagaaattttccatttaagtgttggttcttctttgcagcaccaagtacctgtttctaacagaaagttcctcaaaaaactaaaaatagagctaccatatgatccagcaatgccactgctgggcatatacacaaaagaaaggaagtcagtatatcaaagaggtatctgcactcccatgtttgttgcagcactgctcacaatagccaaaatttggaaacaacctaagtgtccataacagaaaaatgaataaagagaatgtggtacatatacacaatggagtattattcagccattaaaagaatgagatcctgtcatttacaatagcatgaaaggagctagaggtcatcatgttaagtgaaataaaccaggcatagaaagacaaactgtgcatgctttcacttatttgtggaatctaaaaatcaaaacaatgaaaatcatggacataaagaatagaaggatggctgggcaccatggctcatgcctgtaatcccagcacttcaggaggccaaagcaggtggatcacctgaggtcaggagttcgagaccagcctgaccaacatggagaaaccccgtctctactaaaaatacaaaattaacaggattacatgcctgtaatcccagctacatcggaggctgaggcaggagaatcacttgaatccgggaggcaggggttgcagtgagccgagataacgccattgcactccagcctggacaacaagagcaagattccatctcaaaaaaaaaaaaaaagaaaagaaaaagaacagaaggatggttttcagaggctgggaagaatagtgggaatgggggtaatgtaggggtaaagtggggatagctaatgaattagaatatataattataagaactactacttgatagcacaacagaatgactatagtcaataataattgtacatttttaaataactagaagtataattagattgtttgtaaaaccaaggataaatgcttgaggggacagacaccccattcaccacgatatgcatatttcacattgcatgcctgtatcaaaatatcttatgtaccccattaaaaatatacacttatgtacccataagcattgaaattttaaaacaaaaaattttaaaaaagaacatgtaagggaacttagaagtattttccccaagtgtatgtgtgtatgtatgggttggtgggggggtggcagtgggtgggcagagtttggagagtgtataagccaaagacacatgctttaaatgctaagcctaatatttaaaacaaattaattttgttctcattgaagtaaaggcaagtagtactgagcaggccaactacacaaatcctattccattctcagacgtattcccagagtaaacacagttcataaaccactgctcaactctaaccttcccatttttcccatgaagaaactgaggctccggaaaggttatgacttgccaacatgacccatgattagtgaatgggtcgggatcaatccaaataatctaaaccccatactagagtttttcccacgataaccacatataagctgtatatttgtgtgtatatatgatttgttcattcattcaacaagtatttggtaaacattctttatgcaccaggcacaatacttagggacagagcagtgaaccggtactcatatcccttcctttcaaggtgttttcgatcttttggggaattagttattttttaaaaatcacacataaaaataatctaattaaattcataagaaggaaagcagcaggagatccaaggtcattggcagcctgaagttaatttctgaatccacctcctttgccacactactgagttacaaaaataaccatgatcccctgttggggcttctattcaatcccaatgtgtttgacatgtagaactcccagaaaggaggttgaggtgcaggatgccatttttttcaataccaggaggagcactgggtggttcaaagcacaaagaacttacttttgtttttgtgtcttagcccatgccagtttctaccatttcattgattactacatatccagaaggtgcttatggttaccaccgacaacatttctgcagttccagagccacaaataggcaacggaaaacctgcttcattcttctaagtttttcaatcttttcctgcagttgtaggcacattggaaatcactttactgttcacgctcgattctggggccttgggaaacttcgtaaggggtgtaggtttcattgtctcagagatctagcacagaatcatttctgctgttccactccagtgacacactgggaataaagggaagttggaatactcataccaccacagagtcagcttgaagattcccttgggtactccaagtcaacctggtgttccttccatctcttaccatggccccctactaggtagagggctaaaagaaactgcagtgcaatggcccttctctggggccccaccactaaacaatcttcacttcatctctaactctcctcccatcccagcttccagaatccacataattttattgtggagacaggagtctatggaggaaacgttacctgaaaagacaaggattctttcacctggtgagtaacaaacaactctccacaaggaagcacgttttgatcaataagagttgtattatcgcaggtaaggagagccctgaaaggattcttcacagcagtgtctccctaagggaaagtgacagaaaggtgctatggggcagatggagaggggagagggcacaacactgcatgtagaggaggggtcccagtggtgcaggcccactgagtcattatgccagcacatgggtggcatgagatggtaatgaagctatagctcagctggggcagtggctcctacgtgtaatcccaacactttgagaggccgcggcaggtggatcacttgaggtcaggagttcaagaccagcctggccaacaggatgaaaccctgtctctactaaacacagaaaaattagccaagcatggtggtgcacacctgtagtcccagctcctcgggaggctgaggcatgagaatcacttgaacccaggaggcaaaggttgccatgagccgagatcatgccacagcactccagcctgggtgacagagtaagaccctatctcgaaaaaagaaaaaaaaaacaaaaagaagaagaagctctagttcctcccaggctggagattttagcatggtgttgaggaaagttcactcaggttcttctgtaagatgccatggtctgtcaagaactgcttccaaccaactaggtgacctcattccatatagcatttgggaaaaaaacaggctgcaaggcaagagtctgtaaaacaggcttattgttcaaatttactaaattcctatagtccttggagaccctccctgtatgtttacataagggagaggtttttactgataatttaggttctacatttaggggccagaaaattcttttttgactgggaagggtggcagtcctgtgcatcatagccatgcttattggcaagatgtcagtagaagctactagttgttataaccagaaatgcctccagagaccggcaagtattttaaggatgcaaaagcaccctcagctgaagtagaattgttactggtttaaaatagaagactaccactttaaattgttttatggaattgcaagtgtaaagacagagaaaatgctcaacactgtggtgccaccactggagcagaccaagaactacctgtcccagcccggccccagccccaagcagggttcagagctgctgggaggctaaagtgactgctgttggctccactgccgctgccagggagaggtgaaggtttcccatcaatttccagctaaaaatgacaaaagcaggcaggcttcgggctcttggatgcacttcaggccaaggctaacacaaacaacgcaaagaaaagcagagagggccactgtgtgtatcgtgtagtttccagaatacaaagccctttatgattataggttctgttcctataagctagctactgtagaattacaaagtattttccagtttatttatttctgagacagggtctcgctctgtcacccaggctagagtgcagtggcacaatcatatctcatagtttactaagaagtaacctgggcaaattaacctcgttgagtacaaacagaatggtggttttcatgtggcttatgtttcttagatcatgctgtaaagccaaaatgttttgaatgttactcattgacagacagcaatcatagtcaagagtctgcgtaataactttgaccagattgctgaagctactgcctaataaatatatactttatttataagtattgccatttccaaattttcttaagcagttccatccataggcttaataatatatacaataaaattttccccttatgccttctgtttcctctgggtctaggctaaatctttgattctactgtttgtagaacctgctttgaccttctttctctgtgtcaccccttctcctggacagcaaatgtagaaatcatcagctgcttcaacagtgaggatcgagtgggccaaaaattcttagggttatatactacaattttttttctaatatatagtattttataaacatcaaaaagaagtctagttctgccaagggtctgtaggcaaaatatcattccactataaacaagtagacatgctagaaacaaaacacaaagccacctttaataggaaagtcttggtatcatgcagtctagacaataattcttcaattagcacctagtggtattagagaaagaaaatagaagagaggtatagaaaaatagaagagataacttgaacaatgagctgagtcaaatgtgctgaacatatgataatttgggataacacaaatctgatgtgtaacaaaatgtgtaaaagttgcaaaagaatagaactcttaataaatgatgctgggacaattggctactaatatggaaaatagaaaaactactataacctacacaaatatgaattctagacagattaaaggcctaaatattaaaagagaagctttaaaactttcaaaagagaatataaaaaaaatttacaacaggcaaaacaaaccaaagatgaaaaagatgagaaatttcactacattaaaattaaagataccgtaaacagagataagatatataagctacatcctagaggagatacttttaatgtaaataacccataaacagtttatatcaagaatagtgaaaacaataaaaaatgtgaatgacccaaaagaaaaatgagcaaaggatatttcatgaaaaggaagaatcacccaacaacatataaaaagatgtatattctcaataatattcaaaagatccaaaataaaaattagatgtcactttatgcccagattggtaaaaattaaaatgtctgagcatgccacttgttagtgagaatgtaggaaagagggaaatactcctgctttgttagtaatattgtcagctgatgtggctaatttagaaaataatttattaataccaagtgaattgaagatgcctttatagtaccatccaggacgcttgtaggtttaggtctttcccctagagccactcttgcaggagagcttgaggcagcacaaacaaggctgtttatattagcaccctttgtaatacaatagtttatacaacctgaaagcctaccaataagaggtaagtaaatatccattagtcacacaattgaaaaatatgcagaaattgagtgaacaagatgaattaaaatggataaatcacaaaaccataatgagaaggggaaatgtaactttttaaaatgtgttcaatataatcctagttttgtaaattttttttaaaatgcaccaaaaatgcacatataatcagtatatgcttatggacatgtagacatatactaatgttgccaaaagatatacggaaattctacacaccaagaaccagatactaagatttctgccaacccttgttccctaacaggtccattcagagaagaatcagggaggaaagttatgggcctgaggttttaatgaatctataaggctttatttctttttaagcacaaagtgatctgaagcaaatacagaaaaatgtgaacatacttaatatcttgacagtgaataaatggacttatattttaattgaataaaactttaatagcacttactatatgccaggcactttactgggcacttaacataaattaataatcttcattatgtttctctccatgatgaaatatttcacacataaacattcctgttgaattaaataaaaaaatctagagggagataccaagcatgattttataaaatgggcaggaatttgagagtaagtagattataatttttattttcaacactgctattatttttaagtgttaaagttagcttacatttctttgtagtttaaaaacattttaaacagtaacgtaaatataattatgataagtatcattgagtgtttgagcatccaaattaagacaaggagcacattccgtaagaaaatcgtaaaataaagcagacatggccagaccctattgtctgaaagaaattagaggactgcaagattagtattaaaaaggagatagatgttgtggtatcgcaggtagatgtgtaatatgcacataggtgtacatttcataaaaggctgactagtcatttgtgttgtactgatggtcaaaaagaaagaagaatcattaagtagaatgtctgttggacaagaaacgacgtttagaaatttctagaagtcaaggaggatagaagtaagttaatggagcaatcttttatatcttgccaagcaactcaaaataggtctggtgagactgcagcatgggactccagccgcactggaaacctagattgtcttgccctccagaagtcctcctaaatgacgtattcatcagggaaaagagttgacaaaatctttcattcccagccctgtggtaatgatgcttggactcccactgagccaatatgaagtgaaaactttgagaagaaaagctgttagcatcaattaagcgataaaacagtcaaacttactgataatgtgtgtgagcatgtctaacacattccatcttaacaaggtgatctcggttaatgcattaattactccttttagctcctgtgttgcagtgataacaatatctcccatagaaatgcttcttcttagtccatgtggggtatttctctgatagaagcagaaataataacagcagtcttcttagactatcaagagatatacaacactatttaagcaatttgaattcaagggatattttccaaagtctctaccaatttggattagttactgaaaatgaattttgggattggttgtcagcctctctcacatatgctgtccagtattcgtgaccccctcctcgctgttaacagaacccatttttgtttaggtatttctcttacccacttaacctatgtgcttcagaaaaactactacctgctataaccctatcctcatccaccacactcctgagctccctgtgcagacctgtgtggtctaaggtggtgccaattgtttgtatgtaggcacttagccccaaagtcttttttctatgtgctccagcaggggaatggtagcctacaaatgacatttcttggagcattttgccagctgggtattgccaataagaagcattggatgggaaataagaaggggtagggagggaaaagctattgtcttcctgcttccagttctggcaaatgattcagtagctgaaagaacctgtagatgactatagattctagcacacaaagtgggacagaggccttttgctttcttacctagtgacagagcaggagtttcatcagaagcagcaccaattcctacaccaggcattgtaccacctgccctctttctttctttgcaaggataggggcaatagtggcttatggcagttactggcctctggctaatttgtctgactccttgatcattccactcttgtaataattttgttaccgaatctctgtatttctttttctttccagggaactgactgattctaaaattaatctcatcctactaccagtgatagcttcaagcataggtatattgtatgatttgagccaacgagaatgcaggaaacatttgctggtaaagtctgggattattttgcttttattttctgggacagtttacagtagcttctctctttctctcttaacaatctcccgtgttcagttcctacagctattttaatcaccctcccggagatttcaatcccaacagaggacagcagggtcaaaagaccgctagaaaaatatacttgggcaagtatattttgtcaccccgatacacaccctacttctggactcccagtaatgggaagccataaatgtctttatttttaagtccctgcgggaagggatttctattattttctgattgctgacacaaccataatctatgaaatggaatgtctaggaagaaattcctgaatctagataactcagcagattgacatgctgggcagcactacaagactgtggcaaggacacagaatgtctgagtgctccctctagggtatttagaccccataatgactttgggggtttcttccgtagttcccttaaattccagtggtctttcatagaaaatatatattaaaagaacataattggctatgcttgcatattcaggacgtacgacacaagataggccatctttaaggtaaaaaaaaaaatgctgtagaatttcagactcagtggctcagaaaaagtctcagacatttaatagtcagaacacctgagaaatttggggacaatttttttttcttgttttgttctgggcgacctaaatttttcttttttttttttcaaatctgaaatacttatcccattaattactagaatttttttccaggcatccttcaaagtccaaggtcactcttctagtctgtttctttctctgaagcatctctttcatcctatgaatcaataatacttttgatttcactctgtaagtctccttccattaggcttttcagtcaacttcatttcaggctggaactggtccccttcctaactcatctctggcttgacaattatctttctaccagcacaacttaggccatatattcatcctatatcccactgcctttgcatagaaggccaaactcattcataattagactccaacttgcctttctactcttatctcttcctttccttgacttccctggttataatcctggtacgctatatttaactggaggaatattcacttttcctcaaacagcatatttacatccatatctatgagccttgttcaatattgttctgttttcctggaaatctcactctatttacacttgatggaatatcagtcatttatatattcagaatacatgtattgaaaacctatgtgctgaacacagtccaaggcactgggcattcaaaatgatacctgccttgggcattcatacataactccatggggaatatataaatgtgtacaaataaaatatagtgtcctaaatactatcataaagtcgtttgaatcatacatgatttgaacacatcttgcatagtattatctgtctatctacactacaaagtttgcaagggtaaagagtgtattatattcattttgcattacctatccttaacctggagcccattaggaaggaaggaaggaaggaaggaaggaaggaaggaaggaaggaaggaaggaaggaaggagagaaagaaagagaaagagaaaaaagagagagaaagaaaagcaaagaacacagagcaagcctctttaaactggtctagctacactgttatatgtcggaactattgacattttacttcagcacaagaggtctcttccctttcatcaactcttacagtagaaaatgactctgacttctgggactgcttgcaggcgagaatgttaacagacctttcggtagctacagttttcttgttgcccattgatggatcaagagctaattctcaaactattttcaagccaacctggtaagtacataatatttattcaagcgacactaagccatttggcatgatttcaacaggaaagaaagggcactttgagaaagggcttgtggtataaatatggttggctcataactgtatgggtgatgcctctgttcatctcctgataggaaggctacgaaatagttctttataactagctctgtttaatattttgcttattctttctgccatcctcacttcagatctgaatgacagtataatcagacagaactaaagcataatcccagcagagaagagaaagaggcgattaggccctactgataaagcaaatgaattctagttcatccgaggggaaaaaaaatgttcaggctacaagacaatgaccacttttttcccaagcagtgggagatttatcagtgacaagtgtttgcttaggtttattttctgaatccattttcttgcatttatagaggagaaatgctgaaaaatggaattcttatgttccattcataatggctttcaaggatgatcttgcatcttttaaaatccattcctctgattggtggaagactttcacctccttagacatccatctaagacagcacttcctttttccatgttttagaaagacagaaacggtttaaaggggcttgtgatttgtttggaaagagggtaaacactttactgtgtttgtgtataggtcacatcatactgattccacttgggcgggtagccagggagagagcccttgtgcaaaatggacattgctttgaaattcagatagtaagagcgggagactggaagtgggaagtgacatgactgagccccacaaaaagggaaaaggacacaaagaacttggaagaaagtagtgtgaggagagacagggagggtctttttgcatgtttactccagtcctatagtaaaagcccataaacatttatgacaagccagaataaatgattaactgcttatggctttcaaaccagaaccagccgcatcacaataaacactatatcattggagagatacctaaacatggataagattctaacttttaaatttttttattttattttttgacctcattctatttataaatattttggggtatatttctgaaagagaaggattttttgaaaacacagccataatagtgttatcgaacacaaatgaaatgacacttcatcaacaatatttcaaatagctagtcagtattaaaatattcccaattgtctaatgaactttaaaaatgtgtttgatttgggatccaaaaattatcccatatgacaggtttctaagtctttgccatgcattttaatctataggttacttttccaactgtttctgcttccctgtgaaagatccttattactggttctaaaataaagcagagttcctggcacatagtgaggattagtaaatatttatagaataaaggacagagaaagaatatcttccactgccctgcttgtggttggaacagtcatttctagaacgatcacctttttgtctttccctttcacctacctgtagcctctcattgggttccttcactgttctacaacctttaaaaatgaagcaggcccattcacgcgtgctcaccaacctgtggcacgtgaagccgttctctgtgctcccttcaagcctctcaacctctcataattcactgaataaatcactttgtgttttccttcccaaatgaggatattgtacacaacttgaaggcagtaaccattcttaattgatctcctatctccagctcctaaaacactttccatcacagagtatactctcaatgaatgttttctgttgttgataaaaattaaaatgaatgtcagttctcatttacagacttaaggattaaagagaaaggccatagaaatgatcaaagctagcattctttccccctcatgtgtagattctagttttccacaggctcctatacaatcaccggttaagcattgctctttgaatcacggtgtgcttttagataagaatggatatggttccttttggatctgtgcgcatgcagcagttttctagtgcattttaattaactccagttttgtttttgcacaaacaatagtagtatgaaaggcaaaagaaaatatgttcctagagtggtcatcagtactggtgcctcagaggaaagagctgagctacaagtggcaattctaaattggagcttgctacaggacagtgcaggggtaaaaatacatttgcactctgagaagaaagactacaattccatttctgatcaatagtgaagcaccctgccaaagcatggctaaagagtcaagttactgtttttaaacatgttttctctctccagtcattgctctcagtgagaacctcgtagtagtggtacaaaatggggcatattttaaagtgacagggcactcctccagtggcctcccatactccagctgcaagcttctgttccactaaagtaggataaatttttaaactccaagtagcactttagctttctcaactgagggtctgagatatgtacttatattccaagtaatacagagatttctgaaaaattaaagcttcaagccatgacttttatttattgtcagttggctggagggtaaaaatagagatagactaacctgccagtgacaaaaatggggaggtggtgcgtattctaggaagtgcacagcaaaaaaataggcaccagagctgcttagagatggctggcaaaaaatgatttgggattaagcctaggaaagtaaatactaatggacttgaacaagagatctggaaaaaaacaagtatttcgtggtagaagggtaattgaaaaggggatgaactaaaaacccctttggatactaatggaactatgtatcctttgttggtctttcttttgtttttcctcccaaatacctaactttgtctcttgttcctcatttccagaattaaattttagcccaagatgtcaatatatgcataaccatatcaaatatgtgagtattaactcattatctaccagctcctcaaacatttataatacaaaacacaaaataaataggattcaattcttgttgattcaacctagttgagaatagatagtccagttaacaaaaaaatgatgaacacaaagggaaagaggagaggaacccgatatatgttctctaggccttttagaaaacatggagttgttcctttggccacatatatgtgaatctataagaaaggtgatattacagacatcaagggaatgggcactgttcaaaaaggaacgccccacaagtgttaccatggcaaaactggaagagtctataatgttacccagcatgctgttggcattgttgtaaacaaacaagggcaagattcttgccgagagaattaaggtgcgtattgagcacacgaagcagtctaagagcagagatagcttcctgaaacgcgtgaaggaaaatgatcagaaaaagaaagaagccaacgagaaagggacctgggttcaactgaagcaccagcctgctccacccagagaagcacactttgtgagaaccaatgggaaagagcccaagctgctggaacctattccctatgaactcatggcataataggtattaaaataaataaataaacaaaagacctctgggctgttaaaaaaaaattgtctaatttatatgacattggtataatttccccagaattcgaatgcaacttttaaagtaaaacctctggaaaataaatcatgcatcattggtcatttacaacccattttaaagcaattcaatagcatctagagcaaaggttacagaagatgctgtcagggtgtctcccatttcctacaccactgaatgtttcccatctctttctgcatgaggacacaatctgtccagaaagctcatgtgtactcttcaagataggatagaagtgccaggaaatgaatgtccccaggagcaaccattaacgagtaatatgtgggaagatgtggataaacacttgagcttgcttgccctcagtgagcagtgctgtagtatgtgctacagtttatcagtgtgtcctctgtgtgattgagtttggaattacaacctcaacgtgtcttaactgcctttccctcctaccatatccctctttcccactcccccactgtactctctgaagttacttcccaaataaactatcagaattcaagttcttgtctcaagatatgctttaaggggacctcaaacattgacaatgatgcacaactgttttaattaattcccatgagaaatggcaattgactatggttaaaatagtgctttcttggcgccatttattcacatacaatgtcaatttttccataccagcattagcttctgactatgatttagctcataacttttctaagtcactttaaaatggattgactttactctcaaatatggtaaaattatacctgaaatcacattgatagccatacacttttcctaatatataaagttatatttttaatgtttgcttatgtgttacatgaaatgttatatttcatgttttgcaaaacactgagctatatagtgtagataagacacatgcatgctttctctgtcaccagcccatgaccccacagttaaggattgttaaggtaaaaatctatcaaattttttactagacactgcccttggggtgttggagaattgcacttttcttgttagatgacttttgtctggattgacaatgtccattttgagttatgagtttctacccagcaggaaccctacctggcaggtttctttcatattagcatccagtacaatggcaccaaaagtgagaaatagatgggggtggtaatagtagtaactggcactcattttatgtctatgaaaattcgttaagaatatataagatgcaaacagaaagaatgcaatactttgggttcatagtcaaaggactagttatcttctgccgatttgtagcaaaactttgtgtttttggagggggtgttttgtatttgaaaagacactattcctcaaaatacaactcaggaccgaaagcttataaaagcactttataaaggggaattaatatttggtttttggtggttttttttcctaaagaggtactccaatttttttctaagtgacaaactttgtttctcaggaattttattgttattactaatttgtgaaccacatgttgcttgttaccaacaaatctaatttatctaattcatgaaaaactatggctaaatttctggagatgtgtgttggggagggaggaaaggagaggctgagatctagcaaaatgctgagacaacatccattgaagtcattgtgcatgcagatctagaaagataagcacagacaggatatgaaattgtgtagactatgaacatctctggttgattaaatggaattgaaatacattttctctttcatattggaagaggcttaacattaaaaaactaatctcttttgagataaagttcattaacacaatgattattcatttggcttttataatgatattgctgcttaatcaccagaacattgcttcctgtgctcggtgggaaccagcaggaaacatttgaagagcaagtcttgctgctaatgtgatgggagagggaatagtattctcactgctcttcatttcaaaagtacagcacattcttgctcagaagtctaaaacctcttgtccgatagcatgagctttaagccccacaacaaacacagaataaagttatataaccctgaaagctaaatctttgcctcaggtctggtgtttctctctggattacacataaaggttctcaaggggggcattttcattacgaaccaagatttgaagtgtttgatcttggtagttgcagataccacagcactgaattcgatagctcatttgactgtttagctcagtaaacaaagacatgaacgaatcgaaccaaactataaatctttaaaactatatcctccttgatgcaagttgaacccacagtgcctccctaaaactaaatagtctatctgcaatggaatcagaatgaaaatgtaatcataagatgtcatatagacaactattaattttcattcaccaaagattcttttgaatgtaagaattgataaactttctgtagggagttaaattattaatacggcacaatatgcaaaattatctaccagtatgtattgcacagtgtagccacagtagtcaaagctgtaagttccaaaaaatagaaaccaactttggatgatttaagcagacatcaaatggattcaaaggatgttaggttaattcacaaaattatccagtaactcaacttcaaaagctgggcgggaacaaagaatgtttgtagtggttaggactgacatcagtggtttcaaacataaaatcatttaaacaaagacagtattttcattgaacattaaacttcccagcccacaatgcacattcatctacaaccaacctagaaatgtaacgtgactgccactaaggctgccaccagtcagaaaaatggtttttctaatgcctctgtgtcttcaagatctggagagtacaattctggagtaggtacacattcctggccaggtaatgcaacatgctcaggcaggcccttgcagcaaagagaccaaatgatcactggcttgattcaccaggactcccaggatttgatgaatttctccaagataaagagttcagatgctggtcagccaaaaaatgacatattttcattatctaccattggataagcccaacacaattacaaattcataacaaggaggtacttagaacatatcttgacatgactgagaacctattattagttcaattggatggttaaaagctttgtttacaacttctccaaacctgaccatatgttcatgtcagaaacaaatcaaccttttctaaccaaccacataatacttctggcctgcttcaatttgcccacagcctctcagctaagccatcagagttgtagaaagaaagaaaaaaaaagagaaagttgtatatagcacaggagattgttaagaaacgtttcctaggccttaggggtgcctttacaacattgacatctttaagacagggacattttccaaagagtgctgacagaggggttggtgtctgtcaagtgtgctgaccccgttttgatcatatccaaggcacttccaagtctcactaactgaacctaaatgatttgggaactcataaagaaacctgataccagggatgtgcactttcattacgatgttccatttcattattttgcaaaaccctggtgaatatatctgactcccactgagatcagatctgaaaagctcacacagagacaagagcacatgggctgaaaatcagagagaggtcactagtggaatgtgagaagctatgttttgacatttgtcaaatgttaacaaaaacaatcctcattaatcttatatctgtgaatagtgaaaggtaacagcaggaacaaataagacatggataatgcaaagcatgagctaatgtaaaatgaattcatatttgattagtggatacacgatgtaatttctgcaatatctatttgttcttatgttttcttctgcgaatgttataattgggttcaactccctgagtacaacctggttaagtgacactgtgcacttaaatattttcaatgaatcatgattaacaacgttttcgtaagtagcagaaatcttacccaggcacaaataggtcggagtgtatatactggttgaaatcacagagagtctcttgagtaagaaaatcttttgagcaggaaatatctgaatcagccagcagtattggaaaagcatgtgtatcagaagacttgggaacattgtgttgtgataaggaaacattaaattcaacagaaattttgatgagaattttagctagaaaatacaatgttatttggttaaggacagaacccccaatcttgtctgaggcaagaattacatgctgaaacctccgccccagccctgggtccagactcctgtgtgaaagagaccgcagtgcagacggctgacttcagcactgcatgtatgctggatgctcaataactgtggaagataatgaagttcaatattgattttttcagtcatatccagacccccagataataagaaatggtgcagtgtcatcacctcagcttaaaggacaaatgaaaaagctcactgcaggatttgcatgttatatctattttctcctttacatgaaatttccctttgcaaatgttatccattggaaattttctgcccatgatttcaaattggctaaacttcaacaggacttagacatacactctgaagtcaggaacacagccctgcattctctccggattctctcatggaataattttatgaccccgggttatatcacttcatctttcttagtctcaattacttcatttgcttaatgaatggtcagagggaaacaatgtcatcaaagatccctttcagtcaaatgaattgaagcaggaacagtctgtcatctcatataatatgaatccctcacttagaagtatgatattttagacttgaactatcacaaggagtattagatcagagcaaaggacgggcttaatttttaagaagcatctagaggtactgaagttaaggttataaggcaaatcacataatcaccatcccaaaatattatatgaaaatagtcatctatcctgaaaagcaggtaactaaattagatcaacacttgagatcccaataagattttctttatatagagagctgtttatctgctctgacttctgtattttaaattattttgggctactatccttccattgctattataaatcattagaaactcaaaattttccttattatatatgtgaaataattcaatgaaaactattaacacagttgaaaacagtagtagatgcagacaagcacatgtatttaatggattcactgctcaacagatgatcagatctatccaaattgtgcatgtctaaagctgtcatcatatctcttacctcttttttatcctcacagtgaagaagaaatgcaacatggcaaaactcatatcttgggaaggcaggtgtttttggtaataacaaaaaagttaaagttgctcaattctcagtgtacagataaaagtctcctgaagaatttaaagatggtaattatgtatactcactaaaatcagttaggaaaacctaactttcattctttgtacaaaaagaaaagtgattatgtatacatatatactataggacacttcaaaaacagtgcataaatatcaggtacatttaatggcatcattgcacagaaagcttatcctgtgtcacagaagcatttcatctgaggttaaaatctccgatgtcggattgcaaacctgctttgtgcaaagcactataataggaagaataatacgttgacaccaaagaaacaggtttggagaagcttagagtctagtagaaaagaacaatagctattcaagtcaaggtttcctgagatcttttcaaactaaccttgatatgaacaatactgccttctttggattattgatacatgaggctgtcacataggtttttgttaactttctctaaattatcaagtcatttgcagcaggtaggccaatcccttcaagcctcttcacacaatcacctgcttaaagaggtttaccttgaccactctacataaattagcaaaactcgttactctattaccatcaaacaaacagaattttattgttcacttcttttctgtttcctcctcctaaaatataaatcctatgagctggcgaacttttgttttgttccctatcttcagttactaggatagtaattaatactcagaaattgcattataaatttttgctgaagaagtaaatggatggatggatggatggatgaatgaatatatgtgtatttcctggcatggatgacatgcactaaattattcaaagaaatagcctactccgagtttatttttaaactattttgtacttttataataggcatattttatttctgcaatctaattttacaagtatttttgtttaaaaaagaataaggattgctgccctgccatgaaataaaatgacaaagaattgtcatttattgtcactaaagattcacacttgtccaatttctaatcattttcagagaaaataatttcaacttttccaccaaagtgacccattccagaatttgacatctcttgttataaggaaattctttttttagctcatgttaattttctctgttttattttccacgtagtctgttttttttttttttttttttttttttttatctttggcaatagaaacaattccatcacaagatgccaacaatttactccaaaaaatataaatagaatgagatgtgcgcgtgtgaaaaccgtatcatccatagtaggaaagggtgtgcccaaaggcaaagaaaaaaaagttttaattcaaatgaaagtatacatatactacgccaagttttttttttttttttttccccagttccaggaactaatgagtaagaagttgttagacttcctcacatgtctaagaactggtccatatttttgtagatgaaacttacagaatttacttgacagcacaaacacgtatatttataaaataaaaaaagatgatggctgtatctctgtctctatttttaaggaagataatgataattattcataatactattttatttcaagcagaaaagaaatattagttaattatgcaattaccatgttttcaccacttacttttctgaagcaacaaaatattatgcagagaaattatatccttttttatcccttaatgtaagaatttcattttagctggtctattcctcatagaatgccaaactactatgatagaaagcatgaataatacacacacaaacgcacacatacacacacacctgcacacacacatccagttgattttaatagcttataaaaagaaattgacaaaatctatatattggtgaatctctacatccacatatctatatcaacctatttagataaatatagatatataaaacacaaattaaattttttattatactttttaagttctagctagggtacatgtgcacaatgtgcaagtttgttacgtaagtatacatgtgccatgttagtttgctgcacccatcaactcgtcatttacattaggtatttctcctaatgctatccttcccccaggcccccaccatgggacaagccctggtgtgtgatattccccttcctgtgtaagtgttctcattgttcaattcccacctatgagtgagaacatgcagtgtttggttttctgtccttgtgatagtttgctaagaatggtggtttccagcttcacccatgtccctacaaaggacatgaactcatccttttttatggctgcacagtattccatgctgtatatgtgccacattttcttaatccagtctatcattgatgggcatttgggttggttccaagtctttgctactgtgaatagtgccacaataaacatatgtgtgcatgtgtctttatagtacaatgatttataatcctttgggtatatacccagtaatgggatggctgggtcaaatggtatttctagcactagatccctgaggaatcgccacactgtcttccacaatggttgaactaatttacactcccaccaacagtgtaaaagcattcctatttctccacatcctctcccacatctgttgtttcctgacattataatgatcgccattctaactggtgtgagatggtatctcattgtggttttgatttgcatttctctgatgaccagtgatgatgagcattttttcatgtgttttttggctgcataaatgtcttcttttgagaagtgtctgttcatatccttcgcccactttttgatggggttgtttttttcttgtaaatttaagttctttgtagattctggatattagccctttgtcagatgagtagattgcaaaatttttctcccattctgcaggttgcctgttcactctgatggtaatttcttttgctgtgcagaagctctttagtttaattagatcccatttgtcagcattggcttttgttgccattgcttttggtgttttactcatgaagtctttgcccgtgcctatgtcttgaatggtatggcctaggttttcttctagggtttttatggttttaggtctaacatttaagtctttaatccatcttgaattaatttttgtatacggtataaggaaggaatccagtttcagctttctacatatggctagccagttttcccagcaccattttttaaatagggaatcagttccccatttcttatttttgtcaggtttgtcaaatatcagatggtggtagatgtgcggtgttatttctgagggctctgttctgttccattaatctatatctgttttagtaccagtaccatgctgttctggttatggtagccttgtagtatagctggaagtcaggtagcatgatgcctccacctttgttctttttgcttagaattgtcttggctatgcgggctcttttttggttccatatgaactttaaagtagttttttccaattctgtgaagaaagtcattggtagcttgatggggatgacattgaatctgtaaattaccataggcagtacggccattttcacaatattgattcgttctatccatgagcatggaatgttcttccatttgtttgtgtcctgttttacttcgctgagcagtggtttgtagttctccttgatgaggtccttcagatcccttgtaagttgtattcctaggtattttattctctttgtagcaattgtgaatggagttcactcatcatttggctctctgtctgttattggtgtataggaatgcttgtgatttttgcacattgattttgtatcctgagattttgctgaagtagctgatcagcttaaggagattttgggctgagatgttggggttttctaaatatacaatcatgtcatccacaaacagagacaatttgacttcctcttttcctaattgaataccctttatttctttctgctgcctgattgccctgaccagaacttccaaaactatgttgaataggagtggtgagagagggcatcctggtctcctgccagtttctaaagggaatgcttccagtttttccccattcagtatgatattggctgtaggtttgtcataaatagctcttattattttaagataccttccatccatacctagattattgagagtttttagcatgaagggctgttgaattttgttgaaggccttttctgcatctattgagataatcatgtggtttttgtcattggttctgtttatgtgatggactgcgtttattgatttgcatatgttgaaccagccatgcatcccagggatgaagccgacttgattgtggtggataagctttttgatgtgctgctggattcggtttgcctatattttattgagaatttttgcatgaatgtttatcaaggatattggtccaaaattctttttgttgtatctctgtcaggctttggtatcaggatgatgctagcctcataaaatgggttagtgaggattccctcttattctattttttggaatagtttcataaagaatgctaccagctcctctttgtatctctggtagaatccagctgtgaatccgtctgttcctggactttttttggttggtaggctattaattattgcctcaatttcagagcctgttattggtctattcagagattcaacttcttcctggtttagtcttgggagggtgtatgtgtccaggaatttatccatttcttctacattttccagtttatttgtgtagaggtgtttatagtattctctgatggtagtttgtatttctgtgggatcagtggtgatactccctctaccatttcttattgcatctatttgatttttctctcttttcttcttagtcttgctagtggtctaccaattttgttgatcttttcaaaaaaccagctcctggattcattgattttttttttaacagtttgtttgtgtctgtatctccttcagttctgctctgatcttagtcatttcttgccttctgctagcttttgaatttttttgctcttgcttctccaattctcttaattgtgatgttagggtgtcgattttagatctttcctgctttctcttgtgggcatttactgctaaaaatttcccttcacacactgctttaaatgtgtcccagagattctggtacgttgtgtctttgttctcaccggtttcaaagaacatctttatttctgccttcatttcattatttacccagtagtcattcaggagcaagttgttcagtttccatgtagttgtgtggttttgactgagtttcttaatcctgcgttgtaatttgattgcactgtggtctcagagacagtttgttgtgatttctattctttacatttgctgacgagtgctttacttccaattatgtggtcaattttagaataagtgtgatgtggtgctgagaagaatgtatattctgttgatttggggtggagagttctgtagatgtctattaagtcagcttggtccagggctgagttcaagtcctggatatccttgttaaccttctttcttgttgatctgtctaatattgacagtgaggtgttaaagtctcacattattattgtgcgggagtctaagtctctgtaggtctctaaggacttgctttatgaatctgggtgctcctgtattgggtgcatatatatttaggatagttagcccttcttgttgaatcgatccctttaccattatgtaatgcccttctttgtctcttttgatctttcttggtttaaaatctgctttatcagagactaggattgcaacccttgcttttttttttgctttccacttgcttggtagatcttcctccatccctttattttgagcctatgtatgtctctgcacgtgagatgggtctcctgaatacagcacactgataggtctttagtctttatccaattttccagtctgtgtcttttaattggggcatttagcccatttacattaatattgttatatgtaaatttgatcctgtcattataatgttagctggttattttacccattaattgatgcagtttcttcatagcattgatggtctttacaatttggcatgtttttgcagtggctggtaccagttttcctttccatgtttagtgcttccttcaggacctcttgtaaggcaggcttggtcgtgacaaaatctctcagcattagcttgtctgtaaaggatttttccttctcttatgaagcttagtttggctggatatgaaattctgggttgaaaattcttttccttaagaatgctgaatattgactcccactctgtggctcatagggtttctgccaagagatccactgttaatctgataggcttctcttggtgggtaacccaacctttctctctggctgcccttaaaatattttccttcatttcaaccttggcgaatctgacaattatttgtcttggggttgctcttcttgaggattatctttgtggtgttctctgtatttcctgaatttgaatgttggcctgccttgctagattggtgaagttttcctggataatatcctgcagagtgttttccaacttggttccgttctccccagcactttcaggtgcaccaatcaaaggcagatttggtcttttcacatagtcctatatttcttgtaggctttgctcgtttctttttacttttttctctaaacttgttttctcgctgtgtttcattaatttaatcttcaatcactgatatactttcttccgcttgattgaattggctattgaagcttgtgcatgcatcacgaagttttcatgacaccattttcagctccatcaggtcatttaaggtcttctctacactgtttatcttagttagccatttgtctaaccttttttcaagatttcaaggtttttagcttccttctgatgggttagagcatcctcctttagctcacagaagtttgtttttaccgaccttctgatgcctacttctgtcaactcgtcaaagtcattctttgtcctgctttgttccattgctggtgaggagctgcgatcctttggaggagaagaggcgctctggttttgatagttttcagcttttctgctctggtttctccccatctttgtggctgtatctacctttggtctctgacgttggtgacctacagatggggttttggtgtagatatcctttgtgttgatgttgatgctattcctttctgtttcttagttttccttctaacagtcaggtccctcaactgcaggtctgttggagtttgctagaggaccactccagaccctgtttgcctgggtatcaccagcagtggctgcagaagagcaaatattgcagaatagcaaatattgctgcctgatcctttccctggtagcttcgtcccagcggggcaccctcctatatgaggtgtctctcagcccctactgggaggtgtctcccagttaggctacacaggggtcagggacccatttgaggaggcagtctatctgttctcagagctcaaatgccatgctgggagaaccactgctctcttcagagctgtcagacagggatgtttaagcccacagaagtttctgctgccttttgttcaggcatgccctgcctacagagatggagtctatagaggcagtaggctttgctgagctgtggtagcctccacccagttcgagcttcctggcctctttgtttatctactcaagcctcagcaatggcagatgaccctcccccagccaggctttagcctggcaggttgatctcagactgctgcgttagcagtgaataaggctctgtgggcatggggcccgctgagccaggcacaggagagaatcacctggtctgccggttgctaagaatgtgggaaaagtgcagtatttgggcaggagtttcccgtttttccaggtatagtctgtcacaacttcccttggctagaaaagggaaatcccccaaccccttgcactttcccaggtgaggcgatgccctgccctgctttggcttgccctccatgggctgaactcactgtccaacaagtcccaatgagatgaaccacatacttcagttggaaatgcagaaatcacccatcttccgcattgatcacactgagagctacagaccagagctgttcctattcagccatcttaaaacagagcctgagtaagatgttttaatcccaaattagatttctaagaaaacaaactgattaactcatacaagaattacagtaggacttttttcttcattatctcaatcgaatgtcacaaaatattacaagttcagtcattagaatatagtgaataagtgctagaaaggaggtatggggaaattatatgactatatgtgaatgtttgatatagctagattgtaaactaaatgatttcatactgtactttgcctaagtaaataactgaagctctatagcgagagttaaatgcaaattatcacgctttattttatattaaagagtcagaactgcgtgagttcaagttttaaattagcataatttttctcaaacatttccatataataacccatattattcaattattttgtaatttatatacgttattataaaaacctattataaaatggttgcttattttttgtcttaatctaacttttctttagctaataagttttaaaaatcagaattggcttggtaccaaataaatacgacctgctacatatttagaattcaggtttgcagatgattttcaaaaacatttgaccatacttggttttcactgattaaaaccacttaaaacatagtcttcttaccagatatcatattttatttaatacatttctattactgagactcacccctttgaatatacaattttttcatgtgtaacagccaagtgcagagtatacatatgaacgctaagtcaccctttcaattattcatcctattgaagtcagaagggttaggattgaatccttactccccgttaaccagatgtgctgcagtggcaatgcattctctttttcaaaagctgtactcatgtcctgggaatggtgacaatgatatccaacttaacgcccactgccagaactagataaaatagcatgggtgaaccatccagaagagttgcttgcacatagcagtcattcaaaataatgttaatccttttctcttccaagccctctccccttaccatgtttgttagtcatgtgtatcttggctaaatttcccaaactttctttgtacctcaatttgtttattggtaaaatgataatattatatgccattttatgtgatgtcagggtcaaatggcagtggaaaaatatatatacttttctatgtatatagtgtgtacatgaaaatgctctgaaaagtataaataatgcaaatatttgagtcattatcagatgagttttaaagtaattaattcaaaatctataattcttgaaagtttatattattttataaagcttgctattcttggaaatttatttttaaaacgggtcaactgttttcttcaaattcacatttatttagggtcattagtttgcactttataagtaactccatctaaatacaacatctttggagcacttacgtatcttttctgctatattaggcttcatgaccacatagttaatatttatatattgatagatatgtctttctttagttccttccacttagtgaatatgcatactccaatcagatggcctgaaaaagtatgcaacatatgcctgcatcagcacaatctgttttaacttctagaaatgcaatgtatgtatgtatacactgaatgcacatattgtatatatgtgcatgtatctatatcctattagttctgttcctccaagagaaccctgactaatacagattttggtaccaggagtggttccagaggaagaaaatattaaaggatgaagttctttcattggctttagggtttctggagttggctgcttaatatgattagacccaaaaatgctaaggactctacttctaatagtatggagaacactgatagtacttggagtaaactgtttggagagttatgcaaaataaatgaatttgatactcctgattcaccactcctgagaggcaaggagtttaatgactctatacttaatacttttgaccatatgtggagaaccagggaacacaatgaagctgtttggttgcttctaagttcagtggacaaagtgatgaaagaaaatgatgaactcagggattctgtgtcccagcttcagaggcagatagtgagcctcaaatgtgctgagattaccctgagaaagtgttatctcctgtagagaaagagctgaaattgtggaaaaacagacaagttttttttgtttgtttgttttttgttttgacagagtttttctcttgttacccaggctggagtgcaatggcacaatctcagctcactgcaacctccatctcctggattcaactgtttctcctacctcagcctcccaagtagctggggatgcccgccaccacacccagctagttttttgtatttttagtaaagatggggtttcaccatactggtcaggctggtcttgaactcctgacctcaagtgatccacccaccttggcctcccaaagtgctaggattataggcatgagccaccatgcccggccagacacaagctcttatcatgcgagtggctgacctgcaatgaaaggtgcacgcacagcctcagcaggtgtctactgttacactgagggcaatgactggaaaagaatgggaccctgcaacttggaatgggaatgtgtgggaggaccctgatgaagcaggagacactgagtttgtaaacactgattaaacttttttgccagaaggaacagcttccccatccccagtagtagcaacatcacctccctgacccatgctgccatcagcctttccaccattgtctgaggagataaaccatgcactgcctgaggcaacagtgatggcctcccctgaggcagttgccaggcaagataacattgattttcctcagaagccacccccaacacctctgtttgcctctaggcctataactaaagcccccgtgggcctctgaaggtgaggttgagagtgtgacccatgaggaggtgtgctacgctcgaaaggaactgtttgagttctctaatttatataaacagcaatctggagaacaagcatgggaatggatattaagggtataggataatggtggaaggaacatagagttggatcaggctgaatttattgatttgaacccactaagtagggactctgcatttaatgttgcagcttggggagttaaaggttttaatagtttatttgcttagctagctgaaatatggattaaaagatagcccactgtgaatgatccagaaatgcctgatatcccttggtttaatgtagaggaaaggatccaaaggcttagggagattgggatggtggagtgaattagtcacgttagacatacccatcccagctgggagggtccagaagatacacccttgaccaatgccttgctaaatagatttgtgaggacagcacctgcctcttagaagagctctgtaattcttctctgtaggtcagatctaacactgggaaccacagtcactcaactccaacatttaaatacaatggggataattggatcctgaggtagcaggggccaactggcagccctcaaccatcaaaggcaaggtgggcatagctaccgtaattgacagcagaggcaaagcagcaatcagaatagtgtgactcctgtagagctctggcactggctaattaatcacggtgtacaaaagaagtgaaattgatagcaagcctactgcattcctgcttaaattatacaaacagaaaagttctaggtcgaatagacaaaagactgatttgaattataaaaacagaatcatggcccctccatcaatttccagacttgagccagtttacagacccagaaccccttgaatgatgggaaggccaggtccccttgaggagggaccccactacattaccaacaatttatgcagtgaatctttctcccatctttcccctaggagaccttcagccttttcctaagaagacccagggaaactgtgcactggggaaagagaaattatcagacatttcaaggactactggacactggctctgagttgacattcattccaggggacccaaaatgtcactgagatcctccaattaaagtaggtgtttattaaggtcatgtaattaatggagttttagttcaggtctgacttacagtgggtccagtaagtacccgaactcaccctgtggtcatttccccagtgccagaatgcataattggcatagagatacttagcagctggcagaaccctcacattggctccctgactggtagtgtgagggctattatggcgggaaaggccaaatggaagccattagagctgcctctacctagaaaaagagtaaatcaaaaacaatatctcatccctggagggattgcagagattagtgccaccatgaaggacttaaaagatacaggggtggtgattcccaccacatccccgttcaactctcccatttagcctgcgcagaagatagatggatcttggcgaatgacagtgaattattgtaatcttaaccaagtggtgactccaatttcagctgctgtaccagatgcagtttcattgcttgagcaaatgaacacatctcctcgtatctggtatgcagccattgacttggcaaatgccttttattccattcctgtccataaggcccaccagaagcaatttgccttcagctggcaaggtcagcaacatacctttactgttctaccttaggggtatctcaactctcctgctttgtgtcataatcttattcggagagaacttgatacgtttttgcttctgcaagataccacactggtccattacattgatgacattatactgattggatccagtgggcaagaagtagcagacacactggacttattgttgagacatttgtatgccagagaatgggaaataaatctgactaaatatcatggaccttctacctcagtaaaatttctatgggtccagttgcatgcagctggtcaagatattccctttaaagtcaaggataaattgctgcatttggccccactataaccaagaaagaggcacaacacctagtgggcctatttggattttggaggcaacacattcctcattttggatgtgttactctgtccaatttactgagtaacctgaaaggctgctagttttgagtggggtccagaacagaagcaggctctgcaacaggctgctgtgtaagctgctctgccacttgggccatatgacccagcagatccaattaggcttgaggtgtcagtggcagacagggatgctgtttagagcctttggcaggctcccacaggtgaatcacagtggaggcctctaggattttagaacaaggccccgccaccttctgcagataactactctccttttgagagacagctcttggtctgttactgggctttggtggaaactgaacgtttgactatgggtcattaagtcactatgcaacctgaactgtgtatcataaactgggtgctttctgatccatcaagccataaagtgggtcatgcacagcagcattccatcatcaaatggaagtggtatatacgtgatcgggctcaagcaggtcctgaaggcacaagtaagttacatgaggaagtggctcaaatgcccatggtctccactcctgccaccctgccttctctccccaagcctgcactgatggcctcttggggagttttccctatattaggttgacagaggaagagaagactagggcctggttcacagatggttctgcatgatatgcaggcaccacccaaaggggacagttgcagcactacagccccttcgtaggacgtccctgaaagagagtggtgaagggaaatcttcccagtgggcagaactttgagcagtgcacctggttgtgcactttgcatggaaggagaaatggccacatgtgcaattatatactgattcatgggctgtagccaatggtttggctggatggtcagggacttggaagaagcataattggaaaattgctgacaaaaaaatttggggaagaggtatgtggatggacctctctgaatggtcaaaaactatgaagatatttgtatcccatgtgagtactcaccaatgactgacttcagcagagcaggagttaattaatcaagtggtaggatggcctgttctgtggacaccactcagcctctttccccagccacccctgtcaatgcccaatgggcccatgaacaaaatggctgtagtggcagggatggaagttatgcatgggctcggcaacatggacttccattctccaaggctgactcggctacggccactgctgagtgcccaatttgccagcagcagagaccaacactgagcccttgatatggcaccattcctcggggtgatcagccagctagctacccggtgacaggaaagggcagaagtttgtcctcacagggatagacactcactctggatatcagtttgcctatcctgcatgcaatgcttctgccaagactaccatccgtggacccacagaacgccttatccaccatcatggtattccacacagcatagcctctgaccaaggcactcactttatggctaaagaagtgcagcagtgggctcatgctcatggaattcactggtcttaccatggtccccatcatcctaaaacagctggattgatagaacggtggaatggccttttgaagtcacaattgtaataccaactaggtgacaatactttgcagggctggggcaaagttctccagaaggctgtgtatgctctgaaacagcatccaatatatggtactgtttttcccatagcaaagaatcatgggtccagggatcaagaggtgaaagtggaagtggcaccactcaccatcacccctagtgatccactagcaaaacttttgcttcatgttcccacgacatcacgttctgctggcctagagatcttagttccagagggaggaacactgccaccaggagacatgacaatgattccactaaactggaagattgccacctggacactttggggtcctcctacctttaagtcagcaggctaagaagggagttacagtgttggctggggtgactgacccagactatcaagatgaaatcagtctactactccacaacggaggtaaggaagagtatgcatggaatacaggagatccattggggtgtcttagtattaccattgcctgtgattaaggtcaatggaaaactacaacagcccaatccaggcaggactacaaatgacccagaccgctcaggaatgaaggtttgggtcactccactaggaaagaaacacgacctgctgaggtgcttgctgaaggcaaagggaacacagaatgggtagtagaagaaggtaggcatcaataccagctacaaccacatgaccagcttatttaaaaatcataggaagcatatttgaaaataataaagcaacaactataaatctgttgtatatctacatgtcacagtgatcccgtgacaatggtggtcctgtatagtattactttttactgagtgactatatatatatatcctattagtatcctaatatagatacgtatatacatatatacatacatgtacatatatacatatatgcatacatataaatatacatatatacacacatataatgtatatctcatacgagtgctcaccaatgtatagatatgtatagatgtatatattgtatatgtatatatacgtatatgtgtgtatatatatatgaagtgttcccatatataatatatgaaggggagtttattaagtattaacttacacaatccaaagctcccacaataggctgtctgtaagctgaggagcaaggagagccagcctgactccccaaactgaagaacttcgagtccaatgttccagggcaggaagcatccaacacgggaaaaagatgtaggctgggaggttaggcccatcatctccttttcatgcttttctgcctgctttacattcactggcagctgattagattgcgcccactagattaagggtagatctgtcttccccagcccactggctcaaatgttaatctctttcggcaacaccctcagagattcacccaggatcaatacttcgtatctttcaatccaatcaagttgacactcagtattaaccatcacaagtccactccttgtcaacttgaacccatacacatcccctgagatcatagataatcttcaaatagagacaataataaggtcaaaattatgcctaacataatacaaccatccttcatacagccagaaacgtaccaatcctcaacccaagtattattacacaaagttaccaatatttaaatgctgatatgaagtcaataaatcttatgtcacatgaaaaaggagaaaggaaataaaatgaagatattttcttagtacaggtgtacacatgcacaaacatgtttttaaccaaaggaggaggaaatactcatgacaattacagtcctcgtttctgcagctggtcatatggagatatagatatatctacatatacatatatatctatatatttatatagatatctacatatacatatatgtctatatatctatatctatatatatctcctattagttctgtccctctaagacagccctaatacagtgggagagaagtgtctggtttcattcttctgcatatagacacccagtttccccagcaccatttattgaagagactctcctttcctcattgtatgtcccttggagtaaaagaaacatagcatgttcttgctaatatgtgataactaaaaagtaagaaagttgatgttacagaggtagagagtagaattatggttaccagaggctaggaaggttagcagggagaaagaggatgaatagggtttggttaatgggttcaaaaatacaatgagaaggaataagttacagtttcaataccacagtagggcaagggtgaacattgttatcaatcattcattgtatatttcaaaatagctagattttggaacgtctgaagacatagtagataataaatgtttgagtgatggatataccaattactctgatttgatcattacacattgtatacatgtatcaaaatatcacaggtaccccatgaatatgtacaattattacatctcaataaaaaattaaaaatttttaaaattaaaaatcagtcatataaaaacctggtcaaaagcaatccaggaaaagggagaagcatatttaaaaatcataaagcacaactatagagctgttatatatctacatgtcacagtgatcccgtgacaatggtagtcctgtatagtattgctttttgcttctaggttgtggcatgtcttggagtgagccatctagggaaactgccaatggttctttacatgtaaagctgaatctcctgcagaaaattctctcagcatcttaagacaccattatctgaatgtgatttaaactcttttttcagacatatagatcgacaatcatcattttcagcccctcagggtgcaggccatttaccaaaatgacaatagcattaaacttattgctattattggtattaatagctctaataacatctacctgatgacttcaatgctgaattaccgcagggttagtcagaagtaatgagctaaaatgatcataaagcccttttcaaatatttcaggtggtacaaaattattacaaatggcaaggtaggtgttgcacgttctctgtgaaacaacgggtgtcagccagataagaagaaagcaacattagctttgaaagtggcactgggggccctgggtcccagccctccctcaagttttgtttcaaatatcagtgttactagacccactttcaaaaatgaaatgggaatcattttcctagggataagtgagaagatgtgccattctcaacctcaacgatgccttttattatgtttccctggctattcttaccatcttcatcatttcttctcacttgcaaacagtgcggccaaggtgtcgtcaccaaatgcttttagatatgcccacacctaccagcttggcagcccgttactaaaggtaaagcataatcgtgcctgatttagagacagtagcaaaaacctctttacctgctagatatgggaattaagtaaactgtgagagactgtgacactgataatctggatatttgctataagcaaaactaattcctagttatggaaacactctaaagctctataaaatgaaactagtaatacctacaaaaaccatgcagttctaatgaaacttaaaagaagttatgcatataaaagcttttctcaactagtaaattgccaagtgttttaaaatattgattgttcatatggaatacagcatttgggaatattatttcaggagtcttgcagtccatggttccaatgccaacttgctccatggattagctctgtgacattgcataggtcacataacttctctgtctcaatcttcttaaaagaaaatgaaagagttcagactgggtggagcccatcgtagtaccgcaaagccactgtagccagtctgcctctctagattcctcctctctgggcagggcatctctgaaaaaacggcagcagccccagtcaggggcttatagataaaactctcatctccttgggaaggagcacctgagggaaggggtggctgtgggcacagcttcagcacacttaaacgttcctgcctgccagctctgaaaagagatctcccaacatagcacttgagctctgctaacggacagaatgccacctcacgtgggtccctgacccccatgcctcttgacagggagacacctcccagcagggaacaatagatacctcatacaggaaagctctggctggcatttggcgggtgcccctctgggatgaaggttccagaggaaggatgaggcagcaatcttcgctgttctttggcctctgctggtgatacccagacaatcagggtctggagtggacctccagcaaactccaacaggaaactccacaaaggaaaacctatcagactaacagcagatctctgcagaaaccgtacacaagccagaagaagtgggggccaatattcaacattcataaagaaaatcattttccacccagaatttcaaatccagccaaacaaagcttcataagtgaaggagaaataaaatcctttacagacaagcaaatgctgagagattttgtcaccaccaggcctgccttacaagagctcctgaaggaagcactaaacatggaaaggaacaactggtaccagtcactgcaaaattgtaaagaccatcaacactatgaagaaactacatcaactgatgggcaaaataaccagctagcatcataatgacaggatcaaattcacacataacaatattaaccttaaatgtaaatgggctaaatgccccaattaaaagacacagacaggcaaattgggtaaatagtcaagacccatcagtgtgctgtattcaggaaacccatctcacatgcagagatacacataggctcaaaataaagggatggaggaatatttaccaagcaaatggaaagcccaaaaaagcagaagttgcaatcctagtctctgataaaacagactttaaaccaacaaagatcaaaagagacaaagaagggcattatatagtagtaaagggatcaatgcaacaagaagagctaactatcctcaatgtatatgcacccaatgcagaagcacccagattcgtaaagcaagttcttagagacctacaaagagacttagactcccacacagtaatagtggaaaactttaacaccccactgtcaatattagacagatcaatgagacagaaaattaacaagggtattcaggacttgaactcacctctgtaccaagtggacctattatacatctacagaactctccaccccaaatcagcagaatatacattcttctcagcaccacattacacttattctaaaactgaccacataataggaggtaaaacactcctcagcaaacacaaaagaacggaaatcataacagtctctcagaccacaatgcaatcaaattagaattcaggattcagaaactcactcaaaaccacacaactacatgaaaactgaacaacttgctcctgaatgactactggataaataattaaagtagagcagaaataaagatgttctttaaaaccactgagaccaaagacacaacatactagaatctctgggacgcatctaaagcagtgtgtagagggaaatttatagcactaaatgcccacaagagaatgcaggaaagataaaattgacacgctaacatcaaagttatatgaactacagaagcaagagcaaactaattcaaaagctagcagaaggcaagaaataattaagatcagagcagaactgaaggagacagagacatgaaaaacacttaaaaaaaaaatcaatgaatccaggagctggtttttttgaaaagactaacaaaacagatagacctctagcaagactaataaagatgaaaagagagaagaatcaaatagatgcaataaaaaacgataaagggtataccaccactgatcccacagaaatacaaactaacatcagagaacagtataaacacctctatgcaaacacactagaaaatctagaataaatggataaattcctaaacacatacatcctcccatgtctaaatcaggaagaagtcgaatccctaacagacaaataacaacgtctgaaattgaggcagtaattaatagcctaccaactaaaaaacgtccaggaccagatggattcacagccaaattctattctactagaggtacaaagaagagctggtaccatttccttctaaaactattccaaacaatagaaaaaagggactcttctctaactcattttatgaagccagcatcatcctgatgccaaaacctggcagagacacaacaaaaaaaagaaaatttcaggctaatatccctgatgaacatcaatgtgaaaatcctcaataaaatattggcaaaccaaatccagcagcacatcaaaaagcttacccactacaatcaagtctgcttgatccctgggatggaaggctccttcaacatacataaatcaataaacgtaattcatcacataaacagaaccaatgacaaaaaccacatgattacctcaacagatgcagaaaaggacttcgacaaaattcaacactccttcatgctaaaaactctcaataaactaggttttgatggaacatatctcaaaataataaaagctatttatgacaaaccaacagacactatcatactgaataggcaaaaactggaagcattccctttgaaaaccggcacaagacaaggttgccctctataaccactcctattcaacatagtaatggaagttctggccaggacaatcaggcaagagaaaggaatgaagtgtattcagataggaagagaggaagtcaaattgtctctgtttgcagatgacatgactgtatatttagaaaaccccatcatctcagccccaaatctccttaagctgataagcaactttagcaaagtctcaggatacaaaatcaaagcagagtgcaaaatcaaagcttgtgcaaaaatcataagcattcctatacaccaataatagaaaaatagccaaatcatgagtgaactcccattcacaattgctactaattgaataaaatacctaggaatacaacttattagggatgtgaaggacttcaaggagaactacaaaccaccaaggaaatgagaggatatgaacaaatggaaaaacattgtatgctaatgggtaggaagaatcaatattgtggccatactgccaaaagtaatttatagattcactgctatctccattaagctaccattgattttcttcacagaatttgaaaaaactactttaaatttcctatggaaccaaaaaagagcccacatagccaacacaaccctaagcaaaaagaacaaatctggaggcatcatgctacctgacttcaaactatactataaggctacagtaaccaaaacaacatggtagtggtaccaaaacagatatgtagaccaatgcaacagaacagaggcctcagaagtaacactacacatctacaaccagctgatctttggcaaaactgacaaaaacaagcaatggggaaatgattgcctatttaacaaatggtgttgggaaaactggctagccatatgcagaaaagtgaaactggaccgcgttcttaaaccttatataaaaattgactcaaaatggattaagcacttaaaagtaagacctaaaaccataaaaaccctagaagaaaactgaggcaataccattcaggacgtaggcatggcgaaagacttcatgactaaaacaccaaaagcaatggcaacaaaagccaacattgacaaataagatccaattaaactaaagagattttgcacagcaaaagaaattatcatcagagtgaacaggcaatctatagaatgggagaaaatttttataatttattcatctgacaaagggctaatatctacaaggaacttaaatttacaagaaaaaaacaacccaaacaaaaagtgggcaaacgatataaacagatacttctccaaagaagacatttatgcagccaacaaacatatgaaaaaaagctcatcatcactggtcattagagacatgcaaatcaaaaccacaatgagatatcatctcacaccagttagaatggcgatcatccaaaaggaatcagcggatatgggggaggatgcggagaaatagcaatgcttttatactgttggtgggagtgtaaattagttcaaccatgtggaaaacagtgtagcacttcctcaaggatctagaactagaaataccatatgatccagcaatcccattgctgggtatatacagaaagtattataaatcattttaccataatgacacatgcacaggcatgtttattgcagcactgttcacaatagcaaagacttggaaccaacccaaatgcccatcgatgataaactgggtaaagaaaatgtaccacatatacaccatggaatactatgcagacataaaaaaggatgagttcatgtcctttgcagggatatggatgaagctggaaaccatcattctcagcaaactatcacaggaacagaaaaccaaacaccacatgttctcattcataagtgggaattgataaatgagaacacatggacatagggaggggaacatcacacaccagggcctttcggggggtgggctgcttaagaagggatagccttaggagaaataactaatgtagatgacgggttgatgggtgcagcaaaccaccatggcacgcatatacctatgtaacaaacctgcacattccgtacatgtaccccagaacttaaagtataataaaaaaaagaaaaaaaaacagactaaaccaacaaagactcaaaaagacaaagaagggcattacatagcagataaagggatcaatgcaacaagaagagctaactatcttaaatgtatatgcgcccaatacagaagtacccagattcataaagcaagttcttagagacctacaaggagacttagactcccacacaataataatgggagactttaacactccactgtcaatatcaggcagatcaatgagaaagaaaattaacaaggatattcaggacttgaactcagctctggaccaagcagacctaatagacatctgcagaactctccaccccaaatcaacagaatatacattcttctaagcaccacattgcacttattctaaaattgatcacaaaattggaagtaaaacactcctcagcaaatgcaaaagaacagaaattgtaacagtctctcagaccacggtgcaatcaaattacaactcaggattaagaaactcactcaaaactgcacaactacatggaaactgaacaacctgctcctgaatgactactgggtaaataacaaaattaaagaagaaataaataagttcttagaaaccaatgagaacaaagacacaatgtaccagaatctctggaacgcagctaaagtagtgtttagagggaaattgttagcactaaatgcccacatgagaaagtgggaaagttctaaaagttgacaccctaatatcatcattaaatgaattagagaagcaagagtaaacaaattcaaaatatggcagaagacaagaaataacgaagattagagcagaactgaaggaggcagagacacgaaaaagccttcaacaatcaatgagtccaggagctggttttttgaaaagattaacaaaatagatagaccactagccagattaataaagaaggaaagatagaagaatcaaatagacacaataaaaatgataaaggggatattaccactgatcttacagaaatacaaactagcatcagagaatactataaacacctctgcacaaataaactagaaaatctagatgaaatggatgcaagggttgttgaacatatgcaaatcaataaacataatccatcatataaaaagaaccaatgacaaaaatcacatgattatctcaatagatgcagaaaggacctttgataaaattcaacaccctttcatgctaaaaactcaataaactaggtattgatggaacgtatctcaaaataataagagctatttatgacaaacccacagccaatatcatcctgcaggggcaaaatctagaagcatttcctttgaaaaccagcacaagacaatgatgccctctctcaccactcctattcaacgtagtattggaagttctggccagggcaatcaggcaacaaaaagcaataaagagtattcaattaggaagaaagtcacattgtctctgtttgcagatgacatgattttatatttagaaaaacccatcgtctcagcccaaaatctccttaagctgataaacaacttcagcaaagtctcaggatacaaaaatcaatgtgcaaaaatcacaagcattcctatacacaaataacagacaaacagagagccaaatcatgactgaattcccattcacaattgctacaaagagaataaaatacctaggaatacaactcacaagggatgtgaaggacctcttcaaggagaactacaaaccactgctcaagaaaataagagctgacacaaacaaatggaaaaacattccatccttgtggataggaagaatcaattaccatgaaaatggccatactggccaaagtaatttatagattcaatgccattcccatcaggctaccattgactttctcacagaattaaattagaaaaaactaccttaaatttcatatggaaccaagaaagatcccatatagccaagaaaatcttaagcaatagaacaaaactggaggcatcacgctacctgacttcaaactatactataaggctacagtaagaaaaacatcatggtactggaccaaaacagatatatagaccaatggaacacaacagaggcttcagaaataacactacacatctacaagtatctgatctttgacaaaactgacaaaaacaagcagtggggaaaggattccctatttaataaacggtgttgggaaaactggctagccatacgcagacaactgaaactggacccctttcttacaccctatacaaaaattgactcaaaatggattaaacacttaaacataagacctaaaaccataaaaaccctagaagaaaacctaggcaataccattcaggacataggcatgggcaaagacttcatgactaaaacatcaaaagcaatggcaataaaagccaagatggacaaatgggatctaattaaactaaaaagcttctgcacagcaaaagaaactatcatcagagttaacaggcaatctatataatgggagaaaatttttatgatctatccatgtgacaaagggctaatatccagaatctacaaggaacttaaacacatttacaagaaaaaaaaaaaaaccatcaaaaagtgggtgaatgacatgaacagacacttttcaaaagaagatatttaggtgaccaaacatatgaaaaaaagctcatcatcactggtcactggagaaatgtaaatcaaaaccacaatgagataccatctcgcaccagctaatatggtgatcattaaaaagtcaggaaacaacagatgctgcagaggatgtgaagaaataggaacgcttttacactgttggtgggagtgtaaattagttcaatcattttggaagacagtgtggcgattcctcaaggatctagaactaaaaataccatttgacccagcaatcctattactgggtatatacccaaaggattataaatcatgctgctataaagacacatgcacacgtatgtttactgcagcactatccacaatagcaaagacttggaaccaacccaaatgcccatcaatgatagactggataaagaaaatgtggcacatataaaccatagtatactatgcagccataaaaagcatgagttcatgtcctttgcaggcacatggatgaagctggaaaccgtctttctcagcaaactaacacaggaacagaaaaccaacaccacatgttctcactcataagtgagagttgaacaatgagaatatttgggcacagagaggggaacatcacacaccagggcctgttgggggagtgtggggcaaggggagggatagtattaggagaattatctaatgtagatgacaggctgatggatgccgcaaaccaccatggcacatgtatgcctgtgtaacaaacctgcactgtctgcacatgtatcccaaaacgtaaagtacaattttttaaaagagaaaagaaaatgaaataaaaaatgatacaggaaccacggttgtaaaaatttaatagaatatatagcacctagcacatatgtgcctggcctattttatgtaatggaaaggcttgcaacttgttgttgttgttgttatctggagtcttaaggcagagcatcctggtggccggcttcagctgctcacacaaagcattattcagctcctcaaaaaaaggcattatttattaataacatgcatcaacttttagtgcaggatagctcaaattcgagtgttcatttacaaatgcaaaaattcccccaagtcctgatttgtttgggggagcccaagaatcttcatttttaatacatattatgagtgattccagtgtttaggaaataacgtcttgaatgtcaaaatccatttcctacatccttcataagtcttctgaagctgacttctccccataagaatgtatttcagagaaacagtttggcacctagtgttgagcgtgattggcactctcactattaactccagaaacttcatctggaacttgtttctgcaattcttgcacatttttagcttgtggctatcacgactgaagcacaaaaccgaacaacttgaaagctttttgaaattctctgaagaccaggcctctgattcattagaaggtaaaaagtgatggctctttgacaaaggggactgggagagaagccaagagggacatatatttgcacgaaagttttgtttaaagaaaaagagaaagagaccaaaaataatgaatctcagcttcatgtgttcttcacccatgcagctttgggctattctttgtttattggtaacaagaatgcctgcgagaggaaagaactgcaaatagaaatggacttgacgtgaatacaataaggtttcaccatggcaaaaggcagtcatggctccagtttactttgtataaaccacaataaggggtggtggagccccagtttcttgcagtgtgtccctctcccacaccacagtgtattgaggatgaatatcgtatgcatacacacgcaagactgaagtattttggtgtcatctagtgtttgggtaaaggttttacttttttctttttctattaatatcactgcagctaacatcagtttgtcatttaatcatcctttactgacacatttatttttgggtctccatcagtgacttttgagtgttcctgaactcagctgagcactgtccctaactggagtcagtgtgtaactgtacccttagactaaaagcaggcacccagccccagccatcataccctgctgttcattgcagccaggttgatgctgtgtctgcaccatggtcttcctaagtccagagctctgctttctgaaactattaagacaacaggctcccattgagctggttttagtgttggacagacctgagttagtgtcctgaatctgcctcttgctagccatgtagccaagagcaggacacgaatttctctaagtctaggttgctcacctacgaaatgaaataataataatagcacctgattcatagagttctcgtaaggattaattgagataatggcaagtatctttgtattattactagtaatgtatattagtgactattagaagtgcttgttaatactgcatcttccagaactgtgtccaggcaaaagaatcaagagtgctgtgatttctatgcacatttacatttgaggcaaactttttaaacatattttgttcactggcatatcttccatacttagaataattcttagcatacagtaggtactcagtacctaatggataaataactaaattaattaattggtgaacattcggccgggcacagtggctcacgcctgtcatcccagcactttggaaggctgaggcaggcggatcactcttcaggtcaggagttccagaacagcctggccaacatggtgaaaccctgtatttactaaaaatacacacacacacaaaatagccaggcatggtgatgggcacctgtaagcccagctactcatgaggatgaggcaggagaattgcttgaactcaggaggcagaggttgcagtgagctgtgaccgcgccactgtactacagcctgggcgacagagtgagactttgcctcaaaaaaaaaaaaaaaaattggtgaacattggtattagtagttcccttctccttgtttgtgactgctccaatgcagtttgctagaccacaagaattcagacatcccttgtgtgtgcgtcatgtatattccatcttaaaaccagcagaggtgagttcttctctgttcttcttactccttcactgcagttacttttatctccctcgtaaccacccagagccctaagaggatgaccttaataggtcatcatcccatttcacatgtaaagaaaccgaggcatggaaatgaaagtgttttgcctaggcttacacctcactgaggttcacaaccaggattctaacacagaaagcctctcttcaggatgtgtccttaagtactatgcaaagaaagatgcaatattatctccctgcatgagggcatccacagaatggaaattgctttttgctaccaaacaaaagccctctaagagtctacctactgtcaagccatttcttcactgagcatatcatgaggaaatactgtttatctagtcattcacagatctatttaagtttaatagatatttattgaatcctgctagaaatgtacacaatatacagggtttttctcttcacagagcttatgctgtagttggcaatatggtgtcattgatagccatttataagtatccttttcatatataaagaacagtgttgtaatgatgtgctatgctaacatttatttccttaattttgaagaaaagatatcaagttttcaaaagatatctaagaataatacaaatgaataacaaaaaaccttgactcccaaaacacatacaggtgtcagtaattatcccagtgatgccctttatagagagagtccaaacccagatcacagttgcaccctattgtcatgtctctatagtctccttcaatccggaacaatccttagttttgacttgactatcttgaatatggcattcgtgaagattacaggtcagtacttttgaagaatgcctctcaaactgggtttatttgatgattttacatcactagacctaagctgtacattttggttggaatattacagaagtaacaccagttttctctcattgagtcttactgggtggcacaagatattggcttgttccataagtgataatgttaatttttgttcacttgattgagatggtatctaccaaagcaggcagagtggctcacacctgtaaactcagcactttgggaggctgaagtaggaggatctcttgagcccaagagctcgagacaagcctgggcaatagagcaagatcttgatgctactaaaaaaaaaaaaattagctgggcatggtggtacatgcctgcagtctgagctgctccggtgacagagggaggaggattgcttgagcccaactgcactctaggatgagtaacagagcaagaccctgtctcaaaaaagaaaaaattcttccagacttcacctttgtaaaattatgccctctatttacagcgaataaatatttttctggtagaagctttgagattacatgaaatcccattcctcgtaccaatttcacttactggttttgacatccattgcaagttcttttataaattaatgtttattgtgaaggttcacatggggattttttaattctgtcatttcttctacctttagtagttaacattctaccctaagaaagaacatcctatccactccatttatccatttatttatctcatgtagaaccatttattcaacagattataatccattgctgccatttttgtgttgttgctgtggcagttgctcaaattttccctgatttggccagtgacagcactttcaatacggctgacatggccccatcatgctttggacaagtccttactctccggcacaacacgatgatccgggttcccttttctttccctgtggcagccctaaaatcagccgttcctccaaggatccctgcttcctttcggtggataatgtttttggaaactaagataggcagcagttaggttcattgctactggggtatcgctgtacctgagcactcccctccctatggacactaatgtagatgttagtaaatataactacaaatgtaatattatatctacatatttacttctatattatatttatatttacttctatgtctatgtatgttttgaaaagaggcattcacatcaacactttcatcccaatcccaaaagagggttcattctaacttttccattttcatatttgcatttccattctccaagaataagaaaaccagccccccttatgtttcaatagatgtgtgtatcagctcaagcccctgaccccactaaactgctgcacaggtgggacaccctcttcacaggggacttgacaccagatggccactgccctaatttgataacccccacctcaatgggggccaaaggttttcgataggcccaaatccggctgccttctaggaagggaacaaaagaaagaaggaggagggagatatggaacaacgccattgatttaaaaaagaatattaatactgtttccagttatgcacacaaaaaacctaagagtcaaacctctctgactgctaatctgtcccaccacagacatttcctagtaaacaattcaaagtcaatagttccttttttgccatgtaggctctgtaaggagctttgtgtgggatgactaatatagaaataaagcatatcattctcccaagagtcctcaaaatgcttaagagcacaaatggtgggggagggtaaattacatccaaatttattataatctggcaaatcatctgatttgaatatactaattacatgaaaatcaatttgttccaatggttttcaattacatctagcaacaacagggggaagggagagtacaaggggttccctttagagccataattgggcagctataattaactacacaccacataaagggcccttcattacataattatgtttgcaattattcctcttgctctttgattttaagtgagaaagcacaactgtcagaaagtaaagtggtaaacatgaaagttaggcttcgaaaatgggtttgggatttacaatgtttagggggtaaataggtagtacagttttgttttgttttttgaaacaaataggaaccttagacactcttggtcaactaattagcacaaattaaaagaaaatccgtttgaggtgtgtgtctacttacaaaccacctgttttccctctttcttagttttttaaatgaaataagtagctctcgtttaaagtgaaccagacagttccccagtgcgattgtctcctgagagaggagaaacgagattcttcaagaaaatgaaaatgtttcatgcctccgttttatcttctgaaaggttacttttaaaagttaactcctaaagagaaacagatgtgtccagaaattaagtattccaagccagaccaggagaaattctctgtgcctggtatagaagtggaagaggtagctttagttgctaaaataatcttacaggaattacttttatggggggatggaggggggctcaggagagcgaggaatggggctaggacagagtttttcatctagttttgttttcagtcacagtgaaaccttggcagactgtgttgagacaaaacacctgcctctttgtattgatagttctaccatgatacattagtaaatgtatagaacaaacatggtttctgtctgttatttgttttgcttttctgagaaaatgaggttgattgcaaatatgtcttctttttattctggagatattttgttgtttttagctaatgcctcctagaaaatcagaccacaattttcactggaattctggtcattttcaaatgagataccttgaaatctaattcaaaaatatatatgtatgacaaaataatgagaaaaaatacaaaaaccaagaatctgaatgattatgcataattcttttctaactgcatccaacagaaacagccacgtgtaatctacttcctcatataagacatggcacaaaagaaaagcaataataattcattcaataacattttcagagatctttttcgcctatctctttatatgtaggcattcccagagatctcatatgcttttctctacctcttggtttctttctgccactctgcctctcttgtctcacagttgagctcacttccatttattgggtttcaactgcacattgcttatttctgaattacagtggcttcttttttgagtccaaacatacccaatgtaagttcccttcaggaaagtgcatctttttctatattcaccaagaatggagacctctagcttaagttttattttccatacatctcctgtcaatttctataaaattttccaaaactctttctgcagcctttttagatgatttccactcttcttgccccaagtcttaatcatctcaatcaagagtacttactatcttctctaacttatttctacctacaacttgtgttgtagtcaaggttttcagattttccaggccacaatcttttcatcactgaaatgggcttcatagtaactctctatattacatataaatgcaatcagattcaagaaagccatttgcttatgcaattgtggagttagttgttcccacaactcatctcccagttgccaaatcatccttcatatagttgagaggtttgttttccctaaaggactaatatgctttttttcccccaattgtcaaaagaatcctaatttcatgctaaggacagaccacaccatgcttttccacagcattgatagggtttggctgtgtccccacccaaatctcatcttgaattgtagttcccataatcctcatgtgtcgtgggagggacgtggagggaggtaatttaatcatgggggtggttaccctcatgctgttctcatgatagtgagtatgttctcttgatatctgatggttctgtaggaggctttcccccttttgctcggcagttctccttgctgctgccatgtgaagaaagacacgtttgtgtccccttccaccatgactttaagtgtcctagggcctccctagccatgctgaactgtaagtcaattaaatctctttccttcataaattacccagtcttaagtatgtcttttctaacagtgtgagaatggactaatccaagcataatctagttaatctttccaagcattctgcacttcaggttcaacaaataactagcttgctgagcatctttcctatcaattttcttgttccatctagaatgtctttcattccaacccctgctctgttgacatctcatctatctgtgtgtatgtatccttcaacctccagctcaaaagataactccactataactttttctacctttgagcacaggtgatcactcatttttctgtattctcataatgtatcaaatatacctttatttaagtctaatattaagttaaacagaagctaatgttatataaaattaaaatatatattatactgtaatatgaaatatactatttatatttcctacttggttctaagcttcttaggagaagtaatcctgactcattcaccaagctattatccacaaaacattgcacatttaggcactcagtaaatatctgctgaatcattaatattttatacattttcaaaaatggtaatatggaattcaaatagtacctgtcttgtgtttctaagagcaagaaaaacatgaaacaaatatgcttgcaagttaattaacttatattatttttgaagcctggatggcactttcatcattatcattgttatatttggaacaaataatctttattgagtgcttaaaatgtgccaggtatgcactaagtgcttttcatatttacatcattaaaatatgaatgatagttcgataaccaagaaataaataaaagctatctataactttgccacagtgtctctgaaagaaatgctgaagtatatttataatgaaaactaaaaaattccttttttcccacaatttcactcttagtatctaacataacccctgaagttgctccccaaatattttcctcccccagtataagctctaacatccatcccttccagtcaacccaagcaagctccctcatcagttttatctttattccctacctgtgtgatcttgtgcaagttatttaaacccactgtgacacaattttctcatctgtggagtgagaatggctaccaatggtatttagcaatgaactcagctgctaaaaagataatctattgcttaaacaagtctgggtatcaatttctcatgtaacaagtctgatggtagatggtagctggccttggtttggggactcaataatgccagggcctctgctctgtaattttctgggccattcactcattttcacagggggctgcttcagcttcagtcaccatgtccatatttaaggccagggaaggggaagcagaggatgcagttgcatgggtaactaatgtgaaagctttccccgaatccccctactgatgcccactggcactcattgtccaaaaccactgcatgggaaactcagaaggtgaacaaccactggaacaccacccaaaacaaaactagttgttcttaatgtggaaacaggggccaatgggatattagatagacaactagtagtgtctcccatactaccttcagtattgtcatgaaggcaaacgagctaattctcatgctgagtatttatcagaatgcctggcaaatgttaaatatcctcttctttacctgctttcagttacacttagttttctaccataagtaattttctactcttctaaatatagacctgccccctaatctgtttccctggttcacccctcattctttaccaccatgcccagtaaggcctagaagttataggatctggcacagagtcctaaaggtcctcctttactaggaagagcaaagcaaactttagagactgttattgttttgttcctgtaacacactcaaaggaaaaaataaaaaaaggcctaggaacaagccatttaaaatgctcatttatttaataactttagctagcagatcagacttaaaatttgttcttccccagtggcaaggtgaggtaaaaatgtacataataagacatattaaggtcatcagcagagcttctaaactttgaaaataaaagctttttgaagtctataattaataagcactatattaattagggcacttcaatcttagaggttccccttccttaacttgagtgaatctttgatatcgaagagcaggggaattctccttcactatttttcattgtaaattccagttaagcaaaacagtcgtctgtcactacgtgatgggcttattattcaaatctcactcttttaataaaattagattatccagtgtcatcaactaaaaacaaatctgtaattttccaaggccatgtctccctttttcattcagaattgaggccacgtgattctcatctgtggaaacaacataatgccaggcattaggatcatccttgtacctaagggaaatttaagaacccctagctagggccatacatggtgggtcatacctgtaatcctagcactctgggaggccaaggcaggaggataacttgaggccgggagtttgagaatggcctgggcaacaaagcaagactccatctctacaaaacattgaaaatattagctgaacagggtggcttgtgcctgcagtcccagctacttgggaggctgaggtagaaggattgtttgagcccaggtgttcaaggatgcagtgacctatgattatgccactgtgctccagcctgggtgacagagtgagacactggctcaaaaacaaacaacaacaaaaaccctagctaaatatacaaataacccacaatcaattgaaatatgctgataatatggttatgatctcaatcagataactaagttttggtcttattcctcagaccaaagctccacctcataaagagttcaaaaaactgtctcatttttgatgtttctttcattcaggaatcacagttttgctaacctacctagaaataagtatgtgtgtgtgtgtgtgtgtgtgtgtgtgtgtgatctgggtgtgtgtgtgtgtgtgtccactccatctatttaccagtttagccataggaatggaatcctgccattcaaccccagccctgctacctactgctgaacatctcagaggccaagaactagcttatagactttatggctggctttcaccaaagcagctaattcagactcatcatcccattgtgaacaaatttaaaaactgaagtcatacatcaaatgactgtttgaaggcataggacagcaaacaacacaaggttataaattcttgagcgaagagaaacatagctttcttctgcagatattttctgaaaccaaaccacagcagatagaacacaaaaagaagcagtcttgttgagtggaggaaacagattagaattaggagagctagagtgactagcagctgggaaggcatgctactagtggggaaaataggacaaagaaggattaacgaaaacatttgtaaagtttcactttgaggctgatcatggtggctcacacctgtaattccagcactttgggaggccgaggtgggcagattgcttgagcccaggagtatgaggccagcctgggcaacatggtgaaacttctctccacaaaaaacacaaatattagctggttatggtggtgcacactaccagctactcgggaggctgaggtggtaggatcgcttaaggccagtggggcagaggttgcagtgagctgagattgcaccactgcattccagcctggagcacagagtgagaccccggctccaaaaaacaaaaagcaaaacaaaactaaaattcactttgttttaattaactccggaagtatatatgtacagtggaagattctcaaaagacacagcattcacaatgtgaaaaacaataaaacttactgtatgtgcaatgaagcatgagtcaataggttttatatgagacagcagaagagaagattagtcagctcaatgacaggtcactagaaatataccaactgaaacctgatgagaaaaaaaattggaaaaatgtgaaagaaacaatacaagagacgtgggacacagtgtaattttcaaacatataatcagaatgcaaaaacgagaagaaaaagaataacagaagtatttgaaaataatagctgaaaatattccaaacacaatattggcagcgcaagttgcaaaaagctcagtaaaacacatgcaagataaaaccaaaggaaaccatacataggcacctcatagtgaaattgctgaaaaccaaacataaagggaaaagtcctaaaagtatccgaaggaataaaggagaacacattactttcagggaaccacaatgataattacagcttctcaacacaattatggcgaaaaaaagacaaaaaaaactacaattcaaaataacaaaagcaaaaaatgccaacatagaataaaaacatcaatcaaaaatgaaggtgaaataaaactctatcaaacaaaagctgaaagtgcagaaaagccctagaaatgtacatattggggtaaatatacaagttcttagactgtctaaaatggaggtctgcaagatttttttatagcaaatacttcaagcttcacagactacacagtctctgtcacaactactcaaccactgccactgtagtgtgaaaacagccatggacgacgcagaaataaacaggcatgggtgttttcttagtccatttgggcggctacaacaaatatctgacactgggtaattaattaagaatagaaatgtattttctcacagttctggaggtttggaagtccaaaatcaaggcacccacacgttcggttgtctgatgagggaatgcatcttctggaagggaggaacaccaaatcctaacacggcagaaggtggaagggcaagctaaccaaatgcacacagccttttaaaataagggccttaatcccattcaggagagaggcgccctcatggcctaatcacctcttaaaggccccagctgttaatatatcacattggcaacacctgaatttttggtgaggacacatttaaatcacagcagctgtgttccaataaaactttactaataaaaagcaggctggcaagcctcttgtttgccaattcctcatttaaagtaacaatgttttgttgagctgttgacaagtagagataaaatctataacaaaaatagcaaaaaaaaaggtgagagaggataaatggaataaattgctataatgttcaaacactgattggcatgtggaaaacataaatttcaagtagattataataaaggcattttgtaatttctacggtcatacaaaaatgttaacaaacattctatcagaagtgataaaataacaaaaaagatcgactactataaaacaatgcaacatagaaggttgtattagttaactttgtacaaacttcagtggcttaaaacaactgttttatttagcttatgatttctttggtttggcttgtgtggccatctggtctggactgcctaagctggtagctgctgggatctctcattgactgtcatcatctgatgaatttgctaggtctttatgacacagattgtcctcaactcacatgtgtggctggtggccaagctggtttagaggaagcctcactaaggtggcacctctctgctctatgtggtctctgattcccaggaggctagtccacttcttcacacagcagtctcaagattcaaatgagacttttaaagtctctgctagataaaatttgctatattctcaatggccaaagcaaaaagaattttttaaataatattttaaaaatagattatatttgacaaaaagaatacaaataatgtttaatagctgaattaaccatgattgaaaataatagctgagaatatcccaaatttaattaaaatcagcagcacaagttccaaaaagctcagtaaaacacaagcaggataaatacaaagaaaaccccatataggcacatcatagtcaaattgctgaaaagcaaatataaagagaaaagtcctgaaagaatcctaaggaataaaggaggacacattactttcaggcaaccgcaatgataatgactgcttctcaacacgaattataaaaacacaaaaataagataatgacaattcaaaataatgaaagcaaaaaatgccaacatagaatagtcttaaaccatactgcaccagtagtcacattactaaagtataagctttatccaaccaagaaatgactgaggaaattacagcagatggagtgatactgagtattttatatatttagttgtagggctaagactaaagtaagaaagtggttgtattagttcaggatcctccatgtgttcagctctctgaaccttgtcctcatggatttttaatggaagcttcatgactttaacattcctttccccagggtaagggtgggaccctctcatggcagggtcttaaactccacaaagagaaaggcaggagaacattagagtcctgcattggagcaggtgaaagaaaggcaggagtacattagagtcctgcattggagcaggtgaaagaaagacaggaagaaggtcagaggctatccctgaggcctaacgcacccaacattctaataaaagactgtaaccagggctatgggagttatgagtgaggagctagggacaaaatccaatatatataacaccacaataatacacacagttattaccaacataagacagaatatagacagaattgaggctaagcagttttagaaaaaaagaggacccaaaaatatacaaaataagaaatggcaaagagaaataactatgaatacagaggaaatttttaaatcatgaaaagactattttgtacacctttgtgcaaatatatttgaaaatctagatgaaatacaatatttcttagaaaaatacagtttaacaactttccatagaagaaaaagatagtacccatagtagataaattcttagagaatacagaatagaaaggaaaacatccaaattgtttgtatgaaaatgttataacattaataggtaaacctgataaagaaagcacagaaaaagaaactatagatgacaaccagttatgaataaaatagcaaagtcaaaatcttaaatgaaatatcagtatctcagcattatcacacattaggaaaacaatacaaatggccaagttggttttatatcagaaatgaaaggaaggttccaagttagggaatttatcaatatgatttaccatattaattgaccttctgggaaaatgtaggcttatctccatgaatgctgaaaaatatttcagtaacataaaatgcctgttattaataaacctctgcagaaaatatgaatggttgaatatatctaaaacatggttaaatacgtacaacatggttaaaaactaacagttgaggactgttagtacctgaacactaaacatcgtatttaatctgaaaacactaaagtcattcccactaaggccagggacagggaaaagatgagggcactgtgtccactactatataatattattctggaggtggtatccaaagcaattataaaataggtaacaattagaggcataagaattagaaaataaaaataataaaatgaatctctatttgcaaatgccatgatagacctttagataagaattatattgagatcaagatctattgcacagcatggggactataattaataacaacgtacagtcattcattatttcacgatgggcatatattctgagaaatgcatccttaggcgattttgtcattgtgcaaaaatcactgagcgtacttacacaaacctagatggtgtagcttgatacacacttaggcggtaaggtatagtctattgctcctaggctacaaaccagtacagtatgacaccatactgaatgctgtagggatttgcaacaccatgataagtgtttgtacatcttaacatagaaaaggtgcagttaaaaatatggtataaaagataaaaaatggtacacatatatagggcacttaccatgaatggggcttgcaggactggaagtcactgggtgactcagggagtgagtgaagagtaagcatgaaggcctaacacattactgtacactatgatagaattgatgcactatacacttagaatatactacatttattttttaaaaaatttttctttaataataaattaaccttagcttactgtaacttgtctactctattaagtgcctcaacttacagtggggttacatccagataaacccaatttaggttgaaaatatcataaattaaaaatgcattgaatacatctaacctcctgaacgtcatagctgagcccaacctactctggctgggctgtgctcagaactctaacagccgtcatttggacaaaaccactgggcaacacagtacactggacagtgtctattgttcactctcgtgatgctgtggctgactggcagctgcagctctctgccgctgtgcagcaccacaagacagcactgaaccatgtatcaccaacctgggaaaagatccaaattcaaaattccaagtatggtttcatgcgtattgccttcgcactttcttaaatttgaaaaatcgtaagtcaaaatatcctaagttgagggctgtttgtattcaaaatgaagaagagttaaattcaggaatgttaggttctaactcatatatagctagaaaagaatagcaaattaaacctaaagaaagtagaaagaggaaatatgatctatatttaagagcataaatccatgaaatagaatatacatgtataacaggaaaaagcaacaaacctaaaagttagttctttgaaaatattataaaattgccatactccaagcaaggataagagagataatataaattacacacatctgcaacgaaaaagaaacaaaacattaccatagagcctactgactttaaaaagagtaagaacacactagaaatcgctgtggaggtggcatgaggaaacattctgggataactgacatgtttaatattatggtctggaaaggagttcaaagggtgtatacatatgtaaaatattttcaaaccctagaattcaggcttgtacactttcctggatataagttagacctcaattattttaaaaagggaactaccttagatgatgagattccatattttcttatatcataattactgcagctgccatggtaacttactgggaaaccttttctgtttcttcttggcttcttgatattacagacgtactcagtctgctctgcccttcacaatttactgaacaacttcctgtaacctatacttgggtttgccccgaagcctgtgctaccttgagcagtcctttctaggttggccagcgtgacaagaatccttaagggatatgtattaaatatatagatcaccctgtcaattcttgttcagtaggtctcagttacagcaataatctttcttttttttttttttttgttctatcaagtttcagtgattcttatcttcagccaaatttggaagcagtgccctaggtggtatgattaattactgttatgattaattaccatctcctcacttgtcccacttcctcacctccctttctgactaggtctagcaggcatcctacttttgttttcaagactgaaagtttgaaaagaggtcagagaaaccatttaagataattttcaatgatagtcaaagctaaagggaaatcattttcttgaggaacttgtgtggtttttcaccttcaatggagtaagagccatgataggcagcagtagaagtctttgatgattttagttctaagaaagaaaactgatacaaacccacttagttggttcagcatattaccgagtatttattgtatccaattttctcaggtttgaagaccacaatgttaccaccattatacctacatctacacaatggtgttgtgtattagtatccagtcttgcagcatttgtgatgatgttctcaaaattttgtgtctgacattttttgtctccacatttttatgtagaaatgaaaagtggaaaaaaggggcaaacctaggtaaagatgagtcatgttggtatcgttttgtgaaggacatgatgtacaactcttccatttgacatttattaagcacatgctatgtacaaggcactgtgtaaggctatggtttcacagcagtaaataagaaaaacatataatcctgttcttactagacttcataataaaattcacagtctaggacagaagagatactttctttaagttaacatacttttcaatatcattgtggtaagttacattaaggagaagttcaaggtaaaatgacgagatgttaatggaggaaaataagcaagtttagaagtcagttaaggttctccatggaaatgatagttagctcatatatttttcctctgatttgtacttttcaatcaaataaatgaatagattacattttttcacaaaaggaaatttttgaaaaacagaggtttgcagttatatgctgtgatttgattctctcggagatatgtcaattaatgtacaaggacaactttcaaagccaaaatactttgagtgtcactgtgattctgctacaacaattgttagcaaagccagctcttttcttcctcctgttttgaaacaagtacccaactgcagttagcttctttgcagatagacaatagaaatagatatgaaaacttaaaaaaaagagaatgactatgtctaggtaggcgtatgtgtgatttttttttttcatttttattggctctgttcaagatacgtgactctagagaacatcagaaatagcatagttgatcagacagtaccatttctgtttctatgtgagcccagggaaataaattacattttttacctttccaactagttgcagtgcatctataaaagtatatgtctatcagtaatatccaggaagaaataaaatctcgtgagtattttctcatgtcctatggtcattgcgtccattttttcaggttgtgttggaggccatatatcacatccaagatctatgcatgtttttttaataactaataagactggtcaggattgtattttttaactaccacctccatcagaagaaacctatatccaaacacaattctttgggttaggggaaagaaatgtatgtcctttataccgaatttaatttccaaaggcaaaactccagcatgatttaggaagtggacatggacctggaagcttgtgatcattttcaggacaaggtcaagttcaaacttacacagctaccacctatcaacggcagaagaagaaagatgacctgaaaactccttttacatcctgtcagagaacagagtgcttcaagtgtatatatacccagactgttacattactgcattagcatagctgttaaatacattgattcaccaagtgaaggctgccatgtgttcctagcactgtgctaggaaatgtgaatacaattgagaataaaaacaaactcaagtttctgccatgacagaacttatattccgctcagagatgggcaataatacactaaaaaagaaatacatatattacaatcatgcagtgcttattatagaggaaacaaagacagttcagcaatagatgccattggtatggagggatcacatagaaagaaatgttaggtaaggtccttataggtggtggtatttaattaaatatttcaaaagtgaaaatatattccagccatgtaaataatgggaaaagtgtcacatccatttgccaagataatgagacaggacctccctgggtttgaggctcattgaggagattagtgtgtttgaagtgtagatgagagtggaagaagaagatgaagtggagaagtgcctggaaaccagatcatttagtgcctcttaattttatacaatttactgaaaataaactatagttgacctttgaacaacgtgagtttgaactactctgatccacttatacatggattttctttcacctctcccacccatgagactgcaaaaccatctccgcctcctccttctcctattatccctcttccccttccttgtgataatttttttttttaatactttaagttctagggtacatgttcacaacgtgcaggtttgttacatatgaatacatgcgccatgttggtgtgctgcacccattaactcctcatttacattagatatatctcctaatactattcccccaccccaggacaggccccggtgtgtgatgttccccttcctgtgtccaagtgttctcattgttcaattcccacctatgagtgagaacatgcggtgtttggttttttgtccttgtgatagtttgctgagaatgatggcttccagcttcatccatgtccctacaaaggacatgaatccatccttttttatggctgcatagtattccatggtgtatatgtgccacattttcttaatccagtctatcactgatggacatttgggttggttccaagtctttgctattgtgaatagtgccgccataaacatatgtgtacatgtgtctttatagcagcatgatttatagtcctttgggtatatacccagtaatgggatgactgggtcaaacggtatttctagttctcgatccttgaggaatcgccacactgtctttcacaatggttgaactagtttacagtcccaccaacagtgtaaaagtgttcctatttctccacatcctctccagcacctgttgtttcctgactttttaatgatcgccattctaagtggtgtgagatggtatctcattgtggttttgatttgcatttctctgattgccagtggtgatgagcattttttcatgtgtctgttggctgcataaatgtcttcttctgagaagtgtctgttcatatccttcgcccactttttgatggagttgtttgtttttttcttgtacatttgtttgagttttttgtagattctggatattagccctttgtcagatgagtagattgcaaaaattttctcccatcctgtaggttgcctgttcactctgatggtagtttctcttttatttatttatttattttttttgagatggagtctcgcttttttgcccaggctcgagtgcagtggcgcaatctcagctcactgcaacctccgcctcccaggttcacaccattctcctgcctcagcctcccgagcagctgggaccacaggctctcgctaccacacccagctaatccttgtgatagtttgcaggacaaggttacgttcaaatgttaacctcctcaccttgttcaatgtgaaaaccaggaggatgaagagtttacgatgatccacttccacttaatgaatagtaaatatattttctctgtcttatgattttcttgataacattttcttttctctaacttactttaagaatacagtatataatatatgtaacatacaaaatatgtgttaaccaatggtttatggtatcagtaaggcttgcagtcaatggtaggctattaatagttaagttcacaggggtcaaaaattatacatggattttcaactacacagggggtcaatgcccctaatccctgagttgtttaagggtcaactgtatataaaaccttcttaactgttggaaatatgtagaagataaagtaagaagaggttgtagaggtgtgagtttttttaaagctaagaaagataatactaggtttttcaattggttgtatcagttctattgaagaaggtacacgactaggatgatatggaatgagggagttactatagaagttagacctaatgcaatgatgagaactgatttaaaaagctctgcaaggttgttgcctttggggctggtgttgagcttaaactgagggagaggaaagacaaattggaacctctcactggctcctcattacctccaaccttgatgatgatgataacctgtcggacgggtgatgactgccacagagttgtgtgcatatctggcctagaactctgaaaaggcaaaggaagagacctgggaggagctggaggagctgagggtctgggtgcactctacaacaactaggtgagctggcatctcagcaacaatatccatggacggctcttgtgtctgacccttggagcatatcgacagctgctactccacttgcaccacccaaatctcccatacatgtcccttgatctaacctggaaccacagaagaaaaggaatttggggagtgtagctactataggtaagttgacacagaacaaaaccattgcatggaaggtaatgacaacaacgaaaactatgaaaaccacttatagtgacatggcttaatcttttggtgttggtagtttgggatgttgttatggtgagcgtgtgcattttgaggaatttgtattgataaaaaagagacatgattctcacatgatctttgttctctcctcttattttactggaagacaaattctcatatccatataaactttgctttgataatctgtgacactgttaataatctaaaattttgcttttataataactttattttgaaccacatacaaccccaagaaacagatgctaaaattaaaaatgtaaattgtggaagactatgtatacattcataattgcctgatattcaagaacacccagaaatatattctagaagattctcagagctggaggaatctatagacccaggggttttcaaatattgtttgtcattagagatcaaagaattcctttatgcagagcattaaaataaaggatgtgaaaaaggctaccaatagctttgactgaggcaggagtaagagattcagtagcacctgtcattttaccttctgtagtcactgaaagaattctaggaaataaaacagaacaccaacctaagaggcctcttgaggctggctctgtctcattctcttcctctttgaagaaagattccatgcgtctattgtagccccaagataaatgcaactacacagcacataaatgggaaattgaactttcattgaagactcttgagtaaagacagggaagaatgttaaccctgttgcccataccatgtggcaaaattgcattaaaatactcttctaaacatgttttttccaggttccttcagccatgcgcttctttccccatcaccaaggtaccacttcctgaaatttcctttttgtctgaataacaacaattacataactcagtgaaagaaatacatttagataatttaaactaccctcctaaataataaaaactctcatttacagagtgcttagtatgtttcaagaagtgtgcaaattgtgttacatgcattggcccttttttgtcccaaaacaactccagtagatagctactattatctcctgttttatagataaagaaactacggcaaagaaatgttaactaatttgtctaaagtcaatcaggtaataagtggtagaggcaggcaacaaatcccaggctgaggtcttcctaagaaagatagcaaggacgcagtattgttattcagtcagagctttgaaatacctcatgctccaccaactcaaaagtattcaccaaacaaaaccagttgcctcctgcgtggtggagaagaagattataatgcttcctgaagaaaatacaatattcattgtaatgttacagctgtttgaaaaccactagatcttctgatgctcacatttttgaaagccaaaacatttctccagcaagtcatcacaactatttgttgagctgagttataatatggcagattgcatattccaaagatattcacaaaaacatcccccgtcccacaagctactgctacactatgactttgacatgcctcccattaagagatagggtttatgctccctccactcaatctaggtgggcttttgactagggtgaatgtaaggctatatgtctttgaaggctagttcctacctggctctcttgggctattcactcttcaaagccagctactagtctgtgaagaaacccaagctagcccactcggaggtcatgtgtaggtgctctagccaagagtccagccaacagccaagttaacaaccagatacatgtatgtaaagacgcctccacatgagacttcctagccgagggcccctgacatcatggtgcagagacaagcaatacaggttctgccctgtccaaactcctgatccacagaatccatgagcacaacactatgagtgtttcatgccactgtgtttttgcatggcttgtcacatagcaatagtaactggaacttacagggaggaaaaaggttcaaagaagaagtgagctctcaaaggtcctagaacttatactcaagatgctctcaaaaatattcactgaatttgactgctgcatagcaacaaagccagtattacaatctcagcagcaccctgtctgctgcagcaccaagttttctccaattacgcttcgacgtaataaaaaataaaaaggagattttgctatcccagctattaaaatccatggtaaccaggactttaaatatatgtaatatatgctgctaaagttcttggaaatactttgttctcatgaataagtaaaatactcttccaaatatttaatttttactttcaaagtagtttcttgactttttgttcccactctagatgcctcctacattgatttctcactctctatgtattccctctcctccagtcaagaagttttgtccagctttactttctggcttatgtaagaaataggtgtagtaaataggctttcccaaacctggcatgcttctgggtgacagattctgcaatagttcctcatctccactggaatcacagttttgtggcaccacttcagaaatcatttttatactcgtaaaaaggtaaatactagcttgttccccacccaaattacaatgatattctaattacttggttccaaattcaccatccattattctctcccagattccctgcaatattcttctatttctgagcaaacatcaattgtgccaatgtcttaagtaccgtcaatctaaactgaaatggtgccagcttccttaatatcatcaccaaataccttattaattaattaatggtgctgtgaataataaagtactggtgttgttaaaccaggcaaaaagcagtaggtaggcaaaggcagcaactgttccagcttaccggaatatctgtcaactagctagaaggggaaggtgagcatttccactggacattaaaacaaaatcagcaggaaaataataataactcacaattgggagccactgtcctgatgaatgctttcgaggtaagatgctcttcaggttggtaaagtgggactttttcacataaagcccaaggtttccgcctactggtaatctaatgagagaagtgctggctcctcttgtgtttgttttaaagcacctttcagaattgggagtaaatgtaattcattggacaggccacacgatgaattggtttcacagtccactctgtcagctttatgatgctgaaagcaaagatggaacaagaagagtgagtattgaggacaaaatagagtgagtaataagagaacaacaaagctatcgctgttgaaaagagcttttactcaagagtattgaatagcacacttacctttttttcctcctccaatccaggtgaacagggctgagaagaccgtcattgtttcaaatgattgatgttatttcttacagtttgtcaccattaccacaagtatggtctggattactttgtttgctcagctgttcctggctctgctcatcttgcctcaaaccaagcaactgagaggggcatggatcatagggtccatcagctgcctgatggagccccacattcgggccttccccctcctctactcatcaatctccattgtcctggcaagaaggtaatgtctgcggcagtacatgccacccccaagctgtacaatacataatacgatcatgctttccaaaatggccagcttactgtgattggttaaatatccccctggttcatgtaaagcatgaagtgaaggaggatgaggggaagttgctgacattttttagtatctgctttgtgaaaggcactgtgctaatttttttcacatatattaccatactatttagccttatgataattctgtggagtaggtatcatttttttcccgttttacagataaagaaactgaggttcagaaataatacacaattcgccaaaggctaatcagttcctagtgtcggagtacagaaaatgattccccaaaatgtggcactggggcatgctgagtgcttctgtaaattgaaagggctcagaaataagcctcagaatcagggttcccctaaccttgtcttgtccccccaccccaccgagtgcagctgcattttgagttaaccctgtaggatgagctttcagagttttacgcctttttgttgtgcagagcaagcacatgattcatcagtttttgttttttatctttagcatgcttgtttttctttttctgtatgtggtgctgtggcttgttgttagacatctgggcagaagagttgagctaatgttgtaagtaaaacacttaaattaaaacttcaaatatctcctcaacttataattaaatgtaccatatggttctattttacggaaagctggggcctaatttaatgttttcctttttcagcaacaaattttactggcttgttctcaatcatttttatgtcacaaaaacaattactaccaaggcaatattttgagattattagacagaaacaacctcttacctggggataaaaatattgtttctggtgtgcctgtatcattatttaagctcatctgggaataaaaaattgttgcttggcttaacatttgttgtgtcagtgtaacaaaggttcacacttttctccatgtttcgtcattttactttctgtttaatttgaacgcaatctgagacaaaatgctgatttttgcacattttaacagatacggttgagcatcatttggggtgttctaaaaatgtccagtaagcaagttacaaatataagaccaactttcatcacctgaaaaagttcatatcttcttgtcaactttactaaaagaggaaagtgggaggtggagactgttaattaatatttaaagagaacagccttttaaagaggcaattccaattttctgtccaccttgcttctgcaggcacattcaatgactccactccttaactctttttaacaagctacttgtttttttatttgaaaggtaagtcatagtttgtaatcttccccaccaaatatattctgtgcaaaattgttcctccagacattattagtcaccagctacataggcatctgttaatatgcttcattgcctaaacgcaacacttaattcattttcatttttaaagtgacacaatctctgcccttcaaggaacacacgatctaaagcaaacactttcaagggtgtaataaccctgaaagtgagaatgtgaatgactgtattatcagctccaacaagaagtcattgtgcacagaaaaggatttatttaaaggagatacttgaatgaattaataaaaactaggatgtaaagtgcttaatttctttaccatatagtcacattttagaatcccatgcagatctgtgaaaaaaaatgaggtagaccaaaacccaagtactgacatgggatcatcaccaaaacaaattaaatttaaaatggcaagttatattaacccaacaaatatttcaggattgctttagtatgtttcaaacactcctctcacttctggttatagcagaatccacaaagtccccgctctcatgcattctgatataatcccaatttacatttttaaaaaataataaagtgatctatgtacagacacataaatctatgtaactgagtagaaagaggcctcgaaggatgcacaccacgtagctgagtgtttgcttctggagagtaaagtaggagcaagaaggtagtgaagggaggcattttgtatgtggagaacaatttgaacaagagttgaaagaaaaagtcactgctagcatcttatcacagtttacaaggaatatgtcctgagactgctcacaatccccgaatttgccaacacagttaattttcccttgaatcatggatccgtggagagtcacatgagcgacccacagtgtgtaaaatcatatccctagtttgatgttatttcattttcattgttttatatatcggttactggactttaagaaaaacaaaatgaacaagaaagactgtcaccttgaaagagtgacaatccaggcgtgagaaaggcaactggcaaagctaagcagagatgcagttgtttggctgttagtttgtttcactgctgaataaataactggcttcacacatcagtcttgtaaggagtgataagaataattcagatttgtagctcaacaaaatgacaaattactatatatcagggctcaccgtgggatagtgaaaatataaatgttggagctgccaagtcacatatccagccttaaaaattaaaaaaaaaaaaatgaaggcagatggtgtctggaaagtgcatcaattctgactctgatgggcttctgaaagactcttgcagggcctggcaagagggtggaagtgtgcaggtgcaaccaataaatagcccagtacaaaagtaagttgacaaatgaaaacccatgccaatcacatagatgatattgctagactctgccacgtgtgaaaacaccttcatgtccgcattggaagagaaaacctctggacttctggcttatgattgaattcccttttgaccttttgttttggaataattggggagaagcatagggtaaaatatcaggtggcaatggtaagcttcctctgggcctaattaatacagaactctttccagcaggggcgtggtctgtatctggaactagctgccttgatgtatgcagtggaattgtctctttataggtaggcaggtttgtctcaggaccctggtagaaagttatctgtctgttttacgaggcccacccaggaaacggagctctgtaattggtaagtgaagttactctgtacataaggagggctttacataaatacaccaaatataacatgatcctagttgtcttttcccaaaacaaagatatttgaactgttgcctaaaactcaaagttactattttgccaccttactaaattgcctttacaggggtcaaaaacttctatatactcccatccatcaactattatcataggcacatttaattttttttttttttgagatggggtctcgctctgttgtccaggctggagtgcagtggcacaatcttggctcacggcaacctccacctcccgggttcaagcgactcccctgcctcaacctcctgagtagctgggattacaggcacctgccaccacacccggctaattttttgtatttttagtagagacagagttccactgtattagccaggatggtctcaatctcctgacctcgtgatctgcccacctcggcctcccaaagtgctgctgccgcgccaggccacgtttacattttttgataatttttgagagactgttttttgggctgttagataaaactaacaccatttttaaaaaactgtttttataatagttgctcacatacagtatacagacaattggaagattaaaaggaaagcatttaaaagttacttgagaatgttgaaaaatagcagtaagtggcagtttaaatacttgttaagtgcagtgtcaaaattgattggggctttatggaaggaatgccaaattttaaaacattatttaattcttcatgtagtcctctcagttgttcttcactgttccaagaatacaagtaaattatttaccagtaacatgttgtcagacatgcaggtgtctcctaatattttttattcacattatcagctccagcaatttaatgagcttcctgccagccacacataagtagatgagataagagaactggaagatctcgtatgtgtgttgcttatatcagaaatgcagatgcatgggtgcacgatcaaaatagactagcaaaccacagcagtgcatcattgtaacagcctggaatactccattaaaacacctcttggtggctcgatttgccttcttgttctagatcagatttcaggtcatttatacacaaacacccatcatagagcccactctattagccacaggaaacattattcactttacacattttcttgtaactaatacttttcccacaaaaatctccacagtaatttttcaaatggtttgaatcttttttattcttgttgttttggtagagaaaaagctttataacctgtgaaaaatgacaagttgaataaattattaaaaggcccttaacatttgatggtgtaagaccccaagaaaagatatccctttaatattatgatgtaaactatcaggaccatactacttgtaagaaaatgacagtaaatccttttgaatatttatttctaagatttacagagtattaatagggtatttcatttcatttgttttaaaaaaaaatcagaacattaagcgatagcatttcctcttcaactatactaaattgtctcgacagcaatgataatattattgctcttaatgtaaagaagaattgtaaatcacttcatctttgtatttatacaagataatatcactattaatgagcaaagtgactcagaaaatgaaacccattacattcctttgatttgactaggttactgaaagtagcaataaatatttgttacaaacaaaaaacagattgtctttgttaaaaatttctcatgaagtagtagggaattaaactaaataccttcattttgaatcaagctgagaaatcagacaatttccttaaaatttagagctcctgctaaaatgagaatatttactttgggcatccactgattaaaattgccagggcatcctttacagcttatatttccgttttcccataaagtagatagaagtatacaaaataaagtaaaactaatgtatcacagcccaagacaactgacctatgtaaaatgattttctttttccacaacatcttctgattgaatttatctttttctctcattcttgctgtcatcttactgaatttaatcagtggaaaataatttgtcaagggaagtttatgcataattatgtttaagcatgagatacttttcttaaaagacacacaaagattatttaataatatatttccatacttaaaatgaatgaacatgttcaaagattgggcttgttgtgcaataacatttcaggagtatttttaatggcatttttttccaataagcaaacatgtatctaaccatgtgataaaaatgggcggaagggaggaatagccacaaagatgaggaagacccagcattggacccaacataaagaatgtttttaaaatgagataattctaagaagaatcacaatggctgcaaagtcaattattctaatcaaatcacatttcaaaatgtaaattcaatttcctataagccccatgtatgcttaacaatttgtgaagcaccctgctatttctatagcttgttagctgactttcttgaaatgaagactttgtcagaagaacatctgtgctctttattctcatctatgtttctcatgaactgtggagtaaaagtattaatacagcgacggtgctgatcgattgattcaacacacatttagtgagcacctactgtgttccaggaacatgatgttcagtttcaattaagtcctttgcaacttggaatccctctatcactaattaactgtttgaaattaaaaatacatcagcacacacaggctatcctgttgttgctagctttattctcttcaaattaatgaacatttgaatatagctagatttcactgaaataataaattctcgttcttgtgctattgcaaattatatcttttgataaagcaaccttgcggagcagggatgtgaatgacattaagttgaggaatgcatctgtttgcagtgggagaatcaagaatatttgaataaattattgatatgttttctgatcaaatagttgtgatgattacatcaggcatttggaattattccaatgctgctgtcttacaaacttcagtgtatccagacctacctactacccaatattttcccttaatatactataatgtgtctgttcctctatttcagaagctatgttttgtcccagtgtgaatatcatctaaggatcaactttattaatctagccctttttcattttaacagcttaattaaatcatcataaaacgtactgttttcctgtgaggataaagatccatttccttagcctttctcttcaacatagtaaatctctgaaaaagccaccttcttggcatttcctaaactgcactttttccaaatctattttcgtttccttgaggaattccataatgacccatccaatacttcctgtgggtgaggtcaaattgtgaacagcacagcttcctagatttattaccttttctgctagaaacaaaccaagaaccctcctttctttattcagtgccatctcatattgctttttcactttgcaaatttgtcacagtctggttgtaggttaccttttcttttttttttttttaacttttggttatacacacgtcttgctctaagcttgtttacactgtgttataaatatacttcttatatctttttccagtaaccaagtgatacaagttcctggttcccttgaagtcatttttctcactaagaaaaaagaatgacctgagcaaaattagatgacagcataggatagcagagtgttagtgtcatttctgaaggaatgacagggtagtgtgtttgtttatctgtttctggactctgtatttcttaaattttatttacataaacctaattattgagttcagttaaaaataaacagcaacaacaaaaactaaaatcagtaatctcaggggaaaaatgggatgaagcattagttaagttatatgtaactacgataaaatattttttgtcctatattcatagactttttatttagtctagaaaaatgcaaaccaaacaaaattcaatgatgaaaacactctagatgttcactgttcaatgccatgacccctccccagatgtggctattgagcactcgaagtgtggctagtgggactgacgcactcagtttgtggtttcgtttttttttttgtttttttgttttaagacagggtcttgctctgtcacccaggctggagtgcagtggcacaatcatggctcactgaagctttgacaccccaggctcaagccaacccccaactcagtctcctgagtagctgggactaaaggcatctaccaccacacctggctaatttttaattttttttttctttgtagagacagaattttgccatattgcccaggctggtctcaaattcctgggctcaaagtgctaggattacaggcatgagccactgcacccagcctcatttgattttaattaatttaaatttaaatagcaacatgtggccagtgtctactatattggacaacacaagtctaaaatataaatataaagggtaattctgaagggatttattaactaaattatagttttgaggaaaattatggcttgtcttacaaaggagcattattttaataattatttaatgtaatcacaatagtccctttattgtaaacattcctgtttcttttaaaaaatgaatgtttaaacatctgtaatatcagagctggattatatcatcaaattctcacaggaaccctctaagttaagtattcctttaaacttatattacagctaaggtaacaaaagcttagaaaagtaattttcctgaagtcacacagctataatacggtagtacctgtttagaatccatatatttctgattccaagttacaagatcttaacaagtctaacacacatttttaactgcctgctatgtcccagacattgctttgtagaccatcaacagaatagaaataatatcaaaaaaatgtttttattgacactaaggtgaggtaacatgtaaatagtagctactgctcttttctaataagatgatccataggtctagacataaagaaacacataaactcagtaaatatacacatatactcaaagtctgaaaacatgagcattttttaggacttaacttgttaaaatgctttttagttcaaaacacttaaactttctcaatttaaaaagattatgaaacatctttcaagtgcacgtatgacttggcaagaatgtagggacagtttcttgacgctcaaaaagacaaaagcacacaacagcagtggctggtaagcatcaggagggacaactgtgctagtaacatatgacaatccatagtgatccagtgctgtgctacgaaaagtgtggtctgcagaatagcagcagtacatcaactggcagcttgttagaaattaaaacatacacacacacacacacacacacacacacacacaatgaaaacttagaccctactagatacctatggaatcagaatctgcatttgaacaggatccccaggggagttgatgggaagaatattttgcagtgtatctacccttttgggatgactgcttttaaaatgcctccaaagtgggcactagagtcaaactccagggtctatgcaaggttcaaagtggggtctagaattggagctcaaaattagtaacccagaaaggcaaggcccgctgtgaaagggtgaaccaaccaaagcccaccattaataaatacatgctaggaaaacttgcttatcctagtttagggacagctctgggaggatggggagtctttcctgaaatttcacaaacaaaggaaagacctgatgagttttaggctaagaattcatatcatcccacgtggcctcaaaatcctaagcagaataattcaggctaatgtggtgataggttgttagtgcctaaaggaaactgatacaatggagcaacatactttaaaaaaaaaggcctcaaacatttcccatacatatgattcattgactatgaattcacaacttaaaaaactaagaaaagaaagaaagaaaaacaccagccacaccagcaagaatcagcagaaacagcaaacatcagaattagacctactaagactacaggcattgaatttttagctatacagacaataatttttagaaaaaatacataattaaaattaaaatgtcagttacaatagcaacaccaccaacaagaaaacaaggtatccaggctacaaatatattttgttttaattcccagcaacttaaaggagaaacttattttttaaactttctttaaatacattaaaaagacacatgattccaaaatggaagcacagaagaaagctacctttactccccctctcccaccagaaaaccagaaccaaatatacaacactgaatttatcaccagcaataccccagaactcacatataaagatgagacagttcctagggccatagattaagtgaaaaaactctgggcagagagaattggacttctgtttctgtgacacccctccctgcaacatgtctggccccaagcatgttgaaactcacagtttcaacactggaaaaagtcggattaaggtagacaaccagcttccccaccatcttaagttccttagcaggagacctattccggcgtgaacccacaggaagcactgggggtaccagaagggagaaacatcaaggacagccaacgacagaagggggaagcaggactaccattcccatcactggaaattctgtcctgtaactatgccaaaaagatgccacatcacagtgactattcagctgcgctatcctgtaggaggtttgttccacaggccttctggtcatgaatccctaaccagtcttcccacactactgggatgtcccctttgggatctccttgcttctggactagtggtactctgattactagaaccaaggcaaacttgagcttaaggtatcatttagctctgaaaaggaggtagtgacctagcaggaaaaaaaataaagaaagaaggaagaaaaagagggggatgggtgagaagaagaagaaaggaagaagaagaagaaagaagaagaaggaggaggaggagggagaggaggagggaggggggatgggtgagaagaagaagaaggaggaggaggaggagggagaggaggagggagagaaagaaagagagaaagaaagagaccaaagagagaaagaaaaagaaagaagaaagaaaagaaaaagaaagagaaagaaagaaaaagagagaaagaaagaaagagaaagaaagggaaaggaaggaaggggagggagagagggaaagaaaatcaacaggtaaattacaaagaatttctaagcaaacatatccagtaaaaaccaaaacaagccacacagagaagactggaataaataatagacataagtccacaagaaacaacagcaaacagggaactgtgacctctgcaaacagaaaaaggcaaggaaccagtgatgaaactctaatgagacagcagtatgtgaactctgaccaataattcaaaatagtagttttagggaaattcagtgatctccaagagggaaacacagaaaagcttttcagaaatgtaccagataaatttaatagattgaaataatttttaaaaatcagacagataccttggcacaggctgggaatggtggctcctgcctataatcccagcacttttggaggccaaggcagcaggattacttgagcccaggagttcaagaccagtctgagcagtatggtgagactctgtctctacaaaaaaataacaaaaaaatggccggacatggtggtatgtggttgtagtcccaggtacttgggtggctgaggtgggaagatctcttgagcctggatgattgaggctgcagtgagctgtgatggtactactgcagttcaagctgggttacagagtgacaccccgtctcaaatttaaaaaaagaatgaaagaataaaaaaataaatcttggcattgagaaatacatttgctgaactgaaaaatccattagaggctcccaacatcaaaatgaatcaagcagagaaaataataaatgagcttgaatacagtttatttgaaaacgcacagtcaggccaggtgcagtggctcatgcctgtaatcccaacactttgggagactaagcaggcagatcacttgagcccaagagttccagaccagcctgggcaacatggtgaagccccattactaccaaaaaatactaaaattagctgggtgtggtggcatgcacctgtagtcccagctacttgggatgctgaggtgagagaatcacctgagcctgggaaagcaagggtgcagtgagccatgatcctgacactgtactccaacctaagtgacagagtgaggccctatgaaacaaacaaaaaacaaaagcaaacaaacaaacaaaaaacaagaaagaaagaatatgcacaatcggagcagaaaaaatgaaaaaaaataaaaagaatgaagattgcctacaaggtaaagaaaattacttaaaaataccaaatctaagaattattggtgttcaagaggaatttgagcaagagcaaagggtagaaagattattcaaagaaataataacagaaaacttttcaaaacttgagaaaaaaaaaaaagaaatactgagataacagaaggtcagagaacaccaaataaactgaataggaaggaatacttccaaactcactcctatgaggctcgcattaccctgataccacaaccagacaaagacacaacagaaaaagaaaactacaggttaatgaacataactgatgatcacagatgcaaagatcatcaacaaaataataacaaaccaaattcaacaacacattaaaaagttcattcaccatgactgagtgggattaatcccagggatgcaaggatgctccaacatgtacaaatgttagaaggtgatatatatcacattaacaaacccaagaacaaaaacgatatgatcttttcaataggtgctaaaaaagcatttgataaaattcaaatcctgttatgataaaaaccctcaagaaattgggtatagaagaaacatacctcaaaataataaagaccacatatgacaaacccaaagctaacgtcgtaataaatggtgagaaatggagagcctttcttctaagatctggaacaagaaaaggatacctactttcaccactttattcaacataatattggaagcactggcaaaagctattagacgaaagaaataaaaggcatcaaattggaaaggaagaagtcaaattagcatagtttgccaatgacatgatcttgtacttagaaaaaactaaaaatttcaccaaaaaactattagaactaataaacaaacaaagttgcaggataaaaaaatcaacatacaaaatcagtagcatgatatatgccaacagcaaacagtctgaaaaataaatcaatacagcatcatttacaatagctaaaaacatatgaaacactgataaaacaatttaataaaagaagtaaaagaaagagggacctgactatttaaagaaaaacaaacaaacctaaagcaacaacaagagcatcaacaaaaaagtccccaccaaaacctcatccaagggccagcagcctcaaagatcgaaactagacaaactcttgaagatgataaagaatcaataaaaaaaatgctgagacctcaaaaggccagagtgcctcttttcctccaaatgatcacaacacctctccagcaagtgcacagaactggaaggaggatgagatggacgaattgacagaagtaggcttcagacggtgggtagtaataaacttaatacacttggctgaggtaaaggaccacgtcctaactcaatgcaaagatgctaagaaccatgataaaagtttacaggagctgctaactagaataaccagtttagagaggaacataaataacctgatggagctgaaaaacacagcacaactatcagtaactgaaataatcaagtggaagaaagaatatcagagcttgaagactatcttgctgaaataaggcaggcagaaaagactggagaaagaataataaaaaggaatgaataaaacctctgagaactatgggactatgtaaaaagactgaacctatgactgattggagtacctgaaagagatggggctaatggaaccaagttggaaaacacacttcaggatatcatccaggagaacttccctaacctaacaagacaggccaacatgcaaattcaggaaatacagagaactccagtaaaagatactccacaagaagatcaactccaagtcacataatcatcagattctccaagatcgaaatgaaggaaaaaactaagggcagccagagagaaaggccaggtcacctacaaagggaggtccatcagactaacaacgaacctctcagcaaaaaccctacaagccagaagagagtggtggccaatattcagtattcctaaaaagaagaattttcaatccagaatttcatatccaggaaaactaaacttcataagcaaaggagaaataaaatccttttcagacaacaaaatgctgaaggaattcatcaccaccagacctgccttgcaagagctcctgaaggaagtcttaaatatagaaaggaaaaaccagtagcagccactacaaaagcacactgaaatacaaaggccaatgacactgtgaagaaacaactactatgcaaattaactggctaatgtcatgatgacaagatcaaattgacacataacaatatttaccttaaatgtaaatgggctaaatgctgcaattaaaagacacagactgataaattggataaacagtcaagacccattggtgttctatattaaagagactcatctcatgtacaaagacacataggctcaaaataaagggatggaagaaaatttaccaagcaaatggaaagcagaaaaaagcaggagtttcaatcctagtttctgacaaaacagattttaaaccaacaaagatcaaaaaagacaaagaagggcattacataatggtaaagggatcaatgaaacttagaagagctaactatcctaaatatatatgcacccaatacaggagaacccagattcataaagcaagttcttagagacctacaaagagacttagactcccacacagtaatagtgggagactttaacactccactgtcaatattagacagataatcatccctttatgttaaaaactctcaataaacaaattattgacagaacatatctcaaaacaatcagatctctttatgacaaactcacagccaatatcatactgaatgggcaaaagctggaagcattccctctgaaaaccggcgcaagacaaggatgccctctcttaccacttctattcaacttagtattggaagttctggccagggaaattaggcaagagaaagaaataaaggtattcacataggaagagaggaagtcaaattgcctctgtttgcagacgacatgatcctatatctagaaaaccccatcatctcagcccaaaagctccttaagctgataagcaacttcagcagtctcaggacacaaaatcaatgtgcaaaaatcacaagcattcctatacactaataatagacaagcagagagtcaaataataaatgaacttccattcacaactgctacaaggagaataaaatacctaggaatacagctcacaagagaggtgaaggacctcttcaaggagaactactaaccactgctcaaggaaataagagatgacacaaacaaatggaaaaacattccatccttgtggataggaagaatcaatatcatgaaaatggccatactgcccaaagtaatttataaaatttgtagattcaatgctattcccatcaaactaccattgacattcttcaccaaattagaaaaaaaaagctactttaaaattcatatggaacaacaacaaaaaaagcccatatagccaagacaattctaaccaaaagaacaaagctggagtcatgctacctgacttcaaagtatactgcaaggctacagtaaccaaaacagcatggtactggtacaaaaacagacacatagaccaatggaacagactagagatctcaaaaataagaccacacatctacaaccatctgatcttcaataaacccgacaaggacaagcaatgaagaaaggacttcctatttaataaatggtgctgggaaaactgggctagccatatgcagaaaactgaaactggacccccttccttacaccttacacaaaaattaactcaagatggattaaacacttaaatctaaaaccccaaactatgaaacccctagaagaaaatttcggcaataacattcaggaaataggcatgggcaaagattttatgatgaaatcaccaaaagcaattgcaacacaagctaaagttgtctaatgaaatctaattaaactaaagagcttctgcatagcaaaagaaactatcattgctgtgaacagacaacctacagaatgggagaaaacttttgcaatctacccatctgacaaaggtctaatatccagagtctacaaggaacttaaataaatttacaagaaaaaaaacaaacaacaaatccatcaaaagtgggcaaaggacacgaacagaaacttctcaagagaaaacatgtatgcggccaaacaaacatgaaaaaaaagcttaccatcaccaagcattggagaaatgcaaatcaaaaccacaatgaaatactatctcatgccagtcaggatgtcaattattaaaaagtcaagaaacaaaagatgctggcgaggctgtggtaaaattggaatgcttttagactgttgttgggaatgcgaattagttcaaccactgtgaaagacagtgtggcagttcctcaaggatccagaaccagaaataccatttgacccagcaatccctttgctggatatgtatccaaaggaatgtaaatcattctattgtaaagatacatgcacacatatgttcattgcagcactatccacaatagcaaagacatggaataaacccaaatgcccatcaatgatagactggataaagaaaatgtagtacatataccctatggaatagtatgcagccataaaaagaaacgaaatcatgacctttccagagacatgggtgaagctggaagccatcatcctcaacaaactaacacaggaagaggaaaccaaacaccgcatgttctcactcataagtgggagctgaacaatgagaacacatggaaacagggaggaaaacaacacaaaccagggcctgttggtgggtgggggagggagagcatcagaacaagtagttaattcatgtggagcctaatacctaggtgatgggttgataggtgcagcaaaccaccatggcacatgtttacttatgtaacaaacctgcacattctgcacatgtatcccagaatctaaaataaaataaaatttaaaaaaataaaaataggccaggtggggtggctcacgcttgtaatcccagcactttgggaggctgaggtaggtggatcatgaggtcaggagttcgaaaccagcctggccaacacagtgaaaccccgtctctattaaaaatacaaaaattagctgggtatgatggcaggtgcctgtaatgccagctactagggaggctgaggcaggagaatcacttgaacctgagaggcagaggttgcagtgagccaaaattgcaccactgcactccagccagggtgacagagctagactccatctcgaaaataaaataaaataaaattgaaattaaaaaagaagtaaaatatctctacaggaaaactataaaacactgttgaaagcaatctagggggacacaaaaaaatggaaaaatattccatgtggattgaaagaattaatattgttaaaatgacaattctacccaaagtaatttacaaattcaatgcaattcctatcgaaataccaatgagattcttcacagaaatagaaaaaataaattcaaaaatttatttgaaacgtcaaaagacccataatagccaaggaaatcctaagaaaaaagaacaaagctggaggcattatactacctgacttcctgatttcacaatatgctacaacgctacagtaaccaaatcggcatggtactggaaagaaaaaagagaagaaaagaaaacttaagagagagagaaagaaagaaaagaaggaagggagagacggagggagggagggtgacagagaggaaggaaagaaggaaggaaggaaggaaggaaggaaggaaggaaggaaggaaggaaggaaggaaggaagcagagacatagaccatggaacataataggaaacccacatatcaatccacacatatacagccaaatcattttagaccaaggctccaagaatatataatggagaaaagacagtcacttcaataaatagcattgggtaaactggctatccatatgtggaagaatggaactagagatctagacccctatctctcaccatacacaaaaaatcaaatcaaaatggattaaagacttaaatataggacctgaaactatgagactattacaacaaagtttggggaaattctcaaggacactgatctaggcaaagattctttgagtaagacctcaaaagcacagtcaaccaaaagcaaaaatggacaaatggtattgtgtcaagctaaaaagctcctgtacaacaaagaaacaattaacaaaatgaagagacaacccaaagaatgggggaaaataccacaaactattcatccaaaaagggattaataatcagaatacataaaaagctcagacaactctatagcaaataataataataatctgatttttaaatgggcaaaagagttaattaaacatttctcagaagacatacgaatggccaacagatatatgaaaaggtgctcaatatcactaatgatcatcagggaaatgcaaattaaaaccacaatgagataccatctcaccccagttaaaatggcttttatcaaaaataccagcaataatggatactggcaaggatatggagaaaggggaacacttgtaccctgttggtgggaatgtaaattagtacagccactatggaaaagtgtatggaggttctctaagaaactacaaataaaactactgtatgatccagcaattccacttctaggtgtaatatccaaaagaaaagaagtcaatacctctcagaaatatttgcacccccatgtttactgcagcactattcacaatagccaaaatatgaaatcaacctaagtgttcatcaatggatgaataaagacaatttggaatatatacacaacaaaacgttattcggccataaaaaagaatgaaatcctgtcattttcagcaacatgggtggaactgcaagtcataatgtcaagaaaaataagccaggcacacaaagacaaatatcacatgttctcattcatacataggagctaaaaaagtggatcttaagaagatgaagagtagatggtggatactagaggcagggaagtagggagacaaatagagattgattaatggatacaaatatacagttgatagaaaaaataagacagtggtcaatagatcagcaggggacaatagtttacaataatctattgtgtatttctaaatagctagaggaaaataatttaaataattttagcataaagaaaagacaaattaaataatggatatcccaattacactgatttgatctttaaaaattatataaatatattaaatcatcacatgtaaccccaaaatatgtacatctattatgcatcaataaacaggaaaattaaacaaaaaaagaagacctaaataaaaattgagaataatgtctttagtaatcctgatattcaatatctttaaattaaattctatatcaaggtaacagcagttaaaatcaagatgaatttttaatgaaaaatttgataaagttatgtgaagcagtaaagagccaaaaataactgagacaattttgaagcaagcatacacggtgaagagacttgcccaataaaatcaagatttattataaagctataatcaattaaagatgcatggtattcatgcaaggaaatacaaattaaccaactgagcaaactaaacactccagaagtagatcaacgcatatctggaaactttgcaatgacagaaataacgtggcatatcaaggggtaatgatggtactgagaacaaaaaggggagtaggggagaagggggattgaattcccacttcaaccatatgcaaaaccaatctcagataatgtacatctcttagatttaaaaggccaactataaaagcctcagagcaaaacatgaagaaaatcttgatgagcttggtccagggaaagattatctgagtgatgcaaaaagcagtaaagattaagaataaatttgaaactattttacttcattaaaacacatcatacctctttaaaacagaaacacaccataagtgtaacaactgggaaaagatcgaacaactgggaaacacatcgaagacacagaggattggtatccagaatacataaagaactcctacaagtcagtaagaaaaacacaacccgataggaaaacaggcaaatgccaccagcaagcagaagacacagagagggatacacatgaatgataagtgagcagaggaaagcattcccagtctcactcataattatggagatgcaaatcaagcccacagtgagaaatcactttgtatgaattatgctggcagaggtgaagaagcttgacaatagaaagtgtgggcaaggatattaatcagtagcaactctattgctggagagagagtaaattggcagaatcatattttaaaacaatttggtcttattatgatatagaacattgacattccttccagcaatttcactcattgatctatcctgaagaggaatttgcgctcatgtgcaccaggagactattcataccatgaggcatttcattagagattattacagggattatgagaagaattcatcgcatcattaggtgaaaaaaggcaccaaaggttttgtcttggatgacaatctctaagaatgcaaatattttgtggtacatttaagtaaagcagtgactgggaaaatattctagtctattatttgcacagataagggacatctttatttgctctcccccataggaccctatatcctcatactggataaacagaaagctaaactttctggagttgtcagcttagtacctttgcaattcaacttttacatttaaaaaaatacaacattatgttaaaagaaattatcccataaaatgtacatgtgaaggagagagagtgagttaagatattgggggaaaagtgaaaattttaagtttcatgatattcacagtggctccagagatctcggagcagccagtgaacaacccaactaagtttaattttagcttcttgagggcataataacgcttattatctcgaagaagagatgaggaaagaggagagaggatgggacagtgtctgctagaggtattgcttgaagtgaggagaagtggggaagtaagtagcagcattatgcatcattcccaaaccacgtgaaagcaatggagccaggtgaccagggctttttttttccctgcctctgaccttattttacaaaagaaaacaggcccagcacagtggctcacacctgtaatcccagcattttgggaggccaaggcaggcagatggcttcagcccgggagtttgagaccagcctgggcaacatggctaaacccagtttccacaaaaactacaaaagtcaaccaggcatggtagtgtctgcctgtagtcccagctactggggaggctgaggtgggaggatcacttgagtgtgggaggtcaaggctgcagtgagctatgatcataccactgcactccagcccgggcaacaggaagagcatgtctcaaaaaaaagaaaaaagaaaatactctgtgatgttgagaagcttgaaatctacagtttcacaagactacatcttcttaaaaagagatggggacgtccccttattaattaaacatattgtgatctaactagtctccaaatataacttaataaacttgaaagtaaaaatatgtgtagcaaagtgtatacgtattagagatcataaaattatgcatgagaataatacaatttttaaggtagtggttacctctgaagtttttggaaaagcgggtgctagaactctaacttctaggttacgtgcatacatgcctgggaaggaaggaagacaggaagggatgaagggaggaagggaggaaggagaggatgatatcagatggagaaagaaacagaaatgatgagatgtctactgataagaaaagtaaagttcaggtgaaggctgagagatattttatagtgacctgactcttagtaatcgtaactgctttataatccagttatgtgtcttggtttcctaacaattaacagcaaagaaccccttcagtgggtttttacaaccaatgtaataaaatgattaataaaagacagttccacctagaaaactgaacggtataaacatttatccatctcctctctaaaattccctcagtatcattccctgctccctaaatattccaacagtatttgcttatattttagtacaaaagagtttgttgcctttatcaactcagtaatttcatgtgtcccattctttaaggcataatgaaataactacattggacacattgagaaaaagttttgcattgtcgtatgaatatatcagcattttgcaatattagtatccaaaatgattgaaaatagtttgcttaaaaatgtaactttttaaattggagattctcctcctttaaatataagtatacttgcaattaatatatcttctccatattttttaactttgaggataaccaaatagtttaaatgtagtaattggatattccttgaccttcgtacattgacgtacccctccacatccggattcttctctcttcttttactctccaggtgctccacatgatgcaaggcctggtccaagtccccacacccacctcagactgaaataacctttttgtgatcagaaggctaattagtatgtattacaactattacacatttggtcttaggcatgtgctgcatagagataccctttctgctgtcatcttcaactactatataattctggtgggttttaattttagtgttcatatctcatcttcctcaatacacatgattctgaaatgcatagtcttcttaattggctctgaactggaaaaaagttatgtctttctctcagttccttaggtaaatgatgtataattccattggctttcacttttacactattaagcagttcttattagtaacctactaaatatattaagtgtaactaagattttgtattcataaaccaaaattggtatattgttggacttatcgaagactctaattcaacattcttttaaaaacattgactgccacgtggcagttggcaatattttcaacaagtatgagaatttcaatgattctagagaaagctttgttattatgttattaatgttgtcttaagtaaatgttttttctgctactttaaattattcattatatatcattataaatacatcactacctatttagatttttatgactttaaaattaattaatctcacaaaaagttgtgttatgtatttctattaacaggactttaattactcacacctctaaattattcatactcagtttctggaacaagtgtacacgtaatgccatctccttttccaaatttttttgggatggagacactgatcgtatatcctgtgaatgtgtactgttctaatatcttccaatatactgtcaaagtgagcataatgaaaatattgggctatgtataatttttaggcctaatttatatataaaacatgcatgtaagcacacttgcttttctcatcaagatataaaaaagattcctatatatttatagcaacaaatgtacaacaatttgttcttcttcaatactccactgcccataggcctatttttcactagaaagcacgaaagatcttctgttctaaggtggaaatgactgaaaaagttcgaaagccctgtataccaaactaccagaagtgactatactttaggtcagggactaagcataatttgctttccctataatatcgaaaaacataccctggatctcattaggttctccatggaatggtgttggagattcagtttgatcccacacattgaaacagcacctgtccatgtattatttctattaataaatgaattctagtttgaaagactgagaatcaagtaaagtttttttacagttacaaatgcacttttatggtaaaactaaattttgatagacatttttggttaggtgagatatggcaaataaatgtagcagtttaattttctccatagaaatgagaagtaacaattgtttcagtcatctttatttgcaccgttaagattatttatatattctaaatttatactatatgtatatcctaagagatttaggcagagtattttacaagaagaaaaagcttcatatttaaaacataaaatctggccgggcgcggtggctcacgcctgtaatcccagcacttcgggaggctgaggcgggcggatcacgaggtcaggagatcgagaccatcctggctaacacggtgaaaccccgtctctactaaaaatacaaaaattagccgggcgtggtggcgggcgcctgtagtcccagctactcgggaggctgaggcaggagaatggcgggaacccgggaggcggagcttgcggtgagcagagatcacagcaccgcactccagcctgggcgacagcgagactccatctccaaaacataaaaataaaaaaataaataaaatccctggttttacacgtgccaaagtcatagacctacttaggacttggagtaaaagagaagtggttcatacgtttattcactcacaaagtgggtagctgagacatcataaggtcttcaggttagtttttatctttaaatgaaaatgagagaaagtaaagaagaagttcatttctactctggcgtgttttaccaatgaatgcttattggcttcattaaaatccttcattgtagcgtttctcaaactctggtatgtttgagaatcacttggacatcttgtaaatacagatccctgagtttcagccccagaaattgagaaggtcttaggtggggacccaaatgtgcccttctaacgagttcccaggtgatgctgatgcttctcatcaaaggaccagacataagtagcatttcaagtccgctgacaagcaagatgtcataaaacatagatgttatgtaagaaacacgaaaagccttggccatgcagagcaagatggtgattacttactagtgattgctgttatccacgatactagtaccggccgggcgcggtggctcccgcctgtcatcccagcacttcgggaggccgaggcgggcggatcacgagctcaggagatgaagactatcctggctaacacggtgaaaccccgtctctactaaaaatacaaaaaattagccgggcgtggtggcggcgcctgcagtcccagctactcgggaggctgaggcgggagaatggcgggaacccggggggcggagcttgcagtgagccaagatggcgccaccgccctccagcctgggcgacagagccagactccgtctcaaataaataaaaaataaataaatagatagatagataaataaaaatactagtactgtgtaacccaaaagtaaaagataattatttattggtgcataaaatagtaagaaccagaaagaacgtaggccagttctcatttgagaatctgatgttactgagattaagtttttctacccacacacttttaatgtgtgtcattaagtatttaataactgcaatagctatctggaggcagaacatgtcacacatcctctatgatggtataaactagaagtagagagtcagaacttcggccagattttactgacaatttggtcaatgtggtagtttttagaatttaacaatgcttttttcaaaagaaaaggaaaaatcaatactctgaataacaaacagttggccctggcatctatttcacatttttcctggaaaatggcaccaattccccaatgttatgttagggctttgttttaagatttgtagatagaaggaaagagtgccacctgctgaggaagcccagtgcttactccagcacagtggacacagcgtggccgccctgacttaaccttcttagcaccttgaaaaaaaaaaaaaggtgtaaatctatccataaggcaggaagaacaaaacgcccagaagaaattgtcagttggatctagacctttcaaaactaaaggactctaatttgtccatgtcttcaaatcattttagagtatttatgagttataattacacagggatattgggatgccccatctattgaatctaagactatatgaaagacaaaaactgtgatcaagttcttctgaatctgtagaagcaagctgagagaaagcaccttagaaatatgaaatcattgttattttattcaaaattgcaaaatgacctagtctctccaaccaggttggttttttttttaattttctattcaaatttaaccaattcagcctctcaaatctttcaaatcattaattgaattaatttgtaggatttagcacaaaaaatgccttgcctaaaaatctgcttcaatatatatcaaagataggttaaaatatctttcaagatcacagattatggaactattgcatgggttaatatcaaatatttgccctttactagctatgtggccttaaatggttatttgtaccttggtgtgctaagtggtgaaatatagatggtaagatcatagaattattttgagaaaaatgagatgataaagcaatatgcaagtaccataagtaaatgctcaataaatataagttgccactaacatttattattattaaaagttatgaaaaataaccctgaagaaattcttacgagcacagagctaaatagctggacaactgaaagtcaaattcaagtataattcagttttggaaatagaataaaattttaaaatcttttctctacattacataaaaagttattaatattaaagggaataacttttgcataaaaactttgcagatatgttatcaatcaagttggagaaactattcatcatttaacatgtttattttatgtggtcaaaaattaacatgatttaataggaaactaaagtattagtttcccaaaaacttcttgcacaggagtgcttcttcttttcaaacactgaagtcaaactggatgacctaaataatattttttgcttgaatttcatgtgcgcttagcttatagggttttttccttttgctttgttttaaattaaattatactatacaatattctagcctgttaaactgatgagatttcaggggcaaattcatttgataagttataagaattactttattatttcatacaaaatcatattcagagataggcagataatttcaaaatagaagttctaggcttcaacgtaaataactgctgtctgccaacaatccatgtgctttccataaaacaagaccaagagataaatgtgacagcaattaagatatttattagattttaggttacactatgtgaatcactgaaccttctaattgatttattctttgttgcctataacttactttaacatacttcagcacaggctgtgcgtgtgtgtgtgtgtgtgtgtgtgtgtgtgtgtgtgtgtgtgtgtgttttcttctgaacctagaggtagttatccaaatgagaaatatagtcaccaggtgtttagctaatatttaaaaggcctcatccagtcaaaagttacacaccagaggtagacagctataagcagtattttacatcccctcaccatattaattagcattaagggtgtcagtggtggcctttcgttggttaaactggtagaattcaacttaagtggattgtctggaacattgtagagatattctcacccttgtatgaacatggtataaggatctagacatatcagtgttctacactatgaacaatgccctaagggtcatgcataaatgctgatctcgagagtttttgttaccccactgtgaccagatgattaaactatccctgccttgagaagactgttataaacatgatatcatgcaaggagtagatggaacatttaaatggacagagagctaggatttcactgaccttacagaaaaagtcaacagtgtcctattcttacttggatatacaacgtaagaatatcttttatctatcttacaatttgtaaagtcctttaatctggataatctgacttgcttttcatagtcatctaatgaggacagtcaaaagattataaagttgctaatttctaagaggaaactaagtaactgtttgagttgcctacatggcagaactcggtcttctattgaagttttctgaatctgccccagggttcttgatccattacgtgtgaactggtgttgaaataccttcaggacttgtatgctcatgttgctgtggagctagccataattccagctcgttgtattcattaaagaaagaaattatcgtcccttatttcaatgcgagactctgttctgtttctgagtggactggatgattttctggcttaataatattacttctatgtaaattctgtttacattggtagagttaaaagtatagatatgactacaaataatttaataagtcaaaccatcaaagttgtatttattattctgtgtatagaataatacatgaccctgcaactgtcatctgatgattgttcagctggaaaaaaatgggtactattgataaaaaaaaatacatcactctttggatgtttttacctgtgagattaacctttgttaaatatgggagtatttgtttttaatgagagtgttctgtgtgtctactggtgtagaacctttatgctaaggtcatgaggaataacataatgaaatgtctaaaacactattatgtgtgccaattccactcatcgcctatagaaatatttgttttaatgtatcaaaatgctgtttttctcctgttaataaatagttatatctactattttattcctagaggtttttaacgcttttcatatagctatgaagtctcttaaaagatggatcacaaaaaagagtgtccctgaagtccactgtttaactgaaacttttttgtttttttttaaatcaggtagaaacctgaataatttctcaacttatccttttctctcattacctgactgcctaccaacaagaaaataaaaggatttcatttagaaatgtaaaaagacagttaatattcagacttctaataacttgggaagcatgttgttatatacagcaaatggcttcacctctcagagcccaagtttctttatttcctcatgttatttgaatctcaatctcattcatccttataattggatttttttctctctctctctttttccttgggcaatctcttgtggaaaaaaaacaaacaaaaaaatgggaatacagttgctaataaaggccatgtgagggcaggccttctgtgtcccaaactaagaactcctgacacagagacagcctagcctaatggatgtgagctgcctgggtttcattccctgctgcaccactcaccatccgagtgaccttgggcccgatattttaaaccctctgtacttccattttgtcatcaatagcaagaatacaacaataacatttactttatagaaatgactctcagataaaatgtaaaacaaaaaacacatcactagttacatacagtgcttagaacaaatatctcgcacatactaagtatttaattaatgttagcgagtaatactatcatcatcacttttctactgctgaattttctggttttaataactttattttcgaaaccatccatgatatggcctattttggcaccactgggagtgctgccatcttctcaaatagaaagcaattgagaacaattcagaataaattagacctctgaagatatgtcagccccttcacaggagactcattttcaaaacctgctacctctagggcactgctgccagggaaggaggcattctgtgaaaatctatttgttttcacatttttattttcttttaaactgtctactcaaatattaaggagaattttgtgcaaacaccatcaatttaatgggtcaagttcattacgagatggaaagtacttcagctgctggaaaagcatgaatttcttcactcagtttttgccagcacagtgtggcataaatgactgcactgattgcaaaagctctggtatccagctacctgggttcaaaccttggcttttctgctttccaactgagtcacctcagttttctcatctggaaaattgggataacagtagcagttacctctcttcagggttattgtgagggcggggtgtgagaaaagcacctagcatgggacctagaatatagcaagtcatcaacatttggtggctctggttatgtaaagaatgcttatactgtactaaatctcggtgagaaccaatgattcacaattagtggaatacaccagatcactgtgctggagagatgggatggccttgagacattctatcatcaaattcgtttatagatttaaaaaaggaaaaaaaaagtcttaagaactgagatgagtcgcccaaggactgcagtgattgtagtttgaccacaagtgaaaggattcccacctattccattacagtgttgtttgcgtgaacacatgcaggttgtgtatgtgtgatgcaccagtactgatttatgttaagctgacttagactgccatgcagggcctagattatgggagtgaacaaatattagacaaaaactaactgaagaacataagagaagagagatctgaatttccaatatagttgtctttctgatttcaaaaatcagaaacttgtccccagattttgtgtacgttcatttctatgatgagtttccaaaaactgcaagagtcaaaatagggttgtcatgcatggatagttggtggaaggttccaagattccgtaactagactttaatgaaaagaaaatttagattttctacactgcctttaaattttaaaaggatggagcaaaagaacactctagatctatgctgtccaatatggaagctactagccatgtgtgctcatttaaatttaactttaaatgaattaaattttttaaaattagcaagtaaattcctcagtgtactagccacatttccagtattcactatccacacgtggctagtggctgccatgctggacagggcagatggacattcccatctttacagaaagtccttttggaagggtgctactgtagatcatttgagaaatcctcacaattatagttagtagtgtaggctgcacaatggccacaagtaccatggaaagtattttcatgaaatgcaaagatgtgcttgcacggatgataagaaattggcctagactctttagagaatttagtcaaatccaaggcatttactatgcaatgaagagtctataatttgtgacgtgggaaagatctccaagaagggaaaaaaaaaaccctgcagactttaaagcggggggaaaaagactaaacattcaaataattctgatggaggctcacctgattttctaatttatttataagcatctttgaagtgtttttcactttcagagtcacaacaggggcttttccaatcaatatttatgttacttacattacacttggaaaacaggtaacactttcaaatgctgatatatatggaagaagattgcgttggctcaagactgagtctattcatggaaaacgtccatgttgatataaaaaattctatcattcaccatgatgaattttaaacagaagatacatttttatctacttagattttattttggcagtaaaatatctaatgattattcaattttatctgaagtataaaatatcattaggaaccctgcctgcataaagtgctttaaaatttaatcttaacactgccaactgctctttgccatggattgaactaattaataccagtagtttccaactttgaagtcaggaaggaagaattggtattttgccctcacaactctaatctttgacaataatgataatccttatatctgaattgtgttttagaatgcaaaatgctttcaggcaaagtgttttcacataaaatagctcacttgctcttgaaacagtcacttgaaacagacaggggagtttttaacattcttaacttagaaacagggaaactggtgtttatggaattaagtaatgcgtcccaaagactcacagtggcgagcggaaatcaagtcttaatttagtgttatttccgctatgctctgctgccttcctgagcatcttgtaacctgctccagttgctaccaccagatttcataccagactgggaaggagagtaaagaggaagggaaaagagaaagaagagaggaaatgggggaaaatgacagacaagagacaatttatgtccttaaaaataattggcactgagtcattagtaccaaatgtaacacgttaccctggatgggttcctgaaatggagaaaagggcattaggtaaaaattaaggaaatctaataaactataggttttagttaataagtatgtgttaatattggttaatgaataataacaagtgaactatatgatgtaagatgttaataatagggaaaactgggtgtaggatatgtgggaactctcagtactacctttgcaaatttttttatgtcaatctaaaactcttctattagattggtgcaaaagtcattgtggtttttgccattattttttttaaaaataacaagtttattttaaaacacagttaggaggaggaatatcccagatccctcaaggtttacagtgcctcgtgttgctctgttgcagttggctcactgttttgatgatggggagtttccagcccaatgtatgatgcttgtttgatgatactgtagaagagatgtgtcaaactatgacctgcgggccaaattcagcccagctcctttttttataaatgaaattgtattggaacacagccatgctcattcatttacatattatccctggctgcttttgcactaccactagcagaggtaattataagagaagcctaaaacatttgctatccaaacctttacagagaagtttgctgaacacttgtatacaacatcacattttctgttttccttcaacagctactaaccgagtgcctaccatgtgcccagcattattctatgtggtggtgatagtggtcatcaagacaaagactctgcctgctctgcaacttgccttcaagaaaaatgagatcatagaaataagcagttccatcaatgaatcatgcaagattgtatccaatagctctaaacactacaaagaaaataaaaggaacataattgataatagagagtgatactgggagctaaggcggcttagagttggcacacaagtaaggcctctctgagatgaatcctaaatgatgagaatgaatccactatgtaaagataaagggaacaacattccaggtagacggcctagaagcacagcacagaagtcataagacagaaaccgatttcaaggctaaatccaggacatttttttttttttttttttgagacagagtctcactctgttgcccaggctggagtgcagtggtgcaatcttggctcgctgaaacctctgcctcctgggttcaagcaatcctcctgcatcagcctcccgaatagctgggactacaggcacgcaccaccgcgccccgctaatttttgtatttttagtgattcgtccaccttggactcccaaagtgttggaattacaggcgtaagccaccatgcccagcctagatcaagaaaatcgtaagacttttctaaacttccaaaattaaatatataaaaaaaaaatccacatctcttattcctatgtatgtatgtatttatttattgctgcaaagtttttgagagttttttcaaagggaataaccaagatcttcatattccattgggactttgctaataaaattggttattattttaagtacattccccatgggaaaagggcagcactaattctcatttatcacaagattatatggtatgttatgtttccttttaagtcttaaaacaatgtcctccctatttgtgctaaagaaaagaagcttcaaggccaggcactggggctcatgcctgtaatcccagcactttgggaggtcaaggcaggcagatcacttgggcccaggagttcaagattagcctggtcaacatggcaaaaagcttcaaaagcatgactaagttgtaacatatatgactatgttgtaacatatatgacatatatgactatgttgtaacaaaatatctctggaactttcttatctctataactgcaactttatactcattaaacaataacttcccatgtgcagttttttgtacatcaattatactttaataaagctggggaagggggacatttgactactaatataccaacttagaatctgttctctttcaccactggacatggagaggaagaagctagaatgtcccagagtattatctgtcagacagtagttctaaatgatgttattaggtgtatgtggaaaaattattatgttcaaatgaagcttctttactataggatgtctgaggggccttcgtaagtgaacataaattgtgaagtgacaagctgaagcttttaaggcataggaaacacctaatgggcaagggccctggagaatactcttgcttttgagacataatttgctgctttggataatcaaatgaattctgatattcttcttactttggttttatacatatgtgtgtgtgtgtgtgtgtgtgtgtgtgtgtgtacgtgggtgtgggtgtgtgttatagaaatatatttggtgatatatatatcatcaaatatgttatatacagtatcatataaaatttgagataacttatttgctaaaataaacctgttcctttaatgtgcaaaaaaagggggaaagtcaccaggaaggcttcttaaaaaacactgatccttggactctactcctggcgtttctgactcagtagctgtgggtgggggctgagaatctgtgtttctaacaaatcccccccatgctgctgctcggggactacactttgaggaccactgatctagatgttcatttcaatttttttgggtcctagtaatatacacaattgaaagtaacaggaattactaggagttgtgatgcgttaacaatttcagcatctcaatttctttagtaagagtttcatttccctatataaaatgttaatgaccagagtatgcatttgttgctttaaattaaccatatgagaggtagtgtgaaagacgcacacgaaaacagaggcggccagtgacattaaagggccagcaccctcacatcaggtacacaatctcactcatttttttttttccttagacatcttcacttatggtccattgaggccttcagtgttactacaggtaaaggtgatgtcaagtcctgcccagccaccctcacctgtagaacacacactgtgctgctggagttcagagaggaaagtggctttttgccccatcaccccaaccccagccaacagaagcgttcagcagtcaggctcattttctcttattctgttctttgtgctgagttaccatctgctgctatcccaatcattttatatatatatatatatatatatatatatatatatatatatatacacacacacacacacacacacttatacacacatatatacacacacacatcatatacttatacatatgtatatacatatacagtcatacattgcctaacaatgaggatactttctgagaaatgcctcattaggcaattttgtcattgtatgaacaatacttacataaatacttacataatacttacataaatacttacatacaatacttacataaatctggttggtatagactatgcacacctaggctgtacagtatagcccatggttcctaggctgcaaacctgtacagcatgttactggactaaatactgtaggcaactgtaacacaatggtaagtatccatatatctaaacatatctaaagatagaaaaggtacagtaacaatacagtataaaagactttgtagatggtacacatgtacagggcacttaccaagaatgaagcttgcaggaatggaggttgctctgggagagtgagtgagagagtgagtggctgactgaatgtgcagcctaggacattatggtgcactcttgcagattttataaacactgtacactagtctgcatcgtttatttctaaaatatttttctttcttccataataaattaaccttagcttactgtaactttttgactttataaacttttgaatgtttttaactttttgactcttttgtaaaacacttagcttaaaacaaacactctgtacagctgtacaaagatattttctttataatccttactctataagcttttttctatttttaaatttttaaatttttactttatactttttaaactttttgattaaaaaaaaactaaaacacaaacacacgccagcctaggcctacccagggtcaggatcgtcaatatcagtgtcttccacttccacatcctatcccactggaaggtcttcagggacagtaacacacatggagctgtcatctcctattagaacaatgccttcttctagaatacctcctgaggacctgcttgaggctgttttacacttaccttatttattttctgtaagtagaaagagtatactctaaaataaggttaaaatgtatagtatagtaaatacctaaacaataacttagtcatttataatcatatcaagaattatgtaccgcacctaattgtatgtgctgtttttatatgactggcagcacaataggtttgtaaacagcatcaccacacacatgtcagtaatgtgttgtgttgtgttgtgacatcataggacagctataatgtcactaggcaataggaatttttcagtcccattataatcttaggagactaccatgatatatgctatatattgactgaaacattactatgcagtacatgaccatatatatatattcctgatgttaaagaacaactcttcctcacttaagaatatttttaaaataccgaagagtacaagcaaaccaaaacataaactcacaaattaaaatcatccctattcccaaagccagaaataatcacaattaacattttggtgtattcacttctaattgttttttatctgaaatatatgttaaattgaaatgtttttatgtttattggtcatttccatttcttccagaaattgctctttgttgtctttcaatatttttccattattttcaactaattttttccattagggtattactgtatttaccctaatttaaaaattaaattaggtaaattatccaacttacttacaatttgccaatacgcaaccatgttgacttgcaaaaaaagtgatataatttttagcttttaattctgcttgtaatgttcagaaatcttcaattttcacagagttaaatacctctaattttttctttgttattttcccccagtgtttcagtaattagtctaaccatccaaggtcatttaaatgttcatgtttttgttctttgttttattatatcactttaataccttgccaaatacatccatccagtgaacattaacttgacagttttatcaaaatgtattttttccttcccatcatttattgagtattctatatatttccagtttgttatacttgctttaggacataatattatgaattaaaatcttatatagcttattaaggtcatattcatataaacgcttatttcatttatgtgccattgcatttgtttttataacatgtgcctagcacaatgccattttaattatgaaagctttataaaactgtatttcatcaattctaagatgcacaatttttcatatactaacattttctgaaagggaatgattcttagcatgacagaaaattacagttttttttttcttttcagtggttgataaaacaatggtttatattacaatccatgattcttctattcatcgaaatacataatgctttaatacttggtgggacaaagtttcttttattatttcttgtcagtttagatttattttatttacatttttattcttttttcttttctatagatttttcagaagtttatttatcttttttcatctcatctaacgctttcgaattctactttatctgaaacagtttaccgccaccttgtttttgtctgtgttgctaaattgtttttattctttaatttttaatattttatcataattgtatcttcattatttttctctgttgtggtttatatacttatatatgggattgcaagccaaatccagttgtatttatcttctaatagaagagtttaatcctttcatcctttcgtacttattttcataagtgacttttgtttcatacgttctggaatttgcctgtttctgtctttttctatagaaaaagactttctaatctttagggatttggaagtaatttctccagttttaaaattttaaatagttgctgtttgtattttcattatattattatctgtgaacaaaaggcaaccaattcaaccaacttgtatttctttgcctgcttaaaacctactcctgttcatctgacatttggttttaggcctaaattattacactaaaaatttcatttcatctactagttttgacagaacatttgaaataattatttaagtaatttcaaaattcattaaatctcttagattgtaattttcctcattctagagttctaaaattttactcatttctcagccgtattatgtatttaaatttattttaaagctagacatacacagcatacatttttaagtacttccatatctgagactgtccccctgttgccttcatacatggaggaatatttggcttacaatttttaggtctcaaattcaccacatgaaaattctaaagatactgttcaattgtcttcattcaattaataatgcagtggagaagtctgaggccaattcaggttgttcctctattggtaacctgcttctttgcctgaatgcttttaagaatgcttccattaattttcctaattagattcttgccctggttgggtccttttagttttactttctgcagatattctggagcatttttatttttaggctcatagtttaatcaattgtggaagttttaatcagttctttgttaaatgatagcttccattccaattgttctggtttcttctttgggaaaaccacagacactcattttagatttccattctccacctgccgtatacttcactttttctggaagagtgtttttttgttttaatcactttgcctttctcctttgttttcaggaatgacatctcaattttgtgctacacatgaatggttttatttgctgcaatagtcgttcttatctttactgcctccattgcaaattttaattacgcttttgcaatttgatttactatatctactatcttaccttgatcggctttttaacttctccgcctttggtctatatgtcttgttttattgtcggcccattctccctttgttttgtatctgatcccatttgttttccatacttgctgctcacatatgcatagataccatcttttgttgcatatagtgtttaactcaagatggaatattttaacgttttcttctggttcctttaataaatcattgttttaaatgctttttaaaagatccttcaaaatgattttctagtttccctttccctgtatggcaattaaattttaatcggacacatgttgttttattttccctcttgtataagtggagacccatcctatttacagcatttatcaattagcaggatgcccttggccctagctactgtccatttgattataaatttaatcttcgtctcagatctatatttgaaaagcaaattgatgtgcatagttcttggcccaattcccagggtcttttctgttggaattaaaagagatgcctttcctcccacactctggagttcttaccctggaaattaatgcagtacaggaaaatctactgcatgtattgctcccgtgtcttttctacttccttgctacaggaaaggagactgggattacatataaaagcaacaagtatatgttataatgagagagaaaagggatggtggctctctaagaccctaggatttaggtacagggaacagactgcgtaggaaagaaaaagaaaaggcgtaaaagaagagaacagggacctacggaaaacaaagtgccttcctatcttttttcagtagtatgaggctactctctttcatgaaacctccattttttttctctcaatccaattccatcagcttatagttagtggaaattcctcccattttctagcaataggctctgttggtcttaaatttttgtgatgttgtgagttttcctgtgccttaatagctattttagagggaagatggtagagactgccttagggacaactagccagatgccattttaaactggagcctatggattagttataaacacagagaaaacaattgtccatgccataatataacatcattgttgattctatccattctgggttgatgtgagccataaaagttctgtttgttttcagggtcaaatactgagcaacaggaattacgctaacaactttattctgaatataaatttctaaaaatcaacttttgcatggatttaagatacttttgtctgttatgttggctagaataatactgactggaacttgatatttttgtttactaaattaagattgtaaaaactcatgttacttgcttagatattgatttttttaaagctcattatgtcaaaacacttgatttcgttccactttagaattatcttccacacatttaaagattcaccaaggtagtggttctaaaaccatactgtgaataattttctcaggaggagctcataaaaatattcagatccccaggcaatgcctctgcatgtatagactgagtaggaccagagatttttgtttgcaatgagtacacgcaaatgatactaaagcagtggtccagtcatactttgaaaaatgttgatgagtttcaggagagtggttaggacttttctatttttattggtgttcgtatactatagtctcagagacatgtaattatatatctcctacagtgaagactttctgccttaaacagtgaagactttctgcctttaaactagatttttattgttgttaccacatgtaagaacaatatgactatcgcttcaagaatttgtgaaaacatgctcagctatctactggttggctaagagatttaatgcaatttgttctaatagaaaaaaaatctttacataatattccccaaatgagtattattaactatcaagattaagcatataaatatgttaattatctggcaaacagaaaatgcataattaggtaggaagggtaggaattttagagttagaataactaagttaagatccatctatgtaaccttgaacccattatccgatcaaagtctccatttcttcctctgtctaataaggctaatcccatcctcttgactaactcaacaggttttagaaaggtcaaatgatacatacatacatgtgtaaatgctttgtgagctgttagcactgcaaacattaaaaatactgtgcttggccaggcatggtggagcactcctataatcccagctacttgggaggttgaggcgcaagaatcacctgaacctgggaggttgcagcgagctgagatccctccactgcattccagcctaggcacagagaaagactccatctcaaaaaaaaaaaaaaaaaaaaaaaaaaaaaaatatatatatatatatatacacatataatgctaaatgaaaagtactttatctccacacctacacagcatcagcgaaagtttcagcagttctgtcatttcactgaaaaccaaataatcaacatagatttactgaagattataccaagaattaaaactaggtatccaatatataagaaagaaatgtctttgcttttctactttgcagttaaatatattggtatttaatagttcaaaagtatatgatgagtttttctaaaaccattaaaattgagtgctgctgtttctcagataggataaattcattagtctaatagagtgctacaggtaacagttaccccttggtaatttttccactaatattcatgcactgtatttcagtctttcaatactactttaatgacttgtagacttttactcaggtacttcctaattaagtgtatttgtaatagctatagtttttattatcaaatcattctggattcagactttaggctgatagttgtttcttaattgctcaaatttttttaagtttaattagttttagatggcagaacagatggtctgtgaatccattggtgctgtatctatgtgataatatactttggttctgtctaatggagtgactcttcttttctaaatattctcatttaaacagcactcttagtttctcactttttttcaatttgtgtcaaggataatgtgaaataaacatgaattttatcaaattgttataatcttggccaaattcggaatcaaatatgacagctttaattttgatatatttagattcataaattatgattatgcacacctaataaacattaactcagtacaaaaggaatcttatctccaccaatattataaaataaaacaatttcctaacaaattttggtaagcacctaatggatgctggactctggggctaaatcatgaatcaaaataaacagtgatgcggggcaaatgcctatagtcccagctactcaggaggctgagatgacaggatcacttgaggccaggagttagagatcagcctgggcaacagagtgagtccccctgattctaaaaacaaacaaagttccctttctcctttgctctcaaggagcttatagtctatcggggtgaaggtggatgttaaactaatcatcacgctgctgatgacataattacaaactataataaagggtctgaaggaaaaaagtataatcgcatgagcaaagaagcctaagcagtaattgagggtcagagaagacttcttcaacgagcagcctttaagccgagacttgggtagtgaaatcaataaactcaattagtgaagaagaagagaaagaatgttctagacacagaaggcacagcacatgtggagaatatactgcaagagcacacggtaaataaagcaaggccagagtggctgaagcagagaaagtaaggggaagaattctatgaggtagggcttgagagactgaaatagccagacatttccactaagagtaaaaattttagcattatctaaagagtatagcaaagctattagagtattttaacagagggataatattaccatgattgcttgtgaaaagataacttagttgatttcaacatgcaaattgagctaagctgataatgcctatcactacaaacctattaaaatgttcagcaaatatgtcgggcactgtgacccatgccggtagtcccagctactctggaaactaaggcaagaagatttcttgagtccacaagtttgagtctagcctgggcaacacagtgaaaccccatctctaaaaatacaaacagatgaaaaatgttgggtaaatttacaacacaaacttctaaaaaataaaaataaaaaaacgtgtctgagcgccaataaagaagaaagatttcctgatagactcataaaaggaaaagtagctcagaaaataactttaataacagaataatttggaaaagatagtaaaatgagagtgtttaaaattataagttacaggctgaggtcaggagttcgagaccagtctggccaacatggtaaccccatttctactaaaaatacaaaaaatagccaggcgtggtggtgggcacctgtaatcccagctactagagaagctgagacaggggagttgctcaaaaccaggaggcagaggttgcagtgagccaaggtcttgccactatactccagcctgggcaacaaagagagactctgtctcaaaaaaaaacttgaaaattaaaaattaaaaaaaaaaaaaacaaaattataggttacagactcaaaattatggcaaaacaatagatcatcatgaagatataacagatttaaaaatgaatgaaatataacttctaaaattaaaaaattcaattaaaaatttaacgtcttcagcaaattatacattgtagaagagaggattttgaactagaaaatatatcagcagatctacatgtatcaaaggaagaatgtgaaatggaaaatatgacaaagacaaagaatagaataagtagagataccaaatagaaaataaagagagaaggaaaagaaaaatatttgaagagataattgcagtgaaatttctagaatgtataaaaaaggatacttacttgacaaagaacaccaaagccagattaaaacagataaaaatcaataacataacaaatatagggaaactgaagaagactaaagacaaaagatgactctgtggtttttggcttgctcaatgtggcagatggtggaaccattcagaaacacaggacaatggaaacagaggagattagggctggtaaggtcagtcttgaatctgctagattttttttggccttacagacagtcatgtggtaaagtctagtaggcaaatgaatatacagcatggatctgaaagcagaagtctgtgctagagatattggctgtcacatgagtagatgtcaaataaagttgttcatatgggcaaggctgcctaagagatggatttagataaagttaagggctttctggaactacatataatgcctgataaaagtagacacacctgcaaaagaaacatagaaggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtatcaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaagtgggatctaattaaactaaagagcttctgcacagcaaaagaaactaccatcagagtgaacaggcaacctacaaaatgggagaaaattttcgcaacctactcatctgagaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaagaaacatagaaggattgtcagaatggaaaaagaaaacccaagaagatatattcccacaaaagccaaagcaaaagaccaagagaggatttttttattctcctatatttgcagctttgaagatcatctctacatgtaataacatcatattagtctggcattcttctcctagcattaaatattaaatttagcacacattcttacatatattaccacatgtagacatagagatctttcagaataaacgagtattacagatgttcacattatttatctagagattttagtcattgttatcctctaaactagagatctgcaaatgttttccacaaagggccagagagtaagtattccaggtgttggggaccatgaggtctctgtcacaagtactcaacttttccatggtagcatgaaaccagccatagacaatacttaaataatgaggatagttgtctcccaataaaactttatttacaaaaaataagcagcaaaccagagaatctgaacacacgagagcttccggatttgctctaggacagactctgaaccatttttcacttttttattgcatataagtaatatttgcatgcacagcatttattttaattttccatatttttgttaggtgaaaaaaaatatttctttgttaccaggataaactagacaaaatattattagatgtaaactatttactaggaaaatataaatgtaattagaaaattcctaactgcaaagtatagaaagaataacaacagaatataaatagcagtgtttcagttaaggagtatgccttatatatgccaaaagggaaatgacgtagaaaatcaatctgataggagaagggaaactgtaaaagaattcatgatccacgtaatagtactaaagtgtctctttttttgaaaattcaagacattcacatgagcacttgtgaacaattctgtgggagaaagataacaagaaaggaaatatccccaaataaaactgcatgtctgtgcacacaccaacacacatagacacacacatatactactatagtttgtagctatatggaggcttaagaatttctgtagaacaatacacctcaaacttaaaagaaaaataatggttatatattatttaaaaatatatttttaaatgtatctgaagaaaaaacaagagtttcactcttgttgcccaggctggagtgcaatggtgcgatctgggctcactccaacctctacctcccgggttgaagcaattatcctgcctcagcctcccaagtagctgggattacaggcatgcgccaccatgcccggctaattttgtatttttagtagagacagggtttcaccatgttgttcagtctggtctcgaactcctgaccttaggtgatccactcgcctctgcctcccaaagtgctggaattacaggcatgagccattgcaccaggccgaaaaactaaatatattaatgtatcctgttttatctccttgcagcaaccagagtacttacagcatttattaaaaacaatcttccaggaagatggaaaaaatatacacctccctattcctctcactaagtataattaatatcatgttagttatgtatataacaataacaggagactctcaagggtggagagaaggcagatgcaataggggcctcaagacccagggaacaaacacgagttttctggattttctttttgcctcatctattctagactttgggctgaagaatttggcaagctggaaacaccaagaggtgcagacaaaaaaataaaacctgtaaagccaagattttttgttctctctagccagagaaccaggaaaggggcagcttaacaagacagaaaacttttataccataactgctttactccagtcatagaaaattttttccatagaaaacaactgtgagcccacccacacaccaccagcaaagatgaagtgggtcttcctgccagactgtgagaaagcaccccaacacccatccccataccatcaccagggtggtatcagagaaggctgaaagcttggactttcatccccaccatgaagtaaaaaggcctactgctccccaacccttgtgatatcagtagagatcatatggggtctgtgactgaaatatgtgtttagtgaaaagtagaatcttgggggtttaaaactttgataattggcaaagactgatttttaaaaattcaaatgaactttctaaaattaaaatatgacttttatataataaatatatatgaaataatatttatttataatagtatcacagactatttcatattgatcttctctttactgcaatgtacctgagcaaaagagagtttttcatattgcattgggtaaaaatcatataaaaataggcctgattctgcatctaacatcggagttggattggtaacgttacatctgatatgaagtgaactactgcctcgctcttgaataatcctcaatgttttacaacccctagtacaacatcaaaatatattaagataattctttttaattcacaaaggcatggagctgtaagattccttatttatctcaaatggtacctaatttatagaagcttcagaaattacttttcccaacttaattcaggaaaatgtgtacttccccccacccccaagccccttcattggttggtctgctgaaaaaagtgccttttttttagtagaaattctcagcacaactgttaagtgaaggtagcctatagattagatttgagctccatgaaaaatacaaaaatcaaccaccaataattagcagcctcacacaagctttgtagtatctgctttgaggctcatctaattgtatctaatcccacatcagcagggttctcaagcctttacctaatgaaagattttatcataagtccatcaaaatggactgtgagagttattgttttctttctcatccttccaaatcattttaactcttcatcctttttaaaaatgacattttgctgtgttccttgacgtttgtggaaacgatgaccattagccaaactagacaatagcaagagctaaaaacaaaaccgtgtgctcagtacatatcccaggtgatatattgatttattgtagtcttaattattctgcatctatctaccgcttttcccttgcaggttttccagaaactataaaatctttataataatattttctgtggagaaaatgatttcatttaagtatgacttattacaaaaatccagtaatgttattatgcttctattttaatattttaatattttttaaaatttaataactttaattacattttatatttttaataaatacataatggattctagcatagggtaaatggacatattattgtctaaaatgggggaaaactaatttaggaagatgataatttaggaaactagttataatccaatttctagatagcaatctttaatcttataattatttttctttcaattattgcttgaagatttgccattattgtgggatattgagaccataacagtaacttagaaacaacccaagggttacagggaattcttcattactccatagtgaatactcaagttatagaaacaaaacaaaaagagtacaataaagcacaaatcaccatattacttactttgttgtgccaatacattttagaatatctagaactaagctttcagaagtacaatgacaatatgcctgaatattaaaaaatttaaaatttgattatataacagatggattccattgtttttttaaattgcagataaatttgttttgtttctcccagtggagatttttgagtatttaattaaaggcctcattgccccatcattaaattcaaagaagcatatctaatgtgaacacttaaatgtaatgtcactcattagtctttaatgaagagaaacgtattctttctctaaagaacagctgtaaaaatagtgtctgtcacctacaaaattatacattctgaagattattaatgtgcatttaatgactttgaaatatgtctttgcaacagttactatgcatgtttcttcctttcgggcttcatctgtgaaagaggttaactaaagtcagagagcctggaattctcatacacctcaggacaccagcctgaagcagaagctaaattttcccaggtacctgtaacagattgggcatggagtcatttggctttctataccacacattttctcattggtcctgtaccttgatagcagttttcataatgccttagccataaaaatctgtcattagacagttaaaattcatctggagctctttttcctaggatctagtcaacaagaaaattgattttaatgtctgtgccgtttcctgactctgcaagacaagactcagaatacagcacagtgattgcagttgattcactattgccttatcaccaccatcatcatcaccattactattatcctcaccaacatcatcacagtcaccaactgtcattcttgaaaaatgtatttatacctattatatgctgaagtcctacatcctagtatttgatcactgagccatggcagccatctaaatctactgcttttttttttttaagacaaagaaagtactgattagttctgcatacactcagcaaagcatctaggcaaatttttttaaggccatcaactatttagacctatccagatctggatatgtctggtgttagcaaattcaacgtatgtattcttcattgaactctttagattttattcaggagattcagggtcaattaggtaccactaagttatgttctgaagtatattactactttgttgaaatacaacccatcattaagcataattcgacattaagtgcctccttaaagtgcatccaacatgcctttaattacagaagcacctaaaatagttcatcgcagacatatttgcatatctaatggttccatggcataactccaagaatgacaaaatcatattatttatttattcattcagcaagtatttatctagcgtctcttgtgtcagacatagcgctgtgtgctacaggtacagtagtatacagtctcacatttgtaggtataaatacatatatttcacaagtatagtcatgtctttctgcattgggaagatgttcttcatagtctgagtacttcatattttttccttgcaacaggagtgtgaatgacaataacataaaacaagtgtgttacttctggaactattaccaacatggtagtagttccatggtctactggtggttggattatgaaagccataggccacacaagatctaacaaaggtttaaatcttgtgtggcttatggcttttataatccaaccatcttttgtaatttcaccacctgggacaagacaacacatgctgggtgcacgaaaaccctcgtagttttttttggttgaatcaaaagagtaaaaagaagtttcttcatttttaaagtaatttggatgttcaaatttttttgaaaccagttgaaaacatagtttattaaggcatttttatagctactctgtttaactttacttattaagtatttccttctttgtttttttgagacagagtttttgctcttgtcatccagcgcgatctcggctcactgcaacctctgcctcctgggtttaagcgattctcctgcctcagcctcccgagtaactgggataacaggcacccaccaccacacctggctaatttttttttgtttgttttgtttcgtttttgttttctgtttttgaagtatttcttcaatatgtactttaaatatgtactggcttgtcatgctgcgtcatccgttcaccagcatctctctctgctttcctagctccaacccatccacagaaaacaacctaatagctggaaaatagatgctttgccctatgaaacttcttctgatactttccccctgtgcaattgactgcctcctattttgtttccccagtgtatcttgttttcatctatatcaaaatatctttgtattgcatttatatatttacaagcttaacctttagaaaagccacagtctcattgtgttgtctcaataatcgttctattcaaaacataatcttacttgtaaaaataattaaaattaattcacttctctactcagtctcctgaagaaatgtcaaaaggaaaattatatttctaaaacatacagaattaaaaaaaaaaagcttttgtctcaatctttgcatacagggttgataacatcaaataaatagttgggtcaaaagtcaagttggacactctaggttgctaaagatgataagaatatagttgaaatgattgacaatggggctacacaataggaagatggttgataggaagaatacaatgcgtttgtactgtttgaagaccagacactgtgctttcacttacagccaagactttctgggtgcaaatgacagaaacttagttcaaactgacttggctatcttatataatgcctagggacagtctttaggcttggctgaatccagatgctcaaacaatgttatcgaaaattatgtgtgggcttcattctcagcaaggcttttgtcctggtcatagccactacaacccaaggcctacattcaaccagcttaacaatcccagtagaaagaaatcctctttcccaaaagtttcagcggaagttgcaggattgattcttattctccaaacttgggacacccaaactaagactctgacgggctaatgttggatcacaggagtatctaaggaggtggagatttgatcagccccatctgaactggaggactgagagtaaaagaggagtctcacacacagaaactacggggctgtcaccagaagaagggagagatgcaggctggtcacaaatgtgcacactatactcacatgaaataaaatatactgcagatggatattctgtttttacaaagattttccttctgaaatgccaaatggagccaataaaataagaagagacatcatcaactatccacagaaacttttcatatctcaaaatttcagaaattcagtttcccttcagttaccttttcatattgagtatgaattatatcttttgaaaccttagttgccctgctctattgactaaaaagagcaaataactcatgtgaattagtctttctctccatccttctgtactctgtttctctaatatgcatatagatcatatatataatgcatttcaattcttctcagagtgcctgttaagaacagtgggtatatatggtagcacttgaaagagctcagtaaatttattgaacttttcacttggtctaattcactttccatcacttgcttcctcagtgctcttccaagaatgaatgtgtgtgtacatagaatctttgcatgtgtaaacatttcccccgaacacgtgttatgtgtggaaattgctttacatttgtatgcatgtcttcctctcctgatctcttccttcatttatttccaaacacactctttacctagactctgctctgcaagcttacagattttcttgagtcgttgtcatgtgtgaatgggctgcaattcagctctgcttcttcataagctcacctttttttttcttattcccacacaatcaaacttctttagagatagtctgccctcagtgtattcgttacctctgacttcattcatttaaaaaaatcaaccttatggtctggcttttgggcccacttattctactgaggcttcagtcttattaacactgattgaaataacctaagtatagcaccttcatctccgagatcatgtaacgttgtaacaacagttacaataacaacaactgacatggataaaacacaggtgctaggcactatgctaattttctacaaggattagctcagtgtatcatttaattttcacaacatccctaagaggtaggctctatttttaatctccagaaaaaaaaatacacagaagtttgaagtgaataacccaagagtagcataaccaggctcaatctgaagtcttcttatccagtttattcagtgcctgtgtttttttcctgattctctcttagtatcccccttccaaccaactctctgagtctacccttctacagaagatgaaatcttgaaaattatcagtgataacaaatcaccaagtacaatgcttattctccatcctgacctgcctacttttgtaataacaacaaaacttcatatctattaggggaggctaataacctctgttatgtgttacctcccataacaccacaacacttggagtgcagggacaagttcttctgtatgtccggccacacccacagtgccttgcatgtagtgagtctcaatgaatgttcaccaaaggaataacgtgaatagagactttttatagtttgtcatacagcatggtagattctcgatacccaagggatgaatatttgtaaagacttcctagtcttagcattaattcttgtgtctcagcactaatttttgattcactcaacagacacaggtgtgtaatgagtgtgtcatgagtgtgtcaaagtttattttacataataagcaacttacatagtttaaaaaagatattgtaaacttcatggtatccttctgccagtattctgctgtgattaaaatagcatttggggaaatccaataaataaaattatataagattcaatgagagggaaaaacctagcaactactgtactttaaaaatgacacttagttcacaatctcttgggtaaccaatatcagaaagatttggagtatgcagtaagacttaaagtaattttgtttgtgtcagagatgtgacttattctcaagatttacctgctgtatcatttactcttactcactgatttactgtataagtttatcagttacacttaggagcttgatcttgctttctacttaaaacacactgcaagtcttaacactcggaggaaagcactctgcaatctgctgccacattttccattaatccaaaattaccttgatcttgctcagatccataagtcaaatggaagtcaagaacagaagaagaaggaaagaaatcagaaagtttcacattgagctaacttctaaaatactttgtgctttttttttttttttttggaatgttgaagttcttatagcacagtcctattcctttctactcagaccaagatcttattgagctcctacattcttgacaaacactggttccattttcatggcatcacattatatgccccattatgacacacatacctgctgtattaaaagtattaaaattcacatttgcttcagattagaattgttaaagcacaaagaaaaagaactctgtattgcaaaactatggctgaatctcaaggatgtaatattattcatgattaactgatttgcatgcagtttcatcaaagtgtatgtctttaccctaaatgtggcaagtccattttggggagagctgtcatcattgaggtaaaaataagagaaaccactttaggcatgcactgctgaataagcaagcacttgtttctcaattattccttaacaatttctacttctggttctcacactcaccttctacattagcaatatgacccatttattgatcgacagatgtgtagccagtgtgcttttgtcactgtaattgatcatctagtttctgaaatattatgactggagcaaagtattcatattatctttattaagggtttgcttaggcactgcacttgtaaatttcaagcttagttgttctagaaaagaaaaaaagtattttctatgcagccaacttaaatttttgtttgtcataacattgctgtggtgctctggtgtcctcaactatagataacacaggatatgggtgtaccgagttggcaccagttttatggatgtgtcacttagaaatcccaaagagcatgtgtccatgtctctcaatccaccagtaaaacattgagcacactgcagtatatgcacaatgtaaagatccccttatccccagatgcaatggattttttggggggaaatacaaaaagaaactcagtaacaacactaggcaatagattgttagccaatgacagggaaactgctgttggatttcataggagaaagagccagtattgcatatgtggcaacaagaaatgagtaccaagtttgaagtacaggtcagtccatgattaattaaaaagaatagaatagtgtaggcacaggaaacagtatgaataaaggaaagagatgaaaataattctgacatctaactttcattgaatattgaccctgtgccaggcacagtactaagtgctttatgcgtaaactcattcaggataaaactagaaatgtagtgggaaaagctttaaacagtaaataagatggcccaggttttattcctggttctgccactatgttgtcacactaagatctttccttttctaggactcagttttatcatttggcaagtaactggtatgtcatgggaagtcctaaagcttcatcctactccaaattctatgtgaaaatatcaacacaggaaaaatgatctaatatcacaatgaaaatgggtgggaaatgattgttaggcattgaggctttagcacaaagatactagggctgggcgtggtggctcatgcctgtaatctcagcacttttagaggctgaggttggaggatcacttgagttcaggagtttgagaccagcctgggcaacacagtgagaccccatctctacaacaacaacaaaattttcttttaattagctgggtgtggttaatgcctctccagttgcatgcctgtagtcctagatactagggaggctgatgtgagaggatcacttgcgcctgggaggtcgaggctgcattgagccatgaacatgccactgcactccagctcgggtaacagagtgagatcctgtctcaaaaaataaataaataaagatactaggatcattcaattgttgaatgctatgttcaaggaattatgccaggtcacttcattttcatacatgtgaattttgtaaaatgtgaggtcctgacaaatacttacatgtgactttacataagagtgacccattcatatgcctataaaaaacaggcaggtaatgtgctatggttcggatgtggtttgctcagccctgccaagtgtcttgttgaaatttaattcccagtgctggaggaggggcctaatgggaggcatttgagacatggggatggattccttataaatgacttggtgctgtcttcatagtgatggtaaattctcactctattaatccccacaataactgattgttaaaaaggacctggcatctcctttccctctcttttgtttcttctctggccatgtgatctctacatgccagctcccctttgccttctgacatgggcggaagcttcctgaagcagacactggcaccatgcctcttgtaccgtgtgcagaaccatgagccaaataaacctcttttctttataaatcatctagcctcggatattcctttatagcaacataaatgtactaagacataatgtaaatgaataaacaaaattgcatagtgactggcaatctggagagcacatgttctatctaaacaagggggtcactatcatttcctcccaattgttagttatgtgggtatcatgctatatactcttctttgcaataattgagagaggattcagaaagatgaaaacaataattatgattaagctgttcatgtgttctatcttccattctaggtacttttcatacattatcatataactctatttttttttctctttggagacaagagttttgctctgtcacccaggctggagtgccgtgggacgatctcggctcactgcaacctccacctcccaggttcaagcaattatcatgcctcagcctcccgaacagttgggactacaagtgtgcaccaccacatactaccacacctggctaatttttgtatttgtagtagagatggggtttcaccatgttggccaggcttgtctcaaactcctgacctcaggtgatccaccgggctcagcctcctgaagtgctggcattacaggggtgagccaacttgcctggcctaatttggtgtgtgtgtttttaatagaaacggggtttcaccatgctggccaggctggtctcaagctcctgacctcaggtgatccacctgccttggcctcccaaagtcctgggattacaggcatgagccaacacgtccagccattatcatgtaactcttaatgctggggttatatcttttgttcccatttcaggtaagagggatttggagctcagggaagttaaacgtctctgaacatccaaattttttactaatattgagaaaggaagaaggtgatgtcaagtttcaaactcacaacaatcggctataaagccctcattttcccagtatccaatgcagcctagtgagacaagaaagtagtgaacagactaaagcgagtacagtaaatttgatcatatttctcttctggaattaaagtctcgaataaaatctgacagtctcaattcatgccacagaaaacaaaatggaaatattaaaaatatatcacattaaagtgagaggtggccatggaaatgaaaaaccacagttctggactccctcgggtgagacaacagacatccctgggtgctatgtcattcaacctatcatcaagatctacctggtctacctctagttgctttttctacttaggtgcaatcacttatctgtttttgcctcagtgttgatcaggatggttcatgcatttctatctgaaacatttggttggatcagacagaggcttggtttcaaggttaccattttcctagtatttagtactgacttttctgaattataattgcatattccttaactttgttttatttatctgccttcctgactcactgcccatgccagtccctggtcacagcaaaccctcacaccatgccaggacccctgctctatcttgtccataacttctgtatgacaacttctatataatagctaggtagtccaattccagggggcttcccaagtgtctgtagcttgtatcagtctttgacatgataaacatttttattttcaagacatactggggagcagtctccaaagggtatatgaagttaattcatcattaaaatactgaacttttttttttttttttttttgcatcatcagtatagttaagagctttacagcccacctgttaaacagcttcagcagatgcttctgggagctgattttccagactgtaacaactttataatttgagcaactttaatcaagattcttaccttggcagatgccagctttttgcttcaatttcataccaggctcttctgacactttgtttgttgaaaattttgctctttatttgatccccaatgatttcttgcttcctgagttcctctagattaatatctaacagctgtttatgtatcatgtgaaaatcttatataattaagactttaaccctctacaccgtttattttcaaacctagactgtgttaacttattctgtagtttgaagaaagtttcttccatgtcatttcttatgcatactctaaaataaagagctacttaatggacagtgatatcccacagcccgtaaatattaatatgagtgccattagttagagtggaatacactcatttgtgaatgtttttaaagaatataaatgctaatttatttttgcattacaggatatattcttagcatttggaatcattttggcttaattggtatcaactcttctcacataaataaatgaataaatgaaactcaaattgctagcccccagtgacacaagagaaactgacttctggcgcctttttaaaccttttcactgactactacactcgcaatcatccaattaatgagaagaacccttttggctgacacaatgtggctttgatggagaatcgtaaacacaatgcatgaagcttgtttgttccagaaaatatctcattagatataattaagatacacaaaaaggaggtacttaaattctatagctcattgccaatctaatatctcagccattcacaaataaatctcagtcattttaatgcaattgggattatattggaattagtagtttagagttgatatactgtctcccactgaaagcttccaaggtgaaagtcaaacaaaaataaataaaaaatattaaatataacatctttagaaaatactgtttggaaagagtaactagttaattatttggcaaaaaataatgtaatagtcattttttgaggtttggtggttaatgtaaaaacatatagagaaagcttacagcattaagaagcatgggttttggttcaggattcagtgtggctacagcacaagaaaattaatttagatcttgtgggctgcctctcaaacacaacagcagacattgtttttaaaaagatattacctaaatcattcatgcattaaaaactcaattaagaaaagtttgttgctaagaatgagttagcagttttgaggatatgatgaggttttgagatgtagttcttaacattgagtcttcagggatttaataagttcctttgcggagcccctctatgattcttcatttatttcagcactctgtctcttgctacaaattcatagagtacaaacttatgaatagtccacccacaacaactattgctatttgtcatgactcgtgaactgacacatgatcataagaaaccccataaaaacaaataaatgagtgtcttgactgtctgtatctgaaatatctacgcattatggagtatggactatgtgtcaaatgctgtactatgcactacttcttagattagcccaggtagctgatctcttattaggaccatttcttctttttcacaggtgtggaaacttggtctcagagagatgatatggcttgcctaagaagcagctaacaagtagagagacgttttgaagctaagcagtttgtctctagagcttaagctcctaatgctattccattggaactcttggtattagtataagtaaacagattcatttgagtcagatggctaaagtaaattaatggctgattgctctgctcaaagtagagaaataagctcaataaattccatctgtccttacatttttaaagatttcaccagaagaaaacagcttccaagcctaacctcaggtgagatgcaaaaccaaagtttttctcttttttaaaaatctttatctgttttagtcaaagaccccagatttttacagagtagttgttacagaatatttactgcccaccaattattccatacacctccctacacttccagccttctttgcctgtatgctggagccatggatctagctttgccaatcgatactgacagaaaatacatgttttatgtctgggctgggacagtgagttcctctttttccagtggtatccttagaatccacttcagatgacagagctgtaagatatagaagtgctgcctccatatgcactgaaattagagtttatgtaaaactctgattgtattaagtgactaagatttgggaatcattgttgctgcattgtagcctaaccgaatctgactgactaaagtttgtcagtgagttaaaaatgcagctatgtatccatctatgcatgtctttctggtcaccttggagacacccttccttggaaggcagaaagtgttttgtgtgctaaccattagcaggatgcccaataccggccctcatccagagtgaactaacagcatgaacagccctctgtgagcttagaacatagaaattggaaatgatgatgcgtgcctaattagaaactggactcattgtcactggtagccttcagcttgtggctgggcagaagtcactctgctcacccataatgaaaggggtgtgtaaattttccatggtggtcaccattgttcctgtgtgttgaggcaagtcagaaaaaactgcactgctctttggcagaatgccaggaaaaccacagacatttgttcagactcttcggcaaggatgagtttatatcaaaatcttgccataaccaaaaaggtcaaatgaaaggcaaggtaatgttgccatctttttttcttctttttgggaaaatatgtgtccttttaaatacatgatattctagatactactttccctgatctgaaataaagttaatatttaaacaaaattatgtactatctaatctcctgagatgtactacatcagaatcaaatgtgtagatatttaaggaagaaagtttaaagtagatctcctgggttttgtgttataatctgggaatttattagagtaatctgagaaagccaagcccccttcccttgtctttaaagacccaaaatcatatctcacagttaaaagaaatttttttaaaattaagtgtctcaattcagaagatttctaagcaactcacatgttctggccacaagtaaattttccctcatacaaatacacaaacttaaaggaaatattaaatgccaaataacaatagttatcagccaatctgcgatcctctattctgagaatttgtcattacgcctttcaagttatctccaaatcccacctgctttcagatcctcagaagctggctttctgttttgctatgattgctcaatagaaaataaacagatggggctgaaaaaaatccagaaatacaaatggggtagaaactgcctcgggcttttgaacagcatcagaggaagttgtattttttatttttcctgtttgacaaacaaatctcttggaacacaaacctcgatatggttttactctaaatcaccatcaaatatgtttgcttttgttttatttctcttgaaattcacagctaattttaggatttatccttttaattgagatgagtgaatgatcaataattggtatttgaatatattaaactgggggaaacatccttgtaagacatcagtatatatggattcctttatttcatcgtgaaaatttcaggggcactaatctcattaattgctttcaaataaaggccatatccattgacagctgacaaagataaattatgtccaggacaggtttcagttttcatgcatattcttgccctttatgtgtggatgtccacatacagggatctaagttaaacatataatttttttatgtccaatactctattttctatgtgcttttttgtttatagaactttgtcagataacttcaagtataagaccttgagggggaaatggaagggcagagatgctaaatgctacagccccaaagggatgcagggtgcagttgtacagtttgtatcctgaacaaggcgccagcccaagggtgtaaatagggacttaaatccaatctgagttcagttccccaatccaaactcaggttggtgagtgctatatcggtctgtactaggaagttttcaagttagtcccacccctgatgggattcaggtgggaaatgcagagaagtcgtctttttttctctttcacacagagacatcatatggtcctagcagtggccaggttactctgaaagaaagaagcgaaagctgcttttgtgattctttccacttccaagatgaaccatcatggtaccaatccagttaattcagaaacacacacagaaaaggctgaacaagtgaggttaaattaggtaattttgaaattccagattcactatgacagtctatcaaaagtgaaggaatgaagactgaaatgttgacaaaatgccacagctacagcaaacttttgcatggccctgaaaggcaataaaaagtagtagttaagaccatagaatttggattcagccagtccacagtgctctgttcaaactgctagctgtatgtatataaccgtttactacatactctttatgtccctctctctttctaggtaaaattagcaaaaaaaaaaaaaaaaaaaagaaaagaaaagaaaagaaaaaaaagcactgttctgtgacaattcataatgtgcatttaggtgccccatcatgggtgattattgtgccagcatcatgatgattatcatcattatagtcattattgcagtcctgagtcttaaatcccatatatgaactctaatttccttcagaggaaagtttcattgttagctccttgaaggtagggctgttcatgtctccagcttctgtcataaactttgaatacagtgtatattcaataaatattttctgaataactgaatgtttgaaataggcattaaaaaactcaagttatcctcctactgttatcatttgcatatgtaatacacactttaatcctgaattgtaagtagctcaagtgaagtaatacctggcttgcctacatcataatttcattgtgtacatcaagtaagactttatgtactaaagaaatttgcaggccatacaggtttatgcaaatataaagtatttccttctgtaaagatatagaaatataaacataaaaatataaagagtatatacaatatttaccttcctgcccataaaaaataatcaaaattaatcatttttaagcacttatatgtaaggcgttgtgcagcaatacagatacattacctcatttaacttccaaaacaaccctgagttaggcacagttttacccccattttacaaactgaagcttagaaagaccatacaactttctaaagaaaaacagctgctaagtcgtaaagcaaaaatttgaccaaagtttatctgactccaacttctctacccttaaccactactctattgtatacagactgaaaaaaagagaatattataatgttcaaagttaactagatagttttctctatatggttattcaaatgattttcaaaaacaatcttctaagatatattaaaaaaaaaacaaaaatgtctccatgaatgtgtttctgttttcacaagtttttcctggatatggatttacgagcaatttacctgggagaaatatgaaatgcactgagagacttcttagtggggaaaaatatgatattattttacagaaaagtccttccaaagtcctgtcttttcagggaaatggtatcctatcaattcttaggataggtgaactttatgaaagcagaggtaaattgtttgtaagtcttttgtcatccaatccattttaaataataagtatatcaatgtaattataattgtaattttagcatgaatcactaatagttgtttcatccataatcataaaagttacaaatcaaacaatgtcaatatgtcatcaacttattgaagtgcgggagactttgtaatggttcccaaagcatgagccataagtatgggcaacagaatcatctgagtgcatgttaaaaatgtatattttcaggtcttactcttgtttaatgtaatcagaattaatgaacttgggatacagaaacctccacctttgacacaccgcacacatgattttaatgcaatcttgagtttaagaactttttagagatagaacttctgcctcagaaactggtcatctagctcaaccccttgtttttatggatggagaaacaaacccatgttggtttagctactttccaaaggtcacacagctacttttcctattcacctttccatatatcttccagaatttttatgggttttatcatttgaaagatcctaaaaacttttttctacccagcatgagaagatgaatcagaaactaggttaagtgttccagggagatgaaaaattagtagattttcatgttaggatacaaccacagtgaagcttgccatgctcttactcacttctgagctctgccttaatgttctatcaaactaagctgtgagttaggctgtgggtagaacagtgccttcctcaaggacttgttactaaatgacatttaagtacaataagccatgattatagttgactatggaaataataagtaaaatcagtcagttgcctgcaactctgcttgtcttaatgattgatatcaggctttcccaaatctagacaataagatcacttttccattgattgactaacaggccaagagggataatgttgtgaacgtttgccaggccacatttcaattacctgtctggtatagaactgatattgaacagttgcaggtatggcccgaagatttaagattcattagacttataatcataccagaatgagaacaaaccaatcattattctaccaattgaaaaaataaagcttaaaaagtaaaatgagccttaaaacttacctgacaaattccttaactttatagagaaggaaacaaaggccctacaaagtcaaataatatataataatatatacagagtcacataaaaatacagtggcagatctggggcagtaatcataatatcaactttaattcaaacatgatgctaagtactttatattccattagcttattaaacttccattagcaatgaggaaaataaatttcaaagcggttaagattttagagtgattgcctaaaatcacatatctagtatatagagaagctgagatctaaaccattatatcagaatcatgatgcttagacccaggtctaacttttcctgtaccatcctgctctcacactttcaatttccactaaactggtttagtgcctcttcttcagtgaaactcttgatgttgaattggttttgtatcccaaattgggcttcaccaaggcttcaagaaacactttattgccaagctactagaagtcagcaaatgaaaaatataagatgagtttataagccagtcaaggaaattctgtgcttccaaatgtcactgctgtcatttagatgattagcagatttgcagagcaactggaagcttgggaccaacttgaagcattacttctcttggtaatggacggggcacatgagatcaggatgtgtcataaatggctacttatgtagcaaagttctcagataatgagataaatggaaatgacgggaaacacatgtacagagagagattgagagagaaagagaaggcactaaaaaaggaaaagaagcccagagtaggaaaccaaataaaccaataaagttgctgggcaaagcacatatatgcttgcaatgaagactacaagggaaactcatctacttccttgtacaaaaggacagctgcagtacatctgctgcttttgtagaagcagaagcagttaagagaagaataaaatacagagaagatctgctgcaagctgcctgttaaaaagcagccattctgtggctgacacacctgtaaaggaaaaataataccagccgtacatgttaaaggaaactgctggggcaccagcccagtgaacagagatgaggttcaaatctgattcttctactgattagaatgattgtgactattgttgtaactgtttttattaatttagttattactattatttcagacattttaaatgttaaaaatatttggggcctaagaacatagatttacatagatttcagaagtagcatctaacactatgtacaggccatggttaacaaacaacctgtgggcaaggcacagtgctgacctcagcactttgggaggctaatgtgagaatattgcttgagcccaagagtttgagaccagcctgagcaacatagtgggacctcgtctctataaaaaagtaaagaatcagcctggaatggcggtatactaccatagcctcagctacttgggaggttgaggcgggaagattgcttgagccagggaggtcaaggttgcagtgagatgagatcatgccactgcactacagcctgggtgacagagggagattatgtatcaaaagaaaaaaaaagtgcgtataaatacctgacattcatatcaacagtcatgtggcagccatgtgaagatggccagtgaatggagagttcccttcaaagatggatacaattgcaacaagtggacggaatgagatgcaaaaagggatggaggcagggagtgaaaggatacacataaaaagatgaaagcaatttgacagtagaatatgacgtatgaagggtttgtcaaagagataagatggtaggtggaggcaatgtcatagaaggctgtgggggcaaggccttactgtattctattcactaagcgatggacgagttattgacagttttgagacagttgtgtggtacgcatgaaacatcaaattaaccaccaactaccaatctaaggagacataaacctttatgagcacaaaattcacacagaaattggaaggaattttctctatcataagtggaaatagggccatatagcattcccataacaaaagttacagggagatttccaaagtcctctttccaaagtcctttttccaagttacagatttccaaagtttcaaaaatgaataactttcaccttcttgaaggatgaccatcaccatccacccttctctcctctctcttcctacctctctacatcagctactttttttttttttttttttgagatggagtctcgctctgttgcccaggctggaatgcaatggtgccatcttggctcactacaacctccagctcccaggtttaagtgattctcctgcctcggcctcccaagtaggtgggactacaggcatgcaccaccacatccggccaatttctgtatttttagtagtgacgaggtttcttcaggttggtcaggctggcctcacactcctgacctctagtgattcgtctgcctcggcctcccaacgtgttgggattacaggcataagccacctgctttttcagcaattaaggctactttactactgagtctctcaccttgaaacctttcttcctacacctcttcaatatccatggatacaaaatggcagagggcgtggaagacaggcagtggtggtgtacattgtgttctaggatgaggagctggtggtaggaaggaagcaagagaggcgcaaacagagagaagggaatcctgggaagttttccttttccttccactcatttaacaaaacaaaaactagcacatcttcaaattaacaaggaataaagtgacttctgaattgtcctataatcaggtaacatcagatgtatcttcctcaagacagcaccaaatatggctataaaagacagccatatttgataaacaatgactgaatacctgttatttaactagagattctacaaaaccattatggcttccatttgaaaggaaaattgagcagcagccatgtggggtgaaacaacaaggaatccaccgtcccatttctaagtaaaacagagtaagataaacaacattccactcaaagttaaacacattataaagaggaaaaaagggaattcaagattctctgccattaagaatgttaattttgtattcataatataaataaaaatatattctaaaagtatttcataaaggaagataaaatgtcaaaaagtagctttatgttctaaatagactttaacgattatggaataacaaaaacaaaagataataggagacgtgcagtcacaatttagaggtatactttgctgggtgagataagaaaaattataagaaaactaaatatggagtggcaaaactgttggcagtaatgagttgaactggctttgcagaaaatataatcattggaagaagactgtgagatgctattccagaacagataaaaaggataaagaactgaaaatgatgacagaaaaattgtagaaagccaggactaaaaattaggattcaactttcagataatgaatgtttctaacccatgcaaatggattcaaacataattcaaagatctaagcaaagaattcattccttagccttgtcgtggcgtttctgattaaaagccatcaacaaatagtagagtttaattcagttaggttggtattgactcagagagtaagattagggaaataaaaaatctgagaaatgccccccacccccaaaataaaaattgattatgagataaaagttatattatggctcagtgcggaaagatggattattgccacaactagctgtttataaaaagttcaagttatggacttataatgtctttgtttgggctgctataatgaaaataccatagattgggtagcttacaaacaacagaaattcatttctcacagctctggagtctgcaaagtcctagatcaaagcattagtagatttggtgtctgatgaaggcctgtttcctggttcatatacagctgcttcttagccataaccttttatggcagaagggatgaaggagctgtcaagggtttcttctataaggacactaatcccattcctgagagctccatcctcatgatctaatcacctcccacagacccccaccttcaaataccatcacatcgagtatcagaatttaacaattgaatttggaggagaaacaaacattcagtctacagcatatactaccacatacaaaaacatatagcagatggatttagaagttaattattaaaaatgaaatcatatatgcactaacaaaaatatgttaatactcctgttatatgttgagggcatatttaaacacaaaagcaacaaaagaaattaaaaacaaaaaagttattaggtttgactaaccaattatcaaacaatctctcttccttggaaatccaaattttttgaaagaattgcctatattttcaggctttacaaactctgtactctctcattaaggcgctaaaacccgacttccaccccaacaaattcaatataactgctcttgctaaggccaccaatatccaataatctactggtaatcaatgaaaaataccacaatattcttcttatttaatctcttgtaatagttaccataccctctctcttaaaattttaattggttttagtgaccttgaattcatcttattttctttccacttagggccccaactagcacatatagagctttcacaaaaattgggaaaatataataacagcatgctaaggcacaaagcatagtgcatgggattttaggcttcactcatgcctttagccaaatgcctgtgtacaatactcaacctgttcaactgcgtgtggtggccctcttcttctacctcttttagctcattctcatttccctttgcaaatttctaactacagtacttgattctacagtgatgtaagttaataatcataatattttaaatgcaagggtttcttccccaatttttagacttaagctatattcaaagcattgaagacataattatagaacagaatttaaaacacagaagccttggaaacatgaaaaagaagacagtaatataacgaacaaaagttaaaacgtgggtaaaaagggtaagtgcactaatttactcctgtttcatagtgggaggtcaatagatattgtgtgaaaagttattacatttagaaatgaaatcctatactataaggagctgtaatggtaaccaccagaatcagaaaaaaactaaaattaaaaagtgaaaacagccgttgcttctgagtagtaaaactggaggtgaaggggaggagtgaaattttaactttttattttgtgctctttcatactgtttaattttttaaccatttattatttcttcaataaaacaaacagtgcatatatccaatctaatatttattaagatgttaaaagaaaaaagaggttggatcagttaatctttaaggcttcttttatctgtagagtctggttttgtgatcagaaatacagcttagagagataagtcttgcagcagtgtgtagggtggattgcaatggagagagatggaagtgcagaagccaattactaggtttttatagtaaggaaggtgggaaagtaatgaggatctgagctgatgtgtaggcagcaggaatagaaagaaggttaaagatgtggagcctttgtggaggtagaatatatgtaatttggaaattgattggatggatgcacagggtttgagagaagatggtattaaattgactataacgtttcaagtcacggtaattataagactagtattagctgaaataagggagtcagatattagctgaagtgagagagtcaagagtagagggaatattgcaatggttaagccaagctgagtgaagcaaaattgtcattataagaagtgccttaatcattagcggatagggatttaggagaccatggtgatggtcaaaagaaatttgggcaggaatttgtcgaaaaggttggctactgtgctccagccagggatggttggaaatcatttctgaagttttatagtttgtagcttcatgtggtctgaattgaggacagaaaaaaaaaatctccattagtggagacaaaagcattgagtattgagacagctctgcattattctttaggattgacctgaccatgcatagcataaaaataaataataatagtatctaactagaaaagtctgttggacactgcagagtttatcaaagtaattactcctttagaatatctgttagtattaagaatataatatttaggcaaatagatgattattaaaaatatacagttacacctgtaacagttacctttatttacttttcttaacacactaaaattgcaataagaactgaatttcctaatttcatggaagtaaattaaactatctcctggggacatgaattcacagccatccactttacttggactttttttatatttacacctgcttctctctatggaacagattcaagacttttaaaatatataattaaaaattgtagttaattcaaaataaggaaatggggcgaggtaatgccagctgctattataaatgaaagcctgaaatctcaatggattaacaaaaatcaaaatttattcttctctcaagcaaaggtcatttagagcaggagtgggaacctactccatgcaattattcaaggaccaatgctgccagggcttttccatctcccgcatattctttacagattttcccagaacgtggagtcccctatcagcagctaggggacaagaaagatagaaatgcacaggaaatttttatgggccaagcctgaaaataataaacatcacttcagcttgcattcctttggcataaactcagtcatatggccacaactaactgcaacggatgctggaaaataagatctcactatatgcctcaagagaaaacaaaatggaattcatttggtaaatagctagccagtctctgccacggttcacctggctgatcatcaaatatctggtttactcttcatctcacacatagaattcatctatctccatcccaagccccacctagtgtcttgcaggtagctcagcttctgagatctgtgggtgaagtacacatggttccataagaaccccatatggctcctcatagatcagccacctgtgattgaaagggcaaagtaatctgctcccacctcagcacatgtgtgcacacacgcacacacacacacacacacagtagcaaaaggagaagcagtaacctcaaaaaaaatccctttagaaaagggaaaaacaggcaacggttacgtcactgatccatagaattatgaactccttgtggacacctctgacttggcagtggggtgagtttcttaattaaatttttattttgtcttcttggagccaggggagttgtcgttttctatatcctctgactctacctctagttggttttttcatgcttattgttttttgggcacatctgaagtgggtgacgagaagggggatttctcaggggtggctcacttccacaaggggctttctgcccaccttaagcctcaagaaatcaaatttatattttttaatctaggtgaatggagtttttacaaatgcaataccttaaaaatctgagtaggcatcttatttgtttgctttcagccaatttcatattctgatagccaaggtttttctgagacatagtttacaagtatgtgtgtgctttgttttttggctttgttttgtttgcttgttctttcacatgcctctctctcgcaaataaatggtggctatgatgtaggaggtgggacttgacttgagaggcagggctcagatactggaccaaattgagaactagttaaaacagggcccaggcggaagcagctttccataaagacacacccaccagtgtgtcacttcagcttatcatggccatggccacacccagaagttaccattcctttccatggcaatgacccaacaacccggaagttaccacccttttcctagaaatgtctgcatatactgccccttaatttgcatataattaaaagtgggtataaatgtgaatgcagaactgcctctgagcggctactctaggcacactgcctgggaggtagccctgctccacaaggagaagcacctctgctgctgctgtgcactgctgcttcaatacaagttgctgtttaacaccaccagctcatccttgaattctttcctgggtgaagccaagaagcctcccaagctaagccccaattcagaggcttgcctattttgcatcagctatcttgaagcttccaatttaactggaaagtcccatcccaactggactttgctacaaggttaaatcaaaacagaactttgttactcagaggcttttcctattttatttcctgtttgtcatccagaagcacaactttctcaaatcctgcaggacctcaaatttctaaacacattttacttccttttattctctgtgcacagcagttaattatttttcaaactgatctctgtcttctgatactatgttttgctcaaccagtgacaaccagtgctcaccaatattctttttcaatcctttttcttatagccaaaaactctttatatatgttatctgccttctaaattattactattattattattatttgagatggagtctcactctgtcacctaggctggagtgcagtggtgcaatctcggctcactgaaacttccacctcccaggttcaagcaactctcctgcctcagcctcccaagttcctgggactacaggcatgctccaccacgcccagctaattttttgtatttttagtagagatgaggtttcaccacattggccaggctggtctcgaactcctgacctcaggtgatctgccctcttcgacctcccaaagtgctgagactacaggcgtgagctaccatgcccagaccaggttattaacaggcaaacaaatattttgcctctgagaaacttgcatttcttttttttttttttctttttttgagagtctcgctcagtcgcccaggctggagtgcaatggcgtgatctcggctcactgcaacctccaacctcccgggttcaagtgattgtcctgcctcagcctcccgagtagctgggactacaggcgcctgccaccacgcccagctaatttttgtatttttagtagagatggggtttcatcatattggccagggtggtctcgaactcctgacctcatgatccgcccacctcggcctccagaagtgctgggattacaggcgtgagccaccgcgcccagccaagaaacctgaaatttctatacttttttttttgcctctgacatcagtctttttgtcacctacttatgaactacaaagcaaagggaaaccttggaagggacgttttaaggatggcagagcctctatcaacctggaatctcagatgtctgtgttaagcagaacccactgtgctataatttttgttatagcaacactcaaagtctgtttccagtctgctaatcaatagggtagttgttgctgtaaccgatacactccaaagccttggtggctttgtgcattaaaagtttatttcttgctcatgtaagttattactattggcagggagtgggatattggggttgaaaggggctctgctgtcttcgatacatacattccaaggtgaccctagcccttgtcaatcagaggggaattttggggaagggagagaagatcagcagtatgtagccaggcctgaatataacacacatcacttgtacctacatttcattgattagaatcagttatgtggacccaactaccttcaagggaggctggaaagtatggcctaattgtgttctcagtgggaaggggaaacaggaaaaagatagagcctcggccacagaagctaaatgattgctttgatagaccattcacgttgtgtctgagcttcccaactaccagggtaaaaatgaagcatgttaataagacaagacatacagttccttaggggagaagaaggctttcctggaaataaattccaaaaagaactttcttcctaatgtggaaacttgaataggaactgtgaaatggtataacagacagtgctttcaacaagacccttaaaatcaatttaatagtgcttttcatatatttcacatgacattaagtagtaatttgagaaaagtttttccttcattagtaagagccaagatccccattttaaagaggatgtacaatattttatggtggctctgtcagccttggagaatacccttgtcccttaattgttcttctctaatctcttctctaaagagaatgaaatgctctaatgcttttcacttgaaagcgagaagcaaatgaatctccttgagcctcatttggagagatttatcatggacaccatcctggaagcaactgtttccaactatgccattgacaagtctgttagcataaagaaacactgtttcctaaccctaactccaaccaccgtgtaagaagagagtgacacgagtgctcacagcctgcagctgaagaacaaagcaggcaaaggagcattctagcataaagagaaaaacattccaagtatattttgaaatcacagagccatgggctcgaaattcacccctgtcccacgacagttgtgtgacttttgacaacttacttcactgtttcaagcaccaggttttatcagtaataacccaatcctcatagactgtaagaaccaaaagagttcatgcacataaacaacactgcacaaggctcagtaaataaaaagtcacacaataaagataagctatcattgttgttattaatttattattatgtaaaacatgtgaaagcttagcagagtgcttggaacattttatgactaaacagatgttaaccgcctttgatgccattccttctttcacttggccatgtataaccacatgtatctgtttccataatgtatctttatacataaatagtatatctccaaatcataccaaatgtttttttaatgtataataaaaccaggctggagaaggtggctcatgcctgtaatctcagtgctttggaaggctgaggcaggaggattgcttgaggccaggagttctagaccagcctgggcagcatagcaagaccttcatctctacaaaaactaaaaataaaacaagacaggcatggtggctggtgcctgtagtaccagctacttgggaagctcaggtaggaggatcactagagcctaggtgctcaaggttacagtaagctgtgatcacaccaccgcctccagcctgggatgacaccaagatcctgtcacaaaaaaaagagagagagagagagagaaagaaaaggaaaacaaatagaagagtgggctctatctaaatattgatttgaaagaaggaactggggtgtcgtctaaattcttgcaaatagagcaaacattgtgattcttgagtatagttcatggaagatggagaaagactgtgctattatataaactaatcttatcaacagttacaataaaagcacttcccagaattatgcgatactcattttttttcagaattccatgctactttaggagatgacccatacgtccaataaaatcagcattcttgttctcagatacaattttatttacctgtggccatctgcaaaagtaacataatcatagtctatcatagtctattttttcttatcaaagtctatttgattgatctcactgttcttgcagttctttgaaaagccataaataagagtacaaatatgtcaaacaaacatttaccatatacaacatccaattattaaactatatgttgtgttctagtagtacataacatattttggttatggctatggatgacttatctattgttccactttacaatttttattacattagtatattattgtttatttattttgctatttaataatatgataatttttttacctactttctcatatgcacttcccagaaactcagtgaagaaaaagttgcaatcaagatggcaagaactgttggatttctaacttccgtataaaggtaccaaaaatagttcttctttcctacatccaaggtagacatttatttcttctactttgaacaatatacatgtgtttacctaaaatatccaaagtttattttccaaattttgttttcttattttaaataatttgttacaaaagtatctgagtaatttaagtcttaacatccacatttttttaattaaacaataagaacatttttcatgatatgaaagaagaacctaaatgaaataattcttttctcactatctgggaaggtcattagctaaggaagaattattttttaaatcataccttttataggcctattgtcattcactaatatgtggtaataaattatcaaaatattaataaatattatagttaagagaaagaccctgaaaccaaagagacttggtatgaaaatgaagtctccatactaaacagctgtatgactttcctaggtaatttacctaaaatctctgagctttagttctatcacttataaaacaggaaaatcacatgatctgtggcagatatgctgactgttcctctaatagccatgagctcttccataatttgtgcaccctgcaatttggcggggccgtgtgatacttatggacaatgggctcttctgggtcacccctgggtaaaaccatttaatagcagagagcaggtctccagatctttcttctctagacttaaggacatatggacatggtggcatcacaaaattgaggcagcctgaatctctgagtcacaacacactagagagtttctctgaaggttcacctgctcccatatcagagtgtgttgtgttaagtcactgagacttgggggtatatatacatatgtgtgtgtgttgatgctgcacagaaataaacaatcctgtgggttggtttgaggattaaataacagagtgatatgatgtagtgtcacaacttctaacacagtatgaattgaataggtgataccagatagtagcagtagtagtagtcgacattgtacaatcagccccagaatgaccctttgaaataatcacaagtagatattactatcaaactttgtaagagatgaaattagggctcgttccttctaagggccttacatataagcatgtgataggcctggagttcaaagccagtgcctgtttcctgagcactgtttttcccactaccactgtgacaatggtcagcgttttctacatcattgtgacgctgcactagaaattaacttccagcacgcattccaacaaataataacacatgcccatgttgaatatctcagcagaccaaaatatctgagcataaaaaatactcaacatgggaaacagcccttttatttcagagaggcatccaactattaataaactagttaatattcttgtatagtacatggtattgtctcagtcatatttgccatccagagacttattaaaaaatattttgtgtggagtttcaaaaattgtcctggggaatagacaatatgttttctgtcacccctgcccccactcacaattacctgatagctcagggaactacttctccagagtacttctccctaaatagcatgtctgggttagaacaattacaacggttaattgcgaatgaagggccttttaggcatctgaatgaattttgagaaataagtatttgctaggtggatggagttcaaatatgctgaaactgcagccggcattgttctaggccgttatttttagtgcactgaataacagctgctgcatatggtagttttcgagttttctgctaaagatccacttactggcacaaatagtaaatgtttgcatgtgctatttgatacatctcctgtgaggctccatttccacatttaaatatggatcacatatggtgaatcaaaataactttttgtatgtaaagcatatgtccaatgagtaaaccaaagagacatagtctatggcactgtcatgttccatatgtcttctatatgggttaaaatttaataaaaaataatacaatcagatgtgtgtaagaaaaagttcagtttcttagttataacgctagtaattggcaacaataaaaatatatacaatgtataataaatgctattgctcacattttaattaatagagactatgtaaagttataaaagtaataaacataaaatatataaaagtaataaaaataaaatattaaaatactgtaatgaatttctgtctattaaattcttagcaactatacaattcagaaacacaagagctctcttgaatctacttttttaaattttccatttttatgttagatttgggggatacatgtgcaggtctgttacatggtatattgtgtggtgctgaggtttggtcttccgttgatcccgtcacccagatagtgaacataatacccaataggaagtttctcagcccttacccctctcccactctctcttcttttgagtctcccgtgtctgctgttccaatctttatgtccatatgaacccaagatttagctcccacttgtaaaggagaatatgctttatgttctcctttataaaaccaaacagaacttggttttctgtttcggtgttagtttgcttaggataatggccactagttgcatccatgttgctgtagcagacatgatttcattctttttacggctatgtagtattccatagtatatatgtgccacattttttttcaatccatcctcagtgggtacctaggtagagcccatgtctttgctattgtgaatactactgcaataaacctgcaggtacatgtgtctttttggcaaaacaatttattttattttgcatatatactcactaacgggcttactgggtcaaatggtagttctattttaaattatttgagaaatctccaaactgctttccagagtaactgaactaatttgcattcccaccaacagtatataagcatttccttttctctgcagcctcaccagcatctgttgtttttggactttttaataacagccattctgactgatgtgaggtggtatctcgttgtgattttgatttgcatttctctggtgatttaggctatgttaaactaatttttttacatatgttttccttcttcagtaataaattaacctccagcctgggcaacatggcaagatcccatctctacaaaattaaaaaaactaaaaattagccaggtatggtggtggtgcctaaagtcccggctacctgggaggctgaggtgaaaggatctctggagaccgggaagtagaggctgcagtgggccgtgaccatgcctctgcactctatcatgggtgacaaagcaagactctgtctcaaaataattaaaattaaataaaaatcttagcttactttaactattttactatataaacttaattttttaaatttttacccttttgtaataacacttagcttaaaacaaacacatttgtacagctgtacaaaaatattttcattctttatatccttataccatgagcttttttctatttaaaatgctatttatttactttttaaactttatttaaaagtagaacataaacacacatattaacctagacctacagggagtcaggatcattaatatcactgtcttccacttccacatcttgtcctactggaaggtcttcggggacaataacaggcatggagctgtcaccccctaagacagcaatgccttcttctggaatttctcctgagggagctgcctgtggctgttttacaactaacttttttttatataactggaagaagtgcactctaaaataaccaataaaaaatacagtatagtaaatacataaaccagtagcatagttatttttgatgaagtattaggtactgcacataattgtacttgctatatgtctatacaactggcagtgcagtaagtttgtttccaccagcatcaccacgaacaggtgatgaatgggttgctctatgatattatggcatctatgatgttactatgcagtaggaatttttcagctccattataatcttaaggggtcaccatcatatacatatggtccatcattgatggaaacatccttatgcagtgttgtgactgtaacataaggaagggaaatgtgtgctatgagagagtactgtgggggtttatcaactaagaattgggaaactgagggcccagctgagttctgccaataactatgtgtgattctaggcttgtgaatgttttccctctatgggctaaaatgttctgcttcctgaagtaggtgggtgctatggactgaatgtgtcctcctcaaacatttatttgttgaagcactaacccttaatgtggcagtatttggaggtgggatctttgggaagcaattaggcttagatgaaggtaggacccccatgatgggaatcagtgattttataagaaagggaagagagaccagagcttattctctctctctctctctctctctctctctctctctctctctctctcattcctgctctctactcctctatctctctcctgtctctctctccctgtcatgggaagacacagcaggaagacagtcagttgtctgcaagccagaaagaaggccctcaccaggcaaccaaatcagtcatcagcgtctccatgttggacttcccagcctcctgaactgttagaaataaattcctatcgtttaaaccagtctacagtattctgttatagcagcccaagctgactaatacagtgggtaaattcaaaaaagctaaatggttttgtttatgtcctgtaactctcaggttgatatatctaacagtttcttccatgatgctaaaagtcataagaccttgcaaacgaatcaaaattaaattatgttctagtctgggttttatttttactgtatttcattttttaatttattttcaaatactttaaagctgaaaaccatgtaagacgtatgtgataactgagtaaaacagaatatttaattaaacagaacccctccttccccaagcattaggggatttacttgtaatttagttatataagtcctactggtattttacagcaaccctaagaagtaagaacattttaatactgttctctctagtattcaaaataatgaaacaatgacttgctaaggttatatcttcattgttcacaatattttaaataggttaatacatttataataaacactcttcaatgcagtacatatttgaaagaaatcttatttaaacagggcattacaaatgtaataaaaaggttgcatgataaaaatttgccctatccatgatacaggagacaaagatgaactttaaaatgaataccaaggataagctaaatactgtgggaatttgtcaccaaacttttacatttttattgtaacctactaaattatcttaattaaattttaataaagcccatcacaaaatgcaaattcctaagcatctgtttgacagctgactattattccattgtatggatgtaacacaattcattttcacagatcccttttcatggccatgtagatttcttccagtaatttgctattaaatgaaaagctaagttaacattcttatacacatatctttgcttattggtgtgaccatatatttatcctggataaattcttagatggtaacttactgggtcaaatcaacatgtagtaatgttgaaatgtatagacaacattggtgagaaaatatgtaacttgagttttagtaactaaattcattatagctcaggagttaccatttcaatagatcactgaaaataattacatttgtcagttcaaagtgtattggtcacctcttgtttaaaattcagtcacttttggggacgtattccataattatgggattcttcctccttccccactccccctgctttcacactgtgccatagatcatctacattcttagggatgaggcaagggaatactgcatatcctggcctcagctccatgtgctgcctttgatccttgttgcctctgttgagatgcctgttgatgcttagtcttaggttgtcagcctccgttcttcctacctcccacctgcatagttgaggccctctgcacatcttgtctgaactcgaggcctcttttttatccaatgtccttcttaccattgctatactgatggttgtgtagctcacagactcccagcggctttttcaacacctgactgagatttgttaaactgccttcaggtcaagaaatctcccacagccattgccattttactactacttaggtgtcatgatgcttcagtgtcatcctggatgcaggtctctagtttataagaggttggccatcttccatcatataagctcttatgcactgggatgccccccaaactattcatgaaagagttagactagtgttgcccttattaggcacccatgagcatctatgctcttatctcatcctctctggatcttccatttattctagtcaaaatcttactcatattgggtaggaagaaagtgatttcactatgcattttccctgtcctgtagccttacagtcaaatttttggctcactcttacaaccttcttgctgtagtgatagttgtaagccttatgatagtcgtaaactttacattttggaattctgagataaaccttttttctttctcttcaaagcccaatgctttcaagtcaaatgggctttaaaatttctaatgagtctaattaaatgttaatagattagatgcctgtcttgaaaagccatatatttacatcattcccgaaaaaaaaaacaaatggataatgatttggaaaatataagcatttatatatgattagctggttactttggaaaatgagtattgtaatgataaaaaaatccatttcatatttatttaagaactatattatgaattaagttatagatatcatagatgaatgatttcagagtctgtttttaaaaaatgggtcaacaatgaagaaaaccattgtcagaatgatgacatttttacacttagacttaggagataggtttttaccatcactggaagacaaaatagggaggcctttaaaatgatgtcattgaactgtgggaaataaagagttacacgtttctctggatttgagagatttcatataaaatgcactgtcaacttgtaaaaggatcacattgtctttccttgaagtttcttgtttataggaaatcgattatttctatttactaaaaagtcttcagagagtcctcattatcggagagtttatctgagcctaggctgtatatctactatggaggagttaagtgattatgacacagtattcactaatgaactaaacatttatttaaatattcccacttaaccattctttacagcttattactgtgtgtctatgactattatcaatgactttgtaggtcagcctactaacatgtagtaaacaatgccaaatcttgtacaagatgcaggatatcttgaagtcactgaagataattttagagaattaaccaattacagacaaatccattgatgatggcgagttaggccagttaaaaatgaaaagaaaattaatgcagatatagacaagatagacaactcaaataagaatgctttcaacctcaaagaattaaaaggagtccttgaggaaatttatcaaaatcttgagatgcccacaaatttctttttttcaaaaattagccgattgtgatctttctgggaaaattaaatgagaagtaaatagtatcatactgtgttatctatattgttgttgaaaaactaatatgagaaaaacagaaatcaacatttgataacgtgtgtgtccttcctaagcaataaacacataattgaaattagaacatacattttactaaatgaaagaaaatatttattttcataaattttagttttatttttcaagaaaaaaatctcaattacactttattttttacccctaaaaaccaataatgtattgacgtgcattttaaattggttttcttcaatgtcttttttccagtaccttttaaattttttttttggtttacttattttagagacagggtctcatgctgtcacccaggctgcagtgcagtggtatgatcatagattactatagcctggaactcctgggctcaagcaatcctcccgcctcagcctcctgtgtagctaggactataggtgtgcaccactatgcccagctaattattttattttttgtagagatggggtctcattatgtggcccaggctggtctggaactcctgacatcaagctatcttcccacctcagccttccaaagtgctgggattacaagtatgagccaccacactgggcagatggcacttttatgtggtgcaaatgtagctacacttagattactttttcagaattcctttccctgtgtgtctccaggatatcattggacacaaaagacattttacacaagatttggaaggtgaaagtgagacagaatttacatatatatattttatgttttggagatcgttgctgggctccatgtaccatggctgcttacaggtgttggcactgatgtgccagctcacctccttgggatggagcaacacccagatccacagctcttctagccagatgtcttccttcaacttctaatactgggccaaatgtgtcatagcttcatcatgaggaatatcaggttctcttgcaagtcacccaggcctttgaggttggagatggtagggagggcagatatgggttcaagtgtgtacttgagaattctaattgttctcatgggtcccagcttctctttgctctcatctacatgtggctttacttctccactgccagtgtggcagatctgtgatgtcttaagtctcaatagtggatgcagagggaacagcttgtatagagtgcccaaccaactttcatgattattccagatttgactacagtgtaccccatatcactcctagtgagttctgcttctctaatagaaccatgacttctccactagagtagtctcagatattgagaaccaaatagaatatgcaccgtgccatctcatggcagaagctggcttttttgttgcttgtttgtttgtttgttgatcctagtttctaatcagtggtatggaactaaaaatctattttttaattttaacattataaaaaattatcagcgacagtaaattcagacagggagttagaagatttatgttccaatcccagccctaacacttaacttgcagacttgagtaagaatgctctgaattttccaatgaaataaggattaaaaggaaaaaaaacgtgctttgtcctcttcatagagaattatgaatgtaaaattagacaaaactattaagatacacatacaaacttgcatgcacacacacacttacaccataatacccattcaaaatgtcttattttatgactaaatatgtcatcatgaagttatatactttgcacaatactagacatgggatatgaactacattagtcagacagcctcactgtgtaaatcattaaacacttatgaatgcatttaccccatgttaaaaaaaaaaaagcaaatagtactttgtgtctccatacttcatgatgaaactgtaagattaaacttgacggccgggcgcggtggctcacgcctgtaatcccagcactttgggaggccgaggcgggtggatcacgaggtcaggagatcgagaccatcctggctaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcgcgccaccgccctccagcctgggcgacagagcgagactccgtctcaaaaaaaaaaaaaaaaaaaaaaaaaaaaacttgacacagtatgtgaaattgtaaactagtaggtattctactggaaatatattaagatagttttagtaccaccagcattattaagatgtgtgtgtatcttcccactgaggtacagagtccacacatggaggtactgactaagttttgtgcaactctcaactaggtgggagcaatttattttttatctaggcatgattcctgtttgtcctcattctcttggtcccttcagtcttttaggtcagttcactacttgccttttccttttctaaaataagtagtatagcagaggtcaatgctccaaaacattcaaactgttaccaattactttactttggagtgagtaaaacatctataccacaatgactagataaagaatgggcttaatctttccttgccatcccttacctcagtcaacacaagttgttgaaaaatgactgatgaaaaagcaaggctgagaatgaagctaggtccttcatagaaccaagatgtagtttgcagttgttgaattgcgcattgatcaggaatgtacagttacagtcatatatttcaggtataattcctattatcctgaaaggaagtagttaatctgtcattcctgttaactgaaactctctgccacagatgctaaataattgtgagcctgcttaagaaagagatggcaaaaactattttgtgaatataaattttttaaaacacacaatttttatttgcttcattaactgctactttaggggagagaaataggcacccactctgtgaactgatcatcttgataagaaagctaatgagacagaagccacatcaggtattgtcaacttcttttcctggtaatcaatacaagaacagcatcagcaatcattgattatgtgtttcctgtgtgccaaagattatgctaagagactcgtagggagtatataatttaatcccaacaaaccatatgcaataataggatcatataattttgcagataaggaaacagtgatgtagagagggttcctggcctgcccaaaattaccccatgttatcccagctatagggttgtccgacaaaacatcaaaaaaaaaaaaaaaaaaaacagctacattagaattcagacaaatgacaaataaattttaaatataatgtcccaaatatgtagtataagtatgcataaaagaaaatttgccctggaccatttaaacaggcaagaaatactattcatgactattgcaatggggagagagactatttcaatagggaaaagagactgaacagaattgggatgaaacaaaagaagagtttttaattgctgggtgagctagcagaaaggtactagagaatgctgggagcaggttgttcaatgtgactaggccatttgtgtttgctaattggtgcttattaaaattaggcctctgccccctcacagagactgggagatatagaccctaactttcctaataatcacatttcaaagggatagctctcaggtccttgagaacgacatttctgggatatagaagattcatatatcaaaggggtagaaaactaatgtgcaatttcaagctttctaaagtaaatgctcttaagaaaatgaaggtcaagggccaagagtcaggaagaaaactaaagtttagtcaagctagagaatgttgaggtcatcctggtcatgtgtcccaaatattatacaaaatataattatactaaaaaaaaatttgctaatctgaaattcaaatttaacagggcatcctgtatttctatctgctaaatctagcagccccatacaacgagcaagttgtggaaccagtacactgcattgatttgctcctgaattcctccctggcatataaaagcttttgattcagtgtttggtaaataaccaaagtttccagactctgtttccattttctattaattctctaactatccctatgtgtatgttcattttgtttagagagaatatgaggattattgccaagtgggagtgggaggcaggcctcaaggctgaatcagagcacaattattccttcaaggattatacagagaagaaatattttcactacttctctacagagcacttatagctctgctgtgttaccttgacacagaggaaagcatagcaagtattaaagcctctaaaccagcaattatgtgcccaaagaaaagatacttctgtagaccttcattttttaaattatattcttcatatatggctaaagcttttctttagttgtgagaaaacttgccccttcttgtttcaaaaaattaaaaatctaaaaaaaaaagaatccacacaaactaatacaaattccatattaaattgtagtcattatgtttatcaattacacacaaagtaattatcaaataatcatgttttagcggaatctaatctttttcattgtgttgaaggaggaatccatcacttttgttgttgtgcacttatcaacaataatttttaatatttttcaaatgcttatttagcatctgcacaggtgattaaattattttttccatagatttcttatcaaacagaatcatactaataagttcctaatattaagccattcttgcattcctgaaataacccatactagattataatgtggcatgatttgcaagaactgcttaatttgagttataaatattttattttagatttttaataaataataaaataatacataagattcttgtgtttagtacaatctttgtcaggtttttatatcaataatacactcagtcccttaagatagtttgtaaatgtacctttattttttacatgctgtaataaattaaagagcattacaattatttaaaaatttgattaaaccccctacgtaaccatctgagcctgaggtttttgagtgggatcttcttgatagcattcaatatttcttaaatgaaaatagattaatttgaattattttttaaaagtctgttttgataattatattttcctataaaattatacatttcattcaggtgtctaaatgtattcatacaaataataatattaattttcttttctctctttttaaattatttatttttagagatgtaatctagctatgttgcccaaatgccagggctcaagtgatcctctcaccacagcatcccacatttttctttttgtgattagtcaaccgtttattttactgttctactcccaaaatctatttgcatattgcttttactgtttttaagttttcacaataatttatttttgcatttatctttattataaattccttacttagaccttttattagtgtattttattttttctaattattttgcatctgacacttaatttatttgtccttattctttctttcttaaaaaaatgaatataagttttaaggttttgagtttcccttagagcattatgtcccttgggttctgatagatattatttttatttttctctgtaaatcttattctccagttttggtttttcctctttgaactaagagctgttcgaaagagagcatttaaatccctcagtggaagaatcttttgtgggggactgattttgtttgtatgcatagattttctgcaccatcatgggaatattatctgtattttttcactttcataaatttattgaaattacttctggcgtaatatttggttaatttttatgaatgttccatctgctcttaaaaagaagatatatttacatttgtaggaaattgaacattatttatacactattagttagatcagcctcttaaattattttttttgggtagttgctatagactgaatgtttgtgtcccacccaaaatttgtatgttgaaactaatcttcaagatgatggctgatggtatttggaggtggggcctgtgggaagtggttagctcttgggggaagggtggctaataaatgggaatagtacccttataaaagagaccacagagagctcccttcccctttccaccatgtgaggacacagtaaaagtacagctgtagagataacaggaagcgtccctcaccaaacgccagatctgcagcaccttgttcttggacttcccagcctcccaaacagtgaaacagtgagaaataaagctctgttgtttgtaagccaccaagtctatgatattctgttataacaaccctaactgactaagccagctgccaacacttacagtttgtcaacttcatttgtcacaatctgagtatattagccagctactattgtttccatttatctttatatttttataattttctctagtacaactttgagatcatgagctattggccatttgaggtttgtaaggtatatgtacagatgcatctacatattaatgttatgtgccatgttcatgatagggtacgttgtttctaaatttaactttattttctccaaattgcagtgtgtatattatgaggtaaagaaactgaataaaataaaatcatgtcattctcattactctactgattctctaatagacaacaaaccttatctgcccctatcatattagaaaaatcctgtgagtaccttttaaacatttctatgcaaccaggagcagattttcataagacctggtctttttaatagctttttcacaagaaaactggcttttacatcagtaatttaaatactaagttcacccacattttcatgttttcttggtgtgtgaaaagtgggcttaaactcctcacatgacttctacagagaaggaaacagagagaaaccagtctctcctgacctgaaaaacgaagtagccactggactgtgggcgtgaattgttctaaagaattcagtgccttgtcacactgttctgcctggtccatctttgaataaaaagtgcctaagcagagtttctttttcttattattatctgcttgctactcttcccccaaatcaaactaacgtgtattctagatctctaaattacttgctccttcttcagagccctcagccactcaatctgttacctcctttttcaagctgtattttttctttctttttttctaagtaaacctgacccacgaagtctttcttcatatcttcagattttagcattaataacaagtcttctccgaagaaatatcaaagagctttacattctattaattattctcctcatgttttcatctccttcctgtgtgatagttcctcatatttagacagtcatataataaatgttaaactccttgaagaaaaggaacatgcacttcagcaaaatgactagaacattcttttattccagtgaaactgaaaaaagaaaaaaaaaactatgtttctacagttacatgtatcagctattaatattctaatcacagattttgaaactagaaaagaaatatcattgagtcaaatccatgtatgttaaagttaacgaagctgatccacaaaggggggaaatgattctcttaatacctaaaacaactctatcattgttcagtagcctatttcttcaaacaatatttctactcatcatttatattatccctgcataaggataacttcctaggtttgtccttcagtcatttgagctacagatccagggaggaaagagttgtatgttttgtaaatctgaccactgagcttccctctaaatggggagtggcttgggtgacctgagaaaagggttacatttgtataaataatgtgcactaatggtgttcatgctgctaaaaaaatgctcctgctttcaaactatgctgcctggagagcacaggtggatttgtggattagctgtttaaatatttatgaagctatttagacatattttatttattgtaaaaatgtttatactataattatttcaagaattaagctttcacatgctatcagaggcttaaactaaaatctaattattctcaatcatatcctcctaatgctaggtcatgtccaagtggcaaagggtgagaaaagttctttaatggatatttgttgtcataaacttattgatcaatcaatcaatcaactcatattttcaaagcatctcctttgtgacaatctttggagagatgtgttgggtactctaacacagacttacaatgatagtaaatacatttactacttacaaagtatcaggagctggcatacattaactaatttaacacaaaagataatcattgaagtaggtcctattatcattccctctatatagatgaagaaacagtcattagattttaagaactcaatgttaattcgaaggcataggttattagtgtaagtacaaccaacaactcttgataaatgtcaaagtaggattgagaatcaattaaagacttatgagagttgcaaaaataaatcacacaactgagtgattaaaatacaaagaaatcagatatctgtaaagtcgtgacctatgtaccatacttggccatagtcaaatgtatattatgtagctcacattttgatgcatttaattatctcccaaaattgaataatcagcagacttcacataaaataccagatttctggctcctcgtataaaacaaaaaattagaagatctagaagctcttgcttcacattttcatatgatcacagtcagctggatctaagtaccgtttacatgtcttaggttagtatttactctccaatttaccataatcaccactgctctctaatgtctcttagaaggagcctaactcactcagatattctgctctcctggcttatgtagtcaaatgtgctaatgtacattgcttccttatcattactgggagcaagatgttatcggacatgtgaaatgaacataccattattttccctgtccagaagctaatggtcccatttagtagagaataaaaagaatagctcagagcaggctctcagtttcattcgtgtattcactaatagtgcatccatgagaattagatattattccccttaaatatacagggaccatatagtctttatcattcatacatgacacttatttctcagtgtgggtgtgggtgtgtgtgtgagagagagatacctgcacatggacatgtgattactagcctaaggccaacaaatactcttgattaggatgtataggtcaaacaaaatttttaaaagctcatattatatgacttcaaggttgttaacctaatcatttcatggtaattagaaaccctaattgacagcttagatttatttcttaaaaacctaaataaacccattgttttaggcattctttcaaaggcaatcttttctcagtgaaaatactgcgggactattctatttggtgcttagtgaaaatattttgaaataatgtatgtacaattattaaattcaaaattatttttgtcaaataaatagcagttaaaaaaaaaaaaaaagctcagatctctccctttctttccttttcctccaagtatattttagttaattttcttttttttaaagcactctgtttgatttgagggtgttttttctttttttttttcaaggtaggacaccactcaattttgaagcaaattagttgaaaatttaaaaatcagttaaaaatcatagttcctactattttcacttttcatacacaaaattttaataccactcttcagtaattttctttctctcttttattttactttcctttatcccttctagcctccaggagagaaacacaattttgggcaatgtttatcaagtaagaccaaacctcaaacccagtaagatgacacgcctgatgctcgaactgtgcatttaaataaaaaaccacaggcagacacaatcctttctccatacagaccactagacagaaaagtttggggattttaaatttcaagcttcctgacctcagaagttcccactgtgaatcacagtcacatatacctgttacagtacacttcttttcctcagtctatttaggaaactgtctttgtgcattggccctcaaaatttctcattttgtgtgcttctggtatggtggcttgtcaactcttcattgagttgaattagaaagcagaagagaatgcaggagcaggccctttatcaagaatttctgtagtcttacttacaaaatttcaggccttattttcccttcttaacttttttttcatggcatttatgttttgcaccacaaaagacagaaaacatgcttttaaaagaagcaattgcaagtgaaagtttttaggagggaaaagacacatgaggaaagggtgacgtggcttattttgaaagtgtgaatcacacactggaaccgtgatgccaccaaaaaaaccatggaaatacaccttcagaggtgaaaatatgattttcaggaatgtgataatagtttctacagagcacacagaaaatatcactgaaattttgttattccttttatttctcactaaaaagattagaaaattgaaaataagaccttatcataacaaataaatttgatatcaacctttaaagtttttgttaaaattaaatctcagaactgtcttagaaaaacatttgtactatcctgcccatttcttagttaagtaccattgttgagtgaccttggaatagcaatggttctcacacttggctggatattgaaatcacatagggacttaaaaagtgccgatgtctgggtcccaaccacagatattgccatgtcattgatctggggaacagcctggacatcaaaacttttttaagctcccaagtgattcagatttcaaccaagtttgtaaactactaaaaagaggaaattattttaactataaaaatagaaggagaacatataaagaagtaatattaaggagagaaatcagagtccctcttttctttctgaaacaagtcatcacacatatagaaaagagggaagaagtaattttgttctccatagaagagataaacaatagaaaacatttatactttgcactaaattctttattagatttaatgacatatcaaacaaaaatagcaatttcatattgttcaacctatgccacaattggctgacaaatatagatatattaaacaatggtaaaatgtttaacaatataaaggaaattactatgtatcaatcaggtttactcatgtgtaaaaaatatctttttcttaaaattttatattactttacagtttcccaaatactttaatacttaatgtcttatttgattatcccaatatctcaacatggaagagtgggaagatatcttcattttacagaaaacttaaggggcatgccaaaggtaacacttgcttgaggttaggcccagaaagacagtccaatgtctccgtggataaacgttgatttcttaaaccagccatttcttgttttgaaagctcttcactttttagataatatgaccccagaacttaggggcatttatgtgtctaataacaactctcttgaaagctttctgagaataagatgaagatgctgtggttgaatgtacagaaaagatgactatgtcctccatgaaaacaggatagtaccacttccatgatcttttgagtatagagagaggtaactttcttaaagaaaaaaaataactgcaattagagttataataggatcacctttgttctagactgtgtatatggtatattaatggcatttaatatctgatttaatcccttaaataagcgtatcgccctttaacaaggaaggaactaggattcagagatttgtgtaactttggtgtgcatactctttccataagtctagaggcataccaaaaaaaaaaaaaaaaaaaagaaaattaactctcttgaggatgagtagtcatgagttctattcttggttctgtcaccaacttcttatatgatcctcatcccacaaaaatattctccacttctcagaaggtcaagtcttaaggcctcatctaactctaaacttgcgtaagtataggggccatagttcaaaatgcaactctaaaatgcttagaatttagcttctgtttgtaaaatgcagcaggtatttactgtctgcaccgctcatatgttttaacttagtctaatccaaagacctctattttcctccagtgaaccaccttccttttcccagtcatagtgcaagaacttcaggcagaactgtttccacctctgatttcctgaactgacatgtgacttcagcctcattggttatatactcttcaccatggtaattcagggatgggaggtaacccaattccgatcaaagagatcagggttaagagttatttttccaaattagtctaaggaaagtttgttttctttcttgctgaacccggaggccgaatgacataggcctggagctgctgatggctcttggtggaacctgagaattaaaccagtttcattgcacagccaagggatggacgtaaaagatgacctgtcaatattgtttgaatccctaaatcaaaagttttctacaatttttcagtggtatgagtaataaatttcctttttcttttttttttaattattattttaatttaagttttagggtacatgtgcacattgtgcaggttagttacatatgtatacatgtgccatgctggtgtgctgcacccattaactcatcatttagcattaggtatatctcccaatgctatccctcccccctccccccaccccaccacagtccccagagtgtgatgttccccttcctgtgtccatgtgttctcattgttcaattcccacctatgagtgagaatatgcggtgtttggttttttgttcttgcgatagtttactgagaatgatgatttccaatttcatccacgtccctacaaaggacatgaactcatccttttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcctttgggtatatacccagtaataggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttctgacaaagggctaatatccagaatctacaatgaactcaaacaaatttacaagaaaaaaacaaccccatcaaaaagtgggcgaaggacataaatttcctttttctgtttaagtcaacttggtttgattttctgtcacttggaactgaaaaatttctagccagtacttacaccccaagcacatcctttattggaaaacacagaaacatttgggtgatttaaaagatagaacattgggtgatagaaaagaaacaatgggtgattattatgggtttaggtcatggatgcctttgtgacaaaggacttaatttaatctgagctccggcaaagcagacgactcattagaaagctttcggatatacatgaaagaatgtctctttcaaataggattaaacaatagaggtagttaatgacacaagtaactgtaaggactaaaggttcatcaagatcaagcagaccaacgatattacaaagatccaatttatttctatatttctgtgtcatcttttgcaatggctgtttcatcttaatgctgtcgcaaaatggccaccagcagttacaagagttacaaaccactttgttctcttcctacaagtcaagagaacattatttctgacagctctcttaaaagtgtaagaaaacttctttcttagacgccctcattaaatgtctgctcataactaattggccctccttggttcctgtgccttgaaaccctacctgtggccctgggaactgaatgtgctaatctgcttaaattgggactgggtttagcttcaccagaagcacaaacgctaagtaaggggagagaaggagtgaacatcacagccacaatcaggatactatcgctaagaggatgagggagtcggatactgaactgtgaaaaattacaaatgttacagacagcatcaagtggccaaacaattacagcagattgtatctgaataaaaattattacatgggccctaagtctgtgggctgcatttttgtgccaaactgattactttccacagctctccaggttgtgaagtacatgtggaaggacttcaatgaagaaagttgtgttgaaaaaagaatgggatggggcctgttgaaccaggtggccttgcctgcatttcagaggtcgctctccaaagtcatatgtaaaatctggattaattaattttgatggatacaacttgaaggtgaatgaaactctctgtatatagtgaagccaagctgtttccaggaaggaatatttctgttaaacttagcatttttggtataaacataaacgtgtatagttcaatgtccacattaaccacaaaacatgggatttgcctccataaagcatgcaaaattgtttgaggctacattatggtttcacattttcagttctctccgtaatttatgtattcatttcacaagtatttagtagtctcactgcatgccagaagccatgttactcactaggttttaacagtgggcccatggtccaaactctgcattgagtgtcccacaaaaaatgtctacaaggtgaactaggaaggagtactagtaataaaaggatttgcaggcaagacagccgaagtctgataaatgtccacaccaaaattatcatctctacttacagataaagaaacaggacttcagacaagatgagtcatgaattctttattttcatactctctaagagttaacaagtcaccagttgtaccatggtgagagacgtttatgatgtatatgaattcctgggatataggattgatttttgtttggtatcctgctgtattttgttctagtttttaattcctataagttttagccatcatgtaagaattcagctggattcatacaaaaattattgataattagttacccttagtttcaggtttccatatatcttgctttataaggtacttctaaagtcataagagaaatttaatcaataaaattatcaaatatttagcatatttaaatctcagctgatccacaaggcatgaattagagccaacatgaacaccccttcttaagagatatttaattttcagttctgactcaaagatatttattcattctttattcaagagctagttgagtgtgtgtagcactgtaattgatgctattaatacaatgaattaattagaaatttggttgttgccgaaataaacagaacccatactagcttaaacaaaataaaaaaaaattaaaaatgcaacattttgactaatttaaccaaactgtagatggggcagaaatggaaccagtctttggataccacagcaccagggactctaatactttggacttctttctttctgcctgtctctctctttttctcttttatactttatcttatccctgattacgcatgttgatcttattcccttgggccagctgctctgatgaaggtggatccagggcattagacaattctggaattatatccacatgacctactaaccaagaggaaaacagtaccttcctcaccatgttcactttaaggacttcactgtgagacatatgccacgcccaacctcaaccacacaggtgttgggggctcatgagttaaacccggtcacaagacaaaaactttggccaaagttagtataattttcaaaagaaatgtagaagaaatcatcaaaacagatgtgatccctgccatcatcagagctttcggtataacgtgcaggacaaaatgtgaaacacataaattcatattaattacaatcgagatgagtgttaattagaagaaggatattttagaaaacataatatggatagtcagaaaaggattcttccaagaaagtgatgcctaagagagcatagtagttaactagatgaagggtgtgagacgttcccaggcagaggggaaaagaggaaaaatggaaagtataatgaaggcccaaaaatatgctttacagagtaaaaattagaaggttaaaacatcaaaagggatcttggataacctttaataagattttttttaacttctaagggtgtatgagagctaatattttattcacttcattaacatcttttcttaatccagttacacttacagaacaagcacagggctaggatcagaagacctgcttctgacactccatatactggatgacctcaagcaaatcaagcatttttccctgtcaagcattttcctctgggcactccattttctcatctttatatgaaggagattggattggactaagacatcattcctaatagtctgtgcctcatgcaaatgatgtaagctttgagaccagcaagatttgacattaatttggggtaaggacagaatgggattaagcattagccccatggagtgtcatatgatgaacggcactaaaactttaccagggtgataaaaaactacatgaaaatacaatgagatgaaaaaaatatatatttaatagagtcattgacaggaaaggttcatttaaaaggactacttggataagtcacccaggttggggataagaccaccaagtgacatgctcatggaagaggaacctctgagctatcttctaaggaaaatcaggctgggtaactgagtagttttgtttttctgattagggtctactaatttgtcatcaaagtgaattgtttaggaaaacaaagtagaggatgaaaaatgctaaccagccgtggtcctccatctccatctattttctatacaaatctcagactattccatcttctaaaactgaaaacatatttactgcctgggtgcagtggctcatgcctgtaaacctagcagtttgggaggctgaggcaggaggattgcttgagccccaaagtttgaaaccagccttggaaacatagtgagatcccacctctataacacgtaaaaaattagccaggcatggggcagtgtgcctatagtcccagctactcaggatgctgaggtgggagaatcccttgagcccaggagatcaatgcagcagtgagctgtgattttgccaccatactccagcctgggtgacagattgagaccctgcgaaagaaagaaaagagaaaagaaagaaagaaggaaggaaggaaggaaggaaggaaggaaggaaggaaggaaggaaggaaggaaggaaagaaaggaaaggaaaagaaaaaagaaaagaaaagaaggaaagaaagaagaaaagaaaacatatttactggatattggtttgaaaggttgccaaagtattaggctgtccagaatatgggttttggtacagtgctggtaaggaggagtgccttttgggttactgaataccacactactgcacttacctaaggtaacagatggaggtggccaagtctttcttttgtttgtttgttttagagatgagagtctcactctattgcccagtctggagtgcagtggtgcaatgatagatcattgtaacctagaagtcttgggatcaagccatcctcccactttagcctctctagtagctgggactacaggagtaggctaccatgcctggctaatttttttcccccagtagagacagggtcttgctatgttgctcaggctaagctcaaactcctagcctcaagtgatacttctgcctcagcctctcaaagtgttgggattagaggtatgagccactgcattaggcctgggcaaatctcgatgctcttcaagtggttgccagaggatgtttagcatcagatcccaagatatgagcacaactttgtgagttatctggtacagtataacatcattcaaggtttatcgcttatatacaatagccgtcttactgtagacagcccctaaccaagagaatgttgagaaagcctcaaattctgacagggctgacaagggaaggatgtgagtaggggcactagtgatcaaaagcactgactgtgaccttcagattgaaattaagcaacctgatgcagtaatatctaatcaggagagtgaaaggctgaaggtacaatcacatgtttccaggacactggtagacatggaagtaaattatcaatattaatctttgccaaaagaacagtagatttacagtgtatttgagttcttcagaggcagttgtaaatatcatttatcctattacatgctttctggaaaggaacacatacagactaatttggttgtttgttgcaatgaaaggagtcatcaggatgcatttttaatccaaatagatctcttgtgaaattattttccggagacatagtctaatgacacaaactaaaacagtatctatagctaattttggagtcagtagagaacactgagatttcaggcatctttacttagtgccactttcttttataaataatcagaggaaagcaaggtggtagtttggtgtcctttgtttgcctgttttgttgttaaccttgaaggaaagattgaaattaattttaaataatatctgcattcttatccatccacaaaagaactttattttgctttgttttcaaaaaattgcctctcaattattaaaatattctaatgttttagtcctttttttcccaaaagagggtattctgataaggaacattctagactactagcagaattaggttaatacttttaatgctttttttttttccttgattaagctgcttttactcattttaggcctcattttccctttttgatcatgaaggtatctccctaattcactgcaatcacatgaaaatttagcataataaaatttcaagtcacctatacatttactagttaaaaaggagaatttctcccattatctttaagatcagagacaacattttgcatctatcaattcctcatgcagtgctttgtattgtgtaaacaataagtaaatctttgatgaagataatcatgaagaagataatggtaataatcatgatgactatcaaataaaaataagttaatgtatgaataatcattttctaaactgtacatctctataaaaattaaagcaatgttgaagagaactaagttgtcatcaataatcatagattaccattatcagtgatgttaatattattcacacagatatgcaatgatctgactttctcatcacctcattttgcaagtatttcaggataaatgtgtgccactctgagttatttagaacaaaacataaatggagacttatcagcaatttagcaacctcagtaatattaaagttgttaaaacaatcaaatacagacttaaaagcaactaaatctgctatatttgcaagcccaaaatgctaccttaaaaaacttcgtatataatgttggttttatttccaaaggtcaaaagagggaaagattttgtacctgaatgttatgatgaacagcttagggaataaaataactaaaatacattatacacataagttgcagtcatttgaatatataatctgtgtattagcatcattaacatattcacattttcacaccatctgatgtttgccaaggaattataaattgatgtctccaaaaattacccaagcatgttgcatagagaagcaatgcaagaggtggagaggaaaccaaaaggtcaaaacaaagtgtttctctcaaatggagccagaatgccttaaagcattcagtttgcaactagataatctgagttaaatacttgaaaataatgcagatggaaggactgtgaatgttgctagaagcatgagatttccacctgtgattttctcacatttctgttattgatacttaaaaagtgaaagtgctatagaagtgctccccacacactctgttaacaaacatgacccttagcccttcaaaaaatgcctaatgctaaaacagagtaccatgaaaagacacatccctaaataaagagacagctagtcgtgaatggaggctagggtacctctcaagaatcctagcaattgcagaaatctgatccacttggacatttgtcttgtgaacaaccacatggcaaatcaatgaagctcatttatagtttggtaatggttgccaaaaaaaaaaagatttctaaaaacaaaaaattactgagtctgaggtctcagctaagaactgtaatgtgtgccaaatttacctattcttgtaagtccactttctatatggatagacactaaaagtgaagcctgctgaccgatggatagattaaccaaagattagaattgatattaaatagatcaaaaatatttctaaagaatttcctgctaactctccagagcatagtagggcctccgagcttattaatgttggtgctgtttaggctagaaagtagtactttttcttgtcagggttctcaagattgtgagagttttaaaaatatttttgttatgataatgggctctagtaaaaacaaccatcatcaacaaataaataagtcattgacttgattacagaaatcaacacagtcataatcatatgcaaacgtggtaggtatatattatccactgatgctcacaccaggcatggtggtgcatgcctgcgatcccagctacttgggaggctgaggcaggagaatcgcttgaacctgggaggtgaaggttgcggtgacccaagatcacaccatttcactccagcctgggcaacaagagcgaaactccatctcaaaaaagaaaaaaaaaaaataggaactactaaacaaaaattattaaatgtttcaaatgtttacatttaacaaattaatgtctgacgaatgtcttttttcaattctgccagtatttctgggactacatatactcccttatttgaagatgagatcaaaaatttaaatttgagccactgccctattgtgattgccaggcttcccctgtaacatgggatttgattttcaaatatgagtgtgtgtgcggggggaagaataataggcaattactttatacaaatatcattatattggaaggaatggtagacaaatagaaaatactgtttgaaactcaaaaaacgtcaaggatggagaggaggaataaatatttaacatatcaaaagcataatatttgagccaggcgtggtggctcacgcctgtaataccagcactttgggaggttgaggcgggcggttcatgaggtcaggagattgagaccatcctggccaacatggtgaaaccccccatctctactaaaaaaacaaaatttagttgggcatggtggtgcacacctgtattcccagctactcgggaggctgaggcaggagaatcacttgaacccgtgaggtggaggttgcagggagccaagattgcgccaccgcactccagcctggccacagagcgagacttcatcaaaaaaaaaaaaagcataatatttgaacatgacttctcacttataattattctctaaaagagtatcttatattctagtcattggaatacattttctgttactagaaggcaaggacagtgtgttaagcacataaaacaaacaagtactggactttaaaaagtgagcaaaacagcatcaccccataacattgtcctagtgttgcctggtatgttgtcaatgctcaaaaaatatttttatataaatgaatgaatacttgtcttgttgcaatgttaggtagcaggtcgattttggttgtagtattttgcagcccatgacttattttccttttcttaatcaagttggagaatctccaatacaaagtgcatctctggtgctttatttcttaatatacctacattctgcttagcaggcaatatttggtttggctggccttaagtaagaggaatctttcattagtagtttgagagtgtggcttccatgaaatatgtaatcaatcttgcatccagtgcatgaactcttgctaaaggcatgtattgcatgaaccctctacttgaatccaatgctctgcgaacactattcaactttcaagacacagtgagccaagaccacatctttgcagtatctcactggcttcagtgatggcccagctattattcagggacggatccaatagtccctgaagatttatttcctttattcttgacatgtttaaatgactagctgcagatgcatacaatctgaggtaatttagtcaagaaggaagtgcgtttactctagcgctcctctgccgaaacggtctagaggaagagtagattcgagaagcagccctgacataaagcatcgatacatccatctactcttttgacagatttgaataactgagaccaaactcttttattgcttgactgaattagactttttactttctctttctcctatgcaaattagatactaacaactctggtccttcataccttagaaccaagccaatcaaatgcctatttctttgagcttttgtgtttgaatatattcaatagtaataaaataagcagaaaaattaaagccagttctatcatattttctccacaaaaggcccttatactttgaggaaaatgtaatcaattaaacagtgacctctgtcacagtagggtcttcaacatataaatgaaactatataccttcatttagttaatggtccatagtaagtacatggagatacaaatattgcaaaattctgtacatactgagaagtagtctttaagcaattcttgtaagactggtttcagtgggcttagagacttctcttacaacagcactaaagaaattagttacataggctgcaggaaaatatgcttgtttagcacaaaacagtaagaaaggaggtggcaatgattcaccttgactacagggaatgattttataaagaatagaaatgataagtaaagaagttttatttgaaagcatttaagaagcaattataggcaatgaggggtaaaaaaaaagatgaagtagtaagtacttgaaagcttatgaataacaaataaggcttattcaggtaataacaggttacagcaaagttgctggaatatagtattccatcaatattaaggagaaggataaatacattcatgcttagctatttgaagaataaatccacatatgtatttttgtcactcctccaaaagaataaaagggtgcacctggtacacaagtcaaggttctatggtcccaatcagggtcaaatttttaacaataagtcaaccactaaggtacataaaagagccatgcacagcaataacattagttaaaaatgcaaaattctcctgagctgatacaactttccaacaaaaatattatccttaaattgttttcagagcttaaattaccaagactaagcgcaaatgcttctagctaaggctgtttcatgatacattgggttgtaaatttctcaaaaagaatgtttctattttaataagcttgttttcttcttctttctcttttcttatttcttttgcaatagtgtactttttctcattgacctttaattaattacctttaaagctagctaataaaatgtattgctcttgacatagatatctagaattaccttaatttaacacgttttagggcattcaactaaaaatgcaaagagattgtatttttttcagaactcagggccatagcataaaatcagatgccatgtgttgttatttccctagtgcgttaattataagaatatcttttacctgaggagtttagattgtatctgtatgcactttggttcgtcacataggtgataagtaagctgaaaccacagaatggtctgacatagaggtggagtccagagtttcagtcatcttctctaacctcagcctagttatttttaatgtctaagctaatgttattgaaggacaagttgcatgttattcaataattattttcacctctgtactaaactgtttcctaacttagataaccattacatattgccattaataatcctaaccaattataagataagatggaaacctggttccatcttactcactatgtaacaaccacatgtaattcctgatatagactgagtgcgtaacataaatgatacggggttaaagacttaggagttcactaactccttcggttgtctaaccttaccctcttgaatctctgcaaaagtgaacacatcagaggagctgccaagcagttgtgatttttgaccccttcctgtaaagattttatgaagcattaaaataaacccacattacacagtaaatacaatgttaaaaataattctataactttgtttttaaaattgtgtggctgtgagaaactcatttaacttattgcccatgatttctcagcaaacatgaggcatattcaaggattctgcaaagcgagaaaagtctaaccctcacagcgttcccataagtgatgaactattttggaaagtgaagttgacagaatatgtttttaacatattcaatcaaatatttattaatgtatattttgaggcttctttttcattttttggagaccacatctcaagtcctctgaaggtgctgaaaaacttacaagccctaaaaactggagggtccaaagtatgaaacagttccattttcacacctactttaactagagcagatcgaatttgaaccatcttacacattggacatctgctaaaaaaatatataatttttggagttggcaaaccactgatacagaactttttagcctaccaaatgtgaaaacataacaacatacacccctctttttaggaaaatgattattttgggggaaaatcataaagctatcacctggacatttcatttattcaaatataacgcagtcaatggcctgtgcttctatatgtgtaaattatctttgggatttgaaggttagttagctaaattacttgggctatttttttaaaaatccaattcagacttgttctgctatactatattcttcctcttgagatttcagctccctgagtctcctgacatctaagatctgagaaactaaaagttatctaagattagtatgtgggacattttaatctctattagaagatgaattctaacatattttatagataataaatgctttcaatatatcttcaataattgcagggagtaataaaacctgtctagtgtaggatatcatagtggttgataaaatgatcctattgataatcatataagatccaaatgatttcccaatgaactcccctttctttctaatcatgacttaagatctttgctgaatgcccatttcagattctgtgtaaacacatgaaatatggcttggagcttcttaatacttaattgtattaaagtactaggcctgtgctttaaatgtttctagaagaaaattgagtccttaaagagtaagacaagactacaatttttcatacagaatgcccagcactgaaaattacattaaggaagaaaaccaaatcaccaaatgccaagggaggtattctacttccaatagggaaacagtatcttgtatcagctcaattctccttcagataacaattataaatctgtaaaagaagggaatcacaataggtggaccctatatttacctaaattctctctctgaggtaacatcctggttcactatgacacagggaaatacgtataaagaggtagggctgcggagacagagactggagttcaggaccaccagaatggtttaacattgaaaagccctctaaaataagtcaacttcagatgggaacattttaaacatgaatgcagatttacctcatatacttggctgagtcttaaactgcaaatatacaaggtaagaattttaaatcataaagcaacatctgggtagcgaaatagctaagcagagcttccaacagttgcccaatgctagggagagttgaggtaaaatcctatcaacttagaggtacttgataaatacattgacttttccactgaaatgccccaaagtctagtaattaagagtaaggaacacatagaaggacaaccaacatcaccttggaactaagggcaaactgaagtaaacccatcttagcaagtctaaaactgagcgtcaatatgactgaagtgaactgccaataaattacttccttccagaagaaaactcaacattctttaaaggaaaataacaaaatcggaaatgtctaaaatataccaccaatactgtacagcacagaatataattttctaggtgtgcaagaaagcacagaactatcacccataacctagagctaaaggaatcaacagagacatgtacacagataatctattaggctggtgcaaaagttattgcagtttctgccattacttctaatatgtaattctactatatgttagaattagtagacaagaacttcaaaacaacgactaaaaacagtttaaatcatacacaataatggatgaacagaatgaggaaagagatggagaacttcaagacaaaatgggaagtttaaaaatggatataatagaaactctacaactaaaaagggcaataataaaaatgaaaattcgtgggatgtgcttaacagaacaccggacacagaaaaagaaaagatcaatgaactcaaagagaggccaatataaactatttaaattgatttcagagaaaaaaactaatttaaaaaatagcttttcaacaaatggtgctgcaaaaactgacattcacaggtcaaaaaggaatgcaaacactgactttacacctttcacaaaaattaactcaaaatgtattatagaactaaatgtaaaatgcaaaacagtaaaactcctagataggataggagaaaaactaggtgatcctgagtttgccaatgactgtttagataaaacatcagaagtgcaattcatgaagaaaaacttaaagttggacttcatcaaagataaaaacttttgctctgcaaaagatactgttaagagaatgaaaaggtaagcaaaagacaaagaaaatattaacaaaacacatatctgataaaggacttttattaaaaatatacaaagaagtcttaaaactccagaaaagcaaacacacaacacagtccaaaaatgattaaaagatctgaacagacacctcaccgaagataaactgatgacaaatgaacatattaaacctgctcccgagccaggcatggtgctgtgtgcctatagttccagctacttgagaggctgaggtgggagaattgtttgagcccatgaatttgagaccagtctgggcaacatagcgagatttcatcttgctttaaaaaaaaaaaaaaaaaaaaaaaaaaaaaaaagatgctaaatattgtatgcctttaggaaatagcaaactattaggttggtgcaatccctttcatgccaacctgataaaacatccacgagatactaccacacacctatttgaatggctaaagttcagaacactgacagcaccaaatactagtgagaatgtggagcaataggaactctaattcactgctggtaggaatgcaaaacggcacagccaaattggaagacactttggcagttttttacaaaactaaacatactgttagcataagatacagcaatcatgccccttggtatttacccaaatgagccaaaattttatgcccatcaaaaaccacaaatgattatagcagctttgttcattactgccaaaatttggaagcaaccaagatgtgctttagtagttgaatgaataaacaaactggtatatccagcctatgtgatactatttggtgattaaaaagaaatgacctatcaagctatgaaaagacaaggaataatcttaaatgcatatcgctaattgaaagaagccaatctgaaaggctacatcctatatggttctgactatatgacattctggaaaaagaccaaactatggagacagtaaaagtatcagtggcttccagggaaggataaataggtgctccaggaaagacggagcaaaaggtatttttagggcagtaaaactgtagtgtatgatgctgtaatagtgtatgtataccatatacatttctcaaaatccacagaatgtacactacaagtgaaccctaatgtaaaccatggattttggttcgttataatgtatcaatattggctcatcagttgagataaaggtaccatactaagataagacttaatcacagcagaaattatgcgtgtgtgctgggggtgggggtggtagcatgagaactctctgtatttgttttttgtttttgtttttttttgtttgtttttgtttttgttttgagatggagtctctctctgtcccctaagctggagtgcagttgtgcaatctccactcactgcaacctccacctcctgggttcaagttattcctctacctcagcctccaaagtggctaggacaacagtcacatgtccccatgcccagataatttttgtatttttagtagagacggatttacatcatgttggccaggctggtctcaaactcctgacctcaggtgatctgcctgcctcaacctcccaaagttttgggattacaggtgtgagccactgcacctggctatggattttctactcaatttttctgtaaacctaaggctgctctaaaaaataaagtctattaattttaaaaagtagaacagactatctaaactatgggcctatatcacataatctaatatacatgtaaaaggagtcctaggaaagagaatggggcaatggaaatatttgaagagatgatagctgaaagttttccaaatttgaagaaaatcatcaaccccaaacccaagaagttcagaaaacaacaagcagaataattgcaaataatatgttctatgaactattaggtgcatgatagtcaaattgctaaaatccaaggataaaaaaacaaatcttcaaaagcagccagcaggaaaacaaagcaaagaaggaatactactttcagaggaccaggatgagttataactgacttactagaaacagcaaaaatagaagacaaggaattattcttaatcatgtgaaaaagtcatcctagaagccatcctagaattctaaatcttcagcaataatagcatataaaaaaattctggaaaaataaaatttggtgggctttgtccccaagagactcacactaaaaggtgtttagttcaggctgaagtaataacaacttcctgatgtcttcaggaagatacattgctaaatgttacactttaaaaataatatttagaagactattgcctgttttattaaatattttaaatattgttttaaaacatgcaaagaaatgaaatatatgacaaaagagcatcactaaaaagccagtagaataaagaataaaattctctctaaaaatattcaatccaaaataaggcagaaaaaaaggaacaaagaaagatgagtccaatagaaaacaaaggacaagatggtgtatttaagtttaacaaatgtataaccacatacaatccaaatggactacactctaattgaaagacagatgcaatcccagcactttgggaggctgaagcaggatgatcacttgagcccaggagtttgagaccagcttgggcaacatagccagaccccatctctgcaaaaaattttaaaatgagccaacctgggcatggtggcacatgtctatagtcccacctatttgagaggctgaggtgggaggataagttgaactgggaggtcaaggctacagccatgattacaccactgcactccagcctgggtgacagtgagaatttgtctcaaaacggaaaaaacaaatgaaagaaagaaaaacagagaatgttttagacgcttaatctactggaggaagagtatgaaatcctccagttcccaagacccaagcaaagattcactacttcaggggaaagtgatagtagcaaaatccacctccccagggaaaggggcaagaaaccttctcacacagagaatcttgtctgactacaacagggctactaagcaggaacactgagaaagccctaatctgagccctgggctcacaggatctgcccaataagtgactacttgaggatgatgattgtattagtccattttcacactgctataaagaaatatcatagactgggtaatttgtaaaggaaagaggtttaattgactcacagttccacttggctggggaggcctcgggagagatagaaccatggtggaaggtgaagggaagcaagcaccttcttcacaaggcggcaggagagagaataaaagcgggcacaggaaaaagtgacacttttagaaccaccagatctcatgagactcactcactatcatgagaacagcagtggggaaactgccccataatccaatcacttccatccctcaacaagtggggattacagcccttgacacgtgtgggattccaatttgagatgagatttcggtggggacacagagccaaatgatattttatttcctttcatccatgggcaaaggtttgtaagatattttcaagaaaatttagagtgctaatatagtttcagtttcacaaatcttgaaactgctagtttttcccccaaatttgaaacttttttttggtttatgcaagacattttgaacaagttttaataaggcatttaaacatctcttcccttttctaaaatacatgcctctttaataattggaaggaaaccattacttttttaacacaatgtcgagttcagagctagataatgaagttaaacaagtatattcttcctttaagttttctaggtagatggtgtctttaaatctaaattaaaatatcttcgcatactttgagggcataagctttaggagtttcttataattgcttacattgacttttcctaggctgtaaattcagtcttgccttacaattaaaatgatttcaattacatttgtggtttacatttaaaaacctatgaagtacatttttttcctttataaaaagtatgcactggttttctttaaaagcatttcaaaatcttgaccataaaagcaaatagctgatttctttttaacaaaaacatgaacaagttacatattttacatgcgaggtaacattggggtatttataacatcattaccaaattctagttggtctaaataagtttcctaaaataatctctagtttggaacatactgaaaagagggaagcagcacagtataataaagtgcttgactgaaagtcacctgatctggcttctttttctgagtctatcactaactagctgggtgaccctctatgtctcagcttttcctctgtgcagttaagagtttggattatgttatctctctggtttctttcatatccgacattctttatgcacgctattcaattgccttattctatatttaacccctttttgctgtctctagtgaaagcatccagttttataagaagaagattaaatttgcattagaattacccagagatatttattaaacaacagattcctgggccgcagtcctatagctacaatttagtaagtatgaagtagggcccagttacatgaatttttaaccatcatggcaggtgattctgatttggtgcttacaggtacaagagcctacaatataaaatgctttgtattttaagggtaagggtaggatgagtagggtaggacaggtagggtatccatcccaccccgtcccctttccactgaaagccattttcatagctcaatacaatccttctctgccctcctcacccttcaatgtcccgcatatcctcattcttttgggacgtggtacaacagcttgagaaccgctgaacacaggtacaagctataacacaggcaagctggggaatgctatggtggccgaggcccaggtggggtgtcgctgctggccaagggtccccagcttgcaaagtgactgagaagaaatatcctacatcatttacaagcatcagagagtaacaaggcaataaagagctctatttctctaaggccatttctgattctggaagaggtgctgaaagacagggaaaattatcagtatttttaacagcttcatggagtaaggggagtctaggacttttaaaatataaaatgctttatattttaaagtaagttctattatccagcctagagaaatctaaagcctatattatatcaatagacatggagagaatttgattgacttgggatatatctatgaaatctactaaaccagactttcaatttcatcaatatgttgaacaaggatagaggaatttagggtgaagatcatgttctttgcttgggaagatggatggacagtaaagccttttactctgacagcaactaaggagtatgaccaaaaggggaatgagttaagagaatagtccagaaaattggcacattttagacattcttgcctatgacacattcacacagatttgttctgaaggcaaatggacatataagtccagttctcaggaaaaaggtttagaatgaggatagaaatttaacatttatccacatccagatggtaattaaggtccccaaaaaggataaaatgtccaagaaaaaataagctgtgagagaagttattttaggggatataaataacccaaatatatttaaggtagtcgatatccatatttaatgtgcatgaaaatcatctgggtgtttctgcagtttccaagggccttatcaaaagaaattcatagtttcttaaattgggctggatcccggagtctaatttttaacaagcactgcatgtgattctgatataagggatccttaaccacaatcggagggacactgaagtataggcttaatagcagacatttctcgttacaaagatagatgaataaatagatatgtttggacataaatatatgtttgttgaatagaatttgcatttgatccaaaataattactcttgcatgtcacaggctaaataaaaataataaccatctatatttatgaactatagtagctttatcctaagcactagattgagaattgagaaagagaaagcatcttacatgctttgtctctacattattgctccctagtactttactgagtgcttggtacataaatgcttaatatatattaattgagctgaattgtatgaataaaattattggtagattttgcttttcttttcttttaaaataaatacctataatagcaaaaaaaaagagcattatcgaattagaaagcctaatactgtaaacatatcaatttccctcagtctctcattcattacatgtgtgaacacggttaagtttcctaatcagtaaaacaggataataacagaaactgctgagacatccatgcagttaagggcagagtaggtaattaacaccacccatctccttgacgacaaactgaataaaatctttttaaaaatatgcttgtgatagaggcaggaggcagagaaattctaggcagacaggggtgggtccttggtgaaaccccacctgcaagacgaagacagtttaaagcctgaaagccaagctacaagttacatccttggacccgactgagaacttgtctttctgtttggcatgctttcccctgactggtctccacccttcacctattttacatatacctaccctttgctaattggtttttctacactgtcttgcccagctttgaatggtgtcttccctttaaccttttttgcatactcacaaaccaatcagcacacactccccattctgagtccataaaaggccccagaactagtcacatggggaactctctcaccttctggtaggggatcaatctccttgtgtctcctctccactgaaagccattttcattgctcaagtaaatgcttctctgccctcctcactcttcaatgtcccgcatattctcattcttttgggggatggtacaagaactcgggaaccactaaacacagttataaactataacacaggtgagctgagacacatcagtgtggccgagtgaggtccgggcagggtatcactgccagctggggattcttggcttgcaaagtgaccgaaaagaaaaaccctacatcatttgcaggcattggagagctaacaagacaatgaacagctttaagtaggaaagtcaggaaggttagaatggacttggaggctgttgtttctcaaggccatttctgattctggtagaggtgctgaaagacagggaaaattatcagtgcttttaacagtttcatggagtaaggggagtctaggacttctaaaaagagtaggttggtaaacccaccattctgtaggttaggatcatgtcaggctactctttaggaagagtatgacctgtaatccttacaacaggattaaggtaaactgagattgctatttcacctggccacctgtcagaatcaactataaatgctgtctggaaaaatgccatatcatcctaggtctcaaatcatttctacaacttttcagacaaaatgtctcacactgaatcaaaaataaccagtcacatgaggaagaaagaccacatggagcgttagagaacagacaatagaaataagaactgattcataagggttctgaataaaggagctattaaaaccagactttaaaataattaagattattacactcaaaaaagattaggatctttgttttagtatcaaatagaattgaaagcacaaaaattggagttacacactctttgtatattaagaaagcagaattaggcatagctggagagaaaaatagtaaactaatatgtgaatcagaagaaattatccagattgaatattaaggagcaaaagaaaaaggaaagagaaaaatatgaaggagatagccataaacctaggaaataaattaagaagttctaacagataagtcattggagttcaaaaggaaactatagaatcaggcaggagcagtatctgaaaatataatgcatagaagttttacaaaatgtaaaagagatgataagtcatatatttaagaagttctaccaatgatatgatacattgcaaaataaaatggccagaaatttctctcattcctgaatgaaaatcattttgcaatgtgattttgttgcttattgtattgggaagtaaagtgtaatacttcatctccttgaatttggtctagccttgtgatttgttttggctagtgggaatgagaatgtggaagaagtttggatatgggatttctgagcacagacctcaagaagctttggaactttagctcccactctcgtgctgctatagactgccacgtgaggaaactgagactagccttcttaaagatgagaggccatatgaagagacaggaccaatgaagagccaacaccaactataagacatatgactagcccagagtgagcaattaaatgactgcagctgcataagtcactgcagcgaggacaaacagaagaacgagccagctgaatccagcccaaattgctaaaccatagaattgtgagcaaataaattgaatgcactgttttaaataaataaacaaatgcattgctttaaggcattcaaacattagaatcatgtattaaacagcagcaacaactcacacaaaaattgatatctaagattatgttgctgctgtaataaaaacataaaacatatgccactgaccctgggatttggtgttgagtgaagcctggaaaattgtggaggaaactcactgtaagtgagaggtgacagcgtgtggcagtcctcacagccctcgctcgctctgggcgcctcctctgcccgggctcccactttggcggcacttgaggagcccttcagcccgccgctgccctgtgggagcccctttctgggctggccgaggccggagccggctccctcagcttgcggggaggtgtggcgggagaggcgcgagcgggaaccgcggctgcgcgtggcgcttgcgagccagctggagttcgtggtgggcgtgggcttggcgggcctcccactcggagcagctgccctgccggccccgggcgatgaggggcttagcaccccggccagcggctgcggatggtgtacggggtccctcagcagtgccggctcacctgcgctgcgctccatttctcaccgggccttagctgccttcccgcggggcagggctcgggacctgaagcccgccatgcctgagcctcacaccccctccgtgggctcctgtgcggcccgggcctccccgacgagcgccgccccctgctccacggcgcccagtcccatcgaccgcccaagggctgagcagtgcgggcgcagggcgcgggactggcaggcagctccacctgcagccccggtgcgggatccactgggtgaagccagctgggctcctgagtctggtggggatgtggagaacctttatgcctagctcagggattgtaaatacaccaatcggcactctgcatctagctcaaggaaggtttgtaaacacaccaatcagcaccctgtgtctgctcagggtttgtgaatgcaccaatggacactctgtatctagctactctggagggaccttggagaacctttatgcctagttcagggattgtaaatacaccaatcggcactctgcatctagctcaaggaaggtttgtaaacacaccaatcagcaccctgtgtctgctcagggtttgtgaatgcaccaatggacactctgtatctagctactctggagggaccttggagaacctttatgcctagctcagggattgtaaatacaccaatcggcactctgcatctagctcaaggaaggtttgtaaacacaccaatcagcaccctgtgtctactcagggtttgtgaatgcaccaatggacactctatatctagctactctggtggggccttggagaacctttatgtccaccctctgtatctagctactctggtggggacctggagaacctttgtgtctagctcagggattgtaaacgcaccaatcagcgccctgtcaaaacagatcagcaggatgtgggtggggccagataagagaataaaagcaggctgcccaaaccagcagtggcaacccgctcgggtcctcttccacactgtggaagctttgttctttcgctctttgcaataaatcttgctactgctcagtctttgggtccacattgcttttatgagctgtaacgctcaccgcgaaggtctgcatcttcactcctgagccagcgagagcacgaacccaccagaaggaagaaactcggaacacatccaaatatcagaaggaacaaactccagacacgccaccttaagagctgtaacactcaccgcgagggtccatggcttcattcttggagtcagtgagaccaagaacccaccaattctggacacataagcaggaaaagcaagggggaaacatctaccggagactagaaaatggtgacttatgtaatgcagtggcaggtgaaacgataacctgaagttacttaaaagacagaaatgcatttaatgcatgtgtggatctaaacaaggcaatctggaatagaatattgacaatgttggtttccaagcagagtttagaggaaatatagagggcctaggactttctggcttgtaaaatacaactatttctcgtcccctattcttccagctagcaaaatattctcaacgtaagaattagtgtcagtaaaggtcaaatcatgggtgtggctctatgatactttagtaagacctcagacagatttcagaagaaggctggtagaccctcacagcttgacaaaagaattttaagactattgcctcccagctgcctgacatgaccaaagtagagacagatctgtcttgagaataattgcacacatggctttgaggatttagagtgtcacccaataagatttaaaggaaatccacaaagttttaaggagaattgtatttatgaaacaaaacactgctagtttggtctaaaagaggctgagactctccaggctcttcaatgtaaaagatggcccctgagctcataactatgggaagaggaacgatgagaaacatatgtagctgcaaaatagaccctttcatatagaaagggcctactgagagagtaaagccagacactcagacaacattggactaaaacactactcctaggtaatgtaaacagatcataagcaaggagcattctctgcatctggaggaggagaaactaacaataagtgtgtgcctacatttcaaaaaaatctatggactgatgattgttatatgcttctcaatcttcctcttttaaatggagtttctattaagttatcctatccctgtctcaccatttgtattctggatgtatggaggcattttacgtgtcttttaagttcaaaagtctttttttgagttcagaagagatgccgtagaggaagagctgtactctaaaagccttgtcattatcaggcctggatgcagatcaaaagatccaaaaccatgagcctgatgctgcaatcgaatgagagttttgagagtcctcaggactcacgagcatattttgcacgtgaagaaaatgtgaataatttgtaaccagatgacatattgtgctattaacaaaaatagccacaaattcctcccattcatatacgcacacccattgacactataactttttttttctttcttcaagagatggagtgtatttcttcctcacttacaatcagagtttgtcttagaacttctttaaccaacaaaatgtaatggaagttatatttagggaatcatgtgtacggtattaagaggctttgcagctgcactgcccaagagttagtgaagaatccggagctagcctccttaagaatgcaaaaccacataaagaatgtccaaccaggccaggcacggtggctcacgcctgtaattccagtactttgggaggctgaggcaggcggatcctgaggtcaggagttcgagaccagcctgagcaacatggtgaaaccccgtccctgctaaaaatacaaaaattagccaggcagctggcgcacgcctgtaatcccagctactcgcaaggctgaagcaggagattcgcttggctgaagcaggagattcgcttgaacccaggaggcagaggttgcagtgagttgagatcacgctattgcactccagcctgggcaacagagggaggcttcatctcaaaaaaaagaaaaaaagaagaaaaaaaaagaatgtccaaccaatgtcttgtcttgcatgtagcacaaaatgtgaaaaaaaaaaaaaaagaaagaaaaggcatcttaaaacagcccaagttaagcttccagatgactaccactacattagtaatatgggcaggacttgcagaagaatcaagccaaactgctgacatacagaatctcagcaaataaaagtgttgtttaaacctgtaagttttgaatttttttgctagagtaatagagaactgatacaaccccaagtgcagccaatatataatttataaacaaaggaaaaatttaaaaattttcagaaaagtaatgtaagcaagaacgaatcaacagaatattcttaacactgacaattctaaataaatctagattaaaatataagagatgcaggaaagatgaagagaatcaaagggtgaataggtgggtaaatataaatgcgtaataactacataaaacagtagcaatagttcttcagtgtatctgatagatacataggaaaataaataggtaccagttagatagatagagagagggagaaagaagagagatattagaatcacaattctaaaagcagtaagtttgaaggagtatatatggagttaaaatattctaagtgtcttgagttactggagaaagcgtaaaagttccagggaacattaaacttaatttatcaaggatgcatttgtaatctctagggtgactttaaaagaggaataaaagaagacacaactatcaaactaataaagggagaaattgattgataaaaacaactattccaagaaaagacaaagagggaaagaaaagaacatacagcaggcaggacaaataataatgtggtggagtacattgtttaggatggactagcaagtggaagagggtatgaagaagctttcagggtcttgaaaatgttctatttgttgataaacttactagttgcacaaatgttcaatttgtaacaatttgttgatctctacatttatgtttatgcaattttcttttctttgtttttttcatttttatttttaatttatttatttatatttttgagacggagtcttactctgttgcccaggctggagtgtagtggcgcgatctagactcactgcaacctgtgcctcctgggttcaagcaattctcctgcctcaggctcttgagttgctgggactacaggctcatgccaccacacccagctaatttttgtatttttagtagagatggggtttcactgtgttggccaggctggtctcgagttcctgacctcaggttatccacacacctcagcctcccaaagtgctgggactacaggcatgagccaccgcacccagccaattaatgcttatgcactttcctatatgtgtttatttcacaatttaaaaagttaaacacacacacgcacacaaacatgcccaaacaacctacctaccctataggggtcttaaaaagataaattgatacagagtatataaagattaaacttatcatctgacacatcaaaaacactaaataaatgtatatttgctattactatcattattagttttctgtatcttgagcaattcaaataaaaatatcaataataattgttaactttacaaaattagtctaatatttattccaaagaatcaattgacaaaaatagccaataatttacagtgaaagaagaatcaaaaggtttcttgtcctaacaaatattttaaatatatatatataattagtaaacatgacactaacatatgtctacaagaatataataacttggatatatattaaatgcatgttatattttatcaaataagaaattagcatttcagattcgttgaaaagcaaattacttagaaaaatagaatatacatgacttgatgtcgttttaatttcagcagcaaatgccttgttacctgatcccccaacccctctcttgcccttactactgtctcatcagtttgctctcacggtactttaatgagagtaatgtgactctcaacttattcgcaagactcttttctttgaagagttaagtcacccgtttatttcatacttattcctcctcaaagcaggatttttaagtaaaatgtttccaggcaagtgctatttcttgagagcttgtttggaggttctagcaggggaatgcagctactcgtatacccttgacggaagaccggtcctcctctacgtggtatggtcatcctcttccaccaagtgcacagcttctggagggacacacatggagccgtgaggaaggggacacccgcctagccagccatatcagctgaatcaaccctggtgataatggggtgacagatgttgcaaccagattgccctcacatccgcaagtgctatttcttgaagttattccttttagtatcttgtgttccttttaattagcacttttttcataaaattcaaaaacacctttatttcttttgcaaaagtagaattgatattgttatggctaaaccaccatatacaatgatattggtacaaccagttaattgcttagttaaaaaaaaacaaaaatcaccaataaagcaaaagttattgccagaagaattaaagatgactatttaaaaaataaaagcataaatatggtaggagaaaagataagtggctatttatgctccttgaattgagaatagtttttttggtaacagctctgttaagataaaacacacaccacacacacggtttttagtatattctcaaggttgtgcaaccatcactaaaatcaattgcagaattctttcatcactcaaaataaaacttgtacccttcagctatcattctcctagctccttgtcttccccaaacccccagccgtaagtgaccactaatctactttctgtctcagatttccctgttctggatattttatataaatggaatcatgtaagatgtggtctttttactgccttatttgagttagcataaagttttcaaggttcagacacattgtatcatgtatcattaatttattactttttatagccaaataatattccatggtatgaatatgccatacttattcatcatttgatggatattggggttgcttctactttttggctattgtgaataatgttgctttgaatattatgtacaagtttcattttggttactctacttttaaactccagaaaaatcactggttgttttgaaaataatttctatcactttatggacattctctatttgtttttgttggtggggttcttttttgtttttgaaacagggtcttgctctgttatccaggctggagtgcagtgggacggaccatcatggctcactgaagccttgacctcccaggctcaggtgatcctcccacctcagcctcccgagtagctaggactacaggcgcgccaccaaccctggctaattttttatgtttatttttagtttttacttttgtactgatagtggtctcactgtattgctcaggctggtcttgaactcctgggctcagcaatccttccacctcagcctcccaaagtgctgggatatcaggtgtgagccacattctgatatgaatgtcaaatacagctgacattctgtatttgaagcaacatggttatcatgtcttcttttacttttttaatcattctttcctttagttctgtgaacatatttataatagttactttgaaggttttcttttcttttttctgctgaatctgacatctggtttctctcacaggtagtttctgttgcctgcttttatttttctcttgtatgagtcacactttcctgtttctttgcgtgtctcataatttgttgttgaaaacttaattttagataatatattgttacaactctggagggcccccttctgcctcacatgtttattgtagtttgcatgtttagttgtatagtcacttgctgggctgttagaatagggtctatttccctcacagtatgaagactctgattttgctcctcagagggtgcaggctgacatgtgcacagtcagcctccaatacagtgcttttagaagggctgtcttccaggctctttttccatgatcatacccagctgttaagctctactaattcccaactgattgatctattgtttatacaatgccctggagcataaattgctccctagactgaaaacaattcaattaaacttgggttcctttatggggtaattttgagatgaatgtctgaggtttgcttggacccaaagaaggctcttcttagctctcttttttttctctcataagcttactggtttgtggtttaacttaaatccctcatgaaggtaccatcctcttcctaattgctttctaccaaaacctcctttgattttgagatccttaaaattgaacttctctacactccgttgaaagtcaagtcagtttttttgtttatttttttgttttcttatggcctatctcttcccctggaccaaatctctgagccatggctttggaattagttgtggggacagtcatatgcttctctctgatgacaacctagatttagaaggaatcttggtgggggcagcagcctctggtattctaggcgtacctcttgacacagaaccttctccttacaaattagctatgtttagggcaattggctagaaagaatctccctgttctatgaatgagggctgagtgaaagaaggtagccttgacctcctggccacactctcctgatatttagcctctgcaacaggtaattgtggggaggacaggaaatgctaaaggcatgtccttcccagaaagatgccacattccctttactgggttctggggttgcctggggagtgaagggtactactatgttattggctgtgctcacctggagtggagtttctgccgtgctgagctggcagggagaaggttgtggaacaaatgccacagactctcaccgttcttgatgagttttactagattttcttgaataaatatttcttcattgatatatatgtccttaaaaccacttccagagtttttaaatgtgtgtgtgtttaaataattttcacctccacttagcttgttttccttgggagtgggtccactggactccttacattttgattccatatgtcagaacccaagaatatactttaaatatatgacaccaaagatagaaatgtaaagaaaaactactaaattgattatataaaaatgtaaaaaatctttctctctctctctctttctttcttcttttctcttgagatggagtctcgctctgttgtccaggctggagtgcaatggcatgatctcggctcactgcaacctccacctcccgggttcaagagattctcctgtctcagcttcctgagtagctgggattacaggtgcctaccaccgcacccagctaatttttgtatatttagtagagaagggggtttcgccatgttggccaggctggtttcaaactcctgacctcaggtgatccacctgcctcagcctcccaaagtgctgggagtacagatttctaaagttaaaaggcaaatagaaagaaatattttcaacggataaaagtttactaccttaaatattctgaaatctttgactaatctctaggataaagatgaaaactcaaataaatgaataaggaacacagaggcaattcataaaatgcatataacacataaacataaaaaaatctttaacctcactagaattttttaaaaaaggaaaacaagaaacactttatgtccacaaattagaaaatatataaataaacttacaatactcagcaaagaactgaaaaaatacactatgatgagagagtaaattgacacaaactttggcgaaatgaataaatatcatattaaaaacatatataacctttccatgttgcatttaatttatttaaagacggtatatatagtgtgatgtatggctgatggctgtgtgcgtgcatgtgttttcgtgtgtattgtttttaacctgtaagggtactgctgttaacatttgcagagccctaatcaggaatacatattgcagagggcaggtagcatctgtaaacgtcttatctgaaactctcttgagattcaattaacagcatttactatcaacaatacaagccttgctaattggcacaattgaacatagcaatgattattatcactggtgaatgattattttctctggtgaaaagattggtgtttaagatatgggtctggctagaaatactgcacagtgagttttgcccttgcatagcacagaaggaaaatctggtgagccgaataacttataatcttaggaatgatgttttgtgattttgattccgatcagttctgtgttgagcagttttcagaggatttttttgcctgactccaagtaagactttaattgaatcctgcccttgcaatattgtcgcatttgcctctggtgaatctttgattcaaaaggctattggagaaactgtaaggacagaggagttgggactttattgagcttacagtttgaatagctgctttttaatgtctgctatgttgttatgtgtgcagaatttagccttgaattatctcttcttacaatttactacattattttgagggtgatgaggatgaggcctagagccctcattacctctaattgttgatcatggatatctaccagaaagaatctaataattatgaatgaggaaagtcacaagactttttgatatggtttgactccctgtctgcacccataattctcatgtgttgcgggagctgcccagtgggagacaatcgaatcacggaggcaggtctttcccatgctgttcttgtgatagtgaatgtgtctcaccagatctgatggttttgaaaaccagagtttctctgcacaagctctctcctgtctttgctgccctccatgtaagatgtgacttgctcctccttgccttccgccatgcttgtgaggcttcccaagccacgtggaactgtgagtccaattaaacctctttcttttgtaaattacccagtctctggtatgtctttattagaagtgtgaaaatggactaataccctttctgacctagtagatcaagttctgggaatttattctgagttaataatttaaaatgtgtgtaaaatttaacatcagtgtatttatcaatgagttatttatcatagcagaacacaaacaacttgaatgctcaacaatagagaactgattatctgtagtatattctgaaatggaatattaagcagcttttaaaagtgaggggatatataactattgaatgatagagaaaagttcaggacacattgaatatgaagaaactgatattaaaaacatgaacaaaatgaaaatatttaagaaaatatgtaattacagttatgtgaatacaatgtaaattgtttaggataagatgaaaagataaatgatttgatgaattctgtataaattgaatgtctctaaattgaatcgcataccatatgggcggatgtggccgtttaaaggagacatttggtacagttgaccctcattattcacagataacatatttgtgaatttgcccacttactgaaatttacttataactccaaagtcaatacttaaggcacttgagtagacacttgtagacgcacagaggtatttgtagatgcacagagaataaaaattgtagttgcccaatgcacacattcccagcttagatcaaacaaagtgatgctctgtgttcttgtttcagctctcatattctaaaaaagtctcctttttgcagtatatttagtgcatgtttctcaaattttgggtttttctgttggtgattttgctgcttaaaatggcctcgagcacagtgctggagtgctgtctagcattcctaagcaaaagaaagctgtgatgtgcctcacagagaaaatacatgtgttagataagttttgttcaggcaagaattacagtgctgcaggccatgagttctatgttaatgaatcaacagtatatattaaagaaggtatctttatcagttgatgaaaatcttgttaccagaggctgtcaggaacataaccctttattgtctccagtgtttgcagtgactttatagaacataattactgaggacatcagaaatcaactataaatacttttgcaactaatagacctttggaacaattatttttggattttgtataaagaatccaaaaaaatctggaaaacgtgtggctaagaaaacagttgattggtccctaattccaccttattatgtttaaattcagtgggtgtctcacagccacgtttataaaggaatcttggctggggtgtcaggtttctagtttactttgactctatctgtcagtctgtgtccaaccttcatggcaattaactgtgcttttgtgtgctaattatcattatcccagtatgggcccattattagtccaatgtccttagtttaaagcttaagtgtcaatcagtcacctaaaacaattgcatagaaggaagctttgcaaggctggtttgaaagtccttagctgagttctactttattatactccagttcgaaactgaacacaaagctcttcttgatacaattgtttatttaaatactgatttatctacttaattaaagcaaacttgagtttatattttaaaatcagggatgggataattgctactttatgcttgaagatctattcaggtagctatacattaaacaagtaaaaccgtaattataaaacctgcacatttttatctgattgagtcgctcctgccattgaacgaccttattcaagtcatttagaacaaagaaaggtggcatatatgagttttttaaaatcccactggatgccaggagtaaggagaaaatagcatcaaatcagatgtggtcagaaaagaggtatttcttttcctgtgatgcttttcctctttcctcctcttacagtaaatccccacttatcaaatcttcagatgtgtagagaaggaataaggcaggggtaatgggggagtgggacagagagatgccctttctggagtttgcacaacggttgcatgctgagtaaaacctgatgatgtattccattcatgtctccaaaaagtcaaaagcggtttcagcgttgatttcccttaagagttatcagtcctcattcaattggtttaatgagtgtaagaggtgaccttgtgtctatgtagatactcccatattaaaagacctggatgtaaaacttcacatatgtgtaaatagttattttggagggtgttgtgagggttattgcagctctctgctcagctgctactcaggctaaacgggcaggagaaattttccactgtgttagaatgatgattatttgcaaattacatgagcaccagtaattcattcatgcaatgatacagagctgggtctcagtgcagtggtattgaacttgctgctgggggcgttaattgattcgtttggaacattcccctccagagaatcccaatcacaggtcccctgatcaagaaacggacacgcagtcggggtcctggatatgtagagacacacgtgtgaggctgttgtcatcaaaataaaccatttctgtcccctgacaggggttgagtctattaggaacactccccaatcctgggagcttccgcaagaggctttctatcttggcagaggtggcagctgagcatcgcttctttgctgcaggatggaaaaaagggactggattattggctgcattttaaactagctgctgttctagagaaaatgttggggagggactgaacaagcttagcactggatcagtgtgggggtgtgttggtgaaaagaaaaaatgcctcctcctaacttaacgtttaactgatatcccctcaacacgacccaaatctgtctctccagatacacaatgtctgttttcctaactacatggtgaactgtggagcaagtcttggtcatgtttagtttgtttcccagaatctactagaagacaatgcctagcatatagcaggcacagaataagggccaaaggggagaatggaaacaaaatatgtacatttgaaatttagaaacacagttaagggactttgcctgaaattgtcataaaactttgaaaattgcttcaatgtatagtcccagtgggagaatgtgacagcatattttattctttgttcttttctgaaattctgtgtccagtctaaaacacgacatttccctttaatgtgttaggagtatgcatgactacacaggaatattttctggagaacttctggtgaagcatattttgataaacagtcttactaaaagttatatatatgtacttttaattgactagttgcagagaaataatcaatgtaaaaaaaaatcatacatagtacaggtagtaaaagtcacagttccggcagaagcacaaaagccttcaaagtgagtgggaacctgggaaccattgatcctcagtggctgtttaccatggaaaacacctgcatcaccaacattccagttttgcaaaagtacctctattacagacacataccaggcaaggagggaggaaaaagcctgaaaatttctctccaagtttaagtaatcaggaaactttggtggggaggttggggtggggtgggggcgggggggtaacttctttatttagcattaatctcagcaatcatgaaagtcatggaatttcaagtgatgaaaaatttgaccacaacaatacctatcactagcctggttttgcccacttctcgaacaggaattataaagataataattaattctaaaaagcagaagacaaaacaaacaaaccaaaccaacactgaatgaactaataaggctgctgcatatatatgttggagttggatgtttatttgcttactgcagtagtttaaaaatagttttccagttaacatcttttccacatagtggagatgtcagggtaggtttacatgattgcgtaaatggtcagaagttgtttatgtagctctgaactgctgagagatgagcaggaagacctgggttcagcaaaacccttggggctttttcccagagagagaaacagaggctcctctctgggttgctggaatgctttccagacgaattcgactgggttggcttttctctgcctgtcaaagtcactttgcacagtgctggtgaggggctggggcattgctgccaatctctacggttaccccgaggtgtggagttgcggcgaagggagccacttctgcaaggaaacagtagattcataatgtagaatgaccgtggcaacgtcgttcaaagcacattctttcgaataacaaggctttcgacatgccccacccccgcgcacaacacaccacaaattgatccttgtacctaatttacagcaactgttccctctgacctccccccgcccccgccccacattccaacctgaaagcactttgcgtggatgagacttcaggtgtgtaacgcagcctgtccagccagtgtcctccgcctaaggacaggcaggtaaaaacctaccaaagccccctcttctggcctaagttcaatgccacccgcccacccacattccccggttcagcaattttcagcccagacgcagaagcatctgtttccctggccagggcgccttaacgatcccccgaattccgcgtctcccggaggccagaggtttgggtacccaggaaggtcgcgcctcctcgtgccccgatactcgggttgtaaagggaggagacatcgcctcggcgcatccctggccgctgaacaacgcaacccctacgtccccgcacgggaatccggctgataatctcctcttgcctgagaatcgggccaggcgccctttactaatttcgcgcgctggggacctggggctgccgcctctcggccgcgcggggcaggtgctgcgtccccagcgctcgcctcctccggccgcgcactgagcatgcgcgggctccgggcctccggcgcgtctccccgtccccgctcgtctcccgcccgttcccacccgcccgcgcctctccccttccccgagcgtctcccccgccccgcggctaaggagccggcagcccgaactccggcgcgccaggtttttccagccgccgcgagcgccgggagggagggcagcgccgcgccagacggagcccggggttcgacgccaggattggctgcaagtagggagctttcgccgccgccccgggcccctcggactgtgccggcgccgcacccgaggctctcgccagcccggcgccccggtgctgaggtaagtgaggcggcagctgtgcgggtccggctcctgcgtgggcgcgcgatgccccggggacgcggtcgcgggtgtgggggggaaagggcagggtccgcgcgggttgcccgaaggacaggggcgcttcccggggctctgactcccgcggggccgggcagcgtctgcggggccgtccagctcagagcccggaagccctgcagggtcggggagcgggagctgaacgcctgagcgcggaggactcagggccccgacgacgccaccgtcaccccacagcgacccttcttctccttctcagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggtacctggcttccccagtctctgccgcgggagcctgttgggtggcattcgtttccagcaacttctggggggtttccagtttctttcgagaggcaagacaaccgccccgtcccctccccgggcccagacggcggcgaactgtgcgccgggcgccccacagaccccaatccactcactctccttctggaacgcggggctcaaaatcttcgtgcattttctctcttgtgcttcgtgtatatgttttactatttatgaagggtgtggaggtgagggtaggaggacgtgggctcctgaatccctctgaaccagccagagagtcggctgcatggaaacatttcgcagcgaagctcctgcgaggaggcggcttcgcgcgtcgggaagatcaggcggttgcttgctggccagggtctgcagattcggtgcgaagaagctggcggaggttgtgtagggcgagtcagtgtgactgagcaccctgggtgtgtggtctgcgtggaggagagtgggccggatcttgaggtgtgttggaggtttatttgtaagaggagttcctgaaaggaatgtcgtggaactttttctagttttcctgctggaatcaacataggggcgggcacatgtttgtcagaataacagtggcatttaactgcatgggaagctctttcaattttctgtagtgggagctggatagttcaaggagtaactccacataactgagtcgtttggatacccacacaagataatttggaacgcgcttgtatttttttgttttttgagatttctggtttatgtcctttagagagtggggtaggagcgtaaagactgtataggttgcctatgagcaggtccatacaatagcgttcccaagtctgcctaatagcaagtttgttctctctttctctctctctacccaagtgggtgaaaaagaacagtgtgtcatgaagacaggcacctggaggtgatttgggtggcattcatgagaaaattcacgttacccgtaagtttattcttgctatttttatcttgatttctttaaagattttgtgggaatatctgcagtgggtcgcaggagtaggtaagattgctaaggatcaaaaacaagtttcatgagaatattatttttgctaccttataaaatagctattgatttgtttgttgaagctggtttcaactgctctgtcttgttgaggagagatgatgctgataaacgtcattatttttccatctgaaccctgggaggtagctggcaaggatggaaaaactgaccttttcaattaaagactaagagtctaagagaagtgacttggataagggtgcatgtcagagccacatgtaagtttcaacagaggtagattttcctatttgcagttttttaaacaacacttttcagtttctttgagttgtaaaacttttcaagtcaattgggagtcaatgcagtacctttttccatggtcatttcatattggcaggtaattaagagtgattagagaacaaacctttcaaatgatgttggattttttatcattcacttattttacctacttctctctcctttttgttcaaaagtaggtcttctgatttcttttccgatctaagcactaaatcttttggctgcagtttttcttctgaaatgtatacagggcatccgttccttcaatttaggtcttaaaaaaataaagctgctcagcagaaaattcccatgcatggtactgacttttctacaagtttgtctgatcatgattttaacttgttgtttcttctttgttatatttgaggacagacataatatgcattagcttcaatctctcttatcttaaaaattaatattttgtaaaaacttgcttttatattattttagttgaataagtctatttcatatgataggcagggggaagtctctacacactgattttttttgttcctttttgttcatttttccctgtaatgctatgttttaagcctagtgaaggaggcaaggaggcaggatttactgcctagatttattgatcttcattattattattatttactatcagaagaaatctgacaacatatcaataaaatttatttataaactgaagacatgctgttatatgatacactacttataaaacacacaaagaaacaaaaaagatgaataaagcaaaaattatgaaatagaaggtctcatgttgctgttatgtatcccggtggatcattttgtacagcccctggggtgtgtagcacactttaaagatcactgctggtttgatatttttaaaatctttctctccttatctctgctctgctgttcatcatctctgatactctagccagttgtaaaactgctacacttctatatcttctgtaacaaatagattaagcacacttgttttcctctcatggactcatatgtggatagaatgaggtgtaaaggatgaatgtgttttggagatgtcatcttagatctcccaaagtagacatacaggtgaattttaaaaaatggagttttagtttaaagactaagtaccaatggtcaggaagtgaagaatccaaggagtaaatgagggaggattggaaggacactttccacattgcagtgttgtgtggaggctggaaagttcataaaccttgaagcagattaacctgaatctaagtctggcaccatcatttattacatttacagtcctgggcaatgtagttccttaatttctgtgagccttagtttctttaggtataaaattgggataacatctatttcacggcatcacgatagggattaaacatgagagcatgagtcaacatgggtcaagagcttggctcttttagattggctctttagcagatataacagatccaaaagggatactgcctcagatgtgaaatatatttatttctcggttgtgtgaagtcccagaatgggtgatcatggcagtactccttcaaagtgtgattcagagacccagccttcatctgttctgtgcccttgccgtcttcagcagggtcactgtgcttacttgcatcaagccattggaaagaggaagacttgggaggatgttaattgcccagaactggaatgagtgcatattacttttccttgcattgtgctggccagaacccagttctttgtggatgtacgttactattaaggaggctgggaaatatagtctagaaatgttatccaggaagtagaagaaattgttgggggaacaactagcattctctgatgttttattactatatgtgatatttcttccatgttcaataactgttacttccttttcttctcctaacccttgcttttttttttttctggtagaaaaactggaatggatacaataaataataatagaagcagttaatacatacataatgcttactattattgagatactttttaaagcacattgccctactttgcccttctaatattatctctattgtacagatgaggaaaactaggcatagagaaattaagttatttgttcatcatagctagtaagtagcagagctgggatctgaaccaggttctctcactccagaattgattttttaacagctttttttttttttgcttttgcctcaatacttttcttatttaagccactggaccgctttttacttttgcctatatataaaaaagttgccaagagaattttttaaaatactaaagtagaaaaaaaggatataatccaaaacatactggaatggaattagatatgatacagctttatcttgaatacctaccaggatcaggagcagatatttaaagtaactccccccacttacacacccttcaccactacaactgctctttcatttgtgataaacacattttcagggtctgtgccttgaattataaccttcctctgaagattctattgtgggagtcttgcgctaccactttcatgcttcagtatgtgaggataaattcctcttcacttctcagcagaaacaaatatcttccctggcaggtttttcagctaaaatagcctctcctaacttttgatcaaaggtattgctctttatcaatatccccatcctccaagaaaggaaaccctcttcttttcctatgagctttgcaaaattattttttatttatctatttatttatctttattttctatatgactaaggggactgtatatatatcccaggtaccgtctaaaagaaaatggtccctcttgttctcatcctgttgtcccatttccattagagaatctgcctcatcttatgtttcctatgtatttgtctttcataaaaatgcctgttagagttttggttcccagtggctgcagtggaaatgtgtagtggtcaatagtaagcgtatactttttgctaagatagttattgtttcaacattaaagagtgatttttttcctcttgttcagtatgtatttgttgcatcttcacaattaggtaatgatatgtatcttcttaccatgtaggtaggcataaatactgtatacctaccagtcatttctttcccagaagcccctgttcatttcctctttactttccctgagcctcacatcctgagaattttgcttttttttctgaactcctctttcttccaattttttccacttctgtgccatttatgtctacgtgtgtgtgtgtgtgtgtgtgtgtgtgcgtttcaagtcccttcttatgatttaatggggttggagggctggagaggttttcatgtgcttactgtcatgttttcagccaaattccacagggccttgtaacaggctaacatgagcagataagctcttaattttcagtgacttattttaactttttacttcttgctcatgtgtggtagttcagtactcatagaatagatcctgactgagtggctgtccatggggtcattcagggaatcaggttccttagagttttatggctttgttcatctttaagtacctagagtcctcatcattcagtcaagatacagagtgtgaggagataaataatccagagaagtcttattggaggttgttgtaggcacagcctggaagtggttgtcatgacttctgcccacattcctctggggtggacctcagtcacttcgacatcctttgctgcaagggaagctgagaagtggtgtctagctgagtgcctgggggagaagggtgaaaggaaaacaggtttggtaaataactagccagtctttgtcacaggtttccaatgaaagcatgtgagaaaatcagctaattctctaggtatggggaaaagagagcatggattttggttatttgccaaataaatgcccattgccttgcttccttttaattttgacctctattactatcccattcttagtgcatatggtctgggtgggattccgtttcccatttaaggattggagcatgggaaccaggtcttgtcgggaagagcattgacttttcctgtccacagtaattgcttctagaacagaacaggcatggacccagtgagaaccactgcagtgagatgctttgctttttctcagtggctctagttgggctccatgtatgcctttgaactaattcctgtagataaggagattagaaccagggagcatgtgggcctgccactgctgcagctgtcttaacaccaaaaagagaacctagacctgctgaggtcaccacatactacttgagaatgaagccaacagaacagtagcaaggggcatgatggagcaaaaccagctcctcttgcatcatgtgagcccgttaatctggctatgcctaaagtgagttaacctggtatattagtctattctcacactgctagaaagaactgcctgagactgggtaatttgtaaaggaaagaggttcaattcactcagttccgcatggcctcaggaaatttacaaccatggcagaaggcacgagagaagcaaaggcaggtcttacatggcggcaggcaagagacagtgaaggaggaagagccccttataaaaccatcagatctcatgagaactcacaatcatgagaccagcatgggggaaactgcttccacaatgcaatcacctcctaccaggtcccacccttgacacatgcaaattatggggattacctttcaattgatgagatttgcgtggagacacagagccaaaccatatcattctgcccctggcccctcccaaatatcatgtcttttcacatttcaacatgccttcccaacagtcgcccagaatcttaacccattttggcattagctcaaaagtccacagtccaaagtctcatctgagacaaggcaagtcccttctacctatgagcctgtaaaataaaaagcaagttagttaattccaagttgcagtgggagtacaggcactgggtcaatgttcctattccaaatgggagaaattggccaaaacaaaggggctacaggccccatgccagtctgaaaccaggcggggcagttattaaatcttaaagctccgaaatcatcttctttaactctatgtctcaagttcaggtcatgctgatgcaggaggtgggctcccactgtctggggcagttctgcccctctggctttgcaggctacagctcccctcccaactgctttcatggctggagttgagtgtctgctttcatggcacacagtgcaagctgtcagtggatctaccattctgaagtctagaggaccatagccctcttctcacagctccattaggcagtgtcccagtggtgactctgtgttgggagctccaacccccatttcccttccgcactgccctaacagaggttcttcatgagggctctgccccttcatcacacctcttgcctggacatccaggcatttccgtacatctactgaaatctaggcagaggttcccaaaccttcatttttgtcttctgcacacccacaggacgaacaccatgtggaagctgccaaggcttggggcttacaccttccgaagcaacagcttgagctataccttggccccttttagctacagctggagtggctgggacgcagggcaccaagtccctaggctgtacacagcagggagcccagtgccttgtccaagaaaccgtttttccctcctagacctctgggcctgtgatgggaggggctgccgccaagatctctgtcatgccctgaagacgttttccccattgtcctggctcctccttacttctgcaaatttctgcagctggcttgaatttctccccagaaaatgggtttttcttttctacagcatcatcaggctgcaaatttttcaaacctttttgctctgcttcccttttaaacataatttctaatttcagatcatcacactcaagtttaaagttccacagatctctagggcaggggcaaaattctgctagtctctttgctaaagcatagcaagagtgacctttgcttcagttctcgataagttcctcatctccatctgacctggacttcattgtccaaatcattattagcattttggccaaaaccattcaacaagtctctaggaagttccagagtttcccacatctttcttctgagtcctccaagtctctagtaagttccaaactttctgacatcttcctgttttcttctgagccctccaaactgttccagctctatctgttacccaattacaaagttgcttccacattttcgggtatctttatagcagtaccccactctctgcagtaccaatttactgcattagtctgttctcacattgttataaagaactacccaagactgggtgatttataaaggagagaggtttaatggactcacagttctgtatggcttgggaggcaacaggaaacttaaaatcatggtggaaggggagagagaagcaaaggtatatcttacatggcagcaagcaagagagagtgaatgagcaaaggaggaaaatccccttataaaacgatcagatctcgtgagaatcattcactatcacgaaaacagcatgagggaactgctcccatgatccagtcacctcccaatcaccacccttaacacttgggaattatggggattacaatttgagataagatttgggtggggacacagaaccaaaccatatcagctggtgattttgcagctcttcagattcataaattaccctttgacgtaagctgatttgggttggatttgtatgacttaaagtgaatactgatttattagaccaagcaaaaaagaggaaagaatactggataaggaagggagtgggggttttatttgtttgtttgttttcctgagctcatcttatgtcactttggttgtgtgcctaacagtttcactcccttgtaatacatcagacttccagtcaagaaccatttggcatacccctacccaggcacatagagctctcactaaattataaacccgaagctgttaattcttctcaaagctgatctctccttacagagttatggaagggaaatggaggtgaaatcacatcctcaggcttaattccctctttcaagattgcctgtggtccctcctggatgatgctttcttttccagcatcacttccctgttcctatcctcccccaggcttgcagaccaactgtaacaatctaatcacccatcctggaacttttcatgtgccttttcttttttttttttttttttcatgactgtttacattgcctctctctttggcctcctcttactgtccttgtctactgtgtttattacagtttgcacaatgctcaactcaagtatcactaagttaagcctctttcaatactattgaggcataaagaatggctccgtcacctgtacatactctcattgtacttgtttccatgccactgatataatatctgtcatgagaatgaccatctctcttgcttttcccaggacaggggggttcccaggatgctggatattcatttttaaaaccaggaaagtcttgatcaagccaggagaaatttgttgccttgccttctacattgtaatagctctcatttaacatgccactcggtgcaatggaatttcattgagacagtggataacagcttgaaatttggaggcaaaattcttaccaatcctagatccattttgtactagttgtgtgattgtgagcaagtgacctaacttttctaggttacagtttcatcatctgtgtagtggaatagtatgtgttttgtagggttgttagctaattaaaagacatcataaattaaatcacttcgtttagtgatggacacatctataacattgtctaaagcacacgagttttgtgaagattatgtagagtactacatgcaaagtacaagcaggacagtgcccaaatcctagtaagcatccagtacacagcttttgttatggattgttgttattcacttttaagtatctcttgcctaaaacatagtagatgccaaaaatacaattacactcagagaatacatgttcatggagcataaacaatgttactcagagtttgtgataagtggggcaagcaagtcagtgagagtgattaggaaatattttcgataattacttggtctttgaaacttgaaaaagctggaattgactgcaggattagttcctttttagaaacagtttgttttttcttgcatatttaaaccagacttcacaaattttcatagttcggaaagagaaaatattttccatgtttaggcaaggtcagtattggtgcataacccctaagtacatattttcattatttttattaatgaaataaaagtggcgcatttgggggaccaaaatgcaaatattttgtctttcttttggttcataagaaagtgaaggttagggcagtagaatcactactccattattaatcattattccataatgatcttgagttaaaaaaatcatatgatttgttgttgttgttgttaaccacagtgacatatcctctctacctttgggctgaacttttgtatataaaaatactttgtaacttgcacacttgtattaatataaatcttgagtgtccatgttgcctatgcctttcagttttgtcatggaaatttccagtgaggacaggtgttgcatgtgtgcttatgctgagatgggtccagtctggacaagaagacaatcaaacaaaacaatgatatgactcaaatcaccaagtatgttttgtaagatttgattctaggcacattgtcatcattttaagttgtgcaaatttgtattgttatccatattatgatgggtcttcaactattaattataaatacgaatttttttgtctttagtcactcatttgattagctattagctagatattgattctagactccttacagattagtgaattaattgggagtccaagcattatttttagtgtatttaattgggtgaatgacagctttatagagaaagtgattacttaagttgcatatctaattcttagtaaaaaattatagtacaaacaaggtcatctagaattcttggatctaagtaatggtaaattaagagttgcttttaatataatagtatcttttaaaaatggatatccctgtaaaatgtcttcattttctgcttaagcaggtgactaaagataatttacttcttgatgacacgggatcaccatgataaacatagtttggtggtttagaatagagtatgggccttggaatcagacagacctggtttgaatccttgttttgtctcttactagctgtgtgatctcaaacacattcttacttttcccaaggcagtttttaaaatctgtaaagtgaagttgatcctgcctgtcttacagataggctgtgaacattaatggtatgcattgaagactttaggacagtgtgcatggcacattgtaagcattaggtaaatgaaccgtatactacaatctttacaacttatacagaacgtagtatacttaaatgttttatatatttgttgttcattgtttcaacattctttgccacattcctgtgacactgggggatgcaacaggatcccatccagtgcagctgaagtgttgagaccgacactggtgacctccatctgctttctgctgcctttcagattgtcatattataatctttcgctttggtgaactagccttttccacttgctgttttccaccatttgtgaactggaaaaataaaatacacaagctgttcaaacattcttagtaagagtaaacagattcggagtgagactgtgaaggggcctgtttctcccctccccgccttttttttggttgttgttgtgagagagtaatggtatgggtgtttcacatccattttcactgttctcagctttacctctctacttcctggctgaggtactgagagtaagatatcactataccatagtggaaatagaaaataacctgctttgataatattgtgacatgtatttgtgatatgcttggcagtagcatcatgttagtgaaaattcctgtgttacagtgtggaatgttggctatcttacctgtagtacaataaacttcattcaaaatcctgtgcttagaatacagcatgatctttatggtataaagaggttttcttttctatttttttccagcacatttcaaggtcttactagttactagagtctaactcaaaagccttagtatttaccctttattttcttttttaaatccagtggtcagaattcccgataccaaaacaattatggatactattaaggtggctgtaatgcttatatacgcactgtgagttcattgagaattcatagttctgttaattctactcaattcttataataattgaaattcaccagcatattgttgtttatagtatgtggtgtaagtgaaattaatacttttcttttaaacattagtattttcagagaagaaccttttcctgttcttctgaattaatgaattgttacaaatttttgtaggtttcttataatgtggctacttaaatcaacatattaaggtaaactcttaagaaaagaaacataatataatgtactccccaaaataatgaatcccatgttttaggttggtatttagtctccacagctggaaaacactattttatgtgatgtataggaaaggctggaggcagacttggtgatttagaatgactcagtgattcatatcctgtctctactacttatgtatttagtatatatacaaatatatattaaagttagtatgtaacatcagaccaagtcatttaaccttttttagcttcatttttctcttgtatataatggaggaattcctgtagggttgtgaagactaaagttacttaattgtatatacacatagccttgtgccaggaatataattagaccatccctaaaaatgctgtttatcatgattttaccctttcaatgcatttattcaatatgatgcttgtgttgtagatgaaatatgtggatgttatgatttacaaacttgaaatttcattattttaaaatactctgtaaagtgatttatgtttgctcatatgcttttatctatgggatagacaatgcaatcctctctgtgtggagacagaggaaggcaacatttccatagtgtgttgttttatggttgactattactgcgagccactgtatcagaactgagatgagattagcactatttgagattttattttggagaaatggttttggctatggtcaagaatcttatttattagaaagaatgaattactgaataggctctcatctgtattctttctacttcagctatagcccatcttgccatcctgtaaaagaaatgctgacagtgacagaggagaaatataaaaatgtttccagttgctttcagtcaaatgtgattgaaattttataaaagatttacacattttttatttgtaatactgacagtactgggaaatgaatttctgtttactccagagaatagcagtcactttataggtgctttgaattttaaaacttagcaagcataacaataatgactggtgtattattaacatgcatgtaaaaggagtttaacatatctgaagagaaactggttaatgttattttacttcctatgtgtttttacagcctttcaagaatgaaacattggtagtaagtttgttttgaatgtttctctatttcatctttgtatgttggtttactacctattgtatgggattcaaagaatgtttatatcaaaaactgttttgtttagagcttatcattaaacctcattacttagatgttttaattacttttatatgtttctttctgtatttctaacacatacaatgagaatttactgttttccattgtgttttacatttttttcttctggtaagttactaagctaactcacatcagtatcttaattcctggagagagacccccatccatttatgtatatcctatagatctgattatggccttgttatggaaattggcctgactacaggcttctagtcattcatgccctagtattctcccctgttaggtaatttccaagatgcaccctctactatagtttctaagtaattcttctgagcaccagaccaagtattcatggaaggcctaaaatatatactttcaatggaaaggatggtagaaattcagccaattctgctttcttgggcttttagatattaaaaagagctatagaaatataattacactgatggatttcactgctctcaattgcctgaattatcagggttgagcaactgaagcgggtggaagggctgtttcccttatatctgaatataacataataaattgtccatcaatagggactatttgagtttgatattgatctttgatgttatgtatgctgcatttcattgattaaaagcatgcattctagttgggtctagatatacagtctaagtacatgatctatagttcagaatagagtatcatttatatagaaatttgcccatggccgtgttgtaattgtagcccattgattggcatctccaaggagcttgtgagaaatgcagaaattttttcctcacgcagatgcactgtatcagaattttcattttatcagttgatttttattaaagattgatagacattgatttgcattgtattcttaactaactgaaacaactggttccctgctacgaagcctaaatgtcaagcatatacacaacctgcttaattgtatagtaaggacccaatactataggatgaaggataggtacagttgagtttggccaaatgatgatcagagtctatatagtttaaggcgcagatacacaaattttcaaaaatatgggtagaatatagtcaatatgaatggaatagacaatgctttgaaaatcactggagggaggctttattgtttgtgaaaacatgttgtcatcactttttgctttaagcccttggtggtgaaataactcaaaccattcttccttatgctgaagatcgagaaccccaagtatcacatctaccatcccactcatcaatgtgattggtcagtctttgctgaggtcctgcatagccagttttaaagttagagttcttgcatatacatatgaaaaggcatgttacttgtgctttcaaagagctttttgcttggtgtaaaaagaaaactcaaattacagtgtgatgtggaatataatggtggtagtttcatcgagatgatgggaaagaattgataagataaagtagaaagatgagcagaattttcagattgggtttggaaagagcacttaagaaagagggtggccaggtggtggctcacacctgtaatcccaggactttgtgaggccgaagtgggcagatcacttgagctcaggagtttgagaccagcctggtcaacatggcaaaaccccatctcaaaaaaaaacaaaaaaatacaaaaactagctggcgtgttggtgcccacctgcagtcctagctactcgggaggctgagttggtaggatcacttgagctagggaagttgaggctacagtgtgctgtgatcctgtcactgcactccagtctggatgacagagcaagaccttgtctcaaaaaataaataaataaaattaagaaagagggtatagtatgtacaatggccatgggcttatgaggaaaaatggcaagtttggagaatgccaaaggtatgagtggacgctaggggtatgggaaggtggcaatagggccttcatttacacagtttcatagactagaatgtgaatgttatccccagagttggaccaccaacaagcagtgactgtgattgttgcatcatggctttgtgcaaagtagcatctctagcgaatgggacaaattggggaatatgagggaattgggagatattctttatgctgtagaaagccactgcaagatttatatgacaaggtatacagtgctgatctgctgaccaatatattttctggcatcattccgtgtttctctcttgtgagtgaggtgcattcctttgctaataacatttgctgtcctcagacattattaaaggaaatttaatgctgtttgacaacatttcaagtagtagccattgatattgtcatggacatttattgttaatcacaggaacaagtttccttttctaacagcaaaatctcttccactgtttgcagtcttgtgtgatgatgaaacctcagcccaccctcctaataggcagtggaccatgaggcctctctgatgagccttcagccaggctcttctccttgctccagtacatcatgcaggcatgtgacctaagttgcaatgatcagaccctctcctcatacgtagaatcttgggcttagtaacataaggatgaagaaatggttagtagatgtatgctttttactgtgtcagtgtcctggccccactgaacatggtgtgtggtccaatattaatggtatctctactgggggttttggagctgctttgtcctctagttcttccttctattccatgcgctctccatatccttttgatagtctccttttcccaaagttggttattctttcttggaaccaaggaactataaagagaaatggaggttcttccaggtaaccctgtttatcctcttagctttctgttagggacatccacagcacgagacacacaagttagcttttcagggtgcctcttgaggcctgtccaggaatttggaaaattcatcctcttaaacagcccatggcattttccacagtttatggtaagtactcttatctcagtattctgcagaatgcagaaaggtaccttgtaaacttggggtataaatctctctattggttttcaagttgtggtgtatagctttattcaaagggaattctaacatttcatacaaccgcagctgccatgttatttcttttaaaagcttgtgccttctctgaataattcatattgtccagtgccttcagattgtttcataagatcaacacctaaaaagtcctttcttgttctagctaatacttaaagactcttttgcaaatgtgtttctagaaattgttatcacagttagggtgggcatttagctttttgtgcctagcctgtaaacttggtcttattaactttgggaaccatgagtcttggtatttatgcagtgagacttaaatctttctcgaaggtgctttatagtaacctgcatgtaaagcctctaacttgggcctggcactcatcattgggttggaccccaatcctgatgatcttcaaatcctctttcatacatagccatcaccactaaagtcttattcagctaatgttagaaacaaagcattgcaggaggcctcatatctagtaaatgcactttcatacccagtttactgttatcctccataattaacgtgaggcataacagaaaataatcatagaccaggcatacatctcaaagcttagacatgttatgaatgtcactccacataccagctccaatccatcattcctgtcctcagcttggaagtggaggaggggagacgtgtttatgggactaaatataaactctgtggggtaattgctacaaaatgtcatcctcagaaacacctgggagctttggaagaaaataaaatttcacagccccacgctaggtaataccgaatcagagtctctgggaatgagttttaggaaactgtagttgaataggctccccatgtgattctgatgttcagccaggtttgagcgctaaagcatgttctgtggaacactaattcttctaggtagatataaataggattccctttaaaagtgttcttaacaaaaacagaggaaattcaggattttaaacaggttttctaacacgagaatttttcagaatctttatgtgcattgtgaaatgcatgtttctgactatggaacaatcttgcttctctatcccccctgccaactccctacccaacacaaagactctttactaaacatctaatgttgcagatttcagccctggctcctccttagaataatccggttaatcgatcgatctggggttgggggtgggttctgtgtgggagaaacaaactcaaagtgtgttttctattctctcactcaaaaacaatcaatagagaagatttttgtgaccaaatttgtgggggaatcacccacacatcaagcaagcaatcagttttccagcagacactaactcagcgtcctctaattcagttcagtactgacactctctacttagagatagtctcagatcacagaggttgagggctcagtcccacaagactgtcccctactcccaatgccacaggcaagcctctggttgcctgttttaatggcatttctaaaacagaccagctataaattggtgttcccgcaacctcctccttgggttcagttaatttgctagagcttctcacagagctcagggaaacacgtttactggtttattataaaggatgttacaaaggatacagatgaagagattcagagggtgaggtattggggaaaggccccacactgggcctttcatgccctttctgggcacactaccctccaggaaccttttgtgttaagctgtctggaagtgcatctgaacgctgtccttctgcatttttctgggagcttcattaggtaggcatgattgatcaaagtattggccattggtgatcaacctcaccctcagtccctctttccttccaggaggttgggggagggggctgaaagtcccaaccctctaattatatcttggtctttatggtgaccagcccccatcctgaagctacccagtagctgccagccattcatccgctaattagcatacaaaagattttcctttggaggtcccaaggattttaggagttttatgtcaggaaatggggtgtaggacaaatacatatattttaccacttcatgggctaatggaatattttaaaatttcccgggtgattttattagacacgcagggtttaggaccacagatgcgatgtaatgttctttggaagacattctggatgatttatttatttaacaatgtgtcccacatcacccagattttttagtttcacatctgtcaggtggttttactcaacttacatatgtatcatcctatgtttagagcttgtttttaaatatctttttttctgattataataaaaactttttcttagaaaaaacaccccagctattacagacactcttagataaaaatgcattggttgtctaagtgaattttaatcataatgagtaatattaattgaacatttataatgtaccaaggaagtcactaaatgtttttattatattatctcatttaaacctataatagtcctgtgagctagatgctgtgatgacccctgggtcctaaatgagaaaactgagaatcagaaagagtaagtaatttgtctcaggtcatgcagctaataaatggcaatactgatatcatatcagatcccaggtatacctgattgtgagctaaagctcttaaccaatttggaatcctggttaagacagaggcttttatgtttagtgatcagtgtatgcttaaaaccccttagtatgtacatgttactttgtgaagcacattttattgcaaggaaggtgaatcttcataaatgacaggggtttaggaaagtattccaaatgttaagaaccattttaaaatgggaagattttcaaccaaatatttgcatatgaatgtaaacagaatttttgtagttatagtagattggtaatttgtgcatgtaagttatatattattcattaatctgaatgtatttgaatattccaaattcactgtttacatatatttttcctaccgataggcttccaaatgttgctaagcttccagaaatattgagtttgatagatttttttggttcctctggccagaaatttaaacaaaaagaaaagaatgatttggactactggcaataaaactcagtgaaggggatttatgtacgggtccgaatgcatgcttattagtcactcagaacatgatgtttcattttaaaagtacatgcctttgcatcttgttatgacatttagaaaaagttttcagttgcatgtctttcattttgccagagaagataaattgactaatatgtaaatgacattacagggtccaagtgtaatggttaattttatatgtcaaccaggctaggtctggatatttggtcaaacatgtctggatgatgctgtgaagatattttaaagatgagattaacatttaaatcagtggactttgaataaagcagatccataatgtggtgggccacattcagtcagcagagggccttcagaaaaaaactgatctcccaggagaaagaattctgctagcagacagcttttggtctctggctgtgacattaactcttcattgcttgtccagtctgttaacctgccctgcagattttgcacttgccaacctccataatcacgtaagccaattccttggtgtgtctctttctttctgtctctctctccgtgtatacatctagtccatcctattggttttgtttctgtggagaaccctgactactacaccaatattccttattctccctgtatgagaaagtttctctagctgtttttagaataattttatttggatgtccttacccgcaaaatcaactgttagacttttgcagaatgattagtgatggatcataccaaatactgccatctccaacactattgatgtttccccaggcattgggcaatttcatagatgccatatagagtaaatgggaacacagaaagttcaaagatggaatttgttactccctggaaatttgtagtggtaaaggtttccaggtgtggcttttgtcttccagtccaagtaggataatttagagaaatgggaaaataatctctttctagaatccacttcatttttccatttaacctacaggtatcaagtgctactaagccgtaggaccaagctagatcctatgggtagaaaagaaaagaagtggatatggaacttgccatcatagagcttagggtgtggtaggggttacccaaaaagagttaaacaattaatactttaaaaaattataaactgtataggggctctgaaggagaaaaggaaagtgctgagatagtgcataatgtgggcaggatctagtgtaggtggcagagtcaagaaaggcttcttggtaaatgtgaattttgagacccccaaacttgagatggagctagccatgcaataaccagggaagaaagttccaggcaacgaagacagcatgtaaggggcagtaggtaagtaagagcttgactcataacctgatttaagttttaatgtacaaacaatcaagttgtcatgggtcaagaaagccttagactaagctgagtgaagggggctctaaatagaatcatataggagaaataacactgggaaaatgaggatagtttagctggattctactttgagagtatgataaaggagaaacattagtttcacactttactagtttttaaatatgtgtaacttccatattatttaaactataacatgaggcatttaggttatatatatatatatatatataaatatatatatatatatatatatatatatatatttttttttttttttttatgcagagtctcactctgtcgccgaggctggaatgcagtggcatggtctccacggactgcgagctcgcttcctgggatcaagcaattctcctgtctcagcctcccgagtagctgggattacaggtgcacaccactatgcccagctaatttttgtatttttagtagagaggagggttctccatgttgatgaggctggtcttgaactcctgaccttaggtgatctgcctgtgtcggcctcccaaagtgctgggattacaggcatgagctactgcgcctggctgataaataattttttaagtatgcatgtgactctcacgagtgtggactgctagctaaggctggctcatcaatatttgtctagagatcttaaaactgagtgaaatactgtctaagtgaattttaatcataatgagtaatattaattgaacatttacagtgtaccaaggaagtcactaaatgtttctattatctcaattaaacctataataatcctatgaactagatactatgatggcctctgggtcctagatgagaaaactgagaatcagagagagttagtatgaggctcctcacactttgggaggctttctctgcatctgaagccacttgaaagtctagactcattgactttgtgaattttaatgacttccttcctccctcccttccttccctcccttcttccttccttctctccctccctctcttctttccttcttttttccccttcctctctttgttccttcctccctcttaccaaatgctagtacagcactggatatggtgaatatatcatttcaggcataagaaattatatgccgtgtaatcccagcactctgggaggccgaggcgggcagatcacgaggtcagaagtttgagaccagcctgaccaacatagtgaaaccccgtctctactaaaaatagaaaaattagcccgatgtggtggcacgtgcctgtaaacccagctactcaggaggccgaggcaggagaatcgcttgaacctgggaggtggaggttgcagtgagccgagatcacaccactgcacccagcctgggtgacagagtgagactccgtctcaaaaaaaaaaaaaaaaaatgaagttgtgtgcacggggacccatatcctccagtcctatagaattgtaagttggttactatagaacttgtgctgtatttggaacctttcactgaagaatataagcaaatgtcaaacctgtaatttgtcagagtttccatttcacaatctgaagaactgaagtgtacaaccttcactctgcattgttgaaatgaagagaaagagttaaaggtaattatccatataatttgaaagaaaaaatgtctccttctgctcaagaagtagggtctgataccttgattaatttgtactggttactaatatttaatttccctggatagtgtctgaactttccatttcagtttgccattgtaccccctttgtattttaaaattatttttctttatcacacctgtaatcccagcactttgggaggccgaggtgggcggatcacgaggtcaggagatcgagaccacggtgaaaccccgtctctactaaaaaaatacaaaaaaattagccgggcgtggtggcggcgcctgtagtcccagctactcgggaggctgaggcaggagaatggcgggaacccgggaggcggagcttgcagtgagctgagattgcgccactgcactccagcctgggcgacagagcgacactccatctcaaaaaaaaaaaaaaattatttttctttaaaggttatttgtctatgattgtgcattttaatagtatgaaagggtacctggtcaaaactgtttgccttttgtcactttctgctaactcttttccctagagacaatgttactattatttgtttatcatttcagagatctttattgttatatgggcacatataactgattttgtcagttaaaaaaatctgaatgcttactataaaaaatgatggcatggaatatttttcttcacttaaagatgaatcttagatgtcagtctacattaatctatatgtagctaactcttccctgcgaagagtatttattcctttgtacaaaggccataatactagaacttgctcataagaatttatgttctttacagactcttgctatgataaacaatatctttgtaaacatgtgtgattatatctgtaggataaattcctgaaagaagaattggaatttttttggtcaaaaatactgtattgtacatttaaaaacttttataattatttccagattgccctgcaaagaaattatcataatttacattctcaaaacaaggttgtcataatgtttgagttgatgcagtagctccttagcaattaatagacgttcattttacaatctgtcaacatttgcaactttcacgaagcctcacaagtgatcgtgtacccaggtaaaacagcttatgttagacattcttgtgcaaggtttatggttggctgttgttcttaatcctttccagttataagagctcattgaatgtctcagttcaaggttgccatgttatattatgagacattgggtactgtcggtgagacttggcatgactggacgagccattctgatctttgaattacacagcaagtagaagccaggacagtatgttcttgacttaaggcatcctcagcaaagtgataacctagctgatcttctgagaaccctcagccagacacagtggagtttatggtaaattatagctcttgttgagcattgactatatgcctagcacccttgcatatgatttctaatctttacaacaaccctccaaaatgggaataactatcctcactttacaattttggaaatttaagttcaaaacggctgagtgcatttctcaaggtcaaggtcacataactaataattggcagagctatctccctctgcctgcttccagaggagtttttccttttattgcatcattgcaattgaccatcagaatcacttggctttactaattttttatgcattaaacaggtttttctggtcagtatccaggcaaatttaggcagttcttgtttggaagggtcctttcctttggttggtccagcttttgcacccctgtacttagagggatgctcagatgctcagatgtctttgctactgctgtgtccagctgtggtgtatcttcccatgctgaccctactctcatgtttctgaactgacatctcgcaagattaattgagatgctgtagttttctagcgctacactggctgtaattagtcgctgacatatgatgatttattataggggattcctttagaaatttactttgtgttttgggactaagaaatgatcgttagagtttcagacttacagctcttgtcctgcaccacttaactgatcaaaactatgtttgggatgaccaggcagcttgacatcatagcactggtcatcctgactctctaagtaaaactgaaatgtgtggcaaattaaaagcagtgaagatggtgcatggctaaattaattcatcttgattaggccctggtgaatttttaaatatataatcagatgtgagaatttaagatgtgggatagtcaaagccaagaatccaggaagacttctagcaattccacaaagacaaaaagcaaagatgccagaagactgtggccaggcttgcttgtggaatgaaaataaggggaaaaaaatcacttacaatagattaacagtataccctgtcaaagagtgtgccagaagtcacgtaaaattcccaacccactgacagagattttggagaggtgatgagagtgaggggaagggattatctgaaaaatatgaacaaggcagtagtgaggaataagatgccagcatcaacttccgctgtcacttgttttctcaacggttagccatgccactaaggtcaactcagtatgttattaaaatgggcggttttaggtaatgattactttcttggcagatagaggattcttttatctttggggtcatgcatttttaaaagcctttgtctgcatagatttatttaaaacacacacacacacacacacacacacacacacacacacacccccttaagcaaggtatgctggctcacacctataatcccacactttgggaggctgaggcgggaggaccacttgagcccaggagttcaagaccagctggagcaacaaagtgagctccttgtctcaacaacaacaatgacaacaacaacaacaacatctgggcatggtggtgcatgactgtgatcccagctacatgggaggctgaggcaggaggttcccttgtgccaggaggttgaggctgcagtaagctatgttcatgctactctactccagcctggaagagagagtgaaaaacaaccaaccaaccaacaaaaaagcagcttgattgaagtgtagttgatgtacaaaaatctacacagatttaatgtatacaatttgcggattttaatatatgcaaagatgcatgagacaatcagtacaattaaggtaataaatatatctattatctccagaagtttcttcctgcccccgctccatgtttttactggtaagatcacttgacatctacttgcttgacagatttttaagtgcataaaacagtgttgttaactataggcactatgtcgtgtagcagatctctagcacttattcatcttgcagaattgaaattttataccctttgtacccttgaacaataactctccatttttccttcctctacaggctctggaagccaccattctactctttgtttctatgagtttgactattttagataccttatataagtagaatcacccagtatttaaccttctgtaactgccttatttcacttagcatactgtcttccaggtacatgtatgttgtcacatatggcaggatttccttctttttcaaggctgagtaacattctattctctgtgtgtgtgtgtgtgtgtgtgtgtgtgtgtgtgtataacatgccacgttttctttattcatttattgatagatatttaggttgtttccatatcttgactaccgtgaattaagtaaactccaatgatcatgggagtgcagatatcacttctagatctaaatctttgacatcttgacttcaattcctttgggcacagatttctatgaagatttcttttttctttttctttttctttttttttttttttgagacgagtctcacactggcacccaggctggagttcagtggcaccatcttggatcactgcaagctctgcctcctgggttcaccctttctactgcctcagcctcctgagtagctgggactacaggcgcctgccaccatgcccggcaaattttctgtatttttagtagagacgggttttaccgtgttaagcaggatggtctcgatctcctgacctcgtgatccgcccgcctcagcctcccaaagtgctgggattacaggcgtgagccacagcaccaggccttctatgaagatttataagttgctcagtttttatttctggtgtgtgtgtgtgtgtgtgtgtgtgtgtgtgtgtatgtgtgtatgtgtgtgtgttttaattttaaaaaccctgtcatatttaggatatacctcgtgatgagtgtgatcagcactaattgtcactctgttatactaaaagctctttccgtagtgtgtcttcattgcaagcatccattgtgtatggaatcctgaatacagttatttgaatgtctgagtattaaacaattaactgtctttacagaatgtcctccggggaacatagtttttccttagggacccttgggatctctaaccgcttaaaatctagaagctcttatgtgataggatgggaaattaaaaaataaatctctactatatgttaggatgtccatactgcatatagctccttaagataatggactatgattctatcttgtctctgcgcccagtacatggcacatttcagggtgtcacagatttcctaggattaaaatgcttagtaaatatatgaatgaattctaattttagtttctttatctggcaccttttcttgtactttctgagcaataagaagtaggtatctgggtttctagtagatttatgccatataattaagaaatattgatttaataatttttgtgtcctgtgaactttatttaatcattagctaataagatttattgagcatcttgcagttctgtagccctgtgcttgatggtgttagctccttagcacgtaattgttttgactagaatggtaatttaaggtaatttgatatacaaaatggagtgctatgtatggcaaagttgagagggggtgaggagaatataacttcaaacctgtttgaaaactcatcaagtaatatttttcttactttaaatgtgctttggcctcctttgtgtgcaagcaatagagacctatttaggctcctttaactactgggggtttatcaaaaggtgaaatatagaaataaagagacgagaaatactgtccacatgggagattctgatgtgaattctgggaaagctgcacaagtgtggcacacctggacctcacctagatggagggtggttcgaaactagaaggtcctttgtgacttttgtctgatgaggagtcctagcagtttgaggatccagttttcatagttacatagttaatttagtttaatgacttattctgtctttttcatctttgtggtttgcgtttttctcctttctcaatgaattgctagctctcttctcaagagaagcctggattgcttaagttaccatcttcccacctttgtgggcagtgcccttgctggagtccacctgataccctgtggatcagctgccctttgtcgggttcccatcacagccccaatgtgctgtgggtgaaggggtggccagggtgttgagagagagccaagtccatcagagaactttcagaagtaccttgctgtgaatcatccttcacagcctagtgggtgccgctcctcccttttattcaattttttaataaactcaatatttgatcaaattaagtggagggagggaggatggaataacatgctcctgatataatggaaaattcaggctcattgaacttgtgtgatgtgccacaatccttttagaacaagaccgtgattgaaactagtctcttttctctattacttttttgattgttttaaaaaaaatcaagaatatttctaaaatataaaaaaaattacaggagagataatttgagtatcttcactttttacactcctgccaagaatgccccacaaccccacccattacagaaggatcagattccatattggaaatatatgccaatttcaatttagctgctcagtaccaagaattcttgcacctatgagatgctaaaggtttgaactaaatggagccacattcatcattgttgtagaaatctgccagtgtttaaaaggtgctacagggaacctttaagtcatgcaccaaattaaaagattgcaagctccactggtgtagtcaaaagcaagctcaaagctgagtggcatcaaaccaagagtagaagataacttgttactgaattttgttcttcctctgaatgccactctttcaagcagagcgaggaaaatatgaattttgtgttgttaaaagatgtttatttccacaccctaatttatgtttcaaactgcaggcttttgcagagagtgtttctctgaaacttttaaagaaagtgacatgttactacatgggaagaaaagatagagcctggttggtaatgattatacagtcagggctttatctgcttgcagataatttgtggcttatttttaaccgtctgccagtttcttttctcattgttacatttacctgctgattgcaaccctgagccaatcagtcactggtgagcatttggtgaattctacttttttaaactggccaaaagaaaacacatatttccagaatggacacagtgatactagctaatatttattgaatacttattatgcagtagattcaatattttaaatttaacatttacagaaacctcaccatagcaagaattatcattactgttttactgatgaatagggtgaggcttagaaaggtaagtaacttgtcaaggtcttaaaggtagtcaatgtcagaggcagggcttggatccaggggaaacctggtcaattttaatcctgcactgagaggtgatcacaatctgaagactgtgatcgacactaagacagattttgtcaaacaagctggtatcatgaggaagtcagtttggatgatgatggtatcccataacatgtctcaagaagaacttaggatgtttagcttatggtggtgtaaattcagtgcaaggggatgtaataggtgtcttcatttacatgaaacaatttcaagcgaaagatgacttagatctgctttgcatttgcacaggggtgagatgtaagacatattaaagaaaaccataaagagccaactgaatgaaatgattcatcaataaatgtgtttcctcaacgtatagtgagtgtcctatcaatggaaactttaacaaaggagctagattttggttttacaggactcttagatctatggattaagatgtgtctgtaatattagatgtatcttagagaataattatccaaaatatacttcatggaacatggaggaactacagactaacattttctatggtaaaatatttgggaaatgcttcattttttctttcataatatattaacacgttaaaggccaaatcaactatttaggaaaagaaaataaaacaaaatttcaccaactttatgaagctaacatttcctgagctttaacatttttcatttgttattattttttgatactaggaaagccttcttgtgatactattaagatcccatagaacattgcaaatgcttgtccaaacctgcaaaaaaaaaaaaaaaaaaaagcgcacatcatgtgcagagacttcccatgggcattgggtgcagctatttgtaatgagaaacaaaataactgttggcttccgtagtggacttgtgagaaccagtagttttgcatggtgcagggatagataagaaagttgttttcgatatgctattttggattctctcactctaggaaataatcaagtgttgatggtattaaatttcctttagcatacatgcaaagagggcatgtttatagactttgacttgaacttcttctaacaggccttattttccctgagtatgtttctacttacttaaaaacagatgctctctgaaaaattcatgaaaaccaaaaatatgctggagactttggagagaagctcttcaccctgttattaaagttagattgtttctaacaatttttttttgcatcttctgcttggcagttaacttcatgaccttgaacaacctttctggctttcctgtaactcagtttccttcatttacctacctacttaaccagattgtacataaaaatacatagtatatatataaatggttatattaacagatagatcctttcaaacacacttatattggtggctttgttaatgaatattgcatttgtggcagatagacatgtttccttaaatgaaggttttcaaaactggcattgtaagtaaattttacatattatcagttgcttgcacccaaaactatttctactgtgaactggaatacatcttaagaaattattttaaaagatgtaaataactagtggtaaagtgatagagcacatcataactttcttcattatcataagtaatgtggctttgtccatatgttattctcatttgaattataattcttatttttattgtatgggggtttgcacacttttgtcctcaacttttcttgtttattttaaaaagggagtctcaggatttttcttctgaagttaaaatttaaccctaaagaaagatgccacagtagtttagtctgcttttctggagctctgaaccattgagggccagaactgacactataagcaggagcagcagtcccaagatgggattctaatatcaacctttgttttatctgattcactatgagtaagaggatacaatatgagtgaacagcaaacctgtgagaaacctacaagtataaaaccaatggtatttaattcaggtaataaaatagaattcttaaacaccctctaaattaaaaagccagaagatgcagttctaattacatgccttaactagaagtaggatatttgcagcttatcaagttttatgtaaatttgttcctttggcacaatttgcctatataagcagtattagttcagtataaaatgtttattagttattgaaactggctctagtgtaatttctgtgttttaatacatagtcccaagttttgtgggatccctagagagaactgtgtggtgtctatgttttgaataaacaggttttttgaataatagtaacttacatatctatagtctcttatctgaagcccttggggtcaaaagtagtttagaattttagattttagaacggtagtatgctactagtgctgtgtgctatgtgacattccaatagaatcttgggcaatggccaagcatgttgacatttcttagtgcttgaatgggataaagatcataaagagcatctttttcagctgaggtcaggttgggctgacagtgtgtttggttttccagagcgttttgcatattggaactgcagataagggattatggacctgtaatattaaatataatagctgacatgtattgtgtttattccaagccagacatggtactttacttgtattatctcatttaatctttgcaactctttgaagaaggtgatagtattaattttgttttacagatgaggaagagtttcagagaagttaagaaacttgcctaaggatacatacacctagtaagaaagtggtagagttacatctcaactaagtcgaattagacaccaaatctggtgtgcacaataactagttatcctcctcgtattcagtgtctctgatttgcagcccatagactcagtcttacatcaacataaagggaattaatacgaagggtatcaggtgatggagtatcaggcccaggggataattgggggaaagaatgagtctcagtagcaacacttctttgatagtctttcttggccatttccattagaataaatatacttctagtagcagtaagattcagatgagagagaatacttgagcttgtgttgctgttagctagggtaaagtggggtgtcacaaatccagcatgatggagcagtgttcctaaaggaaaattgattgctgtcagcaaaagatgtgattcacgtgagacagcacactcatgtaaaatgtccactgtatggatgattaattaattgcagatgaaactaacatttggatgaaaaccccagttagttttttaagtataatccattttaagtttaccacctgcttgataccagcaaaacagttaacttatcatcttgaatactcagattcctgtggcagttcagacactttctaggtcttggatctcagatctagaatcagtgagcttttttcttatttgtaatctgagagcaacagtacatctcccaatttacctagtgggcattgtgttagctaagatagcccaaagagcttctggaagttcataccctatgtgttcatatttctcatgctgattctgtgttgttcttgtataaccagcagatgcagtaggggagatcctgcataacttctgtggccaagtcataaggagccttgcagtgtccaccttattttcttggcatcttcactctaggggaagctactgccatgtaagaagtctgatcattatgctgtgaggaagtccaagctaaccacgtggagaaagatcaattcctggccagccagctgctattctagctctcccagctagtgtgccagacatgtaaattaccttggacatccccacccaaccgaaccattagttcatttcagtctaaagtgccatctgactgaaatggcatgaacgataccaagggacaactgcccagctgagcccagaccactcacagaaacacgaggggcaataatccacggtaataagtcactaggtttccccgtagtttgttatccaatagcagatatccagaaacaggtttgctgtgaagaagagagataatgtgttatattcctcaaatgaaggtgagcagctgttttattataattgctttgacaatccagaaagcaaggtctttctaatatcctcagaggtttcattacaatttgccattgtgatgaggatagtgatcatgctgtactctctggacagggatggagagtgttagtgattggccagcatccaagattgtcatcatttttccttagtgcaggagtttaaaacattctgccattttctcactcgtatttatattttcacaatgaatggggttttctctaataagattactgtcataaagtctcttatttaaaacttctgatggatcctcattgtggatgacagggcccatttctctgtttttgtagactgtccctctgtccagaaactacaggggaaataagatgtagattttgaaaaagtgacagcgagtcaaagaacagttggtcaaacagcttcccagcagttgggacaggctgccagagtgaatgtcaaagagaagttggttcttggatggttttacagaaaaacaagacaatgaaacaaagaaataagaaataagtaggaggcatgcagagggacaaaaatgaaggacttgatattaggacaccagagcaatcagtagtaggttggataggaggagttgagaagagggaggaggaagcaactaagggttggttggaacttcaacacttaatgggttcactccctcctgtctgtaattaattctagctttagttacttcattttctccttagaggaagataaagtgacctggactatcttctttatgttatagttgtttagaatcaaagggcattttcttaaagtctcttttcccaagtaattcttaagatttcttaagtgtcattgtctcttcaggtggagtcataaaatgcatctctatgaggggcaataaaatgcatggaggtgccttttatggctgttgctagcagaggactagaataagataatgatggtattttgcaaatagtgataaggagcaaattgcacattccaatgtcaatctgttctcaaaagagtatagttcaaagtttctacaaagctttttgaaagcttttcttttttgaaatgagtctctgatttctgtttttcctagctatacatagattttattttggggaaaattttaggtagtaacattatccttaatatttactgatttgctgtagaattttaaactggacaaatgaaagcccttgaggaagagaaatttatattctaacatagcgaaataaatatatgtcttgcaacttgaattgttgttaggaaattacttgtatgcctgagttcatgaattatttaatttaagattattttcctttttctaatttatcactggctaggtcctttaacaatcttttgatttattaagagtcattttccagaattagatttaaagctctattgttttcttatgattttcctatgaaaattgagtatgtctcctataaaagctatatttctcttgtttgacttatttcatttctctattatgaaaggcaatcattttaaaactgatgaaattttaaaaaattgacctaatctgaaaaaaccagcccatttcatgatccttcttcacttattggaaaagactatggagtcaggagttggggaatgtaccgacctccattaagaggtaaatgacttgcttgtgtctagaagcgtttgtgtcatttgcctctcagtgcttgctgcagttttaaggaaattgtcctcctattaaggttatgtatcagaatcacccttgaaactttttattaataaagattctctgtccccacaatgaggtttattaaatcagaatctccagggcactggtgtgctgaacgagtctcctaggtgatttgaattcgtaccccagtctgcatctgaaaactgccgcttttcaaagagaggcagacaggttgatggatgataggatccagtctgacacatggaaaagctacaaggagggagcatggaggaatccttcatttagggagacatgagtattgtgaatgatggtgtaatcactgctaaaaatttctcgggtttctaagaaagttttatgtcctcagttttcttgatggtgtctccagccaagctgtaatgcagtggttcccaactaggggcatcttggtctccaggggctatttgacaatggctggtcctatttttggttgtgataactaaggggatgccgctggcatctagtgattagaggccagggatgctgctgaacaccctcagtgcaaggggagccctgtgttagtcagaattctccagagaaacagaacatatatgatggcccagcttatgcggcagtcatgtgggagttttctcttactcagctttttgtcctcttttgatctccaattgattgggtgaggacctcccacattatggagggcaatctgctttacttagtctggagattcaaatgttaacctcatccaaaatatcctcacagacacacccagaagtacatttgaccaaatgtctacacaacctgtggcccagtcaagttgatatataaaattgaccatcacagccccttacaacaaagagttatcaggcccaaaatgtcagtagtatcaaggctgggaaaccctgatctagtgaagtgcagtgaaattctcaaaataaaaatattctaggggccagcattgaaaaggatgtggcagggccaggtaggagagcattagagatggcctgtgtggaccttgaggaagccagatgagataaagaggaggagagggcatgaacataggataaaagctcgagacaggaagagatggggttaaaatgaacatcaggtacttgaaaagagggatgttcatcaggtgttatttttcctagcagtgttatgtaaaatacgagtactatctgaaagtctgaaaaaggtagggccaatttaacatcagctttaagatagtaaatctctattctgtaagatgtaatggtagtttttaagccttgaaaattggaaatgttagacaatggtagcatatgtgagccagagagaatttgatggtaaatttgtagtacagaactttagacttgtttttaccaggaagaagcatcagagaaacagtgagagtaatcagcgcatatttgttgtatttccgaggctggtaatggagctaaagtgtgggggcagagctttttgtttgggaaagtgtggaaatggggctggtcaatgcagatgaaggggtgctatgggaaccttatgatgtaaaatacactctctcattgtcttcacaagtgtagctctaattgcctgacctatgtgcagatttgttgttcagaacaaatggggttaccataagtatggaaaatggttcctggtctacagcgaattggagagactagagaggcaagccagtgctcttaaatagcagtgacccatctaagttcatttttcatcacccttctggtaaatacttcctaattttctctaggggatgtgctttccccatgtttgatctgtttttttctgagaggtgtttggttcatcctggttgtagggttgggtttgtgatataggcatagcctctcagaggcatttggccataagtcttatctgggtatgggctcatgaccccaggtcaatctagtcagatctgctgatgttaattctgaggctcttttctttccttacttttgtatttggaggtgtaaggatgtaatcccacgttcttggtcataatcttgtcatactatagaaagggactttttcaaaatgtagttaattcaaggaagaccagagttgagagaccttatatcatttgtgctcctggatgaagctgtacctgaagctaggttgtcccagaattctgttagtaaactattaaatttcttttttggttatactagtttgtgttgtttctttcactaatgactgaacaaattactaaaagatacactgaattattaggagaaactgtccaattagtaagtgatatagccaactaataactaattaattaatgtttcatactccagtatttgggctctgtgtatatattggtgatattcttccattcttgtttgtttgtgttttggagagtttgacaaaaatgcataggctatctctggtaatgcttggtttaaagcatatttcatattcagaaagatgttgtatttgagaagcgacgtggtaattggttttgagagtatacatcttagacaattaaatggttacattgcttccttccttggtttaaaaaaaaaaaaagaaatccaagggtattccagttgtataaatagggacaacacagtttatgctatttgtaattacagataccactcaaaagaattgattccgtttacttttgtattagtgtactgtggaaagtcgttaattataatgtctgttcttatccaacaacatgcaataagtaaagatgaaaatatagagattattagtttgaataactggttgcatgccatccggttttatatgattgctgaaatgcaaaacaaacaacccctccccccgaagaaaacaacccaccgttcttaaataagacatttgtgacataacaaattagaatctaggagaaggaaaatattttcccagtatctaaagccattgaatcaaaataatcgtgtagatcacactttagttcagatataacctaaataaattctctagccagggcacccatctgtcaaaaaataaaactctggccctcatttaaaatggctcctttagactgaggtcatctagctgtatctaaattggacatgaaatgtcaatttcataccttatagtggcacatttcatattgctctacttaaggttatgtcagctttacccataaaatgcaagtgatttaggtcttattctaaatgaactaaccagatacatcagcaatgggcactgccttgccactgcagaaaaagggaatgtgtgaagggaagacagaaaccacttattctgtttcttaactctggaagtataggtattccaggttgggatgtcttgtctatattttcattccttgtgaatgataatttgggggtggggggattagaaagatgctttattcaaaatgaattgtattgcctgcaggcgattcacttgcttaagttatatttgtgagttattgtatgtaactttatcacattggaaagtttatgaaccttgtgtagaaaaaagattgcattttgggagctatgcacatcatggctttttcacaagtgacagaaaagtgctgcagatgatttaagcaggaagaaatgaatttttcgaaagattttgagtccagaagggagatagggcagtcagtcttggaagatgaaaaggacaaagccaaagcgggccaggcaggcaagggagtagtgttgtgaacgccctaccccacccctactgcatctgagtgttgcaactgcctgtgttgccactatgtaaacactgctccttaatatctgcttccttggatccgaattcagagccctggggacagtgcatctcattggctgagcatgtatcagccattggtaaccaagctgcaaagaggctgggaaagtaagtagtcggctctttcagcttctagctggaatgtgatcacctcccaatattcttcttcttctttttttttttttttttcgagacggagtctcgctctgttgctcaggctgaagtgcagtggcacgatctcagctcactgcaacctccacttcccgggttcaagtgattctcctgcctcagctccctagttactgggactacaggcgcccgccatcacgcctggctaatttttgtgtttttttactagggacggggtttcaccatgttggccaggctggtcttgaactcctgacctcaagtgatccacctgccttggcctcccaaagtgccgggattacaggtgtgagctaccgtgcccagccccagtatgtcttcttatagtggggggtatctaaaaacaggaagaagtttcagatgcttggcagctgacatggctaattttaggtcaacttgactgtatcatggggtgcctggataaaacattgtttctgggtgtttctgtgaaggtgtgttaggttgagatcaccactagaataaatggacttagtaaagcagattgtgagtggtcatcatccaattcactgagggcatgaatagaacaaaaataccgaaggggaaaaattaagaatttgtccctttctcttcctgcctgctggttgagctgggacattggtcctctcctgccctggaactggtatttataccatttcctggttatcaggccttcagacttgaactggaattacaccattagctcttctctggatctccagcttatagatggcagattttggaacttctcagtctccataatcatatgagccaattctttgtaataaattttcttctctctctctctctctgcctatctatccatctagttatctggatatatcgcctatgggttttctttctctggagagctctgactaatagagtagccaaagcaaagacagtttgtatgtgtatggttttatggggagtggattttcaggaaagcaggaaaaagattttttccagggcacttgggtagtgcatcttttttcctctaacaaatgggggagcatgtggccttctgagtactgggtttgcttaatgaatcaggagagccagtgtttataaatattcctttaaatggcagagcgtagatcctggtttgtagtccccttagtatatttgtaatgttttcatcatacccctaggccaaagaaaatactcaacattaagtagttttattcattaggtaggtaggttgaaacaaatgaataagaatttatgtactaacgtaatttgaaaaacatatatatcatttgaaaaaacacacaaattgaaataaaatatttttttcttaaataaccactattgcttactaatgggatatatcctcctgttgggcacagaatgacttcacatacattggaattagattggacactgctacctgattcccatccacattgattttcatgacgcacattttattacagcaatggctatgaacccagctttgcaaagatataacataatgaaaaggaatgtaatgcaatcaaatattgaaactgccaactacctcgagctatcctgacagttgagcatagcttgggagtggtagacatagattatcactgaaattctaatgtgagcctgatggcaacttgagttgaagggcattcttgcaagactgcttggttggggagtgtcacaccagctggatgtttccagaaccaagggcctgggaaaaactatgccagtgtgcacagtgcacactcttcctcagtgtagccactctgcttctgatgtgttttgttgtctaaatcagtcagcaacctatcacagatgtgtgcatcttttcctaccaatccacaaaacccacctgatacggtttgtctgtgtacccacccaaatttaatcttgaattgtaatccctataattcccacctgtcatggggggcacccagtgggaggtgattgaatcatggacacaggtctttactgtgccgttcttgtcatagcaaatgcgtctcacaggatctgatggctttataaagaggagttcccctgcacaagccctcttgcctgccgccatgtaagatgtgcctttgcttctcctttgccttccaccatgcttgtgaggactccccagccatgtggaactgagagtccattaaacctctttttctttataaattacccagcctcaggtatgtctttattagcagtgtgagaacagactaatacaccacctgaaataatgtaccccttaaaatccttatttatggattgatgagaaaacagagctttcattttatatgattaacagaagataagtgcctctgttgcccagatcagactgtcttagttcattcaggctgctataacaagttaccattttctgggtagctcctaaacaacagaaatttatttcttacaattctagggtcttggaagtccaagatcacggcaacctcagacacttttggtgagggcccacttcctggttcatagatgggccttcttgctatgttctcacatgggtataggaggtaacagagctctctgcagcctcttttataagggcgctaaccccattcatgtcctaattacctcccccaaagccccaactcctaatagcatcaccttgggtattaggatttcaagatatgaattttgggggaacataaacattcagaccatagcataggccaattaagaactaggtatatgtaaaagcatggctccttttttggtacaaagctggtgtatgcctcaaaatttatattttgcactcagaaaaattcttccttttattccctgaactgcttgttcatgtgatctctacttctgtatgtccaggtctttgatatgtgtatgagttgactgtttcattgtgtcggaacatcttttgattgtgtcaagagttccagcttcttttctttaaagatcctgttttataatctgccagcctgaccacactcagcatacagtcttcaaagttacaggttatgtgaaactttcaaatgagatattacttactcctgttcttcagctggaatatcagttgctgggggagctggagaaacaattcccaaaatgaagagcaccttagcatttctacaatgttgtcattgcagggtattgtgataggcagaatgctggccctgccccaaagatgccagtgtcctaatctctagaacctctgaatatgctacctcacatggcaaaagggactctgccaatatgatgaaggtaaggatcttaaaatgaggaaaaaattctggattatcctagtggacctaatattttataagtgtacttgtaaatgaaagagaggggcaggagttgtgattatgtgattgctggctttgaagatgaaagaggaccataagccaaggatcaaggtcagtccctagaaactggaaaagccaagaaaacagactctctgatagaccctccaaaaggaacaggaaggaagccctgcccagtcttaattgtagcccagtgagacccattttagacttctgatttccagaactgtaagatagtaaatgtatattgctttaaattactacatttgtggcaatttgtcacatcagtagtaggaaatgaatacagctataaagtggaagaaaccatagaaagttcactgagccttttgagattaatctttaactcatattctaaaatcatatagctccctgagtgtcaaactgataactacataatcacactttcactgttctcaggtttactacaagcagaattaccccatactggtgttcaggcagatgaattctcactatgaaatactttttaattggcgttcttatgattgcctccaaaatgtttaaaccttttgacagttgcatccattttatgaatccatcttcagtaataaagattgaaatgctctaaaccaccaaaaattagtggcttaatcagaaactgagggtggttctataaatccaaagctgctggtcattagacctcactaccatcattatgtatttcttcatcctgatgcatctcacattcattttttgacacgttaatgatttctgtcgtaggcatattaactgtccacatgtaaatgtgatggacactgctttggtttagcatggggctatttcgattggtcatacagccaaagaaggaagtaaaggatgtaaacagtgtgggtgcttatatttttttccaatatttgtggaagcatctgtttctacatatgactggcacaaatgatatctttttgtaaaatatttcataatttctccaaaatataccagctttctggttttgtttttagagctagagactttgtctgctctcctgactttttgatattctttctttcctttttttttctttcttttttttttaaagatggcatctcattctgtcgcccaggctggagtgcaatggcatgatctcagctcactgcaacctcacctcccaggttcaagagattctcctgcctcagcctccccaatagctgggattacaggtgcccgccatcatgcctggctaattttgtatttttagtagagatgggctggtctcgacgtcctgactgcaagtgatctgcccgcctcggcctcccaaactgctgggattagaggcgcaagccactgtgcctggctgatatgctttcatttttcactccctttttaatcttcccctccattaccagttaacaaactactacagctgcctctgcaaatgatagaagaacaaaaattaggaggagagggggctggaggaggagaagaaagaagcagagaaggagaaggacttcatagaaactacggctgctttcaggcatataatgtgagatcttgagagagaattaaggagtgaatttccacgtaactttcaaagattgtaaataggctgcctctattttttgcaattgccaggcaatgacagtgtactttacttctactctcctctgaaggagcaaaatgagtgctctatggccttaacctctatttctctcttaactggattcaaacgtatgtcatgctttgagccttcattacgtaagcgatttttctcaaggtcactgggagcaccacgttcactgcctctggatggttcactgtactgccgtgcagccttgctgaccatttcatgatttggggttcatgttcattttatagactggatttttttctgttttacgtttcccattttctttgttacttagaattaaccatgaccagatcaattaataaaatagttcaggttgtcttattctatttgtgcatttggtttgcagttaccttcacaaatattctggtggctaatgaagttaaaccaaagtttgtcaatctgattttacataagctgtgtgccaaaactgtgttaggttcaataatgctcattttcttgtttaattttcacaacaactaagaatattatcagattcatattctccttagataattaataattaatcacattattattctcctgagaaggaggtgatactattctcgatttagacataaagaatcttaggctcagagaatcaccagcagattgtaattttgagcctagatcatcaatgtctaaattcttgctcctcttattataccattctactaatttatcaatgataaatatttgttaaatgcatgttgtgtgctaggcattgcaccctgttctttatttacaaacatatgagttattattatctctgatttgtagatgaagaaattgagtttagagttaaatgattgcccaggattatgttgttacaagtgcagaatcagtaatcaaattgctgtgctgtgtcctccagggcctgagttcctacattgccatgagccattaaaggtaagatgctaattaaaggtatccatgactaattttaatggctaacacaagtttggtgaaattgatttaccataatattttggttactttttagggctactcagatacacatacttgaactgtaacagcaaatagtgagaggggaagtaaagattctgagcctcctttctgggtttacagcaatattttgaactaagaagatgaagtagaattagacatgagcaaagctccatccctttcttctgcaggtgagaaagaaatagagggtgtaggaggtaagcatacctacctagtaagccttcatgatttaggtatctggagcaggtgggactggagcaattgccatgaagttcacaattttagtgtggcctgtgatctgtttctttggctacagcttacatatcaggcctggggatttttctggattctgaaggttctagcttccagccttgaaattattctcctacttgtaggtcagtaaaacaagcgtttctttacttgaaagttttaagtcgacagttgccatgataaatcactcccactgatagtgttttagactttgttggttctaccttacgggattttcatagagtttctaaaagagaaagacaagcactagagtgaagaattgttcttattgtggaagaatcatcaaccttggctggacacacagatcaaggggttcagggatgggtggcaaaggatcattgagagggttacatgtgacccttgcctaactatagtagttaattcaactctgcctacacaatgacacggattaccgaggatatgacttgtattatactcatccctctgaccccacatcctaatgttaataatgattcttaaacctggaattgagaactcaaatataaaccagtgcccagcacatagcaagtcatcaattaagtttattgaattaaattaaatattggaattgtatctgtcaaagccatatcagctctaagcttcttaagagaaaaatctgcccagaatttctcaggagggatttctcaacatcgaagctgtcctgttcatattggatttattgtacttacataaacaggaatacacgagcagggaagatcagatcagttaccacaataagggttttgtaccatgatatacatcattttcgctcccctaggaaagcactgctgatgaaaacaattttggagggaggtggtctcaacagagtagatgttcaggtggaggttatctctggtgctctgggcttcttattcataattttctcttatgaaagagagtggttttcaacttcacaattcctttgctcatttggaaatatagtagcagaaagatgaagagagtttgtgacccacaactaaagtctgtgttctcttgtcacttcatcaaattagttctggtggcatttggttcccccccagaaataaatcactgttaaatgattctttataaagcagtccacacatttatcataccacagtgatctgaacccatttagggaattataagctacagttggtcatgttgcaggcctagcaactctggccttgtcacattgcatctctctccactccctgtgctaccactaatccttcaggactgagattcaaggctttgctagtaagaggcttggaaataatcatataaaacataatagtgtggcaaggtgagatcgagcttttaatttttttaagttcacagagagcaagaagacagataggaaaggaccggcagattgggaaaaatcaggaataagatgaaatatcctcagaactttagcttttatgattccacctcacattcagtttaattatgaaatttactggcagtgacaattggcttttggcataaattaatcatgccaagcattatacatgaaatgaaatttcaatcctatttgttgaacattttctaagagcttggcaatcttgcccagcactttacgtagggtttctccttatctaccttatgaaatatgttattattattcccacttttaatatgagaatatttggggattagaaggcttaagtaatttgacaaaggtcatatgggctagcataatagactagaaaacaaactcaggatgctgtaattactacactggaatcattcttagttttttttttttaaatgaagttggcattagttttgttttttaatctttaatacttttatctgagaattgataattaaccattttaagaaaatagttacataaatttagaaatcatttggaaaacaggtaaaattgctacattatttcaatttattttatttttaaaataaatgatattttttatctatatttgagggctatatgagaacctaagacttctattgatgttaattattgacttttatttactgtagttttagtgaataatttaattgacttctattaattcagtcatcatatgctaaacctagagtaactgctgttaatatttttttttttagctactacaaattgaagtatttttgattagagtaaaatttatttctaaaggtaacctgagtaatatctctatgttgtagatagatattactatctatagtaatatctatgcatatagtatctatgtagtagctttccaatttattttgctattatctaaaataagaaatacattttatattgttccagtaaatgcacacatataaacacatatatatgaaattgatacttcataaaatattagttacccttattataatcagtgctcacttgatattttacattttatcccattgtaaaatagatactggtcatgactcacagtattgatttcataactccctaatggttgtagcctgcagtttatcatttgttcaaatgtagtgtggtgggaaagaaagatgatatgactcttcagacagagaggtctggtccctaccctgatatgtgtcagttatatgtcaccttacctataaaatggtgattatcagtacttctcaggggagttgtaaagcctggtacctagtagataattagtaaatatcagtttcttttgtctttagagctcacacttcattccatagttttttgttgttgttttgttttgtttttttgagacggaggctcactctgtcgcccaggctggagtgcagtcgtgatcttggctcattgcaacctctgcctcctgggttcaagcgattctcctgcctcagcctcccgagtagctggaactataggcactcaccaccatgcccagctaatttttgtatttttagtagagatggggtttcatcatattggccaggatggtcttgatctcttgacctcgtgatccacccaccttggcctcccaaagtgctgggattataggagtgagccactgtgcctggcctcattccatagtattatagaaaatgtcgaactgtttaagcattccagcactttattttttaattgttattatttttctaccctcagcatgcatcagaggagcattccagccctttagtttggattttcttgctatttctgattttaactatgtgtgttcttcatatcttggactaaaaaataaaaacaaattaaaaatagcaaaaaaaaaaatttgcagtaattttaacagaccaacattaagtactctggaagccagaccagaagctaggggctcgttaatttttatgtatcatcaatggaaatgacttttatttgttaattattttttatgaccacctattgtaacatcttccaacacatatttccccctctttcccgtcctccactctttaaccttccttgcccattttttgtagagatgccagtgaggtctttctcagtcagtgcttcaatcccattatttcccatctcaacaggcttcactggctcaccattatctttcatattagtcacaggctcctcagcctgaattgaggcctttatgacacaattctagtctacctttggagatgtgcttcctttcagtgtcctctctgtatttcatacttactgctttgatcagacaagatggcctgtctttttccaaatggatctcacaatttccaggctctgtgtatttgcttatgttgtatcctctacctagaagtcttttctcctggtccatctgtcctcattaaaaactccactcctgttttcaaattccttgtctgtttcatcgtgactcttctaattgattctctttcactcccacactacttctattgatgttgatttctctgaagctggctcctagtgccttttttcttcttaaggcatgatagtgtgtctcaagttggaatgatttcatggctcccatatggttgattggttgtgggactttatcgctaatgataattcagaaaatagtagtaggactaattgcaattctgcagatttcaccttaaacatatgctgcttcttgggctgtggaagttggacacattgagataagattattcagaaaaacagcaaggccgggcgcagtggctccctcccataatctcagcactttgggaggcctaggtgagagggtcgcttgagcccaggagtttgagagtagcctgggcattataggggtaccctgtctctacagaaaataaaaaaaaaaaattagccttggtggtgtgtgcctgtagtcccagctactcagatggccggggtagaaatcacttgagctcagaagacacaggttgcagtgagctgagattgcaccactgcacttcagcctgggtgacagagcgagcccctgtctcaaaaaaaaaaagaaaagaaaagaaaaaaatattagtaggtctaactgtaattttctaacttctggttttaaatatacactgtttcttgggcagtgacagtagggtaaaattacccagtttgtgtaaatcttatgaggcttgataaatggacttaataattatcagatgacgaaattaaatgagtcggtgaatgttaatgcgtccctccttccatgtaactagatgccttgggacagttccaatatgtggcatttatattgtattatgatgtgttaataatgtggatcagagacaagcaaaagtcaaggataaatgtaatttcctgtgaaatgtatatttaatactttttaacatttagcggaattacctttggatgtcaattgaacattacatccccttactaccgtgactgtgtgtgtgtgtgtgtgtgtgtgtgtgttgggggggtggtgtctaaggagtaaatctattctcttactgcaatttcaaacactgaagtattataaactttctttaattgtatcgagttttatatattttgttgattctaagagtttttgtgtatgtgtgtgatatcagtgaatcaggcaaatttcccagtgtgtgaagcttttgggtcagctattaggttattacatcatttcagaaatgctccgtctgccttctggtggccttcagatttggccaagtagtggagtagtgcaaagactgctaatattgtagaaatcccgtgaccatacgcagtggtttttattttgttctaaggggtacacacttccatttgtctgttttcatgcggagcacatttatatgagggtaagttcaatggcaacttttagtctgtagagggatacgttgagaaatatgttactgaccataaattaccaatttgagatgaatgcatacttcagaggccccactagctcacatttttactgctgtcccctaaaagcaccttcaggtttatatgctgaagatggagaccttcatagttagaaaattgcattccctcaggccacaggaaatattgcttgacattctgtaacactatttgatgttcttaaaacagcatgctatgtagatactactctaggtcatgtctaattttttaatctgtatttataaatactatgaagcttgtggtttttaagaatagtaatgtttacatttatataatttgatgcaatgacttttccctgtaatataaaattaatttaatgtttagtataaaggaaataaccaggttgtatagttgtaggttgtgcaactacaggttgtgtagttgcaggttgtgtagttgacttgtgtattttcacttcctcatactgacaacataaccagaggcctgaccaatgctggtgaaataaccaaaaaggttgtcaggcagacctttgcgttttaatgcaaattcaacagggaatggggtgggcatagcttttttttttttttctgtattatatcaagtaagctgaatatatgcaaggttagagtttaaatgtaatgattagttttattcatatacatttaaaatctaatattctacaagatgcttagcaccatacttgacacattgtgagcattcagtaaactgatgttatcctttaagaagcatttaccacagaggttaagagcatatgctctagagcaaagttgcctaaactatttctgcctctgtttcatcatttctaatatagggatagatcatttagttcatagaacactgttaaatccatataaagcatctataacagtgtttttaataagtaaaaaaaagtcagctaaatattagttgtttattaattgtaatatatcctaaagcaacttatttcttaacgtagacttctgcacattcttggaaaattaatatctctttttttccttgcaatttttttggatatttgaaactataagtatcttcacccagttgtaggacatatgtttttctattttcttcccccttgttggagaaatctatttctacgggacaagctggttatttgtctacagatcctcccctggggattctgtagcagctacttcaaagctatctcagcttgcacttaatcatttgaaacatcagataacttgcttgttcattttatgcatgttttcttattgaggaaattagtcaacctaaaatgagcaccagaagattatttttcttggttttactcttaaagtcattctcaagcatgttatcttggaagagcagggcactctcctgcagcttttaaggatgactgaactggagaacattctgtttaaccacaaaactcatgttccctctgtttaatttcttaaagcttgccctcccttcaatgcaattaccatttttcttacacattaagaggacaaaatttgttggcttcctctttgggggaggatgtttatttatttagaagatactttttgagttcctactggtccaccgggaactatcgtaagtaagttgaggatacagggatgagcaaaatggacaaattctttgttctcatggaccccacaggagaagaaagacaatagctagtaagcaagtaatacatttttttagacagctaatttttgtatttttagtagagatggggttttgccatgttggccgggctggtctggaactcctgacctcaagtgatccgcccacctcagcctcccaaagtgccgggattacaggcatgagccacttcgcctggccaacaagtaaatatttttgactatgtggaaatatgatgaagaaaatgatgaataggaaaatgggactaagaggcaagaagggcgaagcatctatgaggaagtggtatgtggacagagatttgaatgctgacagggaggcagctaagagactctctgaacaaagaagtatccaggcagaaggaacagcatgggccagggctctggggccaaaacaagctcagtctggctgagaaagggaataaatgactgaacacatttctgtagccttctatgttccaggtgctatccaaggtgcttgggatacgtcagccaacatatttgcaatgttttgcatagttgtcctctccaaaactcatgtcgaaatttaatccccagtgtagcagaattgagaattggggcctttaagaggtgattagaccctgagggatctgccctcaagaatggattcatccactcatggattaatggattaatgactaatggactaatgagttgtcatgaaagtgggactggtggctttataagaagaggaaaacagacctgagctaggacactcagtcatgtgacagcctgtgccaccttgggaccctgctgagagtccccaccagcaagaaggccctcaccagatgtggcttctttattttggacttctcagccttcataactgtaagaaataaatttcttttctttatgaattacccagtttcagtttattttgttaacagcaacaggctaagacaataatgcatgattttttctaagtaaattatgtacaatattaactgatcagtgttttaaaaaaatgtttgtatgcagggaggtaagagtgcaggaataggtgggctacagtgtaaaacactgaggtcaaggtaggtctcatagagcaggtggcatttaaacaaagtattgaaggagacggggcaagtttgtcagatgggtatgtgggagaaggaattaccaggcacaggtaatagctagtacaaaagccgtaaggtagcagtaggcccagcttgttccaagtgcctcaagaaagcctctgtaactggaacagagtgagtgagatgagtgaggcggagaagaggttagagaagtgataagaggtggcatcaggccagtctttgtaaaccactgtcaggacttccgtttgattgaaacgaggtgccgtctggtaggtagctttggggtctagactggggaggggtggagcaaagttaggagcagggtgacttgttagcagaataatggaataagccatgagccacactctggttgctcttacagggccgtggtagagatgatgggactttgtcagattctgaatatatttagaaggcttcagaagtgaagtatgagagaaagaagaatccaggatgtgactccaagtgttttgtcctgaaaaaatagaagattgagatgggaaagactagtgctggaacaggattggatgaggtgaggagtggctgtgtaaagcaggagacacccaccgttcccagggcgtagttctgtatctgccttcctgagttaggcttggcagtacgactggctctggccggtgggtcatgtcgatgtgagacaaaagcagggtacggaaatgtactcccagatcgggctcagcctcttgtgatgcagtcattttcatgagaagagctttcctggggcagacgttgccctcttagcctggaccccaagtgaatgcaagtgacacagagccaccccagctaagcccagctcatcccacatttggaaggagggctgcccatggagcctgctttagattaccagaccctacagaatcaagagaattaatagctactgttgtaagccaatgagtttggaggtggtctgttatgcagaagttttgtggcaatagctcagtaatagagaatccagggagtgaagtgaaatagggagttggatataggagtctggagttgagaagaagtcttggttggagacaaaaatgtaagcgtcattggcataccaatggtatttaaaacctcaaggcaaatgagatcaccatgggagtgaatgtagtagagagggtgaccgaagattgcatgactacatcattacaatgtctggaagaagaggagcaacccatgaggaggaaggaaaatgccctacaaatgaaatggatgaaaacaatatctaggaggaggaagtgacaaatgatgtcaaaggcaactgccaagaattggtcattggatgtggtaacctggggagaattgttgactttgataaatacagttttatgggagtgttggaggtgcaagcctgattagagtgattttaaacacgaatataggcggagagcaactggagatagagagcaaagtaactttttgaggagtttgtgggaaggagacagaaatgaaatgaaacaatggcctcctcacaaaaggagcgcgaaaccatggtaagggtgtactttattctgagcggggaggtagttgaagcgtttaaataatgacctatttgtcttttagatattgctctgactgctgtatagagaatggcgtggggtgaaagggagcagaacagttataaggctatttctgtttcctaggtgagagagtgtgttggcttcagctgtagccctggaaatgtggaaagtcatgtgtaaatttcacatggggtaatggtattaggtagacagcagtgtgggatctttagcttaaggaacttaaaaaagtgtttgtgatcaaatgaaaaatcacaaatgtatatgagaattatgttttgtaacttctctttagctctaccttatcttatataaatcatactggtttgaagcaatatatattggttactttattaaaatttacattctgttatttttttaaataattcctgttgtctatgataaaatggatatgactggccaggcatggtgtctgacgcctgtaatcccagcaatttaggaggccaaggcaggaggatcacttgaggtcaagagttcgagaccagcatggccaacatggtgaaaccccgtctctacaaaaaatacaaacattaaccggatgtggtggtgggcgcctgtaatccccagctactcatgaagctgaggcaggagaattgcttgaacccaggaggtggagattgcagtgagccagtcgtgcctgcactccagcctgggtgacaaagtgacactgtctcaaaaaaaaaaaaaataaaagtggatatggtaatttttctcctttccaaattatattttgttccatcctggatcattcagtctacactggcgtatttcgctcaagtgacattagagatggtttctggcataatatccttgtctgagtctgtgtgcaaaataacttttttaaaaagtggaataagttctatgatctgtagttgggatagggattaaacaacaacagcaaaacagacttttacttccttagatctcagatttatatgtatagagaattggttttacacaaatagtgaataaagtattttgccaagtgtgctttcagtagagacttgaatgattgtgatctgttttgctcttattccacgttcagaggttcccatgggaaccactcccaattcgtgggaagagtggaatttaacaaacaatacagaaaagccatttaatcatcctctgtgtgatccacaaaagtgccagaaatacggaggaaatgaaatcactagaatctctatctgtatgggcctgcccagagaaaaaagtgctgctcatggtaaatagatttgatagatggcagaaaaacaccagtgtcctaaatctgacagtaacaaaaaacctctcccatcatccatctccttcagataccttttcaaaatttgttaagtgttttgtgtcctagagtttggcatcttgccattttaatttaactatttttcccctgaaagatttgtttccagaaaaagcttgggatcataatacagtaaaccttacacataatcttctcattatgttcagaaagctaattttaaacctaattttcccatctctgtctctctctattccagtgcttacctgcctgcattaattaattcctgtgcagcaatgaaaatttgactcagttacctgacctcttaccttctgattgcagaggctctgtctcttacaggggtgtgggacgcctggtgccacaggacatgtgaacacagattatccgtacctgggaggtgactttggtgagatcggagacattggagtcccccaggagcagctcctcagcagattggggataagaacagagggcacctacaacaatctatgtattacagaacacagctctttttcttttgcgaacacagctgtttttcttttgcctgacttgactgaaaactgtttttaagtgaattaagtgttttaagtgaattaggtgtttcagctatgtcgccagtgggcactgaatcctaaaacagtgatctggaagggtcttggtgaccatgctatccaagcaccatgagatttggacctccaagttgggttcatcttctcactctccccgtgctctctactgtgaaaccacattggtcttcgcttcctccaacacagctagctcttgtctgcaccagagtctttgaactgtggtgcgttttacgtgaaatacctccaaatgattcttgttcatccttaagatctcagaatagatgtcatttcctcagaaagcaccaccttcttgaccctccagcctacaggaggattccctggactgtgttgtcatagcacctttgcttttccatcaaaatatttaacatagttcataaattgtttcatagatgagggggtggttagctcgggttgctttttctcttctccagtaagagatttcagaatcactccccttagaatcatttatatgaggttttcccctgagggcaggccagtggcctcactgcttcagaagggggtgtaatcagggtgaagagcaaaaatgcttggtatctttgagggaaaagaaatgaagttttggagagctggtaggtgccagagccgttcctgcctcagtgcttccataaccagctggggacttaggaggtggctgtttgtgggattcaaaaaacggaaccatgggaaccttggaagcccaagtgctgggcgtcttcgatgagcttagcattcagaagagaaattgcgcttcataggccatgtggggtctgtgcataaacctgtatacagcagagttcattgcagcaatggtcccgcgccttcctcagcagcgtcctcaagcagcgccaccgtgtggcagcagtaagcaatggcagtgatcggattcctgtccactccctggtgtggatgtcctcggcggacttcctgtccattacgcatgtgggacatcaagagataaatcggaaaaataagaaatacaactgtatatgaagcccggtttggagaggcatttgtttgcataagtctgtaagatccgttgtagaccctcggtaaatgtttgttttggagatgaggaaatggaggcagagagaaggcaagtcatttatcacagacagcgttaactctgggcagagttaggataagaatatgtgaatcttctggccccagttttggtagttctgcagttgaaagataccatgaagaaggatgatgtgtattaagagaccatgatccgatcactctttatgagattactaagagctatggattgctagggctattcctggctatttggggagagggaagtctgaccctcttggatgcttattttatctctggcaaccattttggggtcattaatatttctcatctgcatgtctgtacctcttccttccagttttcctaatgaccttcttcctttttgcctgcctccttgcatttccgtttcgttggtttaccaaatagatttcattgtgagatatgtgtgtcattgagtcaaatgtatcttcactaaaagagaagttctggttcctgttctgaaatttctgtcttacacatttaaaaatggaagaagatatttaaaagtaaaataaattaaataagcacacattaatataatgagattacataagacctggtggataatatgtgagactgggttgagattgatgagtgatggcttcttagaggagaaagattttaaagatatgcgatatgaaagtagagggaggaggtgtgcactccgacgagaaatgagacaggtggggaagtccagtgtacatgtgtttacggggttagtgagaagagagttggcaaaagtgtatgggattattcagaacaatctgaggaaaagatatctggcttagggaaggagttcctggagtcaatggagacttaagctgttaaaggaaaataaaagtgaaaaaaatgaaaaaaactttggagtagtttttgggctcaaaatctcactttactgttactatctgggtgactttggacaaggtatttaagatatgaatgtgttttctcatctacaaaaatgtgcttttgtgaaaatcaagtaaaatgtcctatgagatgccctaaaacaatactggcctagaggaggtgttcaataaatgtaacttttacactttataccaatttcaaattctcatcactaagttatagtttcaaatgaatgttttcagtttatcttgatgttgctcctgacttcaaaattttctgtttggattttcttagaaattaataatctttcacacatagctatcaaataaatcattgttttcatttaagaaacatggataaattggcacacacacaaaatcattctcagaaatctatcaaaaccaattaaaggaaccccaaattaggaaggacaattgcatttgtcatgaaattagagtggagcctcagcctcaaaccctaaattacaaagactagtttttgaattcaatttaatagaagcttccaggatttcatacatatgttctttaattttgcatatactgcatatatgggaaatgagaatgcttgaaggggcttttaaaccctggtaattaggacagggtggcaaagtgacacatcaaagtttatgttccagaaataaaaaagaaacttgtgacaaatgacttacaaagggcgaattttttccccaaaagtattaatgtaagaagtttagatatgtttctaaaagtctaccatccctcattatttgtccatcattatttcagtacaaacatacccaatgtttcataaaatatatttcattaataattaagacagacaagctttgatttaacaatttcttaccatatgaatgtggttgtggtctcaaccactggtaaaagaattatgggggacacattcagctgctgcaataaagacaaccattgtaaatgcttacctcttagatgaaaatggttgggccggatgtcctcctattgtttgctcttccacatctgaaaagaacgtagactaaatggagtgaatcctcactgatacatggaagtgaatatgtccacattggcagcattcataaacagcagcaggtttccttaatatgagaatcagagtagttacagcatagatgagtttttgagcctgcatagaaaaagtccagaaaacatgcagcacgcactgctggtgagcattaactcactcttgtcatttgggaaagagaacccattgtttctagatcttcaatttctgcagaaaagcatggagtctgttactcttcatttttttgttttgtttgttttgtttttggaagagtgaaatctccagctttaaaaatgttggcaacaaatacaacattctttttaaagcatagtcagtgtaagcatcgttggtgggctagacaggacatacctgtgagccagatttgactcacaggctttcagtttgcagtctctgaggtctagtgtatgaagttggaatcccgagaggcagcgagtgggagaaaatgaaggctcagaacaagtcagacctcttgtagcaggcctataacttcttcctggagcaccttgactctcttagcaccatacaggatctgatctgagagagagttgtgtaagattgatgctccagaattatactgtatacttttgaccagaatattttcattttcagtatgaacacattgctctcttaagtattttttgcatttgtaaaagaaaataataagccccaacatatccctgaagcttacaatatctgtgccccaaactcttccttatgaactttcttaatattttaacaatatcaaaacagaaaaaaaattgttaggcataaattatctacttactctgacctatatcgggttctttttcaagcttttcaaaaggtgacacaaaagccagttcaacctgaatattggaaaagaattgcaggggtctctgagcattgggaaaggatacaaaaggcatcagaagtttggctttgagacagttgccatgaaaggtatctcattttcctgccctggagattttatattaaatggattatctgtctgtcaagcattttgagcattccccttcactgctttccctgaggactattgcagcatcttaccgtgtgaggtgggccatatttttttttgcagatgatttatagaatatgagatatataagcagccgttaacacatctagttttatttttaaagttatgtttgaatggattatgtttgtcccacaatcattttttaatctgaataataaggtcaatttgacacagctctttttttttttttaacatttagtttaatcctttaacaaaccttgccctcatttctgtttaaccttggaccacctgctttggctggttatgtaatttgcaaattagaaaatgactatttcttttttcttgttattggactccaaaactcacccaaattctttttctttgctttgtgtttcctctctgtcttcctaatttcttatgcctgtattaataaaatggcttgagagataatagtctagttaaatgcatagtttcctaatttgcttatggaaaagctaaagtagactggaaagaacatgttactaaattataattttaaattttttatcattgaatgtcagtctcactgtgatccttttatgactctataaatatgctttcttttgaatgctggaggtggaaggcaggttggcggtcacctggactaaaaccatcgttttactgaaaaagcaattgtgaactaaataggagaggtctcttggccaaggtcaaacataagctggtggcaaaatcaggagagagtcttgtatcctggttaagaggtataaggatccagagtcagacaaaactccatgtcctggatggccttatattagttatcttgctatgacttctggcaagtcaaataacttttctgagcctcagtttcaaaaattttaaaatgaagattatcatattgctcactgttatttataatgtggaataagtgatagattccacatcaactgcgtgacatctaacacctagtaagctctcagtaagttgttactgttattgctgcatctctcataatcatcactctgatcacctgtctatgtttgtgtcatcacacagctctagcaatgtttccaaaccaaagaaagggtcccttaaacttcctcagcaagggcttggcatctgttgtcatttgttgactgtttctcagatggttcaggaatgtatacggtgcgtattattaagtttgcagctccccttgatttccattcgtcacatttggtccataaattcaatcaatatgtattgaacaccttccttctgtacacaaagctctactagatccctaggatacagggtgaacaagaaggtataatccctcttgcctggggcttatgtttggagttgggagaatagaagctaaataactaatcatactgttgtttacttatggttgtgttcagtggttaaagttgagtaccaagtgctatgagtgagtaaaagaggggagtcaaagatggaggcttctcggacaagtaggtcttagctaggcatgacctaaggtataattatttttattttgaagggatggtatctgaggaggtacaggaagcagaagtcattgaaattttagggatgaatagaaagtcattgtggctgaagcaaggggatgctggaggataagggtggaaaggaaggaggggctgaaacattaatttttaggccatgttaagttttctgggctgcattataagaaaataaatggaatgttattgaaaggttatacacagaaaaatatcatcaccagatcttttataaagataattttagtgcttcatgaagaacaagtagaggaagcagagagaactgcttggggtcggggtggcttgtaatagagtgggggcagtggaggtggagagagatctgagaaatacaaagaggtacaaggaaccagcctggtgtgtgactggtgtgtcagtggaggcagagagagatgtcaagaatgactccacttttgacatgaactccagtcatcatgaatgttggagtaagactggtccatgatcatatttttttcctggtgaaataaagcacggaggagttctgagttctggaaaaagaccgattgaaatgagaggtgaaaagagaacgctaagtacgatgaggacagaagacatactttaaatatgttaagtagtaagaacatcaaatactaggagccagtatagttaagttacgaattgtgaggtttgtgtatgttagagttgaggaattcctgtttcttgctgttttgatgggcacagtgttcttccacgacagtaatcagataaactacttaggtcaactcaattaatctcttttaaaagaagcctggaataatctgctccgttctttgacataaattgattgattagaatgtttgcatccccaaattaaggtaaaaccactgccattttacagaaggtattgatcttatgtctgttaaaattgtatctttaaattttttaatttagttttattctttttcaatgagaatacagatttcaaactaaatgtagtgtaggtgtgaatgataataaaataccacataatttagtgtagttttcctatacgcattatattcatttcagcgcattatgatttcaactgtgtttgtacttgaattactcatttttgtttatcaacatgaggtttccatctgatccagaatcaaatagtttttattcagagttctattcatttactaaaaataatttcttatgaatgttctcatatatgcacatgcatgcatgttttaaaaagataacagaatcctgttattgccaagaaatttgggggtaagaccatggtggcaatttaagcaggttttgttttgttttagttttgtttttgagatctttatttctcccagctacctatcaaataatataggagggaaaactgtgtcccacaactggaaaacccataaggctccccagtcatctacctcaaatcttgaggagtctccagagctatcattgtgcaaagagatgtgggggagctgttctgacctgtttattgactcaatagtatgtgtcattcaaatttagggaatggagaaagatgctgttgccattctgctggccatgttacttgtcaaagcccataaccacgaatgtttggagaaaatttaaagttgaatataggagagaacaataatgatatggaagtttcctgtactactcaggaggatatcacatttatcaaataaaagaaacaataagaaaacagggctgggtgtggtggctcaggcctgtagtcccagcactttgggaggcagaggcgggtgggtggcttgagtccaggagtttgtgaccagcctgggcaacatagggagaccccatctctacaaaatatataaaaattagctgggtgtggtagtgcacacgtgtagtcacagctactctggaggctgaggtggaaggctagcttgaagccaggaggctgaagttgcagtgagcgaaggtcatgccactgcaccccagcctgagcagcaaaacaagaccctgtctcaaattatactacaaggctatagttaccaaatcagcatggtactggtataaaaatagccaagtaaaccagtggaacagaatagggaacccagaaataaagccaaatactcatagccaactgatcttcaacaaagcatacaaaagcataaagtgaggaaaagacaccttattcaataaatggtgcagggaaaactggcaagccacatgtagaagaatgaagctgtgtcctcatctctcaccttatacaaaaatcaactcaagattcatcaaagacttaaatctaagacatgaaaccatagaaattctagaagatacatcagaaaaactcttgtagatattggcttagggaaagaattcatgactaaggacccaaaagcaaatgtaagaaaaaccaaaataaataaatgagacctaattaaactaaaaagcttctgcacagcaaaagaaatagtcagcaagtaaatagacaacccgcagaatgggagaaaatatttgcaaactatgcatctgacaaaggactaaaatatcgagaatctgcaaggaactcaagaaaaaaaaaactaataatcccatcaaaaagtgggcaaaggacatgaatagacaattcacaaatggagatacacaaacagccaataaacatatgaaaaaatgcttcacatcactagttatcagggaaatgcaaaataaaaccataacgagatataatctcacacaagtcaaaatgactgttattaaaaagtcaaaaaataatagatattggcctgaaagtggtgaaaaggtaacacttttacactgctggtgagaatgtaaactagtacaaccactgtggaaaacagtatggagattccttaaggaactaaaagagagagctaagctgtgaggctgcaaaggtataacaatgataaaatggactttggggattcaggggaaagggtaggaggtggatgggggataaaagactacatgttgggtacaatgtacactgcttgggtgatgagtgcaccaaaatcccagaaatcaccactaaagaactatctgtgtaacaagaaaccacctgtacccccacaactattgaaataaaaaagaaaaaaaggaaagcaaaattaaaacaaagaagaaagagagattgcttgaggaaaaaaaaaacaacaacaaagtataccctttagtagagatagtaaatatcagaatggatgctactgaccaaattaattaactggaaggctgagaaaattcgcataactgtaagtaaaaaagaggttttataagagagaggatgacgcacataggataggtcttggggctcatctcataactaataataggaattttagaaatagagaacagatgagaggaaggaggagaactaacagattaccatttcctctaagccaaacctaattcttcaagccttcacattgaatgacctcactacaagctggtgaagattaatgaaaataaaaacttttagacataccatgatggaattttgaattccaaggtaaagagaaaatgtatacaaaagttgacacagaaaaacaattagttaccttcaaggaaaagagaatttgactattatccagtttctcatctgccacagaaaatgctagtggacaatgcaacattcctttcagaactgtgagtaaaaagggttgcaatcatagtattctctcaccagacacagtttgctcatgtttgacggaaaaatgtgcgttttgatacatgaaaggactcaaagtattctgcaaatgtactgtttaaaaaaaacaaaacaaaacaaaaggaggtagtaggaggagacttaaggatgtactatagccaaaatgaaaatgagtcaaaatatatcacaaataggtcacaatatgagaaggggtgcaagatatatgggtcacaaatgctgctacaagactggccctgggcagattgcattaatatcacctaaggtggccaggcctggtggctcccgcctgtaatcgcagcactttgggaggctgaagcaggtggatcatctgaggtcaggaggtcgagaccagcctggccaacatggtgaaaccccatctctactaaaaatacaaaaattagctgggtgtgatggcgggctcctgtaatcccagctactccagaggctgaggcaggagaattgcttgaacccaggaggcagaggttgcagtgagctgagatcgcgccattgcactccagcctgggtgacaagagcaagactgcatcttaaaaaaaaaaaaagacaaaacaaaaaccacctaatgagattttctttccccagctttattgaagaataattgaaaaataaaaattgtttacattcaaggtatacaacttgattattttgacatgtgtgtacattgtgacaagattaccacaatcaagttagttaacatcttcatcacctcacatagttacctttttttgttgtggtgagaatacttaagacgtactctctttgtaaatttcaagtatacaatacattattactaactatattcaccatgctgtacattaggtatccagaaatcattcattcattaggtatccagaaattattcaaagtttgtgccctttgaccaaaacctccctgttacccccacacctgccccctggtaaccaccattctattttctgtttctatgggttcaactcttttggattccacatataagtgagatcacgcagtatttttctttctgtgcctggcttacttcactttgcataataatgtcctctaggctcattgatgttgcaactggcagaattttttttaagactgaaaaatgttcagctgtgtggaatattatattactattaatattatatgctatattttatatataccacaattgtgatgggtgtaccacaatttcttcaatatcagggctattttgaataatgctgtaatgaacgtggaagttcatctgtctcttcgagagagctattttatttcttttggatatatacccagaagtggaattgctgggtcatatgactgttctatttttaactttttgaggaatctttactgttttgcataatggtatattcattataatgcataatgtcaatttatatccccatcaacagtgtttaagggcttcgttttcaccacatccttgctcaacattagtattcatcagggaaacgcaaatcaaaaccacaatgaaatctcatctcacacctgttaggattttttttggttattatctattatttttgataataattattatcaaaaagtgaaaagataacaagcaagggaattctgccaaggagactttaaatgctgattcctggagtccaaagtgagagattatgagagtgtaaacctgagataggtcccagtagtctgtatttttaataagttctccaagtcacctgacagccaaatttggtaacctgagagtaatgagttcagtaaaatatattacaattaaattattattgataatgtaagttatgaaatattaatgaaatggttaagaaaggatcctcaactgcaaggacaaaaatgcaatcatttttgtctgaaagtaaattctagcttatttcaagagaatctaggtgctgtgtgtatgttgtgaatgctgtgtagtgtaagggaatcactgaagacttagaagcttgtaaatgcctagccttgttcctgaagggggagctcttagagaccgtttagtcattgagattgatggagaaacattacttacatatgcttatatatttaaagattaccaacagtgaaatacaaataagatgaatagctccttaatggctagagaatgcaaaataacacataagaaaaagaaagcttcgatagtagagtaaaaatttggaagaaagaaacgagaaaatataaacaaacaactatgagtgatagaatgtagtttgatagtagtaatcatttcactatgtatatgtatatcaaaatattatgttgtgtacatcagacatagatgtaataaaaataaatttaaaaatatatatgcaagttacaattaaagtaggtaaattaaatcttaaattacaaaacatttttgcattagcttaagaaggataaaccaattccatgctgtttaaaagaagactttttttttaaatggcacaaagtaattggaaagtttttcactattatatctgcagctcttggcatgattggacatatggttcaaaaatgattgccacctcatggaatgaatggatgtggaaaagtataacagcctcctatcacaaccacaaccaaaaataaaaaggtaacgtgtaacaataccattattacaatacacttcaaataataaataattagatggcacatagggctatttttaccaaaaaatccaccattaaacaaggtataatagcatcaaacttttgtgcactgaaggacacacattatgatgaattggaaacataaacattcaagaagaaattaacaaaactattaccagactgggaaattttaatacatctctcagaattggactagtcaaaaaaatccaagacaaatgatgtaatattttccacaatattaagctcataccaatgctttgataaccataagctttttaccttgtcatttaataacattttaattgtaaaataaagtaaatatgatgactaaaagtaaatgaaaacattcgaacaaaatacttctttgttttcaccctggcccattttaatatgtccacttggcttctaatagtatatgatgtttccctttcctcgtttgagaacccctggtttgaatattacagttcagttaagatttatttcaagaccaggcatggtggcttatgcctgtaatccctgaagcagaaggatcacttgaggctaggcgttcaacagaccaagcaacataggaagactccatctctacaaaaaattttaaaacattagctgggcatggtgttgtgtgcctatggttctagctaggctgagccaggaggatcgcttgagtccaggagttaaaggttatagtaagctatgatgaggccattgcaccccactctgacctgggtgacagagtaagaccttgcctccatggttggaaagttatactctacaaatgtagactgtatattgtttcaaaaatgtttttggaatgtttatgaaatttgatcatatatgtaaagaaaatttcaaatattaaatattaaaaatcttataggttatattgtctaattaaagagcaataaaattataaattagcaaggaccaaaaatatgagctacttggaaattaaaattaaacttgtgaatggcttttgggtttaagtggaaatcaattatactatgaactatctttaaaacaagtcacagaaaataattattcaggattctaatatgtggtcagatgtttactgagagagatttttaaaaatgtaaatgcatcattcttaaatatgaaagattgaaattaagtaatctaaacatttaactcgagaggctagaaaatgacattataaaacaaaataaattaataaaaagtgaatagttatttaaaagtagaaattaatgacttgtttacatataaaatatatagaattaaaaataccccatatttgaaaagacttgtaaaatcaacaaagctttgttgtttctgattcaaaaaaatgagttcataaatgtatgatattaaatttaaaggagataggaccatttgtatgtaatacattttcaaaatcagtagtgcttgttatggatgtaatacttgcaagcagatttggtgatttgcttggaaaaagaaagaaccactttgttttttcgaaaagaaaaatttcctgcttaaatgaattgccaagataaagcaaattaaagattgtcttagatttaccctcagttctgcaaaatacacagattcagatggcttcctagttaagtgctgaagctcaagagacaaatcattaccaagtgatttaaaatgtttcagaattttaaaactaaaagtaatagggaacactttctatcttatttaaagttcatgttttgagagtctaatatatattgtgaaattttagaaaggctgtacgaagtaacattaaaaattgtagaccagcttccttattattactcttgtaaatatgattgaatcgcaggcatcatcaagttaaaagaatgatatacacttaccaagtatatttgttctaaaaatgcaagaagagttcagtattcagaggtatattaatataattatttataatacattgaaaagataaattccacatctctattttgaaagatgtttaacgccttttgatgaaatcaaatcgacattccccagtaacatttttagaacattaggaatgataaaataaactttttttttttgagacggagtctggctctgtcactcaggctggagtgcggtggcgcgatctcggctcactgcaagctccgcctcccgggttcccgccattctcctgcctcagcctcccgagtagctgggactacaggcgccgccaccacgcccggctgatttttttgtagagacggggtttcaccctgctagccaggatggtctcgatctcctgacctcgtgatccacccgcctccgcctcccaaagtgctgggattacaggcgtgagccaccgcgcccggcctagaaactttaaagctattatgaaagatatgaaaaacagtagtgaatataacaattcactgtaaacagtaaaactgtttctgttttaagttaaagaacaaatactctttatcaatgctcttagtcaacaatgctctgaagattatagttggtaaaatgaaaacagaattaagaataaataatgggaaaggacaaatattactattttcagattgtatatgggttcttcaataaatttttacaattaaaagcttttagaactaatgagttcactacatgatgagagataagataaatgaaactagttattagctaatacttgcaagaatcaaaaaagtaagggaggccgggcgcggtggctcacgcctgtaatcccagcactttgggaggccgaggcgggaggatcacaaggtcaggagatcgagaccatcctggctaacacggtgaaaccccgtctctactaaaaatacaaaaaattagccgggcgtggtggcggcgcctgtagtcccagctactcgggaggctgaggcgggagaatggcgggaacccgggaggcggagcttgcagtgagccgagatcgcgccaccgcactccagcctgggcgacacaccaagactccgtctcaaaacaaaaaaacaacaacaacaaaaagaggaataatattatattcacagaagaaagaaatacaaaaaaattagaagtaaacttaggaaacttaggaaatcatcaagacctacatgaaaaaatagtaccattcactatatgatataaacaagtgcttgattgaaaagtaaacacactctcctcctaaatgggaagtcctgtcattctaaggatgtcacatgtgcccacattaatctgtaagtttactgaagttcaagtaaaaatctttacagtttttctgtttttgttttttgcttagaataaaggcagaacttaatgaacctaaatttgatttggagaaaaaagtgggtagagaaatgtagggagtgaacagagccttttggaagagggaatgggagactttactagatataaatatgaatgtaaaagccaaaatattttaaaatgtactgtcagtaaaaacttatgcagatgtagatggatcaatagaaatagaacaaaccgtagttataaatttaagtggatattaaatgtcatataaaatgaattgtaatatggattgataactcagcaaatactgaaaaaatggtctattttaatacttagatcaataccacttcaaacaaaagcacattactctgaaacttaaatatagaaataatcacatactactatacgaaaatacagaatgtttctaacttttaagcaaggacttcctcagcctgattttagtcgaataactataatagaggaagatgtttctttaaaaaactaaattctgtaaaacacgaattctttataaacacaaagtcatatataaacaaatgtttattgcagtattttttattacatccaaaaaccatgcacctaaatgtccaccaggaaatggacagataaataaaaatgatttgctcttaccaaaaatgttaaaataactttaaataatgataaggtgggtctacatgtatggacctggaaaaatgccattacattttcagaggacaaaaacactcataaaataggatgtaatatgtgatctcatttttataattccacgtctttgcatttttgtctgtcttttgtgtgtagaaaaagaaaataatgtgaaactaataccaacttcaagaattaaggggatgaaattacacagtggagatttttaactttatttttatatattctgaaatatttgaatggtgaacagtcattgctttaataattggaaaaagtagagctatttccaatttgggttaaaaaagtcagtgggacattatcgtctatattctacctgtatgattgagatcctaagccaaaccaattcttagagatattctgaatgacatatcccaaagcgcaggtaagtacactcactgttagactctgctcatagttatgagggaaacatagtctccagtcacatcaaaaaccatgaaagacaagaaaagatcattagtatactgtatttacttgagttacttactgaatagtatgtactgggctcttggtgtgtttggtattaatattgactgttgggttctagtctagactcttggttctgtggtgctgtcatctataccattggtccttggaacaggagcacctaggaacttgttagaaacagaaagtctcagacttcattcctgacctcgtgaatcagaaatttctggagcccacgctcaatcagcaagcactccaggtgattctgatggatccgaatgtttgagaaccactgctctgctgcatccaggggaaagctatttactaagtcaagttttattgtaagttgatctttctcttttgagtatatcagaatttattaagaatgattagaaaattgattgcaaaccaaagagtggataaagaaaatggggcatatatacaccatggaatactactcagccataaaaaaaaacgaaataatgtctttttcagcaacttagatggagctggaggccattattctaaatgaagtaactcagaaatggaaaaccaaacattgtatgttctcacttataagtgggagccaagctatgaggatgcaaaggcataagaatgatttaatggactttggggacttgaggggaagggtgaaatgggggtgaggcataaaagactacatattgggtacagtgttcattgcttgggtgatggctgcaacaaaatcccggaaatcaccactgaaggacttatccacgtaaccaaaaaccacctgtaccctaaaaacgattgaaataaaaaacaaaaaaaagaaaactggtggcaagtaggccagcccatgaaagccgtttaatacttggttaagtagactgacattcttttcgtagatggtagggagctttaaagatttctgaatgtgagaaggacatgagtggttgatgtccatcaggacaactgctctagctgcagtgtatagcagattgcaggagactgacagtggagatggagagccaagttagaaggcaattaaataggtcaagcaagaggtagtaaaaacctggattggagtagaggaaatggaattggaaaagagacaaatgagaaagagagattgtgaaagtgagaacagtgcttggtccctgatggcatgtaggggccaaaagagaagaaaggcaaagatgattgacgttttaagcctatgtgacaggtattattggcactacagatcagaacaactatcagtgatctgcaacgtggtagattgtgctgatatcagtcatcacacagaagattggtttgtttggatttctaaattggggcttttcagttcattggaaggatggttaaaaatctcaatgattagcattagaacaaaagagaacagaaatacagttgagtactttgccagactcatcaaatatgattttgatgggctaagaactcctaacgaggacacagtgatcaactgagcaaacagaccatttggcttgaacagaaatgtcaacataggcataatctactaagttgctaattagggatggtactagccggttgatggacttcagccaagacatacagaatggtgagaagccagtgcacagagcctctgggaatctgaatgatcaattatttttcatcccataatgtaatttacctgtattagaatttatatgcagaattaaacactccttcttcagagtttccacagtattctagatttttattgaagtatttattttaatggtttatttatcttgggcagagctttttgtggggatatcaaactgttaatggatagaaagggatagattgaatattcctgagagttggatcagtgtgaagtaaagttgaagttggttatactatggcaagtatgatgtagagaaaatctttcggatgttcgaaggtcaactcagctacttacttccttttataatttggttcgacttgaacactatgattcctcatttgttaaatagaaataataataatagtttacctcatagggttattataagaattaaatctaaaatccagttgacttgaactctaaaagataaaataaaatttgaaaaagaactaaaggaaaaaataattaaataaaattatgcatatgcaatgttaaaaaacagaatcggaaaaataatttctcaaagagggtagctgttgttgctattatcgttgttttattttattgtcaaacaggctgtgagagtcaactagaagggtgacgatcttgaggtaagaagtttttgcatccctctagcatattttacaagcagcatcaggtacaagctaaatgagtgtcgctgagcctgaacttgtttggtgagtagttgaataagggaatgataaggcccacattcatttatttttacttttaaggtagaagggtgcagcaacttggtttctgcagaatgtatcacttgctgtcttttccgtggaaaagaggctatagttgttcattcagattgaacaactgattgtaaaattgtaatacccctagatggaggtgtataagaaaactaagccatttcttttcttataaatatgcatacatgtcttagttcattcatgcttctctaacagcataacatagactgggtggcttataagcaacagacatttatttctcaaaattctggagactgggatttccaaatcaaggagctggcaaattggatgtctggtgagggcccacttctggttcatagccagccttcttctctctgagttctcacagggtgtaaaggaccaaggaactctcctgagtctctttgatgagggcactaatctcattcaaaagggttccaccctcatgatctaatcatctaccaaaggccttacctcctaatagtatctctgataggccagtcttgtgttgccagaaatgaacattctcaagttcatttcatgccagaaaggaatatctgagactgggtaatttattttaaaaagaggtttaattgactcacagttctgcaagtggtataagcatggcattggcatctgctcagcttctggagaggcctcagggagctttcagtcatggcagaaggcaaagcaggagcgggcacatcacatggcaaaagcaggagcaagagagtggggaagtgccacatattttcaaacaactgtatatggacactcattattgtaaggacagcacgaagccatgagggatcctcccccatgatccagtcacttcccaccaggccccatctccaaaactggagtttacaattcaacatgagatttgggtggggtcaaatgttccaactatatcactatcacattggtgattaggatttcagcatttgaatttgcaggggacataaatatttgatctatggaaatatgtataagacatttatttaatctataaaataagatctctaatgaatgtgttataaaaggtagcttctaggttcactgtcctattttaggaaacttgcaaatgttcattagtctcctaaacctctgccgatagcttgccttttctttgtgaccttggattttttttttgtaggattccctgtctagaatatcctagcttgtttttcctaaacatggaaatcactaatccttcatggccgagtttaccatccttctccttagtaatttcgctttatttcaacaaggaaaaaaagtctgagaaattctgtagcactttggtccattgttatgacatgcatttcaaatgacctaacactgtttatatttgtgtagaaattttatttatcttattagattgtaaactccatacaagaaagctgaaaaaataaaattaagaatacggggaaaggtttgaagcagaaggtcagagacagaggcttcttcaatgccatacagaggattgggcttgagtagtaactactgcttgataccagatgacttaatctctctaaccatgatgtaatgaaccagaggtgggtccctgtccccaaaggactgtgatccttaataagtgacttggtaagagctctggctaactggtgtgttgaaaatgtcacaacaccctaacctgatctgatcatacagacagaatgagcagagtgattggactaaagctaaaaggcagagagagggcaatgatattacaggcaagcagctagcacagcaaaaaattcaatgtaaataaaatagtagagttaggagaagattatctgccctctttaccaaccccttcatctttaagttaaatctcatgaactcaagttacctgaaaatatggtttattccatgtatgtgaaaaaaggcctgactagtacagcatcattttgtaatctctttggcagaaatgattctttttatatgttgagtctaaatgcactgccttgtagcttccatgcacaggtacttgtcatgcttcctgaaatcacacagaacatgcattaactatgtagccaatgacaggccttctaggatgagcagattcttcaacagtagggagatgtctttcacaggaaacgaatgagtatttgtcagggcttcacttgatatactttctaccactgtcccggtaaggaatagcagaatataaataaagggtctaatatgtacttattaatgagtttgctaaatagaatatatataccacttagtgagtggtactatgattgttttgggtacatacctaagattagcttttgttttaatagtagaaatatgtatatattattatgtatattaggaaaatataaccagcatggaaaacccatggcttccttgagtctattcattaagacaaatggaaaatacatatttaaatttaaaataagaatttaacaatgctaagtaaacagttctagtggtatgcacatatggccaacataatggaggatgtttgctaatgatggtaattagtataacactgctttaagaaaaagtgtcaacagattagcatgatatgccacaagcaaactggaccaagattatcacttttatttttgctttctaatttcagcggttaaattttaagatatttgatatagcttaggagattgattgctttgaaaaccaacttaaatatgaaataaagaaactatactagcacaagtaatgcaagaaataaacatcacttcaaggtcaatatcaagaaattggaaccctttctgaatttataagaatattttgagaaacaactttcctgtcaaatggaagtcaggagaaaatcaacaaagagtcacctttgtacccaagaaaacctatagacacatgtaacagcatgcagaaatataaaggtaaaaaaatcactcaagagtcagtgagaattttttttagtaaaggtcatttgatgtccacttccttgtatatcaaatagttaaatgcggatgaaagcaggagatatgaataatactagaccgtgtatccattaaggaatcatgaaaacaaaagtttaaagcaagaattgctaaaaccaagtgttttctcaaaagagctcttaagtcaaatgtagaggtaagaatatatgactttatcactgtatcattttattacaggatggaattcaacattttcaatgtgattttcatgtattttattgatttgggaaggttagcgattaaatattgttaataacattctacctggtttctcaacatctcatatcttttttcctctgacccatcagaaatactactggcacacttgtctccccagtgcacttcttggattgtttttgctcctctgctcaccacacttcttgaggctgcttcctgaattcctccatacatatgaattctttagcaggctattcagcatgcctgtgctgtctgtgccaaatctaacttccagtcattttcctttgcacttgtgtttggctacttaggtttatcttaatatgctctatatgccagggctcttcagagaagcagaaccaatgggattgtgtgtgtgtttgtgtgtgtgtgtgtgtgtgtgtgtgtgtgtgtgtgtatctccaggaaacttcagtttttacatttaaggctttcagctgattggatgaagatcacccacattaaggagaataatctcctttacttaagctgaattgattatagatgttaatcctatcaacaaaatactttcaaagcaatatcaagactagtgtttgaccaaacaactgggccccagagcctagccaaggtgacgcataaaatttaaccatcacaattgccttgcttttctttctctatcgtctggattttaaaattttttatactttaccttatatgtccttattccatattcctaaatttgaatacccttcaagccccagctcatttctctcttattttcaaagtcattaccattcacttcatcctggaatggtagctaggacctgtgaaattctgtagcaggatgcactgctttcatagcatgcatttcatgctgcctggtgttgaaggtatttgtgtaaggcttttatactctgtgagagctttgagcttctcaagggccagagctgtaacacatatgtctttgaattaatatataattcattgctctacacaaaggtacatacttttttttttgttttctgaagtgcagagtgctattctaagccatcttaaactcaaagaattatagaaacgttctggcatacagtcagaatatggaataggaagagtgtttcacaaagtgtgataggcatcctaccacacaaagtagtgtttgctttaatagattcatgttcatgttactgtgatttagaaaaaaaaaattgtaacatcaaaccaatgaattctcagatattaatgtttaggatggtgttaaaacagagacttatgttaggcttgaatcaatgattaaatatttatttgagggtcaatgttcaagtatgacaatgtagtaaaatagtatgtgaagaaactaggtttgttccatgttaacttaatgcagttctagactggaaatgaggagaattgaaattctataggcccatcactcattgtgtgtgtgatcttaagacatttttacctcttggcatctgtatcttttttggggggtaggtattctgttatcatctaactctaaaagtgtaatttgctactaagatgcctataaatacagccagactacaacacagatggtgcacacaggaagaaaatctctgattggtagactaacccaaaataggctgtgtatatattgaatgaaatacgaccaaaaaatctgcaaatagcagacacagagcatcctttaggttggaactgagtaaagtagatttatgatctaatcttacttattctatgacatttctgtttaatgaatgtccctgatcctcctgccatcttactcacatttctaatgtgctcatactccgaggtaataatgatcatttgcaattataaatgtcctgttatcaattaatttgcagttcaccagtaaccatctgattatctctaacaaagctgcgctggtgtggtaattatgttgagagtaatcatcatgtaattgcacataattatttgtaccttattaagtgctcatatgattaaaatatttctggtcaaataaaaattatccgtgagagtattttttggaggggggaaataagaaatgttgcttcctggtcttctgttctttgaataaggtaaagctgtctagctgacagtccataatgccccagataggatgaattagtaaggagagaagagacttagatttcattaatacaataccttgtacctccaatgaagttgagataataaacttcaacttccagcatggatgaacgctttccctgtagtagctataacaaaaaatattaccctattaagagtgtacactatgaatgtcattgaggacaatgtgtttttcatgtccaacaccgccattagcaattttatactgaacttttatttttctcatagtactctctcttcaaaacttttaatattcacttatttacactcagtgttttttttaatttccagggactgtgtttagtgagatgatctacaggtataattccaaaagcacctaccaaatttgtttattcagacattcattaaagagcaactctatatactagcactctcctttagaaatattatgtgagctacgtagccaaatttactttttccaggacccacaaacaacagcaagaaataggtaaaattaatattagtaatatattttatgtaaaataatcattacttcataggtactcagttgtaaaaaagattagtgaaatattttacattttttgtactaagccttataaatctagtgtagattttacttatagcacatctcaattcagatgagcaacatttcaagggctccatagccataggtagcttatggctgctgaattagatggtgcatatatgttgattgtatctacatggtagataaaggagagtcctaattaatagttagctctctgattttatagatgtttttatgagtttcaatttcctaatctggtaaataatacatctagcctaaaacatttctttttaaattaaaatgttttctagaaggatagggatggaactaacattaagggactgctttactaggtcatgtaggatactaggtatatttacatttattatcaaattcattcttcacaatagtctagaagggtatgttactttacaggttagaaaagtgagatgtaaagtttaaccttatcaatagtagaatagtagaactgggattcaaacttggctatcatctttgaccacagattttgtctcatgcttttcaaataagaaacacatattttgggtccacttgctcattgataggtctagtaagaggattttacttccctgaatactgtgtaaaaggcttgactgcaagaaagttactgattagtttgatttttagggtttctcctgaccttccttatccatgtttcccagtccagtttcttgaattagtctctcctgaaagcttgttctttccagcaaacttatctcaagtatagcataaatcatcttccactggcattttaactgaaagtctgttgactatcacgcacacttacagaaagcctacctttggggataactgagtgactgacagcgatgccttagcaaccatctgattgtagttacagaggaaatttaccttggattgaagaatcacatgccattgtgattgacagagtctgtaagacaatcaaggtcaaacccagagtaaattgagtatgtggctatgagcattgacagataagtcatgtgtcaaatattgcctagccatctggttgctactcatgattagactggattcattgtgtttaatttcttattgaggacaactacatgggaaacttgtttgtttttagtttatcagtgaaatgtgctttatctgctgacataaaatgtttctgcctaaagtgaacttgcaaaatcattagttttatgactccagcatgacctacaaaaaattattatttaaaagtgattgatgcattattgaaaaaaatatattaggtgctgaaagttacactcatgaataaaagcacaattccttaaagaggaataagaaaacaaatgtgatcaccccgagggtttttagaagcccccaaatgtttaaagactattagccaaactgggtaccagatatgtgggtagtgagaggtgatgagatgtcagtgataagtgatgtataaggggacaggtgccttgtgtgaaattctgaaaattcacatttagtagaacgtatcaaacgccagtagaacgtatcaaacgccagcaaatacttagtttatttttgaggacaaaagtggaaaacacagggaagtgaaatcaattgtcctatgtcacattgtacttggaatggggctctgagtcccctgactactaatccagtgcaatttcctcctgtaactttgctgcctttgtaaatgattacattttaaatacaagggctgtttggcttattaattagttagtgttaaaaaaagccaaagttgcttttcatcactgatggattagtacctttcattctgttttcaactaccatattgtccttttaactgaactattaaaaacatttttccttgttgatcacagcttgggtgaacaaagtaggggctaatgaaaataaattcccggtcagagaaaatggcagttgcacgagttttggtggtatgatagtcacatttgcatatgtaaagtataacactacataagcaaataatatgacccaattttaggtggtgatctatatgtcattgctggttcctctgcaagaataaatactgaatgcttctaggcatttccagtaagcacagtaaatccatttcaataatgaagaattcctgagaaaacaatataatagaatcaacaggttctagcaaagtggaattttatcataaattacaagttccaccatgttaacacgtacattgcaacatgttttggacagtacttctgaggttggaattctcagcaagtggttcctattttgacatccagacagtgatagccatttgtaggtggaaaattagttatcagctgtgccttgctttttctttacttgggtttctctatttctctgtctttttacacacacacacatacacacaccccacacacatatacacatatatatctatccttggatatccaaaaaaagattctcaataaattcacaacactaattgaattgagatgatataaagttgttgattatttttaataaagtctagagatctaacattagttgtagcttatttcttcactactaaataagaaattccaagttaagtcttttcatcttttcattaataaatagccaatatgtaatatctgcccatccatatatattatgaactatctgaactactccttataattatggggtaaccagtcaaataaaagtgttgaataaacagcttattgtatatgttatgaattacctgacttaaaattaggagtcaattagtcaaaatgccatgggctatatgactcattgtaacattaataaagtaaaatatgtcttcctataatccagttattggtattaaataatattgaagctattttccaagcaaaacttccgcataagtttgtttttgtcttggttgagaactggttcttttgagataaagccaccaactcagcacaggtttttttttttttctcctgaatggttttgttcaacttaaaatgactgttcctaacagcaggtgctctcttctttgtttcagattatattgaacatgcttttggtcttcacaaatactgaaaatcaactataaaaatgctggatgaaaagaactatatccatatggtaggaagataaaattttagctctaactcatatcttctctgaagaagattcttcagtaagttcaataactaacattatacattcagtcttttaggaaatccttggatctattttcaaaatatatccagaaacagaaagcagctataacatttgactggatctctcattatgagtaaaataaaatctttaacagctattaatcttatacatgatatgacagccgtgattttacctttcttttttaaaattaattttaacagctttggagatccttcactgagatatccagtgggttcaactgacaaagcaaggcacaatttatcatgtaggaatgtacttcacgggaaattttcttctacatatgttttctcttggttcccagagatgaatccgtaataacaataggattctgctaactttgtttttctgattccagttttcctctttactaattccatggctctttttttggggctcattttttgcccaataaattattcccgcttattgacaggactgatttgggaatttaaggtctgaccatttggtgatatctataagtagattcattgtttatagagacctgttctctgttaggcgagagacaatagagaatctagttgttagtctttatctgtttgtttgcttgccaacactgacctcaaataaattaagaattttgtggccactgggcaagagaacagctctttgatatctggactgtatataactggaataatggttatgcacccaaagccatacatggaatgtcatatttgagaatgatagtcacataaccaccccaagctactaagatgccataagtctttaccccaaatgtgtcagaaatggaagacacttctctcctattagaagaaacaaatacgtttggaaaaaaatatttttggataggataacagagaatatcctctccagagaacagggtagtgaaatatattttgttcacataaactgaattttttttttctttttttgagacgtggtctcgctctgtcacccaggctagagtgcagcggcgtgatcatggcttactgcagcctcagtctcctgggctcaagagatcctcctgcctcagcttcctgagtagctgggaccactatcacacaccatcacacgtggctaatttttatgttatttttattattattttggtagaaacgaggtttcaccatattgcccaggctggtttcaaatgcctaggctcaagtaatccaccagctttggcctcccaagggttggaattttacaggagtgagccaccacaccagcctgaaattttcattaaaaggaacttcccttccaggaagggatgaaggaggacttttagaacactagaaatgacagcccaaagagacagagcccagagcatgggtgagggtgagctgtggtgtcttgaaacctagacacttgttggtggaaccagcttgggaacacaggctaattgggaagtatggaaggaggatgcttcagacacaattgaatttttcagtgttactaggacatctattcctgtgtatgaaccacccgcctgctgtggtttgaatgtttgtgtcccctccaaaactcatgttgacatttattctcaggtgaaacaatattatgagggagggcccttaggaggtgataaagtgccttataaaagggcttgatggggcgagttacccctccatcccttcatgtaaggacacaacctcatcccctctggaggatgcagcaacagggcaccatcttggacacagagagctgccttcactagacactgaacctgctggcaccttggtcttggacttcccagcctccagaagtgtgagaaaaaaatttccatgtttacaaattactcagtctgtgttatttggttataacagcacaaatggacaaagatactggcccttctgcaaaaattcaggtcctcaaaatctttgtgaaggatgtggcttttgttactttgctttgcttaagaagggagagtggtctacaatcacagggttgtttacctgcaagctcctcctgggcctggattcctcattgtgcaactgttgtgttatcttcagtgtccacaccactcaaagacaactttggtttgaatggagcctggcctgggctttttacagaggctgacattgatttggcattctgcagggcaccttgctgacttttgttttctctcttgggatgtatccactgagacaaatgactcatccattctctgaatttagttttctgaggagtctgtcttctttggggcagaaatggggacacattgctcaccacggtctctctcttcctctgacctttgcaggaaagtgctttccctctagtgtgtaaagtccccaaccctatgtccaaattctggattctttactaattggaaactgctattataggattcccatttttttcacttggctctaaattagtatcccagatctttcaggagggtctgaaacttaggggattcgagctcttgctaccccagggcactttccatatgctctaagtggatctataaaacatgggaaggtgccatatccccacagtgtatgctatggggatgaggctgtgagccattagcaaattttctgggtcagtgggcacttcagttgtacaatcatgagcccggctctcagtctgtgcctctgtttagagttttaactaagaagaaagatggtcttcggggtgtgatttccagagatcttggactgccaataatggtacaaagtatttcttggttattacagcccttagactactcaaattgtcattgaatatttgggagattctaagctaattagttctctgtgtgcttaatttattttctggttttgttttatgaggcatgtgggactccatagccttaattataacatatccttggaaccattggtcttttcttttttaactgtttttttctttttttaattttttattattatactttaagttctagggtacatgtgcacaacgtgcaggtttattacatatgtatacatgagccatgttgctgtgctgcacccattaactcgtcatttacgttaggtatgtcttctaatgctatccctcccccttccccccaccccacaacaggccccagtgtgtgacgttccccttcctgtgtccaagtgttctcattgttcaattcccacctatgagtgagaacatgcagtgtttggttttttgtccttgcgatggtttgctgagaatgatggtttccagcttcatccatctccctacaaaggacatgaactcatccttttttatggctgcatagtatttcatggtgtatatgtgccacattttcttaatccagtctatcattgatggacatttgggttggttccaagtctttgctattgtgaatagtgccgcaataaacatacgtgtgcatgtgtgtttatagcagcatgatttatattcctttgagtatatacccattaatgggatggctgggtcaaatggtatttctagttctagatccttgaggaattgccacactgtcttccacaatggttgaactagtttacagtcccaccagcagtgtaaaagtgttcctatttctccacatcctctccagcacctgttgtttcctgactttttaatgatggccattctaactggtgtgagatggtatctcattgtggttttgatttgcatttctctgatggtcagtgatgatgagcattttttcatgtgtctgttggctgcataaatgtcttcttctgagaagtgtctgttcatatcctttgcccactttttgatggggttgtttttttcttataagtttgtttaagttctttgtagattctggatattagcctttgtcagatgagtagattgcaaaatttttctcccattctgtaggttgcctgttcactctgatggtgatttcttttgctttgcagaagctctttagtttaattagatctcatttgtcaattttggcttttgttgcaattgcttttggtgttttagacatgaagtccttgcccatgcctatgtcctgaatggtattgcctaggttttcttctaaggttttttatggttttaggtctaacatttaagtctttaatccatcttgaataaatttttgtataaggtgtaaggaagggatccactttcagctttctacatatggctagcctgttttcccagcaccatttattaaatagggaatcctttccgcatttcttgttttagtcatgtttgtcaaagatcagatggttgtagatgtgtggtattatttctgagggctctgttcggttccattgatctatatctctgttttagtaccagtaccatgctgttttggttactatatccttgtagtattgtttgaagtcaggtagcatgatgcctccagctttgttcttttggcttaggattgtcttggcaatgcgggctcttttttgggaatcattggtccttgaaggcagctctaatttcacctcatagctctgctctctgaagcacgcctctgctatggctggagtcccttgggggcgtgattcccattcttattcctaggttcacgatcagctgttgtgtaacttatagttagctctgggttgcccttttggcccccattttagtcacattctgccgggttccgtcttagttgtagtgtgtgtgaggacacaatatcgactacatgcagagatgtatttaccgtctgccctaacctgatgagtctatgcagggcccttgcaaatatcaaagcaggaccaccttatgccgctagccttgcttactcacaggagaggactagatgccacatttttctcccatgattatctgttttctctcagctcagattttgagtctgcctctgaaacatgggtttctgagtagggaaaggtggcatggtaaaaaggccaggattgagatgttctcttttgacaccatagttttatggattcaaggaccatgagaagtgcatcctacttctgccacttgtgaaagcaaatcaagtgggttttaagatgacagcaagaatgaaaagggagaaaaaaaaagtgggtttgctatacttgtcaagtgcctggatcaaggaaggatcaaggaggctttctgagccccttgattggttaccttttgagcccttccccaatcattccctaggcagaattttctgcatcttctaagtagaattttcctgggtgcttcagtacaatccacttgagatccttgttcctctggcccttcaacatggaagtccatgagagtccatatttgcctttccattgagaggtccctaataatttatctttaggctgcatcagcaagagtccctaggattctgtaggcctggcccctctcttgttctgtgagtccatgttgaaggccgtgtccaagttgcttcctcatctccttgctgaaaacaaatgcttcaggaaagatagagactaggacttaggatgaaaaggtcaagttctcctgaggaagattgggagctggagggatggaggcttccaaagatctctgggcctcagtgggtaaataaagtccagaaaccttttagctatttctgctgcagtgccatttcaggcatagaatttcaggtagggtgagaaactgtacccatttctgggttctagggagggatactctataggcattaatctgagggagagagggttgaaatctggcctctcaggtacctgtgaaccagacagaaaggcagtaattagggcaaagttgcaggaagatgctggtgctgggccttggggtgggaaacaggttgcagctgaggaagcagtaggaattctttagcctgcattagtatttggatggcaatgggctttacattgaataaacaaagggagactctgttggggaacagctaccacagactaagactatcagctacaaagactccctgtgccctcccaggagagttaactttacttacactgcaaatcatgccccaagttcttgagagttgggagatgctatgtacactgcagctgctctggttgcccttcagtgctctagagggactgaggattttgccctgttcatcattaagtaattctgtggaattcagaaaattcagcccataacctgacctgagatgttttggaaatgacctttccttctttttttattttctgaaatctgaaaatccagtttctttatgactcatatcttcaaatgcttattgacatccaggctaaaaaagaaaaagttgccagcttccacatgcagggtgtgcccaggcaggggtctgtgatgtgtgaagagaaaaatgctcttgatgtaaaacacaatgtgaggaggtagggaggaacaagtccttcaccgatgcctgccgctagaaggctgacctggaagttggggtccatgcctgagtaccttcaaacagaagaggctaaccagctgaagaactcagcagatctctctgggatggtactcagtgcaataacaggcacaacagattgagttaacgtggtatatggtagtgctggaatagagagggtcagtgttgtaggatgtcagataaatgaatcagtttgatccatggaatgggctgaaggttgagagagattgataccctgagagaggagtcagccaaggccatattcttctcgcctccatgttgtccctgaaaaacaaaaaaagaatgaggggctggagccccattctgactttcctctctctaagc

SEQ ID NO: 51 - DNA, 4173 bp, Homo sapiens
aagtcgtcccttaatgctatcagactgaagacaagtgataaagaatatgttgataactgatatttgaatggctctaatgttacatgcatttcattatctattcatttttgctttaagatgcatataaactgtttccttttagtaaatggaaccgtttgaaagagaaaggcatttgtaaggaaacgttgagaatatgttattagaacatgtttctttctccattagttcatattacatgggtttacattatatgcattttaaataaaatatgttaagataaatgaaaatagttatatttaggctgttagtatattatacatataaaaatattttgtaataaaacttattttgacattatatagatttaattttgtttgatcacaaattactattacattattattattattattattattatactttaagttttagggtacatgtgcacaatgtgcaggttagttacataggtatacatgtgccatgctggtgtactgcacccattaactcgtcatttagcattaggtatacctcctaatgctatccctccccccttcccccaccccacaacagtcccgagtgtgatgttccccttcctgtgtccatgtgttctcattgttcaattcccatctatgagtgagaacatgtggtgtttgtttttttgtccttgcgatagtttactgagaatgatgatttccaatttcatccatgtccctacaaaggacatgaactcatcattttttatggctgcataatattccatggtgtatatgtgccacattttcttaatccagtctatcattgttggacatttgggttggttccaagtctttgctatcgtgaatagtgccgcaataaacatatgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggcagcataaatgtcttcttttgagaagtgtctgttcatatcctttgcccactttttgatggggttgtttgtttttttcttgtaaatttgtttgagttcattgtagattctggatattagctctttgtcagatgagtaggttgtgaaaattttctcccattttgtaggttgcctactcactctgatggtagttgttacattgtttacaaagaaaacagtatgcaaagttttgtataaattttagttaagtgcatttaacttaattttagttaagtgcattttttaatatgacctgtttttaaattgggaactataccctagttaataaattaacttttcagtggagctggttatttatattgtttactgattaatgtttttaattagcagaacttattttttagagcaattttaggtttacagaaaatttagcagatcatatagagttcccatatactcattctccctcactcacagcttcttctattattaatctcttgcattctgtggtacatttcttgcagttaatcaacatactgaaatactgtattaactaaaatccatagtttacattagggttcctctttgtgttgtgcagtcatatggattttgacaagtgtataatgtcacataaccacctttacggtatcttgtaggctagcttcactgtcctagaaatcccctgtgttttacctatttatgtctcttctcccaacttgaacccccggcaaccaatgatcttttttactgtctctgtagttttgccttttcctgcaggtcacgtagttggaatcaaacaagatatagccttctcagactggtttcttttatttagcaatggacacttaaagttcctccatatttttgagacttgataggtcatttctttatattgctgaataatattccattgtctgactgtaccacaattttttttttatccatttgcccttttgagggacatctttgttgcttccagtttttggcaatacaccctctataaaaattcatgtgcaagtttttctgtggatatggcttttaactcatttgggtagatatctaggaaagcaattgcttggttctatggtaagactatgtttagttttgtaagcaactagttttctacaaagaaaactagttttcatagaaaagcagcaaatataccttttgtttttaaatatgttaaacctgaggggaatggctttaaaaccctacatattttacataatcttttttcattatttcagtttttataaaatttctttttcccaatcctggtgtactatgcaccaggctgacctaaaggagaggccttctttgctttctatctataaatttaaatttttttttgacaaattgatacacacatgagttttgacagaaatagaattgccttgataactcttcaaatgtaagtttaatgaggtaagaaataaataaagattatttgaaatctcaatagaaattcaactataaaagtcaaaatagtttagataaatatataaaggggaaaagttgaaaatgttaagaataccacatattcaacatgcagaaagaatctgtcattgaacaatgcgtcctggagagagcaacgatttttaaaaaacagtgaatggcatattattgcaaactttgtttcccacaatttatgttcttttcctaaactgataaaatataatacagtgcctcaaataatattcatttatcaaaaccacttgataaatatctctattgtttcttgggaaactatataggaaaacaccctacattctgcttaataatttccttagtaaaacaacatattctactcaatatttctaaaattaattctttaacaaggtgttatatctctaatatccctaaacatggtttcattagctagccagggtaacaggttgaaaccacactaatgtgtcccagaagaccttgttgttttgtatccactgaaaaagagtcatggcaatattgtgttctgtaatataattagtgagtttctatagtaaaaataagcaaatttcaaataaatgatttagtccttgagatatatgaaaaaagtgtaaaactttcttaaactcatgctttctgaaatcattccaatctcatttttctctcaagctcctcagtcatgttctaccaacagaattattaatctttctgatgtttctaccagacaatcctctctgatgaaacattttttaaataatcatatgaagacgttaaaaaatttgttacagaaaaacagaactattgttttatttttctaataaatatgtaaaatattattaaaatgcagtactacatatttttagatacaaatagctataaattatccatatttccaagaaagcaaatgatgactattcctacataaattgttttattcactgtttaatccatcattaggtttgataacactttgaaataaagtttgtaaatagtataggagataaaaagattctctaaagactgttttcaagttcccccttttagtaacaatgttctttactatacatatttattatgagttaagagaagaaatagttttaaattaaaaagaatgacaaatgtctttacattattcttttagcaattacccactttgtagcaaaaaaactataacccttcaaatttagctgcagaaaaaatccacacattctgtgccacatttatctaattttattcaatgatgactggctacctgggttatacgtggtgaagatttgaggaataagggatagattagaaagaaataaacaaaaagatataatttctccattctcctcttagtaatagccagtaaatatctgagagaattgcaaaaaatacaaactcagttttcattgaaattagtgattgcaataacagttgtccatatttaagcattccaccagaccatgatattttaagcattgaaaaatgtatttttgttggtgtagtaacattattttgtcaatttaaaatttagtttctaaataatttacatctgtagc

SEQ ID NO: 52 - DNA, 47790 bp, Homo sapiens
ctcaagaccaattattttgttatttgtaaaataatgggcagtttcaacccagacaggtgtgtgctttgtagaattgcagtaagcaactatgttatgttatggcaagtttaaattgcaatataattattattctcattcaaatattttctaaacatatggaatatgatgatatagtattacaagttatacatttaacatttatatcagaacttttacctgtatatgaagaacttaagatgaacaaaaataattgcttttgttgaagcaaagtttagaggttctgtcaataaatatattgtagtctgtgtctgctatgatttggtcaggaaaatggaaacctctccaaatatttcaaacagtaagtgatttaaaatagaaaattagaaatgaataaaagtactggaagactattggtacaaatctcaggaaagccagaataggtccagaaaatacaggaatagcaggaaaaaacctaaatggtctatatcaactgttcataccattgaattgagttatttgcagaattagagatattttgtgaaaggagtctcagatatcactggcaatgtctcatatttgcatcttcatatattggcctacacttcttcaaatgcaaaaatggcttctgcttcgcttttctttccaaattttgcataattgcttctcactggaaaactctattctggaatcatgctactaaccattatgagaaatacggtttcaaggcttctggctcttgtaatagaggagagagtataaatggtgaaattgttactgactactggcacacagttcatctttctttaaaatgttcataaagatgtgtcccaaattgtcaaatataagaaagaattatttgaaaatgaaaaagtcagcagaaattacttgtaaataaccttaaaccatctcattttccctcccccttcattctctttaaatcttcatactacgttcgttcttaactctcccatactttgcttattctcatcctactttcacagttttagcaaagtttttcaggtaaatggtgttggagaatactgagccaagttagatgaaaattcctaaaccaagtttggagtgtggctttatggagagtagggggtcaaggtgacggccaaggatgggtggccagttcttaaatttaacaagctgaaatatttttccacaaatgaatcctggacaggtcgcagggaaatccatttcattgtcactggctacttgagtggagtttgagcaagagtgctggtcagagtggcgctcagggcatcctggtcaagcaggaggcacaggcctattgggaacagagtacaccagatcaccaaggccacagcacatggtctatatcttgatgatctgcatgctctggacccaacagacctttctttcctgctccttaggccaatgctttttttttttttttaaacccgtttagtttaccaatatatttttacctatttagttttatttgatgatttagaatatatttatacctttatttgccagaaatgtattgcttatttagttttacttatttctttacaaattctgaacagatttttaaataaaatatgccagtattaacactgatattttggtccaacctgaaataaagtctgacattcatatgatattgccatttgactcacattgcaattactagaaaaaccaagtcctctctgtaaccctaaattgcaaatgcaatacactcaaaacacattacaaaatgtggctgaatatgatgccccaactgaaggtttaaaacaaattctgcaaagcaaatttctccctagtatgaggcttatactctgcacaaaactgacaatatcatgttttggataatgggaatagaaaagtgagaacagatgaagttaggagcttctcaactctactttggcccaaaggaagcaggataaaataaaataaatgaggattcacacagattagatatgtttgcaatctggggaagagaaacgtactctgctctgtaaactgctgtctagaagacaacctctgctggctgggaaaaaataaatgcaaaataatttgttctcacacacaactgctcagagaacagtctgcatttaaataaaatgaaggaaatgaaaaaaaaactaagtgaattaaggattctaacctgggagataaaaaaaaactacaatataaatttgaagaaagagtataaataattattaattataaaatattagcataatgaagcaatgaaaaaatgtccaaaataataaataaatttaagaagaaattttcggcaaaagagataataaagtagatgaacatttaactaatttaattcaaaagtatttggaaagctgttgagggtaaagcaaaaactaccaaaataagaaatgaaaacgaatagcaagattagttggctcaaccctatgcaaacagaatacagattatgattagtatttaccatctttatcttgttcattatgtactaaagaaacagattagtatttcatcattattatgatgctctctgtagatttttagtagatatactttatcaaattaaggaaggtccattatatcctagtgtatttgtttcttttctcatgaatgagggttgaattttatcagatgttctcttttttaaaaacaatctttatttttaatttttgtcggtacgtagtaggtgtatatatttatggggtacacgagatattttgataaggtatgcaatgtgtaataatcacatcatggaaaatggggtatctatcccctcaagcatttatcctttgttacaaaccatccaacagatattctcgtgttattaattgagatgaccatatggttttctttttttctctgttaatgaatcacattattttcaaatgttaaacaaaccttgcctttatgggaaaacccccacttgttagcagcctcttactggctttacaatttctgtaggaattgtagtgatagccactttttttgtgttgacaatttattttctttctcacttattactcttactaatatttttgaaaaattcaaaatttggatttattgacttttatttcttcttcatattagttactttatgtattcttatattattgtttctttgttttattgcattttttttcttttttgagattgagatggaaggttgagatcattgatttttttacccttttttattttctcttaagcattgctttagcagcatcctacatgctttaatatgttgtttttcattacatttcagttcaaaatatttaaatatttcttttgagattctttctttgactcttggattgggtatactgctgaatttccaaacatgaagatttttagttatctttattatttctagtttaataattccactgtggtcagagaacatcatttgtatggtttcctttctttctttctttctttcttttctttctttcttttttttttttttgacagagtcacactctgtcgcccaggctggagtgcagtggtgtgatctcggctcactgcaagtatggctttatttctatgaaaataattaaataattgaggctttatttatgggacagcatatggttcattttggcaaatgtttgaaatgtacttaaaaaatacattgctgttgtaagtagaatgttctacataggttgactaggtaaagttgattaaccaataagtaaatctctaaaattagtaagattttctctgcttgttgaaataattactgagagaaatttgttatcttttgaagctgtgttatgaaatttccttttgtctctaataatatgtgttgctttaaagagcagcacgatgcaataaccaacaaaacttatcaagcccttactttgttccactcatcctctgagttttctgcatatattagcacaaagctaatcatcacaattctgtaattaccgtaatatttcaattttatagataagttaactgagctttagagaaacttgcaaatgcacatatatggtagatggcagagatggcatttgaacccagccagtgtaggcctaaatgttcctaatatctttggaacgctgacttaagcaaacgaaaatttatgcgacattatttgatagaaagcctctaaaatcagtttggtaattttttcattgttgtaaagcagaaactaaatgttttatgctttcgcgacatatgatttttttaaacaatccttttaaatattttttaaaattcccatctcactggtcatataggaatagaccatttgccaggtaagttccatgggccatagtttgcaaacccttgctctacaccatgaaaatgtgagttctccctgcctcttatgcacaaattaaatatcatttcaataatgatacaattatttgagtaggaaagaaccatggaaccaaaaatgtatttcatatgtgaaaaatatgttagcatataaataatattaaagcaaaaaagtccatcttagacggcatgaaagaaatacaagctgcttaaaaacttacacaaataattttgaacacttcttagataacacatactgatctcagaacttttaattctcttgtctcattttatctttatctttttatcatagcttggttaatgcctatagctagtagataatataatacggatttaacactaggaaaactaattttagagtcagaattatagcttttaattatatgattgaaagtgcgtaccactatatgcaagaagcacagctacaccttagtaactgaggcacattgcaagaaaaatgataatgaagacctaaaagaaacatgcaaatctaaattaattagtggtgcctgggtgtgttgcctcatgcctgtagtcctagcactttgggaggcccaagtgggtggatagcttgggtttaggagttcgagagcagcatgggcagcatagtgagaccttgtctctactaaaaatttaaaaaattagctggatgtagtggcacacgcctgaagtcctagctactcagcaggctgaggcaggaggatcacttgagcctgggaaatagacgttgcagtgagctatgattttgtcattgcctcagccagacaatgaatgtcattgttactatgatactgattatcactaagatatataatgaacactaataaaatagagtattatcttttctagggtttattcctccatttattttatatctactaaatacaaattatgcaaatcaaattcttttatcaacgtgcatttgaaactcaacttagcaagacaaatgaaccccaacaaacattcgaaaagtaagacccagattaaaaacaacaaaaacaaaaacccaaactttcttccaaatattggctaatttaattaagggtaaaacataatacaaaatggtagaaaatctaggagatacacacacacacacacacacacacacacacacacaacatatatatatatatatgtgaaagtacgtattatttcagtctgttcagactgctataacaaacatatcataaactgggtggtttaaacaacaaacattgttttctcacagttctggagacttagacgtccaggatcaaggtattggcagatctggtgtctggtgaaggcacacttcttttttcataaatagtcatcttcttgctgcatcctcacatggctgaaggagagagagctcttcaaatctcttttataagggcactaatttcatttatgaggactttaccctcatgacctagttaacttctgaaagccccacctcctaataccatcacattggggttaaattttcagcatactaattttggagtcatagaaacattcagtccatagtatatacatatttcctaggatatattctacattatattatgtattacatgtaaatatatgttctaggaaatatttttaaaattacattctacactatgtaaaatatggtttaagtagaaatgttcagaggaaaactcatagtggtaatctataaaatttagaattaaaaataaggctgctgggcgcggtggctcacgcctgtaatcccagcacttggggaggcccaggcgggcggatcacgaggtcaggagatcgagaccatcctggctaacacggtgaagccccatctctactaaaaatacaaaaaattagccgggcatggtggcgggcgcctgtagtcccagctactctggaggctgaggcaggagaatggcgtgaacccgggaggcggagcttgcagtgagcagagatcatgccactgcactccagcctggatgacagagtgagacttcgtctcaaaaataataataataataataataataataataataataatactgggtgctgtggctcacatctgtaatcccagcaccttgggaggctgaggtgggcggatcacctgaggtgggcagatcacctgaggtcaggagctccggaccagtttgtccagcatagcaaaaccccatctcttctaaaaatacaaaaattagccaggcgaagtggtgcacaactgtggtcccagtcactagggaggctgaggcaggagaactgtttgaatctggccgtggaggttgcaatgaaccgagatcgtgccactgcactccagcctgggtgacagagtgagactccatctcaaagaaaagaaataaaaaaaattaaaaatatggaaagcattctattcaaaccattagaaaaaaaataagaaaaccagaaaatgtaagataaaagcagacattttatatttatattcttatgctgatacatatatcatgaatggctttttgatgcagtgaacaggcatactaccacctatcacaattaggaaaaaggagagaaagcccacatagaaattaataatagtaattagaaaataacccaaaagagaaaattgatggaaattttagtaaatatatttaaaattttagaagaattaactcattagaggaaaacatagggtaaacaaatttgatcccagagagaaattctaaagagaacagttgttatggaagaaaaatacattaaagtcctacatccctaaaaagacaccaggctcaaatattttataggttagccctgtcaaaacttcaaaaacaaataatcttgtgagattttaactgtttcaagagtaagcaaaatagatatatttgtttattaaggatcatcaagataagtaaaaaaataaaaatgcatgacagtatttatagtatgctcctacttgggtttacaaaaagacattcatatctactcataagcacaaaaaaattctggaattttataaaaaagttatctgttgccagtggctgcctttagggcatgagcttcagaaggagatttgcttttttgttttatactgctttattttcatgaagtgtgcatttttaaagatgacttttttcaataagcacaatatttttaaataaacaatcctaagagtacaatgacaagaagagagcaaaaagacagatgtcttggcaatgtgatttggagtagaagagctatactgataagtccaatgacccaaaaagtataaaacataaaattttcaagtagacatcattcagatgttttcccttcataatgctacaataagaacatttgaaaacccttgacatctgaatattttggcatcatgcagtcttaagccacaatcagtaacctttttaaacattaaaaatgtatcattaaatatttaataccatcaaaatgatgtaaggaataatatcacaaatacaaacttttgaaaacccatcacagagtttaagtagaaattatcaatataactaaagtctactcaaacataccctgtctttctactcattagatgtagcattcttcctgacttttttctctttttgtatttgtagtatatatatattatatatttatttctatatatatacttctaaatattgtttacttttgctactttaaaaaagtaccagaaagtatttattttatgttacttcagtattattaatgttcagtattattgtgcttgtgaaagttattcatgaaatacaagtgccactaatttcttttcactaccctgtattttctattgtactcttttgcaaaattgaattatctttcccttgtaaatgaacatttgtattgtttgaggaattatttatttatttatttattttgagaggaagtctcgctctgtcacccaggctagagtgcagtgatgtgatctctgttcactgcaacctccgtctcccagtgagaatcaagagattctcctgcctcagcctcccaagtagctggggctacaagtatccaccaccatgactggctgatttttgcatttttagtagagacggggtttcaccatgttggccaggctggtctcgaactcctgacctcatgatccgcccacctcagcctccaaaagtattgggattacaggtgtgagcctctgtccccggctgaattccttttattaaaagcagctattttgtgactattgttttaaatgtctcattctatgtgcaagcatatctctagccagagtgagttatagttggattgctgggatattttatctttacagagaggcaaaaaaaaatgcatcttaaaatcaatgaaatgtgatagataatgtcagagcatgatattaagcagtaatgtaaatatacacaataagcttatcagagtggctctgtagctgataccaatatttggtattatcagactttctaattttggcttgtcttgtgagcataaaatggtgttctggttgtaatctttatttcttaattaataaatatttatatttgacaacttatgtaaattgtacataatttctgatttcttttattttttattattagtattgacagtctattattctttccaaaatgaaattaaattaggagtgttttaaattttttattttatgcattttaaaactacatactaatatcatgtttttgggttctaaccattgcatatgggcaaagaatagattctttgaaaaaccaattctctgaattttattaaatcttgttttatagcttattcatgatcaactttatatttcaagtttgtttgagtcaattgaatattctcaagatattgggtagactattccatatatgtctattagatcaagcatgtgaattgcattatttaaatattctatagattaggatctgtgaaaacagcacatttttatacaataacggaagtttatcctcaaggttaatttgctccaagtacaaagtatttttgtaaactgtaaggttgagttttaatacattttttattaaacaaggaatagctatttatcctttcaaaatttcattgttgttgctattttttttggaataagtcaataatgcattaaaatttcagaatttgtaaaatgagcaaattaatttttttgtgtgaaaaatatagttcatagttgtttaggtgtttatagttctccttttatgcattaacagttttatataacatctatatttactttttaatattagaggaaatttcttgtggttttgaattgcatttgtactactaggttcctttcatgaactattttaatcatagatcaaatggcttctcacaagaattagctactcaatatcttaataaggtgggctgtcatgcaaggcatgaaaggagtcaaatttcttttgctttcagatatctacaattttatgtgtctcttctgtacaaagccccaaaacattttacaaaaagcaaatatagatgaacagaaaattcaatgtaaaattcaatagctgaactgccttagaattttgaaggacatacgtataccagtgaaatacaatacaagtagttatagaaacaagaaagcaggctggggcattggtgctaattttatcttttgtaactagccttcaaataaatgggttaaatagtgataaatttctataccactttaatacattttaaattttgagaaactatattgggcaagaaagaatgttaaaaccaaggtttcaggaaattacctcatttgaaaacatttgaaaacaaaaatgtggtagtttcctgtatatcctatatagtggttaaatgtctgttagggatagaaatgatttcagtcaagtaattccactttcttgaactcttggccaatctgttttaattattacccattgctactaaacgttccatggaatcaatgttatataatagattatgaatatgctatattcagaaagagtggtgattaccttccatagactcctaactattcttcatgcttatctgattttcccattagatacaattttcattttaaagcaacttatatatatatatatatcagtacttttttagtcctcattgcctataaaactaagtctaaacacaccagtctgggattaaagacctcctataaatagcctatccatacactctgatatgtttgagatagtctattccagtctgtctgttgccctggtataattattaaccatgccccttttactctcaaagttgtcctattttagattatgtagttatctcatccaaaatcaaattccaaccaatttttccaatttcatcttgcatgagaatgcattttatgaattcacttctcaaacccaaataaataactttatgttccctgtatgtttttccatcttgccatgttttcttttttgcctctgttctcctgtcctctatgaaatgaccttcatccccaattgttttggtttcaccttcggtagtcatctcagatatcgactctttcacaaaaattgtcctgattcccagttgaagataatttcattctctaatctttgtgtcattttacctacattcatttaatggtataattatctgacttgactcgtggttattagtaaacttctaatctccactgcttgatttggtgtttcttgaaggctaaatcaatgtcttctaattgtatcattcatagtgtctaatatctaggatgtgctcacaaaaactggttgatttaagaaatgaaaaatttaaagtcatgcattatgttatattaaaaagattccatatctaaaataatcacattaatcagtgtaaaggaattgttaaaatgacaaaataaaatttatgttattaaaagttgtattagatttctgcctctcaaattaatgaggatttgactttatagtctacatagtatatttcaaaatttgaaaatttcaaaactgttatcttcaaaatgtttaagtcctataaaaatacctcaatacaattattttgtgatagtttaaactttctctggctactgaccttcacaaaaaattatttaggtgaacgaccactaaatttctcccctgaggggttactttaatttaatcatattctaaaaatgatttacagcaaaatttgaagttctacatcagtctgaggagtagttggaagttctttcagttcatttattcatatttacaaagttgctttacaaagaaaatactgtagtagtatttatgaatagaacaaaaataaagcaaaaaaagacaaagctctttctctaggaaaagggtagaaaatatgcatttgagaataattcctttttttcccctttattctaatgttgacttaccatcagaggattaatatccccgtgggtcatgtatttggaaataaagagaataccctggcaaaaatatgttttgaagtgaatgataattttagaaagtagggaattatattctagcacaaagggaattgtagtaggttatttaaaaatttttttaattttatatataagtatatatatgtatatatacacacacttaaaggttaaagcaaatgttactgttctttaagtaaatggggaaaacattgtaatgaattatgctctttttaaataccatataaaagatacaagacaataattttattaacaatacttcatgatctcattttcttatttaccccttatatgatgtttgttaacaatattgtgccatctcagcaaatcagtttatctagagatatctcttcagatgcaacctttgattgctaagattacagtcaactccatcatagctgaaagagaaacaggctattctcatttaatttaggtttctattttggccaaaattttaatattttattgaaatctaaaattactgaaatcagaaacagcttttgtcattggagaatgacaaatattcacctgagtgttttaaacatattgggccagaaataatgacatgtaaacatgtttggaaacatgttctgaaacattggacttcatccattccaaggatccattttgccaccactataaaagcactaactttaacaaatccattggcacagaataaccttatcaacaagatttccctcaaatggttccctattgtgtaaggatcttatcatattcctggatttattattcaaaaccctctgcagtccaacttccatctagctctataactcagtacttcaagcatacttaggaaaagaaacataactaagcaaaacaaagcaaatatatgcttgctcagtgtccctttgagaaaaacaaagtacattatatgatttaaaacaatgacaaatactatagtaaaaaaaatctttcaaataaatatacagatgctcctcgactttcaatgaactgacatcccataacctgtcataagctgaaaatgctgtgttgaaaatgcatttattacacttaacttagcaaccatcatagcgtagcctagtttacgttaaacatcttcagaacacttacattagcctacagttaggcaaaatcatctaacacaaagcctattttataataaagtgctgaatacctcatgtaatctattgactatcgtactgaaaattaaattcagagtggttgtatgagtactggaagtatggtccctactgaatgcatatagcctttgcaccatcataaagtcaaaaaattgtaaggtgaactcataaactgaggactgtctgtaactgctttttggtaaaatatttagatagttttagggaacgcattgaatttattttccaccattttccttagtacactctttgctccagccaaattggctggctgtttgcttgaattctcttgcctgcagaggttcccttaaaattctcttctctttctgccattgatgtaagtcctttgccccctttggagtctaatataccttacattactttcctgaggctagtattgacagcctagatagaatgaagaattatagagtctataatttagttacacttgggttgtgctactttgtatttattattggtctttctagtcaccatttattcattcaataaatatttattgagtgactactttttgccaaaacatggagatgaaaagatgactgagaactaatttatatattttgtcttttaatcccccaaaagcggggaccttgcctaatatcttcacatactctctatactttgcagagtcacaactcagtatcactgttgataatgaaattccaggtctaggatgttttaatttaaaatctttttaaaagttgtcagtggccaacacagtgaaaccccgtctctactaaaaatacaaaaaattagccgggcgtggtggcgggcgcctgtagtcccagctactgaggaggctgaggcaggagaatggcgtgaacccaggtggcggagcttgcagtgagccaagattgtgccactgcactctggcctgggcgggcgaaagagcgagactccgtctcaaaaaaaaaaaaaaaggtggtagtttatgtaactaaaataaaggtagatactttgggtttttaaaattatggtatttaaatattactagttgtattagtctgttctcacgctgctaataaaaacatacccaagacctggtgatttataacggaaagaggtttgtttatttatttatttatttatttatttatttatttatttatttatgagacggagtctcgctctgtcaccctgctcactgcaagcaggaaagaggtttaaatggaactgactcacagttccacatggctggggaggcctcacaatcatggcggacagcaaaggaggggcaaagtcacatcttaaacggcggcaggcaaacagagagcgtttgcagaggaactcctcttcataaaaccatcatatcctgtgagacttactcactaccataagaacagcacgggaaaaacccacccccatgattcgttacctcacatagggtacctcccacaacacgtgggaattatgggagctacaattcaagatgtgaagttgtgatttaggtggagacacagccaaaccacatcactagcaacagacaatgcttcccgaggcaatggaaagaagccccatttgtccttactttgaaaaccactgctttagagcataccagccaaactcagccttgtaagctttacttttaaaggcatatttcttcaaggcttatgttttaaaaactactcaaggtagaatctctacaatagatctgggaaggtggcagttaactaatccattaactcttaaagtcaatgaacactagaaaagtattctaatttgttgttgttttctacatccaaaggctttctcccattattaaaatcagaggaaaattatatataaagtcagaggaaaattaatattttgaatttaactatacaagcccctaaagtcaaactataccagctcctaaagtcaaatgattattatttttatggtatcttttctagatgtatatatgtttagctacacaaatgctatccatcatttcaggtatgttaatatgtactctgtttacatggtctctgtaggacttgtaatactcttttttaattagtgaacttcctttctgtttgaatggcttcatgtgttcaaaaactattgatctttcttgctctaagccgtaatttcttttactctattttttctagttcttgtggaaagccttttcttttcatgtgtttcacgttggccccacttttttcttttttcttcttctacagaaagccattcagctatttgaagtccagatcaatttctatttatgaagtcttcactgattattcaaagttaatgtaattcaagcatatttattgtgcatataatataatttattccctaatcatatccaagttagcactccattttataccatcttgctctgtgctataatgccttcttgtacatgtacagttctttaaaacaagattataaataattagaagttgaggattaaatgaacagcataccacacataggttatttcattccctttatatttacaaatgtgcttgacatatttcatagaatttatattatgctagcaatggttcttaacatttctgagctttgaataagttacttaaactaactaaaaaacatacaatttttagaaaatttacttggtattcttgtgtgatactctgactaaggtccatggatgtctataactcaattctcttataatttttgttaggaatgaagatttattgctcccatagatgacaggcttatctaaatgtctatgtgtctggcctggagatatgcattttaagatgcctgccaggtatattttggactcactaaagtttagagaactgttgaagagataatccaataaatttgttttcttaaaatttcttcagagtattaaaacaaattgaagttgaagtatgcaaccattttgatattttttgatgagtaggaaatatgatactaataatttacatttgtaaagtgctttacagttaatacatatatattatataaagttatacatatatctatatatgtagttaatattttgaccttaaaaccatatactttattaacttttacagtatatttgtgaagtagaatctagaagctaaaaagatataactctaagctaattaggatgaattttcaaatgtgtgacagtttatatctagttattgaagggcaataaaacacatcttcagctaatgttacaaaatgtgccttggaagtaaatgccaaatgaccgaattgatttcatctaaaatgaagtatgtaaaaatttggtgaatgtaaatattgatcctaggttcatataaactgttttgataaaacaaaattgcaaggaagcagataatatcaaatgcgtaaagtttatcaaaaataaatagttgtgaaatcattttttcattgagaatatcttaacatgactttatgagataaggtcaaaaaacatttttcaataaggaagcagcactacccagaagggcgaggcagaaagggtttggtgctaagctaatatagtctcaaattttgagaataaatttttttaaagactatgtaattatgatacttttgctttgtgttttaacccaatatctgtatatctacaagtgcaaagttttaaaaattccaaatagctcctccttattatagagttaataggactaatcactgtatccgtagactgtcctttatccgaaatgcttggaactagacatgattcagatcttagatttttgtttttgtgttttggaatacatgcattgtacttactagtttcgcatcccagatctgtaaatccaatccaaaatgttgcagtgaacatgttctttgatcgtcatgtcaaatgctccaaaattttcaagcatttttgatttcagattattgtattatggacccccaaccttattaaattcaagagaggcttccttaccacagatttttttaaggcaagattgctattaatagcaacatagacaaagcacattttctaggggaagcaattagtatattcatttatatacttatgcactgcacagcaaagtttcagtcaatgagggaccacatgtaagatgctgtttccatggattataatggaggtgaaaaattcctatcaccaagtgacattgtagccacagtaacattgtagcacatcacatttgtatgtctgtggtgatgctggtgtaaacaaacctactatgccaccagtcctataaaataatagcacatacacttatatatagtacataatacttgataataaaccattatgttactggtttgtgcatttactaaagtatactttttatcattattatagagtgtactcctacttactaaaaatacattaactgtaaaacagcctcacataggtctttcaggagatattccagaaaaaggcattgtcatcatagggaaagagaattctatgcctgttattatccctgaaaaccttctagtgaaacaagctgtggaagtcaaagacagtgatgcagatgatcctgaccctgtgtaagcctagcgtaatgtgtggagttttgtcttcatttttaacaaaaatttttttaatgataaaagcttatagagtaagaatacaaaaaagaaaatagttttgaacagctgtacaatgtgtttatgttttatgctgtgttattacaaaagagtcaaaagttaaaaaattgaaaagtctataaagtaaatagttacagtaagctgtttaatttattattgaagaaaaatatttttcataaatttagcttagtctaagtataccatgttttaaagtctacagtagtgtacagtaacatcctaggccttcacgttcactcaccacttactctccaactcacccacacagcaacttccagtcctgtaagctccattcatggtaagttccctatgaagtagatatggtttggatgtttgtcccacccaaatcccatgtccccagtgttggaggtggtgcctggtgagaggtgcttgggtcgtcgggggcagatacatcatggcttggtgctgtcctcacaatagcgagttagttcttgcaagatctatttagaagtgtgtggttcctcccctagccatctctctgctcctactctttaccatgtggcatgttggctcctgcttcaccttctacatgagtaatacctctctgaggcctccccaaagcctgagcagatgccagcttgtacaacctgcggagctgtgagccaattcaacttcttttctttataaattacccagtctcaagtattcctttatagcaacacgagaacagactaatacacaggtgtaccattttttatcttttatgccacaatttttacgatatcttttatgccacaatttttacgatatcttttctagatgtacatatgcttaaatacacaaatacttaccattgtgttataattgtctaccgcattcagtacagtaacatgatctaaaggatagtagtcagggagcaataggttctaccatagagcctgggtatatagtaggctaaactatctgttttgtaagtacactctatgatatttgcatgattacaaaattgcttaatgatacatttcttagaaaatatccccatagttaagcaatacatgactgtattttcaagtactgtgccttatctaaagaagtgttttagttcactcttgctcactctctcactttctctctctctctctctctctctctctctctctctctctcgttacacatggctatcagagggcatttttttttgtatagttccttgggaaaaacaaatgttgctttcatatttaaaaattttattttcctccttgactaacaaatatgattggcaaataaaaagacctgtgacctcaaaaagctctgtgcgatagtggcttaattaaggtgtttcttttcatttaatatatggattaccatttatgccaatattataaccagattattcaatcaacaataaggatttatatttattatgagaaaggcatgattgatcaaatgtatgaataactatccaaccattacatgagcttgccttgtacacggtgactatcaagcacttatgcatgttaattagagatgttttgtattcttccttatgtttcataaaacatttattttccgcaatttcttttgaataccttcttctgggttgacagttgaaagcattaaagcatttcatgagaaatattttaaggtttttacctgttctttggtggaaataagaattttctttctcacagactggtgcacaaagactccatctaacagctacccgtatttcctgacagtgactctgaaaggttagtttctaaaagtttaaaagtcatttcattatatcagagcttttatccaaaattcatgctgactgtgaaaacatatatgggtaaggatgatttactttgaaatcatcacaagcaaataatatctggaaacttgtacctttaacttgctggtcatattctctaaatacactttaaataaacatactagtgttcactctttctgaacctataattatttcactctcatttgtgttataacagccatgcatgtttggtaattttatttctctgatagttggaaaaatataatttgttctattgtatttatttattattttccaatgagatgttcagtcattgtcccagaaatacataggttcaaaagataaataagatagagaattaaccataacatgtagttgccttatctgaagcagaaaaagatttatttccttaaaacaaaacaaaacaaaaataattttccattctttactatctatttatttaatatttgagttagctaagcttggtaaaaaggattgctgtgtgctgtaatttgagggttttcaggacctattaattaaaaaaaagtcctccaaatatataaaaagcagctgctccaacccacatggcctgataatttcacgcttaggacaagtgaataatgaaatataagaaagtactttgtattttagggagatgagtacggagagagaggagcttggaagtggagacaaattttaaagcacataaaaccttggagaagaattttccttgatataggatagtaaaacaagtataccatttgtccaggggtggtgcgaagagattagaagggctacagcagctcaaataaactgtttctagggctaaatttccttccttccttccttccttccttccttccttccttccttccttccttccttccttccttccttccttctttctttctttctttctttctttctttcttttctttctttctttctttctttctttctttctttctttctttctttctttctttctttctttctttctttctctttctttctttctctctctctctctttctttctttcatttcttttctttcttttctttcctttttttccagaagtctaggatacttattatggtgtcttccggcataatgctttagaagaagttagcaaagtatcagtgattagatgagggcaagacctcctaagctccacagatacagtggctaggacatggaattgtaccatttatttctgaaagatctaaacattgtatctttttctttctgtgaaaaggttaacatatggcctacactgtaaataccttgtattttagtcaggagaggcgagggcatttggtgctttactgctatagagtgttctcatgggaaaaaaaatagcattgacccagtgaatgagagcacccagataaaatgattacaacctattgtataattccctgatcccacccagttgtgtcatggaacaggatatcacacatgtatacaatgtaatttgtatcgaacataagaagcatttgttccttgattttttgaagtgtataaacagtagatattcatttgtgtttgttttattttaggtatcccaatacctaaatatacagaaattactggaagaaatattcaatctggtgtgatatactaggtgaatgtatcataagaatttctgttccttacaaaattgtgaatgcaaagttttaggaattatattggctatatgatactgatctttgatatctttgtaccttaaagcaagattttcttagtgaacactggcattcacagtattgttttttctctggctatatcaagagctttagttgttttttgttaaatgaaaagaatgaagagactatctttcagacttaaaagttaaagttctgtgtgcagactttcatgtcatgtagaaaaaggaaataaagggagttaattggttttgctgtaatttttcttcagtggattaaaaaaaatctatgcttaaaatactatttaatgataatgggtgacaatttctataaaaatacaacttttgtttcttagaaagttaacttttttctatagtttatataaatatggcattagtcagtaactgtgtgttcggatgcctaaaatgtatagcttttttgtttgtttgtttgtttcaagaagctatgtcttaattaatttaggagactatagggttgttgggaagacacatataaatggagaagccagaaaaagctggacacaaaaacagattattagaatggagctgtacgtggatattagaattggtggctttttaaaataactgagacatagttgcacatttccatactcctgtgtttaccattgagcttttttaccgtctttgtatttttctctatatcattagttttcttacttataattttgatactcttatagcttcagtttatcaagctgtttacaactatcccctcactctgtattctctttctaatgactgttcggttttagcatctatcaaataccttgatgccttcatttgacaagtcaggttcaaacctgataatcctattggctaatctcacttccatgctagacatcatagatgactgttaaatctgaggattagctgcctttggatgatttatccatttttatttagttcaatctgtggtagaggctggatcatgtgggtctaaatattagttaaaattacattgattggagatctagaggttttcctttaggaaaaactataggcttggaataaacaataattggtacatttgagattttaaaaattctgtcttctctacatacggccaataaacatatgaaagaaagctcaacattactgatcattagagaaatgcaaataaaaaccacaatgagatagcatctcacaccaatcagaatggctattattaaaaagtcaaaaaataaccggtgtgtttgaggttattggaaaaaaaaaaaaaaggaatgcttttatactgttggtgggtgtgtaaattagttcaaccattgtggaagacagtgtggtgattccccaaagacctagaggcagaaataccatttgatccaggaatctcattactgggtctatacccaaaggaatataaatcattctagtgtaaacatgcatgcacatgcacttgtatgttcatacagcactattcacaatagcaaagacatggaatgcccatcaatgatagactgaataaagaaaatgtggtacatatacaacatggaatactatgcagccataagaggaacaagatcatgtcctttgcagggacatggataaagctggaagccattatcctcagcaaactaacacaggaacagaaaaccaaataccacatgttgtcacttataagtgggaggtgaatgatgagaacacatggacacatagtggggagcaacactcacgggcgcttgttgaggacggggtggggtgagaggaggggtgaatcaggaagaatagctaatagatgctgggcttaatagctaggtgatgggatgatctgtgcagcaaaccaccatagttcatgtttacctatgtaacaaacctgcacatcctgcacctgtgtcccttaatttaaaatgaaagttggaaaataaaaaaatagctatcttctctaacacaaggagctattctccaatattatgcatcatttattcatttacaacttatttggccactcaattcattttatatatatgtgtgtgtgtgtgtgtgtgtataaatatttgtgtgtgtatatatatatgtgtatatatgtgtgtgtatatatatatgtgtatatatatgtgtgtgtatatatatatatatatatataaaaggggagaatatattggatattggattttgtgtctcttcctagttcaagaataaagatactttatgtgatagggttattaaagcaaactgtcagtcacatgactgcttatatgttcccttgaggccaggtcatttgactttatattcttcatgtttataaaatggtccccctagcccgtctataaccccaggagcctttcctgctggtagggatgtatttcttacaggatcacactccttggtactttgtaggctggtatttattagtaatacgccctgtaagtgcctctgtccagtgggcattatggttctttctggtcaaggttcttggtatatttggaagtgacatgcagttgatatatgtagtcccatattctcatcacagttttcccagttcaagatgtccttggtattcagtgctgcacagatattctttgtaatgaatggatgacagtccttaactgatccttacttgtttgtttcccacaaagtgaaaataagtcctgtatgcaatatgcaatattttaactttttaatttcaaaacattaatatgattattaatcttatgatcaaataaagtggttattaactagcaattatgtgcaacattctaatatttgattgtatgaattagatatgtcacacaacatgtgatcttaatctttcaatcaattataaatgcttactcagatatttctacaatgttaccaaatttcaatctgaatttataatacgaatcagtctttcctaattctcacacccctaaaatgtcagctgagtaaattatttaccaataatacacttaccagtaagatagcatagccttaagttaaagcattactttacctaacttcttttcaactttcaggttatcctagtctaagctgtttacttggattttcctcttttaattcttgtattcatctctgttgatcctagtattctgataacagattctaataattccccaaccattccccaaagctgccccatatacaaaagctgaaataaaagaaaaaggaaagtactgtaacaaggaaggggatagaaaagtcttcatgtagaagaagatgcccaagtggaattttgaaaaattagtactaatttgacaaaagtatgagagtaaaggacatttgtgggtaacacatatttaaaatactcagtgtgtaattattaattcactgattctataaacatgctttgaagtcctgctgtgtttaggtcttatacaagatgctggagctaaagatttagaaaagagtgtcctataatttatagggagattcataataagttcggcacttaataagatgaaaatagaataagtgttatgcggagattgtatgcatgcacgctggacactcacatatgatcacatatctcagcctgggaagaaaggagttactgaagacgttctgtatgaaatcatttagaaatcaatgtactgaggtatactttacatataataaaatggacacatttactctacagattgatgacttttgacattcagctgtgaaacctccaccccaattaagatatgtctcaatattctgtaaaattctgtctctttgcaatgtttccttgtgcatcttttcttgttagtccttctggaataagtaattattgaaatgggtttttgacagatttctcagtagttatgtaagaagaacaagaatttgagtagttattttagaaaagcaagaagaaaaagcacctcactaaaagcagggcttctgtcaaagagcataagaaaatgaggctagagaagttcgtaattagatgataaagaacactgaaagaaaatctgtagtacttccatgggtttaaaccaggataagtcataataatagcagtaaagttaatgatgatgataataataatattgttgagtgtttaccgagaggcaggcacttgtgtatgcatgatttaatttaaccttgtaaagaggttgcttttctcatccattaaagatttgacaagctagaaactcagtagtattaaatgaattgaagattcacaaatagtaagagctcctgggaggtatttacacaaaaacccttttcattttactttcaacatgatttttttaaaacattaacaataaattgatgatagattgaaagcagcagggctggggtccaatttgagagataattaggaggtagaatctacagggcttaataacacatggttgagggaaggatttggtaaagagagtattgaggatcattttcaacttagatgagtagatgatgcaattacccaagatgaagacaattgaaatagaaacaggattggagatgacaagttcagtgttagccatgctgaatttaagcatgaatgttacttccaagtgttgaagtatggcaggaatttggaaatacagctctaaattttggaaaaaaatttctatactgttaaaaaagatgtgaagtcattagtatacatattttagttaaagccagagagaatgtaaataattaacagaaaaaaaactaaggatagaagagcaaaacatttgtctttaaggaatgttggggaaaaacaaatcaaagataatattaagtagaaaaacaacaaaaaacccaaataatagaaaatagtgtcttggaaatcaagggctgggtgtgttccaagatgctattttttaatgacatcatgagaagtgaaaagagaagtcgtagagaaggaaaagaagagtgattaaatatgtacattgcactttgaatccaggcagtcactggaaatttgcgtgaaagtagtttctttgtaatggggaagaaggtggacggcaatgcatggagatttgaataagaaaaagggacaatgcatgtagaaagctcaagatgctcaactttgaggaacggaaacagatgggaatatgttataggaaatcataaaactgagggagttgttttttgcttgatccagttccaaaagaaatagtcacacacacaaaaaaaaaaaagaagaaaagaaaaacaaagataagaaagaggaaaagaggaattaatcatgaagaagaaggatactcattgcaacaaaatcgttgaggatgtatgaggggttagtgtttgagcacaggtagagggataatgtaacgagggtgctgtaacatggccatttgttagactgacagcgtaggttggagagcaggcactttttgctgaggcaatttccccagccttgtgtttatggaacttcagagtgtgactattctgttgtggggtgaggtggagggctgcaaggaaaactacactctgaggctcacttaaggcatgtgctgccggtagcacttctgaatgaggtgcagagttagaggcagtaattacggcattagcatcgcagagtgcccagtgaaaagtttttggagggaagaaaattgtttataatgattgctttctgttttagattttactctataaaacattatttccaaaatcagaaacctagatggcctctaattcttatgattcactgctcaagaactgtgcctgtttcctcctattaagtatgttttcttgtgctgttctgttgcttagacaattttctttggttcttcctattgcattctcattgagttttcttatcttttctcacatttgtttccttgtgatagtgcagggctgagtcttcctggttccttcaatggctagctacattacatttctttcactgaaagccttcccttttttctagtggggacgggcacattggtgtgggaaataggagagctgaagagagagagaaggggtgtgagtggaaatagtgagtggggattatatcagtaggcctttatcatctgtcactttctttcctgaagtttcagtgatgacatttctgataacattcgtaagaatgtaatagagctgtttttcctaatttttaatatatacttcagtaaattaaggttcacatcatactataagttcaagaagttaaatgggaagaaacaattccctagtcaagcttgagaatatatgagaacttaatttcaatgccatacaaaaatattctttgtgtgaaataggcaagagttattttttgacatgtagataaaatatgttttacaagcgttgacaatagacacattttataacagcataaacattataaataagaaagtagagtataaaagtattgtgtgagagaggtcaatgtcagtaagaaattatgaagttaacaagaggaagaaaaaaactggtgtaaatagattgaatgagttgctctgttaaaaaaaaaaaacaaaaaacaaaaaaacttaggataggtcattaaatctagctgttttaaatgttttaaaaattggaaagtataagcaacatactggagactacaaataataatttatctttaagtatcatcagtgatgattgaaagaaaatcatacaaagcaccatgaagtaaacatgaccttttttttttaacttggtaaaggactttttattttatatctctccaacgaatgaaaaatgcagacaaaaagatgttcaacatcatgaatcataagggaaatgcaaatcaaaactacattgagacaccacctcaaacctgttaggatggctgccattgtaaaaacaaaacaagtgatggggaggatgtggagaaattttaaccctttttcagtattagtgggaatgtaaaatggtgcagccactgtggaaaacagaatggtgtgcctcaaaaaattaaaaatataattcctacatgattcagcaattccatttgtgggtatatactcaaaagaattgaaatcaggggctcaaacaggtatctgtgcacctatgtgcatagcggcattattcacaatagtcaaaagatggaagcaacccaagagtgggttgcaattgacatgaatgaacaagcaaaatgagatatacacacacaaggaagaattattcagccttcaaaaggaagaaagttttgacaacatggtattacacagatgaacctcaagggcatcaagctaagtaaaataagtcagacaccatgggacaaatatggtatgatttcacttacagaagctacttagaatagtcagaatcatagggacagaaagtagaatgctgggggaggaggaaatagggagttatgtttcatgggtatggagatttagttttgaaagataaaaaagttctggaaatggttcatgatgatgtcatgctatgtatattttttaccacaattaaaaaagtagttttattttaaaaggccgaagggtgatgaaagtcctcactgctttatccatcttcgggagttttcttctccatttaattcattaaaagaactttcaaatcttacaattttctaggaagctgttcctgtgcagtttgctctcctggatttctcccaagggactactgtcatggaacagaattccactcaggtaacatggggcccagccaatcgcaaatgccaaccaggcatttgtgtgctgtctttaagaagaaaggagatggatgggtctgagggtaaaggaacaagaaggtgtgggtaggggctgagaccagcctgagtattggaatttgtccttgacagctgcgggaaaagccctgtcgaggcctgcacagaggctccaagtgcagaagtatatgtgcatgtgcccatgtatgctttcacttatgtatgtgttcatctattcatgtattcaatgaacacaattagcagctgctgtatgctgggtactgttctatctagtagtaaaccagcctggctgggctttgtcctcataggaaagatataatgaaggagctcacaggcaagcacacgcgtgtacagtgagcccacaactgcactctgatggggtacattaggcaagtctcatttttctggtagccagtgggagatgcatacagataaatccaacagagaatcaggagcaagatgcaggacaagtcggagatacaatttgtgctcagaatgccgaggcccttgccagccatgcaaaggtcttaaccctagagcagcatgaagccatgaaggattctaggcagtgacaggcacggtgagattcatgttttggaaagttcctgcaggctgcagtatgaatacatagtaggaaggcaggaggccaggtgagagaggagctggcctgctccaggaggtagaagcctctggaggtgtttagacacctctagattgagacatgaagctggaacaaaatcatgagatttggtatccatcagtccacctattcctacttttccctgtgtgatgctgagtcgatgtgcccatagtcttagttgatgtgcttttaaagtgagaaaaggagccacctcggcccctctttctctagagtttctgctacagtgattgggtgagatcatgtgaatacagagctttgtcatcaggggcaaggtgttgcaggcttattgatgagaatgtggatggtgatggtgatggagaacataattctggtatttaaggggttgaggagtgctgcatgtactccacgcagggcagcatactcagaggtttatgcatatcatccagtaggattttgtaccacatttggagatacatgttactatccccaagataatgagaaaacagctccagagacgcttatgcaaggtcacccagaggaggggggtcagaaggcagattcaaaacatggtttgtctggatttaaaactcttatgagccccacaccaccagccacttaagaaggcaattgtactttgagattttatcagtctcagttggctttggggccaggatgtgtgttcattcattcatcagtccattcagaaaatatacatggagtacctaacatttggcagccacagcccaagcccatgaagggaacagtggacaaaacacacatcttcgcatgacttctttattgtggttaaaaaaaaagacatatcatgaattctactctctgaacaaaattttcagtgtacggtatgtacagtattgttaattgtatgcatattgttgcacagcacatctctagagctttttcattctgcctgactgaaactccacacacattttgcaactccccatttctttcttctcctaggccgtggcaaccaccattctactttgtttctgtgagtttgaccactttaaatatcccatgtaagtgtaatcatgcaacatttctccttacgtgactggcctgtttcacttagtataatgtcctaaagtttcattcacattgtagcatatgacagaatttccttcctttataaaactgaataatattccattgtatatatttaccatattttatttatccactcatctgttgatggacaattaggttgagtccacatcttggctattatgactaatgctgcaatgaacatgggagcacagctaactctttgagaccctgatctcaattcatttagatcaataccttgaagtgagattgctgaatcatatggtagttctatttttaaaattttgaggaaacttagtactgtttttcaaagcagctgcaccatttactttcccaccaacagtgcagaagggttccaatttctccacatcctcagcaacacttgttcttttcttttctttttttaaaatattttaatttagataaagagattacatgtgagtgtttgttacactgttatgttatgtgctggtggagattgtgcttctaattcacccattacccaaatagtgaatattgtacccaataggcattttttcagtcttccctgtcctcccacccttccctgtttcagagtaaccagtgtctatcacttccacctttatatccatgtgcacccattgtttagcactgatttataaatgagaacatgtagtatttgattttctgtttctgagctagttcccttaagataatggcctccagctccatccatgttgctgcaaaggacattcattcttttttatggctatgtggtattccattttatgtgtgtatgtgtgtgtgtgtgtgtgtatgtgtgagtgtacatggtatttaatatatatataatacatatacgtatatatgtgtattacatcaataaataccaacatttattgatgtgatatgccatattaaatgtgacacacacacacacacagacattttctttatccagtcaaccattggatagacacttaggttggttctatgactctcctattgtgaatagtgctgtgatgaacatacaagtgcaggtgtcttttgtatacaataatttatttttctttgaataaatacccagtgttggaattgctgagttgaatggagttctattttcagttctttgagatacctccatattgttttccgtaaaggttgaactaatttgcattcccaccaacagtatatgagcattcccttttctctgcatacatgccaacatctgttatatttgacttttaattctagtcattctgactgttgtgagataatatcttattgtggttttaacttatatttctctgatgtttaatgatgttgaacaatttttatgtttgttttacacttattatttcttcttttgataaatatctgttcatgtctttgctagtttttaatagggtttgttgtttgtatcttattgagattttgaattccttatagattctggatattagtcctttgtgagaggcataatttgcaaatatttctcccattctgtaggttgtctgtttactctgttgattatttcttttgttgtacagaaggcttttagtttaattaaatcccatgtctatttttatttttgtttcatttgattttggggtattcatcataagttatttgcctagaccaatctccagaggagtttttttctagctttcttctagaatttgtatagcttcaggtcttacttttaagtctttcatccatattgacttaatttttatataatgtgagagataagggtcggttttcattcttctgcatatggctagccaattttcccaacaacattttttgaataggatgcccttttcaaatttgttatttttgtcaactttactgatgatcagttggttgtaggtatgtggctttatttctgggttctttattctgttccactgatctatgtgtctctttttgtaccagtaccacattgttttagttactaaatccttgtagtgtaatttgaagtcaggcaatatgatgcctctggatgtgtttttcttgtttagtaattctttggctctttgggctcttttttggttttgtatgaactttaggactgtttttttctaattccatgaaaaatgatgttggtaatttgatagggattgtgttgactctgtggattattttgggcagtgttatcattttaatgatatcaattcttccaacccatgagcatggaatgttttccgtttgtcatctatgatttctttcatcagtgctttgtaattttctttgtagaaatctttcacttccttgcttaaatgtgtttataggtatttcatctatttgtgactattgtaaatgtgattgagttcttgatttgggtctcagcccaaatattacttttttaaaataggaaaagtttcatgagtttgcatattctccttgcacggggaccacgctaatctttcctgtatcattctaattttagtatatgtgctactgaagagagcaccaaacattattgatgtattaaaaatgctactgacttttgtacatcaattttgtaaggttcatttgctctatagtcacttatgtccagagttcctttgttgatttcctgccccaataatctggcgttatcagtagggtgttgagttactcactattattttattgctatgaatctgttttcctggtctagtagtatttgttttatgaaactggatgctccaatgttgggtgcatatatatttagaatagctaaatcttcttcttctattgaacccttcatcattatctaatatcctactttctataaattttactgatattggtttatagtctgtcttacgtgatatgaagatggctggtcatgctcatttttgttttccatttgcatggtatgtctttttttacccctttactttgtctgtagtatttagccaagagtaactatcttgtaggtagcaagtcgttgtgtctttttttctttaaaatacaatttgccattttgtatgttttaggtaaagcatttaggccatttatattcaagagtaatattgatatgaaaggttttgttcctgtcatagtgttgctagctagttgccttggagtttcaactgtgtaattgctttataagggctgtgagctttgtagttatgtatactgttacgatagtgaatatcatccttttgtttccatgttacaaattctttgagtattttcgtttgactagtctaatggtaatacgttttctttgtagttatttgtctgggaaagactttagttttgcttcatttttgaagctttgtttggtaagatatgaaatccttgactggtgttttttatacataaagagactaaaaataggctcctaatctcatctgcttatatatatacacacatatatatatgcacatatatatacacacacatatatatacatatatatgcacatatatacatatataagtatatatatgtatatatatataatgtatattgtatacggtcttttggctttcattctgggtactttcagcagcaaagagtctctataaatttcttagttacagatagccttttgtggtgtttttttcaaatactgattccagttgtgatgtatgggacatgtgggcaggctcatagcctctagtggagctagggtgacagaagtcacaggaagcttatctcattctctagtgctgtgcacttgtctcagcagattttctactgtgttgtgacattcaacctccaggccagtaggtggtacttataggtaagatttggctgcagctaatgcagattggtacatatattatcctgtttactgggagaaactctctattgccttaggaagagggctgatttttctcagatgaacactcttttcccatcttctcctccctgggatctgaagtgtcctttgctcttctggtaaattctcattttccttcttgaattgaagctcacaggcttgatctttacacagtattttgctatttccaagtggttgaaagttgataaaagcctctaatcttcatcttgttaaaaacaaatgaacaaacaaaaaacaacaaaaatatcccacatttgttattttctatttttttaaatgcccatcctatcagatgtgaggtgatatctcactattgttttcagtttcatttccttgttgataagtgatattgagaatcttttcatatacatgttgccatttgtatgtcttctttgaagaaatgtctattcatatacttattttgtatatttttaattaagttttatggttttcttgtatattttggatattaaccacttatacagtttagaaatatcttctctcattctgtaggttgccttttcactctgttgattgtttcctttgttgcacataaacttttagattgacatattccaaattgtctatttttgtgtttgttgcttgtggttttgatgttatatccaactttttgatgccaatatagtgttataaagatttgccttcatgtgttcttttaggagttttatggctttaggtcttatgtctttaatccacttagacttgatttttgcatatagcatacgataaaattccatttttatttttgcatgtagatattcaactttaccaaatctatttatggaaaagactatcctttccccattgtgtattcttggtatctttgttggagatcatttgactatacatgtgtgggtttatttctgggctctctattctatttgattggattacatgtctatctttatgccagtactattctcttgattactatagtcttgtcatatgtattgaatttcagaagtgtggggcgtccaggattgttctttctcaagattgttttggctctatgggattctttgtttccatattaaatttagtattttttttctatttctgaacaaaaagtcactgagattttgataggggttgcattgacattgtacattgctttatgtaataagaacattttagcaatattaaatcttccaagccacaaacacagtatgtccttccatttacctatgtcttctttattctttgaacaatgttttgtaattttcaatatgcaagcttttcacatccctggataagtttacccttaattacttctttttggatactaatgtaaataggactactttttaaatttcccttttagattttttttttttgttgcaagaaatacaactgatatttgtatgttgattttgtatcttgaaagtttactgaatttgtttattatttctaacaggattttaaaaagtctttagagttttctgtatatgagatcatgtcatctgcaaacagggacttaggtttgggggcacatatgcaggtttgttatatgggtaagttgcatgttgcaggggttggtgtacatgcaacttacccatataactatgctaataagcatagtcctgatagatagttttttttttatcctctaccctcaaacaggccccagtgtatattattcccttctttgtccatatgtacccaatgtttagctcccacttataagtgagaacatgctgtatttggttatctgttcctacattaatttgcttaggaaaatggcctgcagctgcatccatgttgctacaaacaaaaggcatgatggtattcttttttttgatggataatgttccatgctgtataggtaccacatgtaccacattttctttatcgaatcgctgttgggcatctaagttgattccatgtattagttattgagaacaatgctgcaatgagcatacacctgcatgtgtctttatggtataacaatttatttaccttcggatatatatccagtaatgcattttctgggtcagatggtagttctgtattaaattctttgagaagtcttcaaaatgcttcccatgatggctgaaataatttagattctaccaagcagtacataaccattcccttttctcttcaaccttgccagcatatattaatttttgactttgttatagtagccattctgactgaggtgagatactatctcattgtggttttgatttgcatttctctaatgattagtaatgctgagcactcataatgcattttggccacatgtgccttctcttgagaagtgtctgttcatgtcctttttttttttaataaaggggttgttttctgcttgtaaatttgttaaagttccttatacattctggatattagacctttgtcagatgcacagtttgcaaaatattttctcccattctgtaagttgtctgtttactctattgatagtttatattttgatgtgcggaaactttatttaggtaacattggtcaattttctttcttgttgcaattatgtttagtatcttcatcataaaatttttgccaggttctatgttcagaatggaatttcttaggttattcatatggttagactctgtgtccccacccatatctcatcttgaattataatccccataattcccacatgtcaagggtggtacctggtggaaggtgattggatcatagaggcaatttcccccatgctgttctcatgatagtgagtgagttctcatgggatctaatggtttcataagcatttgagaattcctcctacatgtgctctctctctctctttttcacctgtgccatgtaagacgtgcctctttcccttccactatgattgtaaatttcctgaggccttcccagccatatggaatgagtctattaaacctccttcctttataaattacccagtcttgggtatttatttatagcaatgtaagaacaaaataatacagttgtcttcaagggtttttagttttaactttaagtcttcaatctatcttgagttaattattgtatatggtataaggaaggggtccagtttcaatcttttgcatatgactggccagttatcgcagcaccatttattaaatacagagtcctttctccattgcttatttttgtcaggtttgtcaaagatcagacagctgtaggtgtacagcattatttctagcttctctagtctattccattggtctatgtgtctgttcttgtactagtaccatgctgttttggtttctctatccttttattatagcttgaaatcaggtaatgtgatggtttagctttgttctttttgcttagaattgctttgactattcaggctcttttgtggttctatatgcattttagaattttgtgaaaaatgtaatcagtattgttgtaggtatagcattgaatctgtacattgctttgggaagtatggccattttaatgatactgattctttttatctatgagaatgaaatgtgtttccatttgtttgtgtcattcctgatttctttcagcagtgtttcttaattctcattatagagctttttcacctccctggttagctctgtttctggtgtgtgtgtgtgtgtgtgtgtgtgtgtgtgtgtgtgtgtgtgtgtgcatgcgtgcttcttagcttggatattgttggtgtatggaaatgcttctcatttttgtacacttgtatcctgaacctttgctgaatttgtttaaaagatctaggagctttgggcagagactatggagttttctacatataaaattatatcatctgtgaagagagatagttcaactacctctcttcctatttggatgcattttacttcgttgtttagcttgattgctctggctgcaacttctgctactatgttgaataggagtggtgagagtgagcattcttgtcttcttccagttctcaaggggaatgcttccagtttttgcccattcagtatgatgttggctgtgggtttgtcatagatgcttcttattttgaggtatattcctttaatgcctactttgttgagggttcttaacatgaagcaatgttgaattttatcaaaagtttttctgcatctatttagataatcatgtggttttgtttttagttctgtttatgtgatgaataacatttattgattggcatatctggaatcaaccttgtatccgaagaataaagcctacttgatcatgggggattactttttgaattactgatggaatccgtttgctagtattttgttgagaatttttccatctatgttcattaggaatattgacctgaagttttcttttttcattgtgcctctgccaggttttggtatcagaatgatcctagcctcgtagaacgagttagggaggaaatcctcctgctctgtttttaagaataatttcaatagaatttaaatcatatcttccttattgtctggtagaattcagctgcaaatacatctggtccagattttctctggtgggtaggccttttgttatgattaaatttcagaacttgttatttgtcagttaggtgtttcagtttcttcctttttcaatcttgggaggttgcatgtttctaggattttatccgtttcttctaagttttctagtttgtgttcatagaggtgtttgtaatagtctccaagggtgttttcctgtttctgcagggtcagtggcaatgtttcctttgccatttctaattatatttatttatatttagattatatctagaaaaacctaaagactccacccaaaaaaaaaaaactgaagttgtgatgaatgacttcagtaaagttgcaggatacaaaatcagtgtaaaaaattagtaatatttctatattcaaaataacgatctagccaacaaagaaatcaagaaagcaaccccatgtacagtagctacgaaaaagtaacaaaatacttaggaataattttaaccaaggaagtgaaaggcctctataaggaaaaccacaaaataccaatgaaagaaattgaatatgacacaaacgaatggaaaaagatttgatgctcatgttttagaataattaatatcaataaaatgaccatattgcccaaagcaatctatggatttaatgcaatctttgtcaaaataccaacatcattcttcacaaaatcagaaaaaaatcctgaaattcatatcgaatcataaaagagcctgaatcatcaaagcagttctaaacaaaaataactacactggaggcatcacattacctgacttcaaaatatgtggcaaggctatctagccaaagcagcatgatattggcataagaatagacacatagaccaatggagcagaatagagaacccacaaataaagccacacatcgagagccaactgatttttggaaaagctaacaagaacttacactgggaaaaggacaccctcttgagtaaatggttctgggaaaatttggatagtcacatgcagaagaatgaaactggaccttgtctatcaccataggcaaaaatcaattcaaatgaattaaagacataaatttaagacctgaaattataaaaatactagaagaaaacagggaaaactctcctggacattgttctaggtaaatattttatgattaacacctcaaaaagcacaggcaacaaaaacaaaaactgataaatgggactatattaaactaaaaagcatatggacaaaaatcaatggagtgaagagacaacctcttgaaaggaagaaaatatttgcgaactattcattcaacacaggactaatatccatcgtctacaaggaactcaaacaactcagcaggaaaaaaatatatgtaatcccattataaagttggtgaggggaagaatgctgagtataggcccttgatgtcttctggctcagagttgctggtgaaaaatctgcttttagcctgatggagctccctttcatgcaacctgtttcttctctctggctgcctttaaaattttttcttccattttgaccttggaggatttgatatctgtgtgtcttgaggatggttatctcatacgatatcttgcagggattctctgcatttcctaaatttgaacatcagcctctctagtgaagttggggaagttttcatggacaatatcttgaaatatgttttcgaagtccctctttttacagggatgccaatgagtagtatgcttggggtctttacataacctgtatttcccagaggcttcatttattcttttttatttttatttttatttttattttgtctgagttgattcaaagagccagttttttgtgtgtgagctctgagatttttaatctttgtctattttgttaatacttctgattacattatgaaatttttatagtgagtttttcaactcgatcagatcagtttggttctttcttaaaatgagtatattccacttcagctcttatattgttttattgtattccttagattccctcgattggatttcaactttcatttaaatctcaatgatcttgattcctattcatatttcaaattctatgtctgtcatttcagcctggttaagaaccattgttggggaactagtgcagttgcttgcaggtaagaagatactctggcttttttagtttcttgagttcttgtgttggttctttcttgtgtgggctgatgttcctttaatctttgaagttgctgtcctttggatagggattttgcttttatattctttgatacccttgagggagtgactgtcatataaagtcggttcagtcaactggcttcatttcaagaagatttcagaggatgaggctcagctgagtacccctaggctgtatgctttaactttgaggggttggtaccagcccaaagctttgttctctggcccctccgggttaagtacctgctgagttggaggtgtcaaggtgtttctactctatgtcaacagtactgtaatgggagatatcatcaaaagttctttgatggggttgggcagcagcatctgtatacaagtgtgcattagtggtggtggtgacttggcagggtcttcaagcatcaactgggtaggacaccaaccaaggccaggtagcagcatctgcgagtgccagtgcaagagtggcaatggtgtttgtgcccatgcactcacaccaacagtggcgggtgtggtggggtgcgtgcttgtgtgtactagtcagggcagggtgataggtctgcttgtgcatgccaacacaatggtgttgggggactgtaggagagtgtgctctggcagagcagcaggggcaattttatttatttttttgagaagcctttttttccctattgacttcctgttgaataaaggtggctagagtgggcatcttcatcttagaagggcagttcttcatcttagaagaaaggctttcagaattaatcttgagtttgatgttagctgtgggctttttatatatggcctttattacattgaactagtttatttctcctcctagtttgttgaattttttttatcattaaagggtattaaattatgttaaatatttttttagcatctatttatatcattatgtgatttttaaaaattcttcattaatatggtatatcatgttgatttttgtatgttgaaccatccttgcatcccagggataaatcttacttgatcaagatgtgtgatcctttcaacatactcttaaattcagtttgatctattttgttgagtatttgtatatcttttttcattagagatattgacctgtaattttcttagagtggcttcgtctggctttgatatcaggatgatgcttgctctatcaaatgagtttggaagtgttttctcctcttcaattttttgaaagggtttggaagaaaataattggcattagtttattaaatatttgttagaattcaccagtgaagctatcagttcttgagcttctctttgttggagatttttttattactgattctatgtaattactagttatagatctgttcaatttttatttagtcattacttagtcttggtagattgtatatttctaaaaatttatttcttctgggttatctaatttgttggagaataattattcatgctagtctcttataatcctttttatttctgtagagtaagttgtaatgtctatcatttctgaatttatttatttaaggcttctctatttttcttagttcagctaaggcattcttaaatttttttatgtttttaaaaattcaacttttggttttattattttttttcaattttcttttagtctctattttacttatgtaagtctaatctttattttcttccttctgctaaatttgtgtttagttttttaaatttaatttgccattttatatatttttttcttttcttcctgttttctttttggagacagggtctcactttgttgcccagactggattgcagtggcatgatcaaagctcactagaacctagaactttggactcaagtgatcctgccacttcagtctcccaagtagctgagaatacaagcgtgtaccaccatgagtggctaatttttttaatttttagtagagagaaggtcttgctatgttccccaggctggtccttttcttaggtaggtgtttatcactgtgacttctcttttagtactgcttttgctatattccataaattttgatatgttgtgctttcatctttgtttagctttgaatagctttggttactctgggtcttttgatgttacatataatttgatgttacatacaagatattttctaaattttcttttgatttcttctttgacccaatcattattcaagagtatgttgtttaatttcctcacatttatttttttttcagttttccttctgttattgatttaccctactacttttcccagctctggtaatcatccttttactctctatctccatgagctcaattactgtaatgtttagatccaacaaataggtgagaacataggacgtttgtctttctgtgcctggcttatttcacttaacataatactctttcattccatccatgtttttgcaaatgacaggatctaattcttttcttttagagtactattttcattcatcttttgagggacacttacgttgctttcaaatcttacctgttgtgaacagtgctgcagcaaacatggatgtgcagatatctctttcatgtactaatttcctttcttttgggtaggaacccagcagtgggattgctggatcatatggtggctcaatttttagcttttttgagcaagcttcaaattcttctcaatagtggttataataatttgtattcccatcaatagtgtacaagagttcccttttctccatatccttcccagcatttgttattatctgacttttgcatataagccattttaactgctgtgagatgatatgtcattgtggttttgatttacatttctcttgtgttcagtgactttgagcatcatttcatgtgcctgtttgtcatgtgtatgtcttcatttgacaaatgcctattcactttttttgcccatttttgattggaatattagatttttacctatagagttgtttgtgcttcttttgtattctgttactagtcccttgtcagatgggtagtttgaaatttttttctcccattttatgggttgtctcttcacttcctttgctgtccagaagctttttaacttagtgtgatctcatttttccatttttgctttggttccctgtgcttgtggggtattattcaggaaatttttgcccagaccaatgtgctagagattttccccaatgttttcttatagtagttttataatgtgagatcttatatttacatctttaatccattttaatatgatttttgtatatggtgaaagagtggggtcaagtttaattcttctacatattgatatctagttttctcagtaccatttattgaagagactatcttttcttcaatgtatattcttggcaccattgttaaatatgagttcactgtagctgtatggatttgtttatgggttttccattctatttctttggttttttatattattttttggtgtgtttttaattttcatgctggtacccgtgtaactgtttttatgccaataccctcctgttctggttgctgtagcaccagatttgaagtcaggtaatgtgattcatccagctttgttccttttgctcaaaatagctttggttattctgggtcttttgatattacatataaattttaggatttttttttgaatttctgtgaagaatgtccttggtattttgataaggattatactgaaactgtagattactttgggtagtatggacattttgatgatattgaatcttccaatccatgaacatggaatatcttttaccttttggtgtccacttcagtttctttcatcagtattttatagtttttatcatagagatctttcacttctttgattaggttaatccttaggttttttattttatttgtggctactgtaaatgggattcctcttatttatttatttatttattttttaccattagtatatagaaatgctatgatttttatatgttgattttgtgtcctgcaactttactgaactgatcagttcttatagttttcttgtggagtctttaggttttttttaaataaaagattatattatctgcaaacaaggataatttgacttcttccactccaatttggatgccctttatttatttctcttgtctgattgctttaactaggactcccagtactatgttgaataacagtggtgaaagtgggtatttttgtcacattttagatgtcaggggaaagcctttcagattttcccctttcaatatgatactagctgggggtctatcatatatggcttttattatgttgagatatgttccttctatacccagtttttttgacaatttttatcatgaagggatgttgaattgtatccaatgttttttcagcaccaattgaaatgatcatatagtttttgtctttcattctgttaatgcgatgtatcatagtgattgatttgtgtatgttgcatcccagggataagtcttgtttgatcatgatacatgataatgaccttccttccttgcatcccagggataagtcttgtttgatcatgataaatgatctttttagtgtattgttgaattcagtttgcttgtattttgttgaggctttttgcataaatattcaacagcgcattgactagtagttttctttttttgaagtgtgtttgtgtggttttggtatcagggtaatactggattcatagaatgaatttggaaatactccctaacccaatacacagaaatgttctccacatcatgccaccactgtggaggagtgaagaactgaggttggtagggggtggatgatattggaggttcaactgtctttttcttccccttctgtgcccctttcagtgacatgaagttaaaatcagatactgtgagtactgaattttagtgcttgtgaaggtgcttttcttttgtagttgttaaattggtgtccttctgagtgggacaatcaatggagacttgcattctgccatcttggtctgactcccactcttcttcatttttgagggaaatttttgccagacataccattccaatttgctagtttggtttttttttaactttagcactttgaatatattattttccattctggcttgcaagatttctgctaaatctattttgtaaaacattggtcaagggtatatctgctggaccttcccaggtgagataagtaggtttaaagagactaatccactccaccatcccaatctccctaagcctttggatcccttccctacattaaccaagggatatcaggcatttccagttcactcatgtgggccatcttttaatccatatttcagctaaccaagcaaataaactattagaaccttttttaactctccaagctgcaacattaaatgcagaatcccaacttagtgggcccaaatcaataagttcagccttatccaactctatgttcttccaccatcatcccacacccttaatatccatccccatgcctgttctccagatttcttcttatataaatttgaaaactcaagcagttctttgagtgcagcacacctcctcatgggtcacattctgcacctcacctctaggggcccaccggactttagtcttgttataggtctagaagcaaacaggggtgttgtgtgtggctcctgaggagaatcaacattatcttgcctgataactgtctcaggggaggccatcactgttgactcaggcaacacagagtttatctccttagacaagggtggaaagtctgatggcagcatgagttggagaggatgttgcctctactggggatgaggaagctgtttgttctggcagaaatggttcgtcgtagtttaaaaactcagtgtccccagcttcatcagaatccttttacatgtccctgttccaagttgcaggatcccattcttttccaatcaatgccctcacttcaacagacacctgcatgcacctttcattgcaggtcagccactcacatgataagagtttgtgtctgcctttccacaatttcagctctttctctacaggagataagactcagggcaatcctagaagatttgaagctcggtatctgcttctgaagccaggagttagaatccctgagttcattttctttcatcactttgtgcagtgaacttaggagcaaccaaccaacttcattaggttccttcattctctacatatagtcaaaggtattatatatagagtcactaaactccttgcctctcacaagcagtgaatcaggagtgtcaaatgcatttatttggcataactctctaaacagttcacaccaaggactattagtttctccacactattagaagtagagtccttagcattttggagtctaatcatattaagcagccagctccaaaaactccaagaccaacaaaagaactccatccttagtattttgttcctctagaaccactcttggtaccaaaatctgaattagtcagggttctctagagggacggaactaataggatagatatatatataaagggaagtttagaggccaggcgccgtggctcatgcctccaatcccagcactttgggaggccaaggcaggtggaacacctgaggtcaggagttcaagaccagcctggccaacatggtaaaaccctgtctctactaaaaatacaaaaattagccaggcgtggtggtgggtgcctataattccagcttcttgggaggctgaggcaggagaatcacttaaatccgggaggtggaggttgcagtgagccgaaattttgccattgcactccagtctgggccacagagtgagactccatctcaattaaaaaaaaaaaaaaaaaagccgggggaagtttattaagtagtattaactcaaatcatcacaacgtcccataataggacatctgcaagctaaggagcaaggaagccagtctgagtcccaaagctgaaggacttggagtccaatgtttgagggcaggaatcatccagcacgggagagagatgtaggctcggaggctgagccaatttagccttttcacgtttttttctgcttgctttatatcctggccacactggcagctgattagatggtacccaccaagattaagggtgggtctgtgtttcccagcccacgactcaaatgttaatctcctttggcagcagcctcacagacacacccaggatcaatactttgcatccttcattccagtcaagttgacactcagtattaaccatcacagttcccatttccttatctgcaaactgatgataatggtgcctacctcacggtcagggaattaggttagaatgggagagctctgtaattaataatactatacaaaaaatatattcttataagactgaattattataaatgcattattttcttgaaataaattagtactttgtaaatcataagcaaaattatactgcttatacatgatgtgtgcagaaaataaatgttgcccaaaactttttcaaagcacaaataatttgaaaaacatgactgttgtgaatagtgcagtgtcatgtgtttataaaatgggaagctcaattctactttataaccatcttcctttaaatcaatttgtttgtgttacagcaagggatactgggatttatttaatctggagagtaataa

SEQ ID NO: 53 - DNA, 7716 bp, Homo sapiens
attgaaataatgtggtcaaactagatagtccaccctatacaactcaaaccaaagactgctgctttggaaattctgatatccagtttagctgcccaaattttagtaaactggaccatcgccacatcatttcattttgtgttgtgtaaatatgtcctactgcctaaaatactatttagtttcttccatttctacctccaggcactgtgcaacttaaacaaatgcagacagatgctaagtaacatatggtttctatcaatgtctagtgtaaaaatggcactgatttttctgatgatgcatattgtttccttctaaacatattcattaacacatgtaagtagattggtacaaataaaatcaacctgtaagtgaaaaccaaaaacatgtaattggtaaacacatggtttgttcaaatgaagccctaaaatatttgtatattttttcaaatattaacctgtaaccaattttacctactttaaattcttaaatattcttattttattcaaaatagtgaaagcaattatcttagagtcttagagaatgtttacaaaaatccttcgatttctttaaattttataatatccctttctatccccgcataaccacagaacagaaaatggggtttgtgggtccagattgtttgtatttcatattttttacatataattattttaaaatgccatttcaacatttaaaatgccatttcaacatgcaattttggccagcagagttacagaggcagttgatgttattgtgtcaacaaaatcattatgctttatatgtaatgaaaccgtgtctttcaattcacttttggaacaattttagaagtaagtagcgtcaagtcactatgtgtagttcagacagtgaatctgaactctgccatctattgatggtataactttgggtaaattatttaagatcttgaatctttaatttcctaatctgtaatttagggctaacaattgtacttcataggattggcttaaaagttagaggagataaatcacttaaaatgttagcataacatctaacccatgataaacactccatgttaagttagctgttgttttttagcataattatcatatggttgattttaatcaaacgctctaatggtttttaggtacaaatactaaaatagcatccaggtttacctcagtaatgtcaaacttcctctatattaaaataagtatgttttaagtaactcaatcaaacagaaaaatagtcattttttttcttaccaaacaagaattatcattagacagaatttccatatgatgaagggcaatacataaagcaacctaaattatcttcccaggaaatttcattctttctatagttgttgccaaattgccaggttcactatcatgcagatcccaaatattatagtacttcatcttcaaatttctgccactagtatggacaataaccttgcctctgttttccatttgcttttgacatgagctaaaaacttccaaactacttttctcaatactaattatgagcaaaatgaatcatgaaaggagaaagtacaagcaatataagaatagcacagtctacaaagtattgctttcttattctagcttatctaatttaatttccaaattctcagatcttttcccccaaaaaacactagcaacatatccaaaaggaaagccctgtcaatctgaacactgccacaaaccataggcagaaaacaacaagtatattaaaagaatcagtagtgtgactatcttttgtctattcaatggaactctcaagttgatggaatcacatgtttacatatgagaagtagatataacctctttcaatagctctcttttggaggctgctggtgatccaaattagattaggccagattagaaagagggtgagtatttcaaccaaggtgctcaatgaaggtcctagaggataaattattgctcttcctccattatgctccctcttcccatgcccttgggctgcttatttaatgaaatatagtagtatcagactgcataaggaatagccatgtccattttgtatggacaactgattttctaccatttgtgaactgctttggtaagactgcttttcctggtcttctagtgagcaggaaaccaagagaagaaagtctttctgaatacctgtgattcttgggctccaaaaccaaccaaccaaacaaaaacctttttagaggcaaaatttataataatagcagccacgatttttgaaacccttagactatccccagcatagagataagcactttaaagttgctatcatatttaacaactccttgaagtattattgtcttttaataaaatggaggtaagtttctcaaggttacactcttataaaaagtgatctattgagtttgaattttgaagttctcaaggaagcaataaggcttctgactactttataatccatctagtcacttactattggatagtaatattttggccactgttactagaactggggaaacagttgtgaataatacaaagcaaaaccctgacctcatgtgactcacactatagcagagggtaaataggcacataaattaaacaatgtaatcccagatagtggtatgtgctttttagaaattaaaacaggactaagggatacaaaaagaatgtggccagggtgagaagaatacttaacatacagttgaaacaagagagtatagaggagagaagtattccaaatggggaagacatccctgtttgtcaaagccctgagcttaaagtttctgaggggcaagaacaggccatgtgacagagtacaaggtaaacgtccaccatggctttttttccattctacagaatgagtaaattaaattcaaagaacatcacttactgaatggctttttgattctgaagttcatactcttttgtgttatatagcttttttaacaattaatgaaaaattgtttactttattctgtttttaaattattcccatctctttcatgtaagaccttcttggtttttgacatcttaatgtttcatcagcaaatattagcagcataatatctagtcattctgttttttctttttcctaaatactaaaaatatgctacagttttgagagtgtgctttgactttctcatatatgtctgtgggtatgatcgagaaaaataaactgtctataataatggaaaacctgattgtaaaatatattatgacttttgggagaaaaaatgttatttatttctattttctatttcaaataacgaagttttaatctattcaaataatgatataattttcaaaatttattgtcattctattgccaggaaaacttaggtatgcttaaattaaatagcacatttaattagctcaaacagaaaagattaaattcatgattcagaatttgcatatttatcaaatatatctgtaggaataaagatatgtgatatttaatgtggatttatagctttatattttttatatcttaagtccaaattatctaattcagttactgtatttatatttccatacctgggactcttctccataagccagtaatagcaatgaccttatagcagacaggttaatgttaaagcatgtccattacttcttgcactactctgtctgcattcaaaccgtatactttatgtagaaatgcaattattttattatataactaaaatggacatattggaaacattttggcaccatctcactttatggcataagaatgttttcacctctcacaacattcagttggagagggatggatttttatgtacactaactgattaaaattcattaatttggagatagacccaataaaacatttaagaaaacctatagttctcacgcctgtaatcccagcattttgggaggccaaggcgggcagatcacgaattcaggagatcaagatcatcctggctaacacggtgaaaccccgtctctactaaaactacaaaaaagtagccgggcatggtggcgggctcctgcatagtcccagctactcaggaggctgaggcaggagaatgttgtgaacctgggcgggagcttgcagtgagccaagatcgtgccactgcactccagcctgggtgacagagcgagactccgtctaaaaaaaaaaaaaagttaaataaataatatctaatgtaaagcctgggatacagaccgcagaataggctatatctcaggaccatagtgtataacaaatttacaatgaataaatggacgtaccgtgagttaagagagcaagggtgatgctgggtaggcagtgacaggtatgctgttcagggaatactagatgactacttttgaactcagtccttgtcaaacctctgacagtgcagtattgccaggttttaaataaatgaaaagcgaaagttccaatttgtcaaaacaggtacaacatcagagtaattagtagagcaaactctataggtttcaacgtaggatttcattaatagttagctgtgtttaaatatggtttaaagattaatcatgtgggaggctgaggcaggagaatcgcttgaacccgggaagcagaggttgcagtgagccaagatcccgccactgcactccagcctgggcgacagagcaagactccattttttttttttaaagaaaagattaatcgtgcacaattttcagagaaaagttatagcttaaagaaaaactgtacttgctctaattgaagaaaaatatgaagaaactggaaatgagataacaggtcacaatattggttaaatatattcagatgtgatctaagaaaaaatgagaattttggtcatttgtactgagaagcagaaatacaagcactaacaggttattttaataagttaaattgagaatgctttggtctaccagttggatagaggttatttttttctgaattttatttgggacctatggcaagtacctacaaaagatatcattgtctacatagttccaaatatgcaacttggcttctaaattgtttggggtcagtatctgaatgttagcaaagacgttctttaaaaaaacaaaccaacaacattttctttttttttttccctataaaagttgggtagatgtcatatgctctcttttctgtggaaaaagatgaagccttttgtctaggttgtgagatttgctctgctctctgattttaaacggtaattaaaatataatttgtaactaattccagtagagtttattttttttttttatctaaagggttccactttgtttttccaagaatcattacgagtaagagtcattgcctctcagggcttggcaagccctaaagttacgtctctttctcttttcccctccctctctgttccctttctttttatctcctgctctgacttgttcctttaattggctctaatataaaactgaagtatatctggtgaatactgttttgtgttctctgtttctaatttaaagaatggatgagtggtagacttttctctctctaaataaaaaataacaaacagtaccctaaatcaactttttgtatggttcttggtttttattagggtgggtcagtgaccctcaattaccaaagaagaggaaaaaagtttcccataccgagtaagcaagaataagtacagtataaggaactgggttaagaaacagaaaggatctgctaatagtatttttatacacagtgaatgattttatgtgaaacatcagctcctctaggaattgttttcaggttagttggatgaaagctaataatttctattgcccctgactccacaagaacatgattcatgaaccattcaaattcaatattttctgaggtggccctactcttctttggatctagctgcagtctttcatcttgttttacacagatgcttctactgatttgaattttagagtcttagtctaatgcctttctttgttgatggagacaaataaggccagacaatcttaagggacatgctgaaggtcacaaataaggcatgggcaagtctgtcctatatgtaagcttcaaagccagttcatgtcttcattccttaaaaatttattgagtgcctactatgtgcaagatcctatgctaagccccgagatgtgtaaagaaacaaagcagaggagactcctgctctcacaaagctagctttataaaattattttcgttaattctagtggcatatctggtagatcattctatggaataaatgttagaagtatctaaattcaaagactaaaaattccttaatattgattcaaaaattgagtaagctacacggtatcttctggtcataaaaaaatcttattacttttgactgatttacttaaccatagttttttctaacataattattaattttgtttataaaaatgttcattcaatgtttacttatttttctacatgaatattttctttataaacatggtccatttaaaaccagaacttgtattatttaattttgtttttaaagatcttaatggtataacatacctaccagggctaaatatttatattcaaacctcgtaatggactaataagaagtgagaacaatgccaatcatagataacattttttgaatcagacgctctgcttaacactgcatctcactgataacactgccattatctcagcctttatagcaaatctatgatgtagatactaatatgatctgcatttttaatatgtataactgaggattagaaaaatgaaagaacatgttccacgctacacagcaagtaagtgacaaagtggaatttgagaccaatactgcctgtctgaagaacactctcaggctgggcacagtggctcatgcttgtaatcccgacagtttgggaggctgaggcaggaggatcacttgaggtcaggagtttgagaccagcctgggcaatataatcaaaccctatctctaaagaaaaaaatatttaaaaaattatctgggtgtggtggtgtgtgcctgtagtccttgctacttgggaggctgggtgggggaggattgcttgagcccaggcgtttgaagctgtagtgagctatgatcttgccactgcactccagcctgggtgacacagtgagagcctatctctaaaacaagaaagaaagaaagaaagaacacactctcctgtaatgacatctagacatacagaaagtatttaaaatgctatacatgagttttacttgaagacggtttctcatgttttacctaaggcctgagaatgataataataaaggaaaatttgcagttttgcttctctcttttcaaattcttcatttttaaagatttgtagagtcaattaaaataatgaagtgagctagaacacagatcaggagaaatcttgaaaatgttaattaattagaaaataagtaaaattaggtgtgagactagatgatctcttcactgcttatggcttataatttctatctgttgaagttttacccatcattgaagtgtttgcttcaattagagtatcacctcaggaatcttcagattctatgagttagaatggttctttcctttctcagtgttccccaggtctttgtagctccagaatagcactcatttttttgttttgttttgtttattttactttgtattactattatatgagtatttcagatgactacataaatgtattctgagtgcctatatgattgatatagtctaatgaaaaaatcagtaactcttactactcattgacgggctcctaaatgccaggtactatatgagtctactttgcgtagtattttcaataacatcatgacccactgtaaacacacacacacacatccctggggcttatttaaagcaaa

SEQ ID NO: 54 - DNA, 11592 bp, Homo sapiens
cgtccctctgagaaagactctccctggattctgtttcagagagttgagcttttccccagagcagatgctttgaaactgtctcaggtggacagagggggctgcagggagggcacagaggacttcctgggagtgaggtttcctgggattgagtcccagccctgctgtagggctggagtgaaaggggcctccccagagagcctctcccagggctctgtccccaagtggccaagctaattcggttccgtgctccccttttgcccacccccaccagaggccacaggctggactgggcgccactgctcatgcttctgtcctgggatagcacagaccagtacaccagggtctggcacatgtccgttgtagtcactgcagccctcccagtctccccgttttgtagaggaagccacagctcggggcaaagccgcacctcgcagtggacaggtgagtctctgcctccccaccagctgcctcttccacagatggacccccaatcacactgtcatatcgcctgtctgagcctcactgtgctagtctgtaggagggggcacctcctcttgggccatccatataaggctggagacaaacagctccacccagttatgggagtcccatgccatccaggacacatccaagtggatctctcatagcctatcatggttcctccaagactcagttttctcatctgtccagtggaatgacaatggtacaggctgtgagaatcccttatctgaaatgactgggatcagaagtgtttcggatcttggctttaagttgtagaatatttgtatgcacataatgagatatcgtgaggatgggacccaagtctaaacacgaaatttataatacataagtttctggaggctccagggagaatgtgttccttgcctttcccagcttccagaggccgcctgcgttccttggctcgaggtccctcctccaccttcagagccagcggggcagcctctcctctcctctccgacctcctgcctccctcttacaaggacccttgtggttcggggtcatctgattatccacccagataatccagggtcatctctctctttcctgatccttaactcagtcatatctgcaaagtcccttttgccacataaggggacacattcacagacgggttctggggatcaaaacagggacatctttgagggctgtgtttctgctgaccacgctctcctctgggcctgccctttgcatctgcagatagcagtggactctctttagggggagcaaagcctcccgctctgagcatgggctggactttgggggtccaggactggggaggggtcgacattgtaggtcaccaccatgtgtgactgtccagggaggctgggggatgaaacagccgagggtctgactgggggagagccgagaacacaccccactttatccggaaggccagccatgtctgctcagagacgaagagtcacgggacagccctgtccaagagcaaagacccgtccaagagcagggtcagcacctcggagagttccccgcaggccgccacggggcggggagagaattcatggggcttcgacttagaaggggaacatacaatgctgtggttttcactgcctctgggtgcaactcagcatttccccaattacgaagccagggccttggcccccagcaggaagcctggggtatttcattgcctcacactcacgtcccatctgctgaggggcacgtacgccaccactactcctgagtggcagttgattttacgctcacagattcgtcctgttatttagtatgttaattcaggcggctatgcatggttgtctcacaaatttgatttttaaggaatttaacatttcaaaatacttggtttcccttgtaacccctcaccttttattttctgtacctacggtcatccctcaagagggatccgtaggcctcccctgcctgccctgggcacagggacatcccgaagcgccggtcccagagcctgggctctgctgctgtttctctgtgacttgaggcaagatatcctacgctgccgagatagcagcccctctgcctggggaggtgagtgtgaggaacccggtgtactctgtcgatgtttaagggtcagtgggcgccgaatgaatggtttctgtcagcagcacattctgcatctcccaaaaccaaaaccaaaaggacagccggattttcccctctgcctgacttcactaggctcgcgtctgattttttttttttagcaccgtcagcataagggcctgggtttattttgtggttgtttatagtggaattgggtgtagtgtcctgatttgttttccaggatgttcgttttggggtcaagggtctttggggtggatgaggcgggagaaccaggcttgagtgaggctctgccctcctttcctggccccctggtggcccctccagagtctgtcccggccatggaccccagtccccgctgagccatgcggagagtttgggagaagtgcatacctgccttgggggcttgactggcaggctgctttcctctggctcatcttgaagttaaaatgtagctcagaccctcctcagcccccacgcagggttgcaacctcttccgtctgtctccctgtgaaatccaccttccagggggcagcctgggacctgggatggccctccctacctgaaacctttcaggccttccactgcctgcagggaaaagcaccggctcctttcacggacttccagcaccccttcggggctgctgctgcctggttggtaagccctgagctcactaatctcagccgtcacatgctgttgggcaccagcctgtctctttggaccataaaaacgccatgttgggttggcaggataagtcggcaagttttgatccagggctacagatttcctggttgtattgtttcaaggttaatttctttctttttttttttgagatggagtcgcgccctgtcacccaggctggagtgcagtggcacaatctcggctcactgcaacttccgcctcccaggttcaagcaattctcctgcctcagcctcccaagtagttgggactacaggcctgtgccacgtgtccagctaatttttgtatctttagtagagacaaggcttcaccacgttggtcaggctggtctcaaactcctgacctcaagtgctccacctgccttggcctcccaaactactgggattataggcatgtgccactgtgcctggccaaggttaatttcttgatagagttggacagtcggttttgctacaaagcttgttttgaaaatgagagttggttccagcatgattgatatatcagggaacagtttcaagataacacaagtttcccgttttcctttgtgagatttcacccaccagaagcactgggtgaacacagccactgcccccagctggcctgatgcacctgtgttcacataggaacacataggatgcatacgcacctcacacagccccagccgccccagggaccccatcctcgtcagggcacaacttccccgtctccactgccccgtctctgccactctgcaccagctctccagcccacctccctcggtaaacttacagcgttttcaagcccaagtgccgtgttaatgtgtctctgaaccccttgacatgtgaagctgtgctgccgtttttattagggtttctgtctgttttgagtgccctttccctaaccccattccccaacaagccctgtggttttgactgtgcggttttgcatgcagtgatttctaggaatgcagacgtcgagttgtggtggaatcgactcttctgtgctcatgtgagggaatggccttgttttgaggaaatatgcgctgaagtactcaggggttaaaaatcatatggccagctgggcgcggtggctcacgcctgtaatcccagcactttgggaggccgaggcgggtggatcacgaggtcagcagattgatagcatcctggctaacacggtgaaacctcgtctctactaaaaatataaaaaattagctgggcgtggtggaaggcgcctgtagtcccagctacatgggaggctgaggcaggagaatggcgtgaacccgggaggcggagcttgcagtgagccgagattgcgccactgcacctccagcctgggcgacagaatgagactctgtctgaaaaaaaaaaaaaatcatatggcccgtcaggcgcggtggctcacgcagtttgggaggctgaggtgggtggatcacttgaggtcaggagttcgagaccagcctggccaacatggtgaaaccctgtctctactaaagatacaaaaattagccgggcgtggtggcatgcgcctgtaatcccagctactgaggagactgaggcaggagaattgcttgaacctgggaggcggaggttgcagtgagccgagatcgcgccattgcactccagcctgggcaacaagagtgaaactccgtcgcaaaaaatagtaataattcgtccgtctcctcggcgagtggaggctggggccagggtggaacaggagctccacggtgagccaccccggagtgaaggccactggccctccttatccttgctgcggtgtgggggtgtgggtgtatgacccacagctcacatgtggaaacatggaggccccggggcctgtgtgacttgcccagggtcccagctagcaggtggcagagcaagacctgtatgcagaggcccaaggaagcgtcatgaggacccaggtcaccagtgcatctccagggtgaacctggcccctgcccagcgcatttgcctgtcccctgaaaccgccaccacacaaaaccatgtgcatcttcagagcaggaggcgtctccaccatctgtttgctcccgtttgacaaatggtcggtgctccttgaacggataaacaggaaccatccggccctcttccttgccggagctcatccctttgactccagggagggaggtcatgagcaccacagtctttatgggggagatcactggcctgcccctgggcggagaagccaaactagaaccttctccccagggtgagctcacaggcttttcccatccgggacccctgagccgattggctgcccgggacctgctgttatatcgggggctcccattgcaaagcccctgcgtgggctggcttccccgggtttggtttctccccattgtgcagggtcttggggtagggtctgagccaggtcaccctggagaaccgacagcaccggcccagccccgctgtgacctgctgaccccggaccccgcactttgcttagtgctttaggtctgtaggagtaatctttggagaatcgtgattctgggacccgagctctgagggaacaacctcctctgagcctcccaaggccccccaacattgtggggtgagccccacctcacagatgctgagacaggcctagaggcgtggcgctcccagccccatgccccacatagctctaaggcctggcctcacttgcaggtgagggtcctaggaagctgggggtgggagcaggcctaggagaggcactcaacaaccacggctcagcatggtctagaactgccccctcttcctcccggctgccccgagtctggcttccgtcagacccagcctccttccccagcccatccctctccctctttgatgaggccgatggggcaaagacctttgcttcccagaatgttctgtccctggttggaacactggtccctgggacacagccctgtcctcagctttgaagtcagttcccatcgctgccccccaggtagctggctggcttctgccaacctcagcctggtcgcagctggcacctcctcaccaggtactaaaccagggtgtgcagaggcccgctcgatccatggggcagatcagcaaatggtagtgcaggatgccccatcatatgtgaatatcaggtaaataacaggtacttctttttttctcttttttttttttttgagacagagtttcgctcattgcccaggctggagtgcagcggcatggtcttggttcactgtagcctctgcctccctgatttaagcagttctcctgcctcaggctcccaagtatctgggattacaggcacctgccaccatgcccagctaatttttatatttttagtagagacagggtttcatcatgttggtcaggctggtctagaactcctgacctcaggtgatccgctcccctcgacctctcaaagtgcttatattacaggcatgagccaccgcgcctggcctatttttttttttttcccttggcaacagggtcttgctcttttgcccaggctggagtacagtggcgcagtcatggctcacttcagcctcaaattcctgggctcaagtgagcctctcaccttagcctcctaagcagctgcaactacaggtgtgcaccaccatgccttactaattttctttaaaatttttttgtagagataggggtctccctatgttggtcaggctggtctcaaactcctgggctcaagccagagaggggctggcctggtgctctgggttctccagaccccctcctgccttggtctcccacagtgctgggattacaggatgagccacggtgcatggccacctgatggataatgtctaatataagagaacccctaatttagctgtccctgtacccttgtgaggtgagcagtattgttgcctacattctatagatggggaaacagaggccacagaggcctagcagcctgcctcgtcaccgagtgggagcttggcagggctgggatctgaacccaggccgtcggctcctgggcctgtgtgccccctccatgaccatatcagcttcctacagcttccatgacaaagcaccacaaaaccggaggcttaaacacagaaacgcagtcccccagctccgggcagaagctcgagacgagggtgtggcagggccgtgccccctctgcagcctctggggagggtcccttccggcttctgggggctgccggcctccctggagtggccacgtcacttgttgctgctgtctccctcgtcacgtggcctctccttctctgtctcttagctccctctgccccgtcctgagcacagctgtgattgcattagggcccacctgtataaccgaggatgccctcttctcaagagccgtaccttgatctcatctgcagagatgcttttcccgacgtgaatggaatattctgaggattaggacgtggacctaccttgttaggggccaccattcagctgactgtctttgccaagcacaggcagtggagactgtgtcatgctctgatccgaacaatcgtccttctgtctgccgcccgacttccccagccctgttcagaaagacagaaggaactcctgccccaccctaagctgaagtcgggagcgtgaggaccctttatctggtctttgggggccaggtgggttcacgggcacaggacagcatgacaggcagggcctggcattgggacacctgggtcttagtcctcacctgtgacagcggggggtcttgggcaacgtcccacccctctctgggccttgaagatgaaggggttagatcctggcctcccggagcttcccctggtgtaggatcaacacactttttctgtcaaggactagagagtattttaggctttgctggccctgtagtctaagtcacatactcttctctgtctgtttttgtttgttttgttttgttttgttttgtttttgtttttcctacaacccctttaaaatgcaaaacccgttcctagctccaggccatggctgccattgggctgtgttgagcctgtggcgcgtgcacaggcccctgcccttggtggacactctgattccacctgcaaatcctgagcgcacaccggctctgaacaggctctgtggcttcagaaacttatcttctggcttcgtcgatctggctggtttgccctggggatcccgcatcctctgactaccgtgatgagcagagcgcagcgcccggctccgtgggccaacttttggtgtcttgccctgcctgagcctgttcctccttcctctccctgcccctccagccgctccgggtcctctgggaagctctggcctcttcaccagccctgcgcggctgctggatctggaggccggagccggcacatgcgtctgacagcagcgctgctgtctcttgtttttcgtggtccatgtttgggggttacatctgggcctgtcccttctctgtgtagcctgaaggcagttcccaggcttgtgtccctcacctctccgcagacgccctttccagatcctgttcaaatcctggccctactcacgggaacttgggtgagtcagttcccttcactgagccttcatgcctccctgttaaggagaagcttcactcggcatggcgtggcccgtcacactcatcctgcatctgttacaccaaatgcagtttcctcttctataaatgggagaaaatcacctgtccttgccaagggtccggtgggaattaaatgagctgagccagggcacgggtggagcttgctgagtgttaggtcgtgtgcctgctcttcttggcggagtctggccagatacctcatctggttccattgctgtcagtctctaaatggggcctttcctgcccagctcccagccctggtgctcacaccatcacaggccaaagaactggattccagacactgcctcctccactgtccccacagtgaaaatggggagggatgtccctgtggagccctaactgggacccagacagccctacccccagctcccaccccctccggctgtcccggaggccgtgctccgtggatctcctctccctcgcctccacgtgggctccaggtagctgcacacgcattacaaacatctcgttaatcttctcggaggtcctgcgaggcgaggcctgtggtagccctgcccttggagcactgagaattagtaaggaaatcgccgctgcatctcccggtggcacaggggcgtggaggcgtggcgggccttccctcttgcaccactttggatcctgggtcctcacagcagtgttctctgcaggggaggtgcaggcattggtctgctctagggccaggtggtctaaaaagtccctggtcagccccgagtcctgcaggaatctgcatgttagtgggatttggggttcaggatgcttgcctgctgggtaggatggggttgctgagtgaggctgaaatcccagatgggatgtctgggctcctccatgcctgacttgggaggggtgagaaaaggaaggagacttggccatctttaggctaaaagcctagtgctgtctcacaggagggaagagcaggtctctgcaacacacgcctggggttccgtcccctctggccacttgtctgtcaccttggacacgttgcctggcagcctctgagcctcagtgtgcttctgtgaattggggtgaccctagcacggtgctcacgacagaaagcatgggagtgcagacgtgggtcagtggcccgcggtgagagctccctgtctgccccatggtgagtttccacagcagtgagagaggcctggcgtgtggggtggaggccgggacagtgtgagggccgcctggtcagagcgggaggcaggaccccgtagggagatgaaagccaagctggacccaggcagaaaaagaggaacgaaggacaggaagtccaagagcagtcactgctgacgtgagtgcggcctgcaggcagccagtgtggatggactctcaggccctccgttgtgtgttaggggaccggaggagcagagaggttgcagcagccggccggcctctctcggtgagggccggactgcacatggggctcagaggccgtgggtgtgcctgcccgcctgtgtcagctccagccgtgggggcgggggtaatccgaggctgcgtcccgaggctgtgggagctctgccttcatccttccattcacaggtagggacacaggcgtggggattccacggtgcccttgaggcagctgtttcctagacccccaaggccctgacggagactcccccacccctcaggagcagagggtgaggcggggtctgcaccggccgatgtgggcaactgttgcaccctcggagcccagcagcgagggtgggggtctgtggggagtcagccgcagccaccagcattgctggaatgtgtcagaatggtggtgcctcctgcaaacaaccttagcctctgttcatcctgtcaccagggtcctgggagaagcaaacccacgtgtggcctctgcagggtgggtggggaggttctcccggccaggcctgactgacgcccctgctgctccctgtggtccagcctggacttgccaccgattattctatcaatggcactgcactgggcaccaggatccaagcagtggactgcgggacaggacctgtccctgtgagcggcctgtccctctccccaggcccagcctcctgttggttatccttccaagcccatgcctgggctgtgcgatccacctttcctccaggcactcttcaggcaaatctctggagcacccactgggtgccacacactgcggatgggacgcagggtaccgcacagccccggtcctcagggacccggcggggacagcactggtgaaaaaccacggaagtacattgatgtgtcacttcaacaggggcctacgcaggggcctgccctgtgccaggccctgtcgttggtttgtggggtgaagaccctgttcctatggtgtggacgtggtagagatccaggggctctggcagcttgtatgggggaatggggacgggaggggggtcaggaatgggcttctcgagagaagtgacatttggtcagaggcccaagagcgggaattgatcctggccctccctgaatcagtgtggtgtgacccctcccgccaaggtgagggtagcaaggtgcctggggctggaatcctggggctgtggcccgtacagtcgcccgggacccatgcccagcagggccctgcacccggagtttaacactgaggtccccaccttgaaattcctaatcattgagtctttgtaacttgtgttagggagtccagcgagacaatggggtatgtgcggggtctttggagcttcagcccatgcacagacacgtctctctgttcctcgactcctagcatgctctcacctgcctgccccagagaccaagccccacctggccccttcgtcaccccgaggtggcgactgggttgtgctgaaggagggaggcccacacgccaccactgccctctgacccgtcaggggccccgagggcctggttggtcagggctgggcactccacccaccccggatgacagcaccaggctcatgtgccaggtgactcagccagggccactcaccagcgccacctggtatgtcctgggtggcggccgctgtgcctgctcctatccaccatggttgggcactggctgggaagagaggtgaccaccaggccctaatagcaggagtcacccacacaacccttgtacccagccctggggtccaggccgcctgcaccggctcagttctgcgcctgagctcccagctctggggtccaggccacctgcaccggctcagccctgcacccgggctcccagtgctggggtcccccaccccttggtgttgccgcatcctccctgggcccaagattcctggagctggagaacccccttcctccctgaggcatggagactgggctggtcctgagcccactccaggcacaggggaca

SEQ ID NO: 55 - DNA, 86101 bp, Homo sapiens
cagccgttcttttatcttaggagtcggaaatcttacatctgtatttttatttcgctgtgcttccgccccctgctctgctaccctcacctcactacgttgttttattggcatagtataaaattcacattttacaatatgcaattcagtggcactagcacattcacggggttctgatcatcagctctatcaggttgcaggccactttcatcaccccaaaaccccagccctgtgagcagccattcctgctcctccccggccatcatccgtctgtctctggatttacctgttcatgttatgggggagagagagagagagagagagtgtgtgtgtttgtgtgtgtgtgtgtgtgtgttttaaatgaaggcttgtggtacggggtctgttctcattttgcgccggtgttgggcctgaagtgtgtcctgtgtgcatgtctctgacccccggagtcatgggacccagtcacgtgctgcgctgacgtggagtccgaagttgtaaagacaaagctgggtgagaccctagtgactcacaggcccttctgctctcctttccagatctgggactttctcggggacaaccctgggataacagccaccactggagtctatgcttgaaggccattccgcctcgtggtgccctgggcgaatgtcgagggaaagcagactccctgtgcccccggggttggcttcttgctcaaggattccagatgctggcctcctgggtggtgttcccatgccgagctccagttgggggtgtgaccagcaccccgtgcgggggctgctggtgttctgtgttgtcagagcagtgctgttttgtgtttttctttaaaaaaaaaatttttttttgagatggggtttcactcttgttgcccagactggagtgcagtggcacaatcttggctcactgcagcagcctctgcctcctgggttcaagcaattctcctgcctctgcctccccagtagctgggactacaggtgcccgccaccatgccctgctaatttttatagttttagtgaagatgaggtttcaccatattggccaggctggtctcgaactcctgacctcaggtgatctacctgcctggcctcccaaagtgctgagattataggcatgagccaccacacccggcctccttttaaaattttaatttttaatgagatggggtctcactatgttgcccaggctggctttgaactcctggcctcaaatgattctcctgtctcagctgtgttttgtgtttgctccagccctttgctggtgaacagacacgttcactggacacctaagtgcctggaccgtggagcacagggtgggggtgctgttcatggccggaacgccagaggctactggggagacacaggagcgaccaccatgatccacagaccaggactgtacagagcacttgaaggggcggcctcaagaattgtgccggaacagtgaacatgagggctcctggctcccctctgaggacaagggttaggtaggaggggacaggggcagggctgaggtgggtcggcttggttcatggcagggcttggggagtgaggagagtgaggagtaccgggacccggggtccctgctctgctcacctgctgagaatgagccagtgttggcctctggtctccatgtctgtagagaggcttctctgcttcccctcctgtagaatgggaacgacaacatccagccatagagtgctgagaattcagggacaggacacagcgaaggtgccccagtcccccttcctgaccccagcctggcgtcaccctctatccaagggaagaagcagggatctgcctacgaatctctcaggatgtgaagtgtggcccccagcctggtgcctttgcagtgggcccaggacggagggtagccttggcacctggggaggacaggtgaacctggatccagactctgcctcaggtgacagccctgggttctaacgctgccgcttccgcttcctggctgtgtgttcctagggcggccacagcccctctccagcctcagttgcctcacctgggaagagaggtgcagggcttttgcgatgatcataatagttaccatcaatcgagcattagcgactttccagcaccttaaggcagttaccctgtgatctgcacagccgccctcccctcgttgcagatgaggagactgagtcagagagaggttaacccagacattcccaaggttgtagattgagaaagtgttgagttgggattcgaactcaagtctgtctgaggcctcctagccccttcctgaccccagagccttccgcacctcatggctccaccagaccctgcatgaagctcctggtgggcaaactgggcaccttcactttaaacgttgagggaaaaatacacataacctacagtgtcccgtctcagtcatcttcacgtgtgccgttctgtggcattaagcacattcacgctgttcaaccgtcaccagaacttttccatctccagaactttctcatcttcccaaaccgaaactctgtcccactaaatgctcactgcctgtcctccctcctgtcctccctcctggcctccctcctggcctcccgcctgtcctcccgcctgtcctccctcctgtcctccctcctggcccctcgcaccctccgttctactttctgtgtctatgagtctgatgactccagggaccccaggagagtagaatcccacaggatttgtcccttccagcctggcttattccactgcatgacggcctcaaggctcatccaggaagcagcaggtgcccggctttccttcctttttaaggctgaggaatattccactgcatggggggaccacgtcattttatccccgatgccttcacttttcagctcttgttcccatctgtatctgtaagctggagcatcccttgatggaggagggatctcagggagtgggtgagcctctcctctttccagggtcatcctccactttgcgggggcagcccaccttcctggagttccagctgagggggggcccaatttaacaagcactttgggaggttgaggtgggcggatcatgaggtccagagattgagaccatcctggccaacatggtgaaaccctgtctctactaaaaacagaaaaaaattagctgggtgtggtggtgcatgcctgtagtcccagctactcaggaggctgaggcaggagaatcgattgaacctgggaggcaaaggttacagtgagctgagatcgcgctactgcactctagcctggcgacagagcaagactccatctcaaaaaaaaaagggttgtccggttacctgtgcatgccaggtaatcgacaaatgctttttatttttatttatgtatttgtttagagacagagtcttgctctgtcgcccaggctggagtgcagtggcatgatctgtgctcactgtaacctccacctcccaggttcaagtgatcctcctgcctcagcctcttgagtacctgggattacaggcacccatcaccatgcctagctagtttttttgtatttttagtagagacaggatttcactatgttggccagcgtggtctctaactcctgacttcaggtgatctgctcgcctcggcctcccaaagtgctgggattacaagcatgagccaccccacccagccaacaaacgctttttaaatataagtatgtcccatgcagcgtgtcccctaaagaacgatgtgttgttcatctgaaactcagatgttaccaggcgtcctgtgtttgatgtgacaaccctgtccacagccctggcacggaaggggcagtcgctgagggtgcagtcttggggtgagggtccctgtgatggcagcctgtgtccagcttggactggccatgggaaggccactgtgtgggcgggtctggccttggtaaagggccaccccctgagacccaccgagcctagttccagtttcctcctcacaaccccagcctggaagggcgttcgggtgtggagcaagccacagggtttccccccagtgtggttcgcattggggtgccgggtggttccgagtcagctgccccctctgcctcctccccgtgcccatcacaactgcccccagtgctgggacctctgggcaagaggctgaggctgacactctggaaaggtgtgcagtggtgttgtggggtccctggggtccggtccacatacatccctgcttgcccggctcttggcatcctgtaggagaaggtgccacagcctagtgggtgggagggcaggagccccatcactggagtcggaggttgcttttgatgttgatggcagtgaggttgcttctgatgttgatggcagtgaggttgtttccgacgttgatggcagtggacttgcctccaggttagctgcctccccaagcagctttgggggtacagaatgaccgaccagtgtgggatcccaaacatcctatccccttgcctgaaagtgggacgaggctgaagctgacctctcgctgagaccacctcattcggccccgtcctctgctgccacgtccttcttcctggtaccccccttctccagccccaaataagtcacgttcacaggatccccagctcaggctctgctcctggagaagctgccctcagaggctgcgttgccgattcctttttcaacggagaggctgcagcgtgtggcaggtgccaccatctcttggagtgaggcagcctcaggggctctgtccggggctgcagcctgattggtgatctttgcacgccccttctctgccctggctgggccatatgccacatggggcgtgaggggcctgcaacacaagtccctctgggggctcgtgatgtggttgagctggaagatacattctggaacatctaagaccccagccactgtcctgagtctggatgccgcgggtgccgggcatgggggctctgggcccgggccctggggtgcttggaggtgctgtggaggaggggtggggctggcttggagcccatgggattcgattggagggtgggagtgtgagagaggagagagcgtgaacagagccttggacagaaaagcctggaaggatcaggaccctttggggggtggcgggtgaaggtggcggggtgtggggataccctggggacggacaggtcacttgaggctacaggactttgaattccacacttagtttggatcccaccctctggtgtggggcgtgtgagtggagggggcctggctagggaaagggggggggcagtggggagtggagggctgcttcgctccgagagatggcggcacctgccacccgctgcagcctctccgtttaaaaagtgactggcagaacaggagcagctgctgccagctcctgtccattttgtcctctgaaaagagaggtcggggtggccaggtcctcatttttcaggagacagaagagagctgaatttttatgtcaaatctcttggttttgagttgttagcaggtaattccaatgttttatgaaaacagcggtgggacgaataaaacctacgtatcagtaagtctcggcctccaggcctctggtctgcagcctgtgccaccgtgagttggaagagtggtggacggactctgttctccccgcaaaagccctttccagggtggcacatccacgccgttagtgcccggctgcagggagaagctcaaatgacaaatgaggcttgaggtttgccgcgttgggcgtcgtgctgaggcccagccgtcctcacggtgacctttggcatgaggagtcctggttccactctacagacgaggacactgagggccagcggggcccagaaacttccctgagtcacagctcacagagcaagacatgggcccaggtctgctgaccgggtttcctttttattttattgtggtaagagaaatacagaatgtaccacgttagctacttttaagtatacaattcagtggtattaattaccttcacggtgttaggtagctgtcatcactgtttacctccaaggctttcccatcatcctactgcaaaactctgtccctattcaacactgaccccacaaccctccccagcccctgcacccaccgcgctttctgcatctctgagcgtgactactctaaggaccccgtgtacatggaatcatccgatatgtggccttttgtgcccagctcagttcactctgtgtaatgtcttcagcgttcatccacattgcagcctgtgtgagaatgttctaccttttcaaggctgaatgatgttccatcgtatggacggaccgcatggcgtctgtccatttaccaggtgatggacttgtgggttgcctttccctttccagccatggaaacagtgctgctgagaacccaggtgcacaggcagctgctgcagtccccaccctcccttcttctggggatatcaggtctgctgattttatgtctgaaggtcatgggccactgtcccttccctatgcccttgaatctcttccatggtgtgtccactgtgtggtcttcctggatacctccagcaatggggagctcactgtctcccagagcagcccattcagggcttagtgtgtagcccacacctgtgtccctgtagctgccactcattagcctcctaacccaggacgcgtttccttgtgcccttggcaggggctccgtattcactctgggttctgtggtcctcactctgcaccacagactctgatgcctcccttctccctccccgatttccaagagagaacaagatctagccatgagaagcaggatggaggtgtcttcaaaaacagccactggtgatagaagttgtaggaaggtaccatggtctgtctgcctccacgcaaacctcaccaggtttcatcaagatagcacaccaggagtggtgtggctcatgactgtaatcacagcacttctggaggctgaggcaggatcacttgagcccatgagttagaaaccagcctggccaacataatgagactgccatctctacaaataatttacaaagtagtggagcatggtggtgcacgcctgtagtcccagctgcgcaggaggctgaggcaggaggatcgcctgagcccaggggttcctggctgtcgtgagctgtgatggtctcactgcactccagcctgggcaacacagcgagaacctgtctcaaaaaacacaaaacaacaggaagctcagacaggactgtggctgcttcaaccctgtccgtggccaggctgtgccccctcctctgtcgctgggcactcacccctctctcattttctccccagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggtaggagggcgagggggcggggggcccttcttggtgcccagaaggtgtttgtgagcccagtctgttcagtcctgctgtcgctcaaggccttgggctaggcccagtttgaggcctacactggtgtttctcaaactatgcccccatggaaccctagggttccctggaggttctcagaggtgactgtggtcaggattggtgcagaggaatggttgatttgtgggggtgtagaggcctacagcctccttaaactgagcagtgtctctttgttctatatgctgatgtttagtgtaaaatattggtgaataaagaaggtggtctgttccgttagtacaatgcattggagtgctgctgtgctagctagtaggggtgacaccaccaggtgggggtggcaggtccagcactgcagggctgtgggaggtggctaggagctgcctcagctacccagacctgcgatctagattcttccgggaccctgggagatggcagcagttgggaggccaattccgagtgcctggcaaggggctcatgcaggcctggtgctttgggggcagccgctgttctgaatcggctgcatgacttacggaatttggggtccagtggggcctctaggccctaaggaatgggtccagaggtgactgtgggtgggatcgacgtggcttttgggtacctttaggggtgggtgcaggatggggcctttagggctggaggaaggtgcccagggtctggctcctgtggaggtgagtgtgtgagccaggggctggtccccgccaagctgtggctggcaggagccacctgctgcaggttggaggaagttcccctgtggaaagccacgggccccacaggtaggcatttgggttctaaagtaactgaggttactaaagggctttgtcaagacttgggaaggcatttcagaaaacccagagcctttgctttccaccggcatttgctttcctgggccagacgagggcccttggggtagcccggagagtcttggggcagggatctgggagctgcgggggagtccatgggctgcccaggcaggaggcttcccagggcacgttcccctgcgtctttctggatggctttgtgttctcagccaggggcagacctggagttcctccaggaaagctcccagcctgggtgcggctcagcccttcccgacctgtcgctaattaaagttcagcccatttggttctgattttcagtgacctttgatctatagtgaaaaacaaaaatggtggctgcggtttgttggcagaatatgttgctcgcgacttctattgttttagagggaatcaagatcgattccaagaagctgaaagaaacatggaattactacctgacaccgaggtccaaactcgctgtttgcccctccctgctccctcagaaatgttcaggcagggaaataaacagcagcccacgtgtgactactcatctggggttttaagaacaaattagaatcagtagttattttttccatcataaatgtaatacttgttccacaggaaaataaataacactgagaagggagaaagcagcattagctctggtctgatggatcggccgagcgctctccttggcattttggtgaatttctttcctctgtgttttgtttttcgaccctttctattttgtatagttgcttttttgaccctagtggacaagaagcagttttgggggctgggggacagcggcgtcacggaattgaggaagctcgtggcagcttccgtgtgacctgcagattggttcatgagttcattggttcatgagttctcagcagctcgaggacttagtggacagtgccctgcaggactgagcttatttcacagccttggcactgggtggatgtctgtaggactggggggacctgcgacctgagatagttttcagacgaattcccctagacattaagagaagcgggttcccattaaggagcccaggtggcatggacagggctgggggcagcacaggtgaggagctgctccaaggcaggttgtcagcctctctggacctcaacttctaatctctgaaggcctgtgaagcttaggtggtaacagctcccttcctggggcatccaacctcttcctggggttttggggggcccaggggctctgtggagcattgctgggggagatgcctacgtataagtgggcatcatgctggggtgaaagcccaggggctgggccgggagggcgagacctgagacccatgcaaaggagccggggccagggtggggtgggcacggctcctactgagtccccagcccttgggacgctggccagccagccttggcatggccagcatccctgtgtctcctggggaggcattttacttaatggacagaaggacagacagacgggtggagggagtgagagggaaaggatgggtttgcaggctggtgcagctgtgaaactgacggagcccaccccctgccaaccccccgacagcctttgaggcccagcagcccatgctccctggcaggttgcggcttgccttctgcactggcggagtccgagctgactccgtcccttcgcccgagcgggcgtcgcggggagggaggtggttcctgcttccgcatgcgcacaactggggtcttggatcgtagctcctttgtgagaaagggactggctcacccgccatgtcctgctgtccacacacacggctctgcacaccactcacggcctcctcaccgctgtgcacagccagcacgtccatgcgcacctgtggagccagggtgtacggctgcacaggtgcgcctaggtggaggtctccaggtcactggaacttaaagtgtccaagagaggaggtgtcaggcctcaaaggggcactaggaactggcgtctcacccttgcctctgagacccgcagacccacatccagcctgggctgtcgtggctgagtgccccaggccggtcgcctcccctctctgggctgggttccctgctgaaggggggcggggctccctgctccctgtagtggcctcggcgtggggccgggcctgtggttgcaccatctccattggtgtcatcctcccccagccctgctgtgacaggcatgggaggcaggtgtgtttgtgagctcactggtgcgacccttggaggtgggaggctacacagtatttttggtcatcagaggatggaggatgagcctgcattctgggctgcagggcctggagctgtgctttctcaatggacttagaatttggggaaaaaaaaaaggaaaaaaaggagggaagagagtctgccgccctggagagtgaagctgatgaatggctggctcaggcgcccacagccccagggccaaccctccactggagcatgagagcggccgcaccacgtgggctgaggagtgactggccccgggcgggctcctgccactatcacagtcgagagatgcgagggagttgtagggcagctggcactgtcctcacccgccccggccggcagggcttgtcaggccgcgtgaagtgagaaacggtttgcggtgtcctccgcggagtgccgggcccttccccggagagcagctctgcagggaagggaagtgggttttcctggaaaacggggcgggaggtgtggagctcggagagactgaggtcctgcactgctaaggggactggccccggccctgggctgggagagggggagctgggactcagcccagggtggagtcaccatgggttctaaggcacaggatggataccctcctcggccatgtgacatcattgtttgggatgcgcccagtgttcggagccttcgaggctctccaggtgcctggagggcttgtagaaatggtggtcaggccccacgccccagactttgtctcatcatgtctaggtgggggccccagcacctgcatgctgacctggtccccaggacgcagatgctgctggcctgagcgtccccggctgtctcctgtctggtgtgggtgctgccgccgggaggccttggccccacggggagatgaggcatcacacacgcagccacaacacgggtcggaggcagagtccagcccagcaagggtgtggcagtggagacgagggaggggtgaagctggtggttccaggaggttccgtctgggtgagaccctctgctgcagagaggggcgggagccagtggccccgcggagctgaggtcatgtgagaaggggctgcagtctcttctgtgtcattctcctgtggggtcagcctcaccccagtgggaactcccactagtgaaagtctgagatggccccatcctgccgtgtcgcctagcagtgcaccacagggcattcggcccctcctgccttcacacactcaagacgttttcatgactcatctcctgccaggagggcacacacagggcacctttgcacggcgctgcctgtcctgaatgcctcgctgtccccgggtggacataggaattcatcacagtcctcctcgaagcccgggttgctctagaagatgaaactcaattgctgtccttgatctgctgctcactagaggccctgggttgggaatcggaatgtaaatgtgtcacccatcctagagaagaaagtcctgcagtgtgacatggcttcattttcaacagctgagaccctctgccacaacaactctcacagccccctcatccccacccgccgtggaaaccaaataaaagcagaaagctctggtggaagccgagctgggggcgatggggcagattgtagcccgtttctccttcccgtccccctccccactttggcccctgggacctgctcagaaccccagggtgaaggagacatctcaagtgtgacccattggctgcttctgctgcgggagagggagagacggggtggcccatgtgaaagctatgcctcctgcagccccgcaaagcctgcaaaagctcagccaggatttgatgggattgtttctgctgggaccccctctctgctgcgtctcgtgcaaacgttgctgtgaagggatgccaaggggttttgcaaagcagaaacccaagctgagaggaggagaagggattgttctgggggcaggcccaccttgattcagggggtttcgcttcattgtgctttgcagacgctgtgtttttacacattggaggtttgtggcacccgtgcatggggcaagcctcttggtgccgttttcccaacagcacgtgctcacatcgtgtgtccgtgccacactttggtaattctcacggtatttcaagctttttcatgattatatctgttcatggtgatctgtgatcagtggtctttgaggttactagtgtggttattttgggatgccacacatcgcacccatataagacagtgaacttaataaatgctctgtgttctgaccaatcctccaaccagccgctcccccatccctctctctcctctggtctccctattccctgagacacaacagtattaaaattaggccagttaataacactccaatggtctctaagtgttcatgtgaaagaagagtctcacatctctcactttaaatcaaaagctggaaatgataaagcgtagagaggaaggtgtgtcaaaagccgagacaggcctcatgcaccaggcagcctagttttgaatgtaaaggaaaagtaattgaagaaaattaaagtgttactccagtgaatacatgaatgataagggagtgaaacaatgttattgctgatatggagaaaattttagggtctgaagagaagatcaaactaaccacaagcctgatccagagcaaggctcaactctaatgctgtgaaggctgagagaggtgaggaagctgcagaagagctggaaacgagcagaggctggttcatcaggtttaaggaaagaagccgcttccagaacataaagtgcaaggtgagggagcaggttacccagaagatctggctaagattgttgatgaaggtggctacactaaacagattttcagtgtcgatggaacagctttctattggaaggagattccatctaggactttcatgctaggaagaagctaatggctggatttgaaggacaggctgactctcttgttaggggccagcacagctggaaatgttaacttgaagccagtgttcattgaacattccaaaaatcctagggcccataagaattgtgtaaaatccactctgtgctctagaaatggaacaacaaagacctggatggctgcacggcttacagcatggtttccagaatagttttaagcccagtgttgtgatctactgctcagaaaaagattccttttaaaatattactactcaccccggagcgcccatggagatgtacaggaagatgaatgttgtttgcgtgcctgctaacataacatccagcatgcagctgtggatcaaggactaattttgactttgaggtcttattatttaagaaatacatttagtaaggctgccatagatagtgatttctctgatggatctgggcaaagtccattgaaaaccttctggaaaggattcaccattctagatcccattaagaacattcgtgattcaaggttggaggtcaaaacatccacattaacaagaatttagaagaagttgattccagccctcatggacggctttaggggctcaagacttcagtggaggaaggactgcagatgtggtggaaatagcaagagaactggaattagaagcggagcctgccgatgggactgcattgctgcaagctcacgaccacactcgaaagactgaggagttgctgcttaggggtgaaacgagaaaatggtttcttgcgatggaatctactcctggcgaagatgctgcagacattgttgaagtgacagcaaagatttagaatgttccttcaatttagttgataaaacagcagcagagtttgaggggattgactccagtttccaatgaagctctaccgtgagtcaaatgctatcaaatagcatcacatgctacagagaaatcttttgtgaaaggaagagttcattgatgcagccaacattgttgtcgttttttttttgttttgttttgagatggagtctcgctctgttgcccaggctggagtgcagtggcacgatcttggctcactgcaagctccgcctcccaggttcacgccattctcctgcctcagcctcccaagtagctgggactacaggcgcccaccaccgtgcccagctaatttttttgtatttttagtagagatggggtttcaccgtattagctaggatggtctcgatctcctgacctcgagatccgcccacctcggcctcccaaaatgctgggattacaggcgtgagccaccgcgcccagcctgttagaagttgccgcctcagccttcggcactcaccacgctgatcacccacagccaagccaagatcctccattgaaggctcagattattgttcacattttttagcaacaaagtattttaaaattaagatttgcaattttttaagatataatgctatagcacgcttaatagactacaatatagtagaaacataacttttttctttttcgtgacagggtcttactctgccgtccaggccggagcgcagtggtgccatcacgactcactgcaaccttcacgtcccgggctcaagtgatcctcctgcttccgccttccgagtagcgtgtggggagggtgcacgcagctgggctaggatggcctggctggggtcagcccccgtctgtcctggaggccaggcaggtgcggagcttacggaggtggccacctagatgatggtgcctactctcgtgagttgaggcccttggatctctggcagtcagcaggactgtggtggcagccggtgtgctggttgtcagctgatgtccctgtctgtgatttttccgtgtgaatgcagccttgactgggcatgtagatcagaggtgacaagtcctgggcacctctgccactcttcttcctgccctgcacccactacagacacagctaattggtggctgcgttgagaatcttgtcaccaggcaggctcttctgtcggctcaggactgtcctgcgggcatagcaggaagtgaactgcagggggaagttggggcctggttgctgaggagggcagtgcgtggtctccaagccagtcagtgcctgcgggggggactagaattctcacccaggcctctgctctcagtcctgttcctcctctcacattcttcacacccaggctgggctcagggatccttgttgatgatggccttgaaatgtcctctgaacagtgtggctctgggggtgtgtaaaacccagggtgatgcctgctctgaaaggggcttccagatccctttgtgtctccagcacctgccgtgtgcctgccccaagctggggtctgtgagctgtgccttggggcccctgcctgtccccgctctgctctctgctgtggcttgctggctgcagggttctccagtgagtgagggatccctgctggccatgcctggagctgagggtggagggaggcccagcaggaagccccacaggtaggccccagtgagggtgcattatctacaggaaagttgcctgggacactctagtgggccgtctaggaaatgcagcctttaaggacctgaaatggagggggatatttttagtttttaaaatttatttctcattaaaattataacacagcctcgtaaaaatattaaaacagcgagacagatgtgtcaggggttatgtatatgaaggaggtagcacagttctcatcacgggtgtgcttagtgtccccctaaagttcatgccagttaatgtgatcgtgactgtaattggaaatagggtcgttgcagatataattaagatgaggtccttctggagtcgagtgggactggtgtccttagaggagaagagacacggacacacagaatgccacgtgggacagaggcctgctgtctacacctgtgcagaggagacaacaaggagagtggggcatgacccctgcccacgacactcgcctccaggaaggcagccagctgcccatctttggtgcggtcatctctgcaggcaacagaatggcagagtggcagtctgatcactctactccattgtgtgagagtctccaggatgaagaccaggctccccagcaggacgtgcggccctcatggagttctggccttgttttcggctgttgcctggctgatattctgcacatctgcccaccgtcctctgggcggtccacgaatacattgtgccttcctctttgcatatgctggtccctctgctggcaatgcccttccttcttggtgagctccaatgcatccctcaagactcagttcagatgcgcctctctggactcatccccaactcccagacggggttggctgctcccttttttcagatcctgaaacacttacttgtccccctttatgtgggcatttatctgatagtagagtttttctgtactgttggaatggtgagttccctgaagctaggtcagcttccttctcagcattcagcaggcggtgggggaggagggaaggagaggaacttcctaataaagatgaacacctctttgtggttaggtcagaccagcctgtgcctgtgcgacctggtgcagaccttcacctctcagagcctcggtttcctcatctgagcctcaggcacgacaatctgctagactctgcttcccggtggcagctggggaatgggatgggaaggagccctgggatgctcaggtcatccctgccaccagaatgtccccagagtcatgaccatcagcacctcagcctcgctgctttttccttggggtctgcaggggcaggacgcaaaccccacacgctcgctgcgcagtaagctgcaggggcttctccagcagcacctctgaggcctgcctaccacgtggagatgctgctcccgtgggctctgaccaccgctctgccctcttctcacaggaaccagcgaccactcggcccggcgtaaccacgcatgtccactggtcacctggtggccttcgacaagaacgtgtgataaatccctgccggagtgcggctccgggaaaacgctgtcaccgcaaaccagctcctctttgttgcagtcccccgggggcatggcccggcaagtttccttagccaggggccagtttgcctggggtcagtgggcagcgcctgggagtcgagtgtctcgagtggggctctgcttggtttctccttgaaggtctggcagggtcagaccctgcatcggcagtaaccgcggagatgggagagccgagtctgccgctgtgggcttcctgggccttcccgccacccccgccagggcccttgggctgcatattcgaggcgcgcagcctgccaggccctccggcctccctgcgtggccaccagggaaaatggcttcactttgctgagcctctgtctccctggttacaaaacaaataattttattttttgtgacagggtgttattttttgtgacagggtgttgttctgctctgtcccccgggctggagtgcagtggtacgatcatagcccactgcagcctcgatctcctgagctcaaacgatcctcccacctcagcctcctgagtagctgggaccgcagccgtgcaccaccacgcccagctaacatttttatgtcttgtagagatggggtctcactgtgttgaccaggctggtctccaactcctggcctcaaaaattctcctgcctcagcctcccaaagtgctgggattacaggcgtgagccactatgcctggccaataatgttctattttaatttcctgtattccctaaatagtcataaccgtttccaagggcgatattcagaacacgtaatgagtgcagtgcaggcaccagcccacgtctcggccccccgtgtggggaaccagtctggccatctcatggtccctgcgtctgctctgcccacctcgtaggaggctctggattgaatgaggttcgacagtgctgactgtgagcctggccctgagtccgctcaggggtctcacttgccactctgctgctgtcactgcgccgttccctttgcccacatgccctcctggtctctgcatagatgtcctgagtgggactgctgggagtggggcactgctgcgtggcagtggagcctcgatagtgggtctcttgggggattattggcaagctgcaccccttgaaagttaaccgatcggggtgcatggcgtgaacttcccttcctgagctggtcagcccagtgtatgctgtgagccaggagccctgagggcgtctctgcccgcctatctcagagcacactctgtgttgcaggtgccgtgacacctattttacagcccaggaaacagagtctttcatgctgttccttccagccgaaccctcagctggagtcactccagaagccgcaggcaggagagttcccacaaaggactggatgcacaccttcctgagacggggggtgggttaggattccagcaaaggaagctctaaacaccagagtggccagtccatggcatttgttgggggacttacagagggggcttcagcttcctgtgggaatggggagatgagccacgttctgccccggtatgtctgcaacgacgggatcagattacggagttcatatgagggtgaaggaactcggctcagggccgggcccagtttccaggcttgatcttgcagtgtttgggggcaacaccctgaataaatgaatcagtcagtgcctgggaacattcgaggccctggcttgggttcaagcctgcaggaaaaacgtgcagctggcgggtcaggggcagttaggacagaggacgaggaggaacgggggcccctacgtgccatgggcatgtgctcgtctctctcctggtgtccgcctttctcctctgccttgtggctcagcttggactgccataacaaaatacgatagagtgggtggcagaaatgcattttctccccgttctgaaaactggacagtccaaatgcatggtgcctgtggtgttccgacaggggatcactcctcgggctccttctcgctctgttcacggggctttccttggtgcatggagaggatctccctctcctcctcttcttataaggtcaccagtcccatcagattagggccccacccatatggcctcatttaaccttaattacctccttaaaggccctatctccacatataggcccttgtcatagcggaggcttcacataggaacctgagggggactcagcctggagcacctggtgtgttaggaggaggccaggccagcgctgagcaccctgcctgtgggtgagccctgcttctcaagcaacagtaataaataaaaaggaggaggccaaactgaccagacctaaaaaaacagtatcttaaggtctgacacctgccacggcatgaatgagccagagaaagtgatgctgagtgaaggaagcctgtcacaaaaggacaaatgtggcatgtgaaatctctagaacagggagattcatggggacagggagtggactgggttaccaggggctggggtgggaacaacggggagtggcttcttcatgggtgtagggtttctgttgagggcgacgacagtaccctgcaagtggaccggtgaccgatgcacagcgttgaatgtactgaatgccactgaactgtgaactttaaaactgttaaagtggcaagttttatgttatattaaaaaaatcatatatagaaaggatgttgtattaaacgagaaaaactcatttctctcaagtaccagtcactcattgtggagactgctcttgaggtcactgtgcccaggcctcttctgtcttgagccagtccatctctggggtgtgaccctagcttacccccatgaccacaggaagaccatgagctggtcctttaaggatgcaacctgggagttgccccgaggactgtgctcacattctgttggccaaaactcggttacgtgaccacacctagctgcaagggaggctgggaaatgtagtccttagtctgggggcatgtgcctggctgacaatggggcttcagtgctgtgggagaggaggagctggtggctgccaggggatggacagctgtctctaccaacctggcctcacagtggtcacgctccaggacataaatgtcccctctgcagcaaagacttcctgggtgtggaggggactgggggcccacaccctggtcttcacaagatggtctcctaccccggaaggcaccatgcggcccacgcttcagtgtgaagacaccacctgtgtgttaatgggcccaacaccaacctgggtgcagggcaggtattcagcaaacagtgaatggacaccagggagctggctactatagcgacctcctgaggtcgcagggctaccaaacagtgcacggcatttgcaccccagctcaggcgtcccggcagggattctgcattgtctgcctttgaaaaaagggtgggagagttaggacaggaattttctctgtttccctctctctctccttctccccgcttctccccctctctttttccctttctcttttcctccctctctgtccctccctctcttttcctctctatctccctatctgctttgctctctgtctctctgtcctatttttctccatcactctttgtccttgtctctttttctcgttctctgtcactccgtttctgcttttgttcccccttctctctctctccccaacccccctgtttctctatctcttcacctgtgaattcctgaaacagacccagggcatgatgtcgtggagggcaggccccagaggcgtccaggtgacaccgtgtgggcatttgtaaagcaggaggccccagcaggtggagcaggaggactcacccccctgcagtgggtggtcaagaagagctgcctttcctaagcccctctctcctccagccacccctcacctggggcctgctgagagggacaaggtggattggggcttgctgtggggctggtgctgaggcaggggtgggtggccccccagcccctatttcctcctctccaaacccagccatcccagttaattatttgcccagcagggcagcttgactggctggtgtcttgctgagcaataagcagctgaataagggtgcaattgctggaggcggggtcgcagctgcagacctgggcggtcacttagtctgggacagctgcggcggccacagcgaaagccatgcagcctgccccatgcctggctttgtcgcgacggctgctggaacagacgggtgtggtggctcatgcttgtaatctcagccctttgggaggccaaagcaggcggatcacttgaggtcaggagttagagaccagcctggccaacatggcaagatcccctctctactgaaaatacaaaaaaattcagccgggtatggtggcaggcacctgtaatcccagctactcaggaagctgaggcatgagaatcacttgaacccaggaggcggaggttgcactgagccaagatcaagccactgcactccagcctgggtgacagagtaagactgtctcaaaaaaaaaaaagaaaaaaaaaaagaaaactacacacacatacacacaacataaaatgtatgattttggccaggcacagtggctcacgcctataatcccagcactgggaggttgaggtgggtgaatcacttgaggtcaggagttctggaccagtctgggccaacatggtgaaattccatctctactaaaaatacaaaaattagtagtgtattagtgggtgtggtgacaggtgcctgtaatcccagttactcaggaggttgaggcaggagaattgcttgaacgcaggagacgaaggttgcagtaagccgagatagcaccactgcactccagcctgggcaacaaagcaagactccatttcaaaaaaaaaaaggatgatttttaaccatttttaagtgtaccgtaagtggcattaagcatgtggtgcaaccatgaccaccatctatctccagaactcctttcaccttgcagaaatgacaccctggacccttgaaacactaactccccctcccaggttccctcccccagcctggggattaggcatctagcagctgctgtctggagagggatagcatggccctgctccgtcccttctgggcccgttgagctctgctgtgaaggggattcctttccttgtccctgtcactcctagtgtggaggtcgggggtaccaagccccagccctgccacctggaaaccctgggaaagcagcgtcacctccctgtgcctcagtttcctcatctgtaaaggggagctgaggacaggacctgcctccgagcctggggagagacggcagtgcacagggactagctgtgcgtctcagtaatacggagagaactttgcaggccaatggcgtccctctgagaaagactctccctggattctgtttcagagagttgagcttttccccagagcagatgctttgaaactgtctcaggtggacagagggggctgcagggagggcacagaggacttcctgggagtgaggtttcctgggattgagtcccagccctgctgtagggctggagtgaaaggggcctccccagagagcctctcccagggctctgtccccaagtggccaagctaattcggttccgtgctccccttttgcccacccccaccagaggccacaggctggactgggcgccactgctcatgcttctgtcctgggatagcacagaccagtacaccagggtctggcacatgtccgttgtagtcactgcagccctcccagtctccccgttttgtagaggaagccacagctcggggcaaagccgcacctcgcagtggacaggtgagtctctgcctccccaccagctgcctcttccacagatggacccccaatcacactgtcatatcgcctgtctgagcctcactgtgctagtctgtaggagggggcacctcctcttgggccatccatataaggctggagacaaacagctccacccagttatgggagtcccatgccatccaggacacatccaagtggatctctcatagcctatcatggttcctccaagactcagttttctcatctgtccagtggaatgacaatggtacaggctgtgagaatcccttatctgaaatgactgggatcagaagtgtttcggatcttggctttaagttgtagaatatttgtatgcacataatgagatatcgtgaggatgggacccaagtctaaacacgaaatttataatacataagtttctggaggctccagggagaatgtgttccttgcctttcccagcttccagaggccgcctgcgttccttggctcgaggtccctcctccaccttcagagccagcggggcagcctctcctctcctctccgacctcctgcctccctcttacaaggacccttgtggttcggggtcatctgattatccacccagataatccagggtcatctctctctttcctgatccttaactcagtcatatctgcaaagtcccttttgccacataaggggacacattcacagacgggttctggggatcaaaacagggacatctttgagggctgtgtttctgctgaccacgctctcctctgggcctgccctttgcatctgcagatagcagtggactctctttagggggagcaaagcctcccgctctgagcatgggctggactttgggggtccaggactggggaggggtcgacattgtaggtcaccaccatgtgtgactgtccagggaggctgggggatgaaacagccgagggtctgactgggggagagccgagaacacaccccactttatccggaaggccagccatgtctgctcagagacgaagagtcacgggacagccctgtccaagagcaaagacccgtccaagagcagggtcagcacctcggagagttccccgcaggccgccacggggcggggagagaattcatggggcttcgacttagaaggggaacatacaatgctgtggttttcactgcctctgggtgcaactcagcatttccccaattacgaagccagggccttggcccccagcaggaagcctggggtatttcattgcctcacactcacgtcccatctgctgaggggcacgtacgccaccactactcctgagtggcagttgattttacgctcacagattcgtcctgttatttagtatgttaattcaggcggctatgcatggttgtctcacaaatttgatttttaaggaatttaacatttcaaaatacttggtttcccttgtaacccctcaccttttattttctgtacctacggtcatccctcaagagggatccgtaggcctcccctgcctgccctgggcacagggacatcccgaagcgccggtcccagagcctgggctctgctgctgtttctctgtgacttgaggcaagatatcctacgctgccgagatagcagcccctctgcctggggaggtgagtgtgaggaacccggtgtactctgtcgatgtttaagggtcagtgggcgccgaatgaatggtttctgtcagcagcacattctgcatctcccaaaaccaaaaccaaaaggacagccggattttcccctctgcctgacttcactaggctcgcgtctgattttttttttttagcaccgtcagcataagggcctgggtttattttgtggttgtttatagtggaattgggtgtagtgtcctgatttgttttccaggatgttcgttttggggtcaagggtctttggggtggatgaggcgggagaaccaggcttgagtgaggctctgccctcctttcctggccccctggtggcccctccagagtctgtcccggccatggaccccagtccccgctgagccatgcggagagtttgggagaagtgcatacctgccttgggggcttgactggcaggctgctttcctctggctcatcttgaagttaaaatgtagctcagaccctcctcagcccccacgcagggttgcaacctcttccgtctgtctccctgtgaaatccaccttccagggggcagcctgggacctgggatggccctccctacctgaaacctttcaggccttccactgcctgcagggaaaagcaccggctcctttcacggacttccagcaccccttcggggctgctgctgcctggttggtaagccctgagctcactaatctcagccgtcacatgctgttgggcaccagcctgtctctttggaccataaaaacgccatgttgggttggcaggataagtcggcaagttttgatccagggctacagatttcctggttgtattgtttcaaggttaatttctttctttttttttttgagatggagtcgcgccctgtcacccaggctggagtgcagtggcacaatctcggctcactgcaacttccgcctcccaggttcaagcaattctcctgcctcagcctcccaagtagttgggactacaggcctgtgccacgtgtccagctaatttttgtatctttagtagagacaaggcttcaccacgttggtcaggctggtctcaaactcctgacctcaagtgctccacctgccttggcctcccaaactactgggattataggcatgtgccactgtgcctggccaaggttaatttcttgatagagttggacagtcggttttgctacaaagcttgttttgaaaatgagagttggttccagcatgattgatatatcagggaacagtttcaagataacacaagtttcccgttttcctttgtgagatttcacccaccagaagcactgggtgaacacagccactgcccccagctggcctgatgcacctgtgttcacataggaacacataggatgcatacgcacctcacacagccccagccgccccagggaccccatcctcgtcagggcacaacttccccgtctccactgccccgtctctgccactctgcaccagctctccagcccacctccctcggtaaacttacagcgttttcaagcccaagtgccgtgttaatgtgtctctgaaccccttgacatgtgaagctgtgctgccgtttttattagggtttctgtctgttttgagtgccctttccctaaccccattccccaacaagccctgtggttttgactgtgcggttttgcatgcagtgatttctaggaatgcagacgtcgagttgtggtggaatcgactcttctgtgctcatgtgagggaatggccttgttttgaggaaatatgcgctgaagtactcaggggttaaaaatcatatggccagctgggcgcggtggctcacgcctgtaatcccagcactttgggaggccgaggcgggtggatcacgaggtcagcagattgatagcatcctggctaacacggtgaaacctcgtctctactaaaaatataaaaaattagctgggcgtggtggaaggcgcctgtagtcccagctacatgggaggctgaggcaggagaatggcgtgaacccgggaggcggagcttgcagtgagccgagattgcgccactgcacctccagcctgggcgacagaatgagactctgtctgaaaaaaaaaaaaaatcatatggcccgtcaggcgcggtggctcacgcagtttgggaggctgaggtgggtggatcacttgaggtcaggagttcgagaccagcctggccaacatggtgaaaccctgtctctactaaagatacaaaaattagccgggcgtggtggcatgcgcctgtaatcccagctactgaggagactgaggcaggagaattgcttgaacctgggaggcggaggttgcagtgagccgagatcgcgccattgcactccagcctgggcaacaagagtgaaactccgtcgcaaaaaatagtaataattcgtccgtctcctcggcgagtggaggctggggccagggtggaacaggagctccacggtgagccaccccggagtgaaggccactggccctccttatccttgctgcggtgtgggggtgtgggtgtatgacccacagctcacatgtggaaacatggaggccccggggcctgtgtgacttgcccagggtcccagctagcaggtggcagagcaagacctgtatgcagaggcccaaggaagcgtcatgaggacccaggtcaccagtgcatctccagggtgaacctggcccctgcccagcgcatttgcctgtcccctgaaaccgccaccacacaaaaccatgtgcatcttcagagcaggaggcgtctccaccatctgtttgctcccgtttgacaaatggtcggtgctccttgaacggataaacaggaaccatccggccctcttccttgccggagctcatccctttgactccagggagggaggtcatgagcaccacagtctttatgggggagatcactggcctgcccctgggcggagaagccaaactagaaccttctccccagggtgagctcacaggcttttcccatccgggacccctgagccgattggctgcccgggacctgctgttatatcgggggctcccattgcaaagcccctgcgtgggctggcttccccgggtttggtttctccccattgtgcagggtcttggggtagggtctgagccaggtcaccctggagaaccgacagcaccggcccagccccgctgtgacctgctgaccccggaccccgcactttgcttagtgctttaggtctgtaggagtaatctttggagaatcgtgattctgggacccgagctctgagggaacaacctcctctgagcctcccaaggccccccaacattgtggggtgagccccacctcacagatgctgagacaggcctagaggcgtggcgctcccagccccatgccccacatagctctaaggcctggcctcacttgcaggtgagggtcctaggaagctgggggtgggagcaggcctaggagaggcactcaacaaccacggctcagcatggtctagaactgccccctcttcctcccggctgccccgagtctggcttccgtcagacccagcctccttccccagcccatccctctccctctttgatgaggccgatggggcaaagacctttgcttcccagaatgttctgtccctggttggaacactggtccctgggacacagccctgtcctcagctttgaagtcagttcccatcgctgccccccaggtagctggctggcttctgccaacctcagcctggtcgcagctggcacctcctcaccaggtactaaaccagggtgtgcagaggcccgctcgatccatggggcagatcagcaaatggtagtgcaggatgccccatcatatgtgaatatcaggtaaataacaggtacttctttttttctcttttttttttttttgagacagagtttcgctcattgcccaggctggagtgcagcggcatggtcttggttcactgtagcctctgcctccctgatttaagcagttctcctgcctcaggctcccaagtatctgggattacaggcacctgccaccatgcccagctaatttttatatttttagtagagacagggtttcatcatgttggtcaggctggtctagaactcctgacctcaggtgatccgctcccctcgacctctcaaagtgcttatattacaggcatgagccaccgcgcctggcctatttttttttttttcccttggcaacagggtcttgctcttttgcccaggctggagtacagtggcgcagtcatggctcacttcagcctcaaattcctgggctcaagtgagcctctcaccttagcctcctaagcagctgcaactacaggtgtgcaccaccatgccttactaattttctttaaaatttttttgtagagataggggtctccctatgttggtcaggctggtctcaaactcctgggctcaagccagagaggggctggcctggtgctctgggttctccagaccccctcctgccttggtctcccacagtgctgggattacaggatgagccacggtgcatggccacctgatggataatgtctaatataagagaacccctaatttagctgtccctgtacccttgtgaggtgagcagtattgttgcctacattctatagatggggaaacagaggccacagaggcctagcagcctgcctcgtcaccgagtgggagcttggcagggctgggatctgaacccaggccgtcggctcctgggcctgtgtgccccctccatgaccatatcagcttcctacagcttccatgacaaagcaccacaaaaccggaggcttaaacacagaaacgcagtcccccagctccgggcagaagctcgagacgagggtgtggcagggccgtgccccctctgcagcctctggggagggtcccttccggcttctgggggctgccggcctccctggagtggccacgtcacttgttgctgctgtctccctcgtcacgtggcctctccttctctgtctcttagctccctctgccccgtcctgagcacagctgtgattgcattagggcccacctgtataaccgaggatgccctcttctcaagagccgtaccttgatctcatctgcagagatgcttttcccgacgtgaatggaatattctgaggattaggacgtggacctaccttgttaggggccaccattcagctgactgtctttgccaagcacaggcagtggagactgtgtcatgctctgatccgaacaatcgtccttctgtctgccgcccgacttccccagccctgttcagaaagacagaaggaactcctgccccaccctaagctgaagtcgggagcgtgaggaccctttatctggtctttgggggccaggtgggttcacgggcacaggacagcatgacaggcagggcctggcattgggacacctgggtcttagtcctcacctgtgacagcggggggtcttgggcaacgtcccacccctctctgggccttgaagatgaaggggttagatcctggcctcccggagcttcccctggtgtaggatcaacacactttttctgtcaaggactagagagtattttaggctttgctggccctgtagtctaagtcacatactcttctctgtctgtttttgtttgttttgttttgttttgttttgtttttgtttttcctacaacccctttaaaatgcaaaacccgttcctagctccaggccatggctgccattgggctgtgttgagcctgtggcgcgtgcacaggcccctgcccttggtggacactctgattccacctgcaaatcctgagcgcacaccggctctgaacaggctctgtggcttcagaaacttatcttctggcttcgtcgatctggctggtttgccctggggatcccgcatcctctgactaccgtgatgagcagagcgcagcgcccggctccgtgggccaacttttggtgtcttgccctgcctgagcctgttcctccttcctctccctgcccctccagccgctccgggtcctctgggaagctctggcctcttcaccagccctgcgcggctgctggatctggaggccggagccggcacatgcgtctgacagcagcgctgctgtctcttgtttttcgtggtccatgtttgggggttacatctgggcctgtcccttctctgtgtagcctgaaggcagttcccaggcttgtgtccctcacctctccgcagacgccctttccagatcctgttcaaatcctggccctactcacgggaacttgggtgagtcagttcccttcactgagccttcatgcctccctgttaaggagaagcttcactcggcatggcgtggcccgtcacactcatcctgcatctgttacaccaaatgcagtttcctcttctataaatgggagaaaatcacctgtccttgccaagggtccggtgggaattaaatgagctgagccagggcacgggtggagcttgctgagtgttaggtcgtgtgcctgctcttcttggcggagtctggccagatacctcatctggttccattgctgtcagtctctaaatggggcctttcctgcccagctcccagccctggtgctcacaccatcacaggccaaagaactggattccagacactgcctcctccactgtccccacagtgaaaatggggagggatgtccctgtggagccctaactgggacccagacagccctacccccagctcccaccccctccggctgtcccggaggccgtgctccgtggatctcctctccctcgcctccacgtgggctccaggtagctgcacacgcattacaaacatctcgttaatcttctcggaggtcctgcgaggcgaggcctgtggtagccctgcccttggagcactgagaattagtaaggaaatcgccgctgcatctcccggtggcacaggggcgtggaggcgtggcgggccttccctcttgcaccactttggatcctgggtcctcacagcagtgttctctgcaggggaggtgcaggcattggtctgctctagggccaggtggtctaaaaagtccctggtcagccccgagtcctgcaggaatctgcatgttagtgggatttggggttcaggatgcttgcctgctgggtaggatggggttgctgagtgaggctgaaatcccagatgggatgtctgggctcctccatgcctgacttgggaggggtgagaaaaggaaggagacttggccatctttaggctaaaagcctagtgctgtctcacaggagggaagagcaggtctctgcaacacacgcctggggttccgtcccctctggccacttgtctgtcaccttggacacgttgcctggcagcctctgagcctcagtgtgcttctgtgaattggggtgaccctagcacggtgctcacgacagaaagcatgggagtgcagacgtgggtcagtggcccgcggtgagagctccctgtctgccccatggtgagtttccacagcagtgagagaggcctggcgtgtggggtggaggccgggacagtgtgagggccgcctggtcagagcgggaggcaggaccccgtagggagatgaaagccaagctggacccaggcagaaaaagaggaacgaaggacaggaagtccaagagcagtcactgctgacgtgagtgcggcctgcaggcagccagtgtggatggactctcaggccctccgttgtgtgttaggggaccggaggagcagagaggttgcagcagccggccggcctctctcggtgagggccggactgcacatggggctcagaggccgtgggtgtgcctgcccgcctgtgtcagctccagccgtgggggcgggggtaatccgaggctgcgtcccgaggctgtgggagctctgccttcatccttccattcacaggtagggacacaggcgtggggattccacggtgcccttgaggcagctgtttcctagacccccaaggccctgacggagactcccccacccctcaggagcagagggtgaggcggggtctgcaccggccgatgtgggcaactgttgcaccctcggagcccagcagcgagggtgggggtctgtggggagtcagccgcagccaccagcattgctggaatgtgtcagaatggtggtgcctcctgcaaacaaccttagcctctgttcatcctgtcaccagggtcctgggagaagcaaacccacgtgtggcctctgcagggtgggtggggaggttctcccggccaggcctgactgacgcccctgctgctccctgtggtccagcctggacttgccaccgattattctatcaatggcactgcactgggcaccaggatccaagcagtggactgcgggacaggacctgtccctgtgagcggcctgtccctctccccaggcccagcctcctgttggttatccttccaagcccatgcctgggctgtgcgatccacctttcctccaggcactcttcaggcaaatctctggagcacccactgggtgccacacactgcggatgggacgcagggtaccgcacagccccggtcctcagggacccggcggggacagcactggtgaaaaaccacggaagtacattgatgtgtcacttcaacaggggcctacgcaggggcctgccctgtgccaggccctgtcgttggtttgtggggtgaagaccctgttcctatggtgtggacgtggtagagatccaggggctctggcagcttgtatgggggaatggggacgggaggggggtcaggaatgggcttctcgagagaagtgacatttggtcagaggcccaagagcgggaattgatcctggccctccctgaatcagtgtggtgtgacccctcccgccaaggtgagggtagcaaggtgcctggggctggaatcctggggctgtggcccgtacagtcgcccgggacccatgcccagcagggccctgcacccggagtttaacactgaggtccccaccttgaaattcctaatcattgagtctttgtaacttgtgttagggagtccagcgagacaatggggtatgtgcggggtctttggagcttcagcccatgcacagacacgtctctctgttcctcgactcctagcatgctctcacctgcctgccccagagaccaagccccacctggccccttcgtcaccccgaggtggcgactgggttgtgctgaaggagggaggcccacacgccaccactgccctctgacccgtcaggggccccgagggcctggttggtcagggctgggcactccacccaccccggatgacagcaccaggctcatgtgccaggtgactcagccagggccactcaccagcgccacctggtatgtcctgggtggcggccgctgtgcctgctcctatccaccatggttgggcactggctgggaagagaggtgaccaccaggccctaatagcaggagtcacccacacaacccttgtacccagccctggggtccaggccgcctgcaccggctcagttctgcgcctgagctcccagctctggggtccaggccacctgcaccggctcagccctgcacccgggctcccagtgctggggtcccccaccccttggtgttgccgcatcctccctgggcccaagattcctggagctggagaacccccttcctccctgaggcatggagactgggctggtcctgagcccactccaggcacaggggacacacctgcttccttcttaactgagtagagcagagttattttgaagatcggttttcagcaggacagtaaaaaggcgaactgggagattgttcatgcagcagcttctaaaaccagtttttagataaatgcaccttcgtctgtggggggtggccgcacccagcctcgcttcaggtgcctgacggggtacgtgctgcgttcagtcccaggcaggtgtagggctgggcaggtggagatgcggtgccctcgctcaaccggggtctaggctcctcgccgggcggggttcacctgctatccccagtgtgtgggggcgggggtgtggggtgagggagaagagtggggcactgagtctaaacataggctgtggcctgtaggtgaggggaggcggcagcaaggagggggagatcaactcctgaagagactccgtttctaacacgccgggagccctgcgctttgtcatggaaactggcaagagtccctctccatccctccctactcccagaaacaagatggtcccaggctaacgggcttctctctggcctggccctgctcccagacccccgctgagggtggtaaacaccccagccgcgcccttggcaggggttccgtcccaggggcctccctgttctcactgtgagggtgggcatgatgggcagctttgcggagcctcctcagcacagagccgcacatgacgggggtggacagactgtggccccacagccgtccatcactttcatcctgtattgggggagaacggggcttgcttgaggtctgtcctggatattcgtaatgctggcattgacggggccagtgaaggctctgattggtgcgggtgacgaggacacagtcgcagcaggcgtagaccaccagagcagggtgtccacgtggctggccacgtttagttgataaaagtggcatctataaatgggtggtggtgcggaatgggtggttgattaaatggtattgggccgctcaggtggccattggggaaaggtaaagctggatccctacctcataccaaaattattctaggtggataaaaagtttaaatgtaggccaggcagtggcttgtgcctataatctcagcactttgggaggccgacatgggcacatcacctaaggtcaggagttcaagaccagcttggccaacatggtgaaatgccatctctactaaaaatacaaaaaattacctttgcgtggtagcacgtgcacgtaatcccggctacttgggaggttgaggcaggagaatcgcttaaacccaggaggcggaggttgcagtgggccgagatcgcaccgttgcactccagactgggcgacacagtgcgactctgtcattaaaaaaaaaaaaagtttaaatgtaaaacataataaaagctggtttccttactgcataaaacacttctacaaatcgacaagaaaaaaaaatcaaccgcactcttaataacagaaatgtaaattaaaactacaaggagataatgctgggtttcacttgtcttgggagagatttaaaaaaaaaaactgatctactgaattacagaagatgcgaggaaacagaccccctcgtgctttgctcgtgggggtgtaaatgtcctccctggagagaaaattgtgaatctctagcaaagttcagaccccaggaacatttaaactgcagctttaattcaacagcggcacttctggaagtatcttctgaagatggatttgtgtgtgaaatatcaaatatacaaggttgttattagactgtgaattctaataggagaacatggaagacagccttcatgtccatcagcatgggcggacttcatgtgttctggaacggtcattaaaacaagaggctgggcacggtggctcacacctgtaatcccagtactttgggaggctgaggcgagaggatcacctgaggtcaggagttcgagaccagcctgaccaacatggcgaaaccctgtctctactaaaaatataaaaatgagctgggtgtgatggcgggcacctgtaatcccagctacttgggaggctgaggcagaagaatcgcttgaacctgggaggcagaggttgcagtgagctgagattgtgccactgtactccagtctgggtgacacagcgagactctgtctcaaaaaaataaaatataaataaataatttaaaaattatttaataaataaatagaataagaaagctgtgtttgctgatatggaacaatctccaagatacagtgttaagttaaaaaaaaaaacaaaaacaggccaggcgcagtggctcacgcctgtaatcccaacactttcggaggccgaggcaggtggatcacgaggtcaggagatcgagaccatcctggctaacacggtgaaaccccgtctctactaaaaatacaaaaaattagccaggcgtggtggcgggcgcctgtagtcccagctactcgggagtgtgaggcaggagaatggcgtgaacccgggaggtggagcttgcagtgagccgagatcgcgccactgactccagcctggacgacagagcgagactccgtctcaaaaaaaaacaaaaacaaaaaaaagcaggggcagaactgtgtgtggtgggccaacacttgtgtccaggtttctagcatgtgagagtgtttgaaaactggagcctgtcctgtgacggagtcttgtgcagacatgaaaaacaagagatatcctagtgagctcccaaacagggacacccatgacagagtaaaagcagaaacaagtcacaggaaaaaatatgtagagcataaccccatttgtgcggcaaaaataaggtgtgtatgtcgatcactgcatgggagaggaagcgaaagagaaccactcagaatgaagagtcattttctgtgggaagctggacacatgtggaagggtttgaaggaggagttttactttcattctgtacattgtaaaattttttctaaagaacttgtgttttacttttgtatatttttatttatttatttattttgagatggagtcttgctctgtcgcccaggctggaatgcagtggcgcgatcttgtctcgctgcaacctctgcctcttgggttcaagccattctcctgcctcagcctcctgagtagctgggactacaggcgcctgccaccatgcccggctaatttttgtatttttagtagagatgggggtttcaccatgttggccaggctggtcttgaactcctgacctcaggtgatccaccagcctcggcctcccaaagtgctgggattacacgtgtgagccacagcgcctggccaacttttgtatattttaaaaataaaatatccagccacaatccctgagaatagctaggcagtggaaggatgatttctaccaccccatgccccaccccccagctggcagaagctttcaccccccgcccctcccccgccgtttccccgactcgctgacccctcctctgcccctgggccttttgcatcctggagctctcttccccttgccaactcctcctgcctcccaggcctcagccacgcctgcttcctttgggctgatgctgagcaccaacccagagtgtcggtgctgctcattgctccagtgaccccgtccagaccagcctccccgtccagccttcctcttgctcctgggcaggacctgccctgtgctttgaggccctggggcctgcacatatccagcatgtgggtgtgccctgtctgtgtgtaccaggtaagcgggcagatgagcccagcagacactgctgcagccggaggctgccggcagcccgcagtggcacagccgtgctgtgggagggcctttctgtgtctggggctgtgttttccacactccccctctggcttttactgttttgctccgggagtgtggctttctagagttttgtctgattttatagcagagtttctgttaactcaaaaagggactccacagtgaaggtttaaaggtggtcccagctgcagcaggaagcaggtgtggggtgcctgctgcccaggccctgttccccagcactgcttctgacccaggaggggctggggagaggaccactattcctcacctttcatacacccactcccatcctatttcgcaccccttcctccaggctgcctgcacctctgccctgctggcctttcgctctgtaattcctttctgaaagaaatgttttccatgaaacaacaacagcaagaagaaagcagatcagctgttggcaggagctgggaggagggatggggagggcagctgatggatatggggtttctgtcgcaggcgacgaaagtgctgtaaagttagatcacgatggtggtgacccgcctcagtaaatgtgctaaaaaccagtgaattatactctcaacaggagtgtaattgctgtcttcttagaacgtgtggccatggaaatgtgctctttttatgtgtttacctttgtatcagccgtcttctcaatgagaccagaatccctatcagagcaaggaccttgtttgtgtctcccttttcctctatgtcctaatatacaacagtgtgtttagcttgtagcagacactcaatttaacaacatctttttgaacgagtggatccataaatgcattaagtggctctgtgacttcagactcttcttcaggtttacggtatataaatatatcatttacggtaccttcatttatggtatataggtgatattttagccggggtgcagtggttcacacctgtaatctcagcaccttgggaggcagacgcaggtggatcacgaggtcaagagatcgagatcatcttggccaacgtggtgaaaccccgtctctcctaaaaatacaaaaattagtcaggcatggtggtgcgcgcctgtaatcccagctacatgggtgcctgaggcagcagaatcccttgaacctgggaggcggagctcgcagtgagctgagatcacaccactgtactccagcttgggtgacagagcaagactccatctcaaaaaaaaaattgttatctcagccaggcacagtggctcacacctgtaatctcagcactttgggaggctgaggcaagtggatcacatgaggtcaggagttcaagtccagcctgaccaacatggcgaaaccccgtctctactaaaaatacaaaaattaggccaggcgcggtggcgcacgcctgtaatcccagcacttggggaggctgaagtgggcggatcacgaggtcaggagatcgaaaccatggtgaaaccccgtctctactaagaatacaaaaaattagccgggcgtggtggcgggcgcctgtagtcccagctactcgggaggctgaggcaggagaatggcgtgaacccgggaggtggagcttacagtgagctgagatcgtgccactgcaatccagcctaggcgacagagtgggactccattatacacacacacacgcactatatatatatacacacacacacacacacacacacacacacacacacacacaaaaaaaaaaattagccgggtgtggtgggcgcctgtaatcccagccacgtgggaggctgaggcagaagaattgcctgaacctgggaggcagagtttgcagtgagccgtgatcatgccactgtactgcagcctgggtgacagagcaaaattctgtctcaaaaaacaaacaaaataaatgatatctcaataaagctgctaaaaaaaactcgcccaccaggtacccatcaggtatcttatccagcataagaacagctgggctgtgtgctgtctgcacctcatcccatgaatctttgcaggggttctacaagggtcctccttactaaaccccctgcacaggtgaggaaactgaggcccagagattatgcagcctgcccaggtaaagcagctggtgaacgtggacagcgtggcccccgtcataccttctcgccagctgacggtgctgtccagggagtctggaaagcagagatccaaaggaattggctgggctggaaggctccttacagaagagctcgcttgcccattcactcattcatttgttcagctgaacacccacctacgagtgtgtaccaggcagacccgctcctgtctccacgaaccacaatcacagaattgtgtaaacgaggtaaagccggaggcctgagattgtggggatggggattgaggtcaggactgtcttaccaaggagtgacatttggcctgggattgaaaagtcacgaaggaactgaacattaagaccctgtatgtaaggctgggtgtggtggctcccactgtaatcccagcactttgggaggccaaggtggaggaatgcttgaggccatgagttcggaatcagcctgggcaacatagtgagaccccatctctacaaaaataaacaaaattagccaggcgtagtgtcttcctgcccacttgggtggctgaagtggaaggactgcttgagcccaggagttcaagactgtggtgagcagtgattgtgccactgcactccagcctgggtgacaaagggagaccctgtctctaaaaaataagattataaaccagccaggcgtggtggctcacatctgtaatcccagcactttgggaggctgaggcggttggatcacctgagggttttgagaccagcctggccaacatgacaaaaccctgtctctactaaaagtagaaaaattagccgggcttggtggcacatacctgtagtcccagctacttgggaggctgaggaaggagaatttcttgaacctgtgagaaagaggttgcagtgagccgagatcatgccactgcactccagtgtggacagcagagccagactccatcacacacacacacacaatatatatatatgtgtgtgtctgtgtatacacactcacatactcacactctctgtagtgggctgaatggtgtccccaaaagctaggtctgcctggcaactcacttccaacttcttggaataagggtctctgcaaatggaattagttaaggatctgcagatgagattctcctggatcaggctgggccccaatccaacgaagagtgccctcgtgaggcagaagaggagagagacacgtgccggagaaggccacatgagggcagaggccgagaggcgggagtaaggccaccacgagcctgggaacgccgagggcgccagcagccgccagcagctggagagaggatggatgggaggattttctaaagccttccgataggggtgtgacttcttgattttggactccgggactgcaggaccgtgagaaaaggagtgagtgttaagtccacctagttagtggtcattcattaccgtagcccgggacacttacgtgaacttcagacctcaaatcctccccatcttgcagccccaggcgcagacctgggcagtggggcccccgtgtgcccatcccccagctggccaggctcagctgagagctcctcgacctcctgcctgtccctgccacccttaggagtccgagaaactggacctgcccgtggcctggacaccacttcctttattgcttagggtttctctctttctttctttaaaaattttttaaatgaaaaatggggctgagggaagactcggtctaaagataagagaggggtcacctggatctggaatgttctctggctttccaggctgctctgatcgcagacctcctgtctttaacaacccagcctgggtcaggtctgatgaaatgcactttccagggaatggggctggtttgggctctgcagaagcttccctcttccatcctggcaccggcagaaaagcccattaaaataattgcagggagagactgttacctaagtttcctccccttgagctgttggagctcttctttgacctttatggtttttaaaaccctgccaatccttgccttgtcccccggacgcattcatccagtgggttgggaagctggtgttcgctgtccgggctgggtcgtgccggctctccgtgtgtgcacgtgtgggtctgggctgggtgttgacctgctcctgggccagggcccaccagagccttagtccgggtggccaccatctgggaggcccggccgtgtcctctcttaccccagttctccaggcactggccaggggccccctcagcacacatgtcatagttggtccctccctgcccatggcccttcagaggcccccagctggtcttgggaggagggtgcctgtgtgggccagctttcagcacagcccccgccctctgctccagccttgggtgcaccccaaccccacccagctgaccagcctgttggggggcctgtggaccccgcctctaagcctgggtcttcctctgggcacccgttggggacagggcagccacacacccagcccagggtgtggtctccccacccagctgcctcccttgcaaaggcagggttgccttggcaatgacacctgaggaggagacgcttgccctgggtgcgctgtttccctgtcttcagtaagggaggaggctggcttcctctggcggagggaggcagcagctctcctttgccttggaacccgctttgctccagtgatccctgagccaccacattggtaagactggctggagctgaaggtccgagtgtggcttcaggactggtgacgatggccagggatgaagggctgcggcgtgtggaggggctgcgcccggaaggaagcggtgtggacccagaaggaagcggagccctggtgggcagcctggctgtgctctggcccaggaaccgggccttttcttgcctcttgcctctgactcagagcggcttgtgggagcctcgcatgcagggccaggcagggcaagaacgatcgcgaccttttcctccagggaaggttgcaagaaaggcgggatctgtaacgtgactaggtggaggcactacggagccatggtgcaggggtggggggccccaggtgagctcagatgccctccctgcctgtgccaccgtggcctgaccctccacaggtgggagccataggcgtcaggagccattaccccttggagaactgggtgccaggccgagacctggtgtctcatttatgacaaaccgctgcagtgcgtttgggagtctcctcctccatgacgtgcttgtctggattggttttattttagtgcaggcaccacgtcgtctttttatatacgtgtgaacgtatatatgtaaacacacgtatgatgttggtgagttcatgttggtggtatttttactaagcaaagatgtgggaaccaaatgggcccatccggggagtttcccatttggtccctcgtgctgtgtgtggtggggggcattgtggtcgaggtctgaacagccggggaagtgaaagaccccgtcctctccgggagcttacgggagtgggagagacattgacgaaatattacccatcgcaggagtcaggtgcacacagtgatgatagttccgggaggtcaggtgcgcgcggtgatgacagttccggaaggtcaggtgcacgcggtgatgacagttccgggaggtcaggtgcacgcggtgatgacagttccgggaggtcaggtgcgcgcggtgatgacagttccagaaggtcacgtgcgcgcggtcgtgacagttccagaaggtcaggtgcgcacggtgatgacagttccgggaggtcaggtgcgcgcggtcgtgacagttccgggaggtcaggtgcgcgcggtggtgacagttccgggaggtcaggtgcgcgcggtcgtgacagtgccgggaggtcaggtgcgcgcggtggtgacagtgccgggaggtcaggtgcgcgcggtggtgacagtgccgggaggtcaggtgcgcgcggtggtgacagtgccgggaggtcaggtgcgcgcggtcgtgacagtgccgggaggtcaggtgcgcctggtgatgacagttccgggaggtcaggtgcgcgcggtgatgacagtgccgggaggtcaggtgcgcgcggtcgtgacagtgccgggaggtcaggtgcgcgcggtggtgacagttccgggaggtcaggtgcatgcggtgattgttccggaaggtcaagtgcatgtggtcatagttccagaaggtgtccccggggcaggatatgttttcctattttccttggcttccggggagcttggagcctgctttcctttgggtcctgggctgattttcgggcaggtgctgggatgcagtgtcctgggtgctgcagcatggctgagcctcggattctctgtccagggctagctgtgttcaggccgcgcatctttagttttggggcatcgcaaatcctcctggaatctgatgaaagctgtggaccctctgcttgtggcggggggtcatgcagaaaactttgagtacagtttcaggagatgcacggaccacccaagggcctggaatcggagcccccacaagacagggggtgtgctctctgggccagcgtttggagcactctctggctcttggagccctggtggggcattcccagcagcttgcttcatttcctggacacgtgttcttggctgtggtttatattactctctgtatgtaaatgtcataggttttttttcttctagtaaaattgttcctagttagcacagtggaatcttgaaacaagaaagccatctttcatgaacagtgtgtggtttccaggcttagcccatggagttggagtgacaggtatggcagagatggggggtcaggctgcgtagaaggtgtttgcgccccctaggtgcaggtgttaatcctcaccaccagggcgatggtgctaggatgtggggcctttgggaggtgatggggctgaggactgagcctcatagtggggattagtgccctgatgaaagaggcctcagagagcaccctcgcttcttctaccatgtgagcacccagcaggaaggtgctgtccaggacccagaaagtgggtcctctgcagacaccaaatctgctggcaccttgatcttggacttccagcctccggaactgggggaaagcaatgtctgctattgatgagccgcccaagctgcggtgctttgttgcagccccaacaggctaagtcaggaaccgtgaacaggagacctcccagggagtctgctcggaggggggatttgtcgtgggggaattggtcattgtgcctcagtttccccattgttggggaagtggtgcccatggccactggcaggcccccccgggggccagcacaccaggtaggaagaaatgcaagccccaggctgctgagatgcacagagccccacattctgccttcgggacgtctgtctagtcccttgtcttacaaagggtgggcaggtcccctgcaggactcagcagagggagagacacagtcagggagcggccagaggggtgacgtgcccggctgcccacaggtacaatggctccttcgtgtcacacatgggtgtcggcgtcatctttcggctgggtgagggaactgcccagctgcccaagccctgggttcccaagtcagagttgctgggattactgggcagggaggtggtcccgcaacccacaccggggcagtggcaggaagcacagacacacacagcacagcgggccggcaccgccggggtgggttgtctgggcttggactctttctgtgcacatgctgatgtttgttgataataagaacagaaacattttctttttttttttttgagatggagtcttgctctgtcacccaggctggagtgcaatggcgtgatctccgctcactgcaacttccgcctcccaggttcaagcaattctccttcctcagcctcctgagtagctgggattacaggcacgtgccacaacacccggctaatttttgtaatttttagtagagacggagtttcaccatgttgtgcaggctggtcttgaactcctgacctcatgatctgcccgcctcagcctcccaaagtgctgggattacaggcgtgagccactgtgcccagcccctccccttttttttttccttgagacagagtcttgctctattacccaagctggagtgcagtgacgcgatctcagctcactgcaacctccacctcccagattcaagcaatcctcctgcctcagtgtcccgagtagctgggaccacagatgcgtgccatcacacccagctaattttgtatttttggcagagacaggcttttgccatgttgcccaggctggtcgtgaacgcctgagctcaagcgatcttcctgccttggcctcccaaagtgctgggattacaggcgtgagccaccatgccctgcccagaggtgttttcaagcatgtcctgtgcactgggcctggttggttgatgctcagtgatgtttattgaatgaatgaatgaatgaacgaacaagatccagaagtctgagggtaaacatggggtgccagcatcttgtcttagcccagcccgttgttggggggttggcagagtacctcaacccagacccctgtcacctgtgccccctgccccccctcacgctcctccctgtctcccccaggacctcccactctcgggcaaaggccgaggcagccctcacagcagctcagaaagcccaggaggaggcgcggatcgccaggatcactgccaaagagttctccccttccttccagcaccgggaaaacggtgagtctcgccgggcctgatactggcatcgtggggagggggtgcgtggatggctgggcagtcctggcagcagatgtgtcctccagagcgggtaggcttagatgggctcagccccagctgctcccctgcccggtgtcttcctctcccgccgaaggtgcttgtttgtgccaaggcctggcctggctccccgggacacaggacatgtgtcttggcaggtctctcccattcccacagtccttggggcaccgcgtgttgcttgccggctgtccctgacggtgaattcccacctgcccagcctgtgctgtctgctgcccgccctcccccagtgttgttctagaaccttctgggatgatggaactatctgctgggtccagcgtggcagccattagctgggtgtgtctgcggtcctggctcttgacctgcctctgatgtgaactaacttaccattaaacacacccagtggctgctgggttggacagcgtcacaaatggcagctcccgctgtgcccctcggaaagagctggaagctgctgcctgatttaggaacctcgtcctcccttcgagggggggatcatgggtgatacggcccagtgacagtggcgggggcgtggagggtgtggggtgggtggcggagaggccgtggccagctgcctcccatctcctacctcatcttggaggaagcttcctctgcaccaggaggccccagagaatggggttaggagcgcgccccctcaacccgagctctgaccggtgagcggtattcggatgaggctctgcgcgctggaggtccgcacctgacaccacagccctgaacttgctcgcaacgcctgccactctggccaccaggacaggatgaggagcccagcctgggggctgcggggctgggcgctcccctgactggaacgcgagaccacatcatctctagaggtgaccgtccgccaccactccaagaccttgccttcactgggcgagtgccgggccctgcagagcctgcagctgcagcctggaggtcaggaggacgagcccccgcacccccaccgccttgggcagcttctattccactgcgtcccctccactctcctggcccctccagacacacgcaccccaaagtgtccaagtgggagggcaatgggccacgtgcccctgtggccattggcatcctccatggtctcgccctcaggccctgagtttccttctccctggggcccctccttgcctcgcccacgaccagctgcctgggctgggaggcggtggggcgcacacttgggggcacacgtgtagcgtgcacgtgcatgtggggagtgggtgcagtgctgcgggatggacgaacggaacagggatgctggagaggaagccagtgccgtcgggggcacctgccagaaccctggctgggccactccacgcagaatgcacgtaggacggcatgggattccacgtaccaaccctggcccatggtcgcctcagctccagccctgcctgcgactcacattccactgcctgcggcctgttttgtttcctctcagagcctcagttccatgtgtgaaaggaaggggaccagacagggaacattgaagcctccatcctgtgccaaatcccccaagagacgcatccaccggaagctcccaacgtgacttatttgggaggagggtctgtgcaggtgtcattatggaacagactttgagacaagatcagcctggattggggtgagtcctagatccacgcggcgtccttagaagagacagaagaggaggagacaggggcggatggagtgatgtcagagatcactggagactccgtggctggagggtggctggagcggagaccctggaaggaagcagcactcccgacacctggatcacggcttctaacttccagaaacacgagtttgccttttgggtgtttctacccccacccccgcgtggtgctttactgctccagtcccaagaaatgggtgcaggctcccccaccctgagaattccagttaagactctggagtcggagatgcttcctggagggctcagtcctggagtcagaggagatgcttcctggagggctcagtcctggagtcagagatacttcctggagggctcagttctggattcagaggagatgcttcccagagggctcagtcctggagtcagagatgcttcctggagggctcagttctggattcagaggagatgcttcccagagggctcagtcctggagtcagagatgcttcctggagggctcaatcctggagtcagagatgtttcccggagggctcagtcctggagtcagagatgcttcctcgagggctcagtcctggagtcagagatgcttcctggagggctcagtcctggacttggagatacttcctggagggctcagtcctggattcagaggagatgcttcccagagggctcagtcctggagtcagagatgcttcctggagggctcagtcctggattcagaggagatgcttcctggagggctcaggtccctgcaggaggggccttgggctgaccttttaagtcctgaagctgcctcctccgacagttcttgtcttcatgatacagatgcgggcccctgtgggggccgctgtgatggagagacggggccgctgctgcctcactggtgggagtccagtcctcgagggtctggccaagttggcctcacctcctgctgctgcaccttggagcctggctcactctgagcacctcggtccgatctgccacctctttgggtggcgccccggagccttctctgagcagcatcttccctggagggggcgttgggaccgtgtgttttttacaagcgctgggactggcatgagatttgatccaagcatttcttgtttccgccttggatgcattcaggatcagtgttcccagaccaggcaccccggggccttctcggctgctggggaggggtggggctgggggaagctgtccaggtccttcctcagtcgtcctcacagccaggagctgaggtcaccaatgacagatgacagaacagagcctccaagaggggaacagggttgccagagcgctcaggcaggatgtggtggaatcaggatttaaaacgaggctctgaagcctgggccatgccggcttctagagaagcaaaccatccagcgcttcggctgcagagagtggctggcgccagcctcttgctgcctgtctgggaggtccctggcagcctcccagcccgagaactctgaccgtcagggttctgcccaaggccacgtgaaggcaggaccatgaaggagcctggccatgcggtgtccagtgcccaggccacttccggtgccatccgcccccgccccagaggcaggaggactgagcgtcggaggctgcaggacgcaggtggcttgaaggcacaggaagaagctgcaggggcttcacgaggacccgccctgcatcctcaccacgaggcttctaggaacgttacctgctcagcagctcattctagctgagggtgccctcctgctggtggtgctgggagtcggggcccctctagcgtggggtctcctgggccagccaggcctgatctcggcagcagtgggtggacgacctggtgggaaaggccggggcgccatcgggggatggggggggccttgatcccagcctgctaggtccatagcgtctaaggcacaggaatgccagccccttggaagtcccatcctggccaaggaggaggtacgatgtgggtgatccgtgggcatgattgggggcctctgatggggccagggctgccctccacacaggaccctcacggggagagaggtggtggggctgggcgtcaggtgggtacgtggatgtcagcacagttctacacagaccttctctggcccattccctgctctgctcgggggacacccaaccagcccagccctgtttctggggagtgaccacagagaagcagtcattgagacctcagagtggcccacccacacccccgtgtgacaggaactcagacttgggagggctggccacccacccagagctacccagctgtgccccaagccccaggccagggccatggcctcgctctgctcagcactgcctcttagaccagcaaggaggaggacacagcagcccagcctggtggcgtcgcagcgtgccccgaatctgcttgctaacgtctctttacaaacggagggactatctggtgccacaccgagggtagccatgtctcccagaccttctcctgccaaaaggtcagactggggtacaggcgtctcccagaccttctcctgccaaaaggtcagactggggtacaggccaggagaatgtccgagcgtgagagactctaagatgggcagtggctcttggtgtccgagctggtctcatgaggtggccgccccgggtagagctctgagacctccgtcctcagagggaagactccccaaattcccacagagctctgcaccattttggctcgggcaggacggggatgctgggggcgggggtcccactgttctgtgctgagcctaggacgctacttgagatgaacgtgtaactgttccccggagggtaagaagcgccgcgttcttgggtttctcctaatggaataaagtcgggcatggctcccgtgtccctgcgttggcaggaaatgagatcccagtcaatgttcttggttctcacctcctgctgggggctcacggagctccggagaagtctcggggctagtcctacaatgctgcccctccctatccaggcctccgggtgggggctgatggggactgagccaccggcagacgacagggactctgctggctgcagagctggcccctgggtcctgtggtgacctccccttccggggagccccgccctaggacttgaagccccagcagcctcgaaaggtggggagggaagtcggctcctgggctctcacgctggccccggcactggctgtttctcagcaagactgtcccagcaccctgagacacagtcccaggcgggtaggggtgttggcggccttgctgtgacagctcggcctccccagacaggtggtcagctagggtgaggggcttcctcttaccctcaggacaggcgagtcagggttggtgggacctgagtccacaccccagcgtcctcacgcactttccgagccttgggtctcccttgtagcctgggagctgctgtccgcccttcctgtggtgcctgggcctagccagtctccctccaagtgtctgtggggtggggaccacgggggtcccacagagggctttgggagccacggtccccactcccctcccttgcctgcagcctttcggtgagtgggaagcgcctctgctgccctgaggttccctctggcgccctggcccggggaccgcggcctcgctgtggaatgtgctgggtaacgccgtctggcgtcgtcttgtgtccccatacagggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacggtgagtgggcggccaccaggctggtcccagtggaggcaacatccacctctctgctgacctggtgtttcctgagggtttccagcaaggtcactgctcccctgttcctctccaggggtggagtagggtgggggtacagccgggagtggtggccctcaggtcgctgggaccctcccctaggaagccaggtggggcaggtgtcatacctctttccgtgagaggctgcccccaggttgtccagaaagcacacgaaactcctggtttccaggcagcatgggatccctgcgctccccgcaacgtgctcaaccccagctgctccaagagtctgtgcccctggtcagtagccttgggccgtgagatgaccgcttgagtgtcctgtgtcctggataggaacccagaggcgaaacagctgggggcaaggctggccctggggctgggagtcaggtctggggttggggggagctgccagtccaggtttctctcacccatggggggtgttggggttggagccggctcccacgtgaggcccgctgtgtgcaactcaccgtcagcctcacccagcaccccccccccaaattcgttcctccagggcaggcagcttggagggaagaacagcgtccccctgggctagactcggcgcgaggctgggggtcccaggctagactcggtgtgcgaggctgggggtcctggtgcctcacacagggctggcctccccttgaagggaccttcactctgcaaatcccaccctgctcccttgaccagtgctgcaggaatgaagggctttgggaatgaagggctgtgggacggtggctacataggatctgcgcacggccaggccctcaccccagcagggctctgctcgctcgtggctgccaggcagtgcgtggtgctgaacagaagtgctgcaagccagtctgcccctcgggtgtgaggacgcaggggggtgtccgcagggggcgctcagggcgtgtgggccgggcaggggggaccattggtaggtttattgtcgacgctgcggcaggggtcggtgtctgtccctgcccctgacctaggggagctgtggttttctcctcctgccagccccacccccagaggggtcaccgcgtgacacccctttgaaggggcacgtcctgccgggcggcaatgcctgtttctgcctctccttggaaccactgcggacgtctgtctgtcctgttgggttcctaagatgcctccccgttccccaaagcccacagagaacagcccctatgctcctgctgggaccaaaataccagctcacacttacaacttgattttccccatcgcagccggagatgtgtgcgtggctgtgcgcgcgcggttattttaggaacagccaagcagtgggcagggtgggaggtgtagggacgggttctatttttagcctgcttaatgcactgacacttttgggtgcttttaaatgaacctccctgggggtcaatgcacaagctggggacaagtgccaagctggcctctgggatgagttagcgacacgcagggtgctacatgctgccctggtcctgcccggtctccagctggggctaatctggaggtcccgtcagctgcagcatcatgtcccacccaccctggaggatgccagctgagctccttggaagtggccaccctggggtacctggtgctggtgcaaacaaggtttccctccctgtctccctccccgtctccctccccacagctttggagctgtgttttctgccaggtctgtgaggggagatggtgtgtagaggcgcggtcaatcctaagcactgttccaggccctgttggtgggaagcaggaggggcccgtgccagccggcatccatgtcaggggacaggtgtcagggcagtcgggtgccaggctgggctgagtgccttcagtgccaccccctcacaggggtacagctctctgcagtgtctcccctgggccaccagcagggtctggggtgctgtcttctggccatccccctccaccattcccaacatgctgcagagctcacacgccagaggccctgggtcccactggccacagatgggcctgggattctagcccacatagggtcccactggccacagatgggcctgggattctggcccgtgtagggccctggcaattcagggtaaagtcccttaggatggaagcacaggttctccctaccgctctactggtgaaggaactctggccctggctgtttccctcttggtgaaatgatggatatgacctgatggtggggtccagggttggaggatggctggggagacagaagcttccctcctgcgggcagccacgccctcgcccacagcgtccgtacctgcttcccggcccagagcacgggctggactgtggcagaagaggtgccactgaccaccccactctgtcctgctaccccactacaggctgactagcatccggcccttcctcctcgctggggtgggggaactttgcaccaggggtggcatcagtgggcagggctgggcccttggctgttctctgccccctgcaggctggcccggcccaaccaagttgtcatggggcccaagactcacaatacacctgcctgaggccacgatgccacggaaagctgggctcagggcagcttgctttctctctggctgagtggaggcccttgctgtgtccacaactccacttccatctgcgcctcaggtccctgataggctgggaggttgcggagggtgtgggcctggtgctgctgtggctgcaggtgccccctaggcagcacctcaccctctgaggaccctcctctctgagctgcatcccaaggacagtttacaaagccctttgctgactggggttcagcttatctgttgagcaaactttttctttaaaaagtttcttggccaggcacggtggctcacacctataatcccagcactttgagaggccgaggcaggtggatcacctgaggttatcagttcgagaccagcctggccaccagggtgaaatcctgtctccacttaaaaatacaaaaattagccgggcatggtggcacacgcctgtaattccagctactcaggaggctgaggcacaagaatttccagaacccgcaggaggcagaggctgctgtgaactgagatcatgccactgcactccagcctgggcaacagagcgagactccatctcaaaagtttctcaagccagtgtctctagggcctgagggctccaatccccagtgtgaggtgaggcgctcgggcctgggagctgatgcccagcatacagtcgggggtgcccctgccaggtgtggtgcagagcacggcgggggtgtgtgagacctgaggatagcgtctggatgtttctctcacgttaacgggaatgagataggctcattggctgctcatccccaaatccaaatggaaaaccgccattcgggccaggcagaggcaagtactcccacccgttgccgctgccgtgttgagcccaccgtgccgagtggtgttggcaggagcctcccgaggaagctgtgccaacgcaggagtggtcagagcctgtccaggccacagacggggctacgatgagcactgctgcccagggcatgttgggggcagctcctggagaccacagggaggggaggtgggcacccaggtgtgggcagaactggaccaggaggaggaggggcagcagcttgctcaaggcacagggcctcagccacagggtggcgggctgggaaggggcgagggtgtggtgggttctgagtgccccatgcaacggctgttttgggccacgtgctcaagcaggcacccagggaagaccagcctaggtgctggcgtgaggcccttcaacatcagctacgatgctgcttcatcaggagcacagcctggggaaagaatgaaactgacccaggagacaaaagggtccccgggccagacggtcaagcaggaggctgcttcgctgccgcgggatgtggcatccaggctaggcaaggggacggcaggctgccatccccagagggagttctccgggcaaggccgtgaccccactggggctctgagtttgcatccttcctgtgtgtcaagagcagagccggccactgccagcccatagctcccatggtgcggccctggagagctgacttcatgcgggatgtctgctgttctttgcgtagctttactgagacagaaagcgtgtactgttcacttcaggtggccacagtgtacaagtcagggattttagtgtattcccagttatacagccatcacccccaattctatctagatcagctccatcaccttaaacctcagggccattgagcaggcacttgctgtcccctcctcccccagctcccggactctgctttctgcctggtgcccagcttctcacgcagcatgcactgctcctgcgctttctctgtggcagccgcggttgcacggcccatgtcttccccgctgtgtgttcatcctccactggacagctggctctgcttccactccgtggctgttgtgaatcctgctgccgggagtgtgtgcacacacaaggttttgagtggaggcttgactttgccctcttagatttaggcctgggagtggaactgctgggtccccggtgttctcatcaattctcttccagtctctgggagaggagccagcagcagctgcttcgttgtgggtggggggaagggggaggcccgttgttcgggctcccctccttaatgcaggcctgagcagccctcacctggtgccacatgagctactcagtcttaacagaccaccccatcatgtctttgaaatttgaccagaggccagacttgggggcttaaaggagtccatggaaaaccagtctgttaacagggagggggaggagagtagccatccctgaggaatgtgcatcctgggaccttcaggacaagccctggtccatctgtgtcgcacagcagcaggatgtctgcgtggtaggaagtggagggctccgggggctctgaacagctccttaccacagtggggtctacatctccttccaggtggctgcgagatgcagggcgtggtgggggtggggagaggcaggggcaagtgtcctctggaagcagactgtgggcaagactggagtgggtgtcccagccattcctgggctggggccaccgtccaggaggcgtccattccctgtgcagcaggtactgtatctgtagggcagcacccacccctgccgtcctgggagcttcccagaggggccacgctccctctccccctgcctggtgtgagcagaacacagcagagtgcaggactgcaagaatcactgcagaagggcgcccccggaaaaggctctgttgtgagacgtgtcctacctggccccggcaagcacagggaaggtggcagcttggtccgagtgcccaggctgtgcggctgaagggggagtctggcacttggggctccggcggaggctgaggacttgtgagccacttcagggaggtggtggcagcagcattcaggaccataacctaaatccaaggcagctcgcaattggacacagtcctccagagccagttggcgtgaggggtttgttgaggaaggtgtggtgagggggggttttgttgaggacactgtgctcacggactttgggagtcctctgagttccagggcctctctgctgggctgcatctgacactggccatggcagccatgcgggcccttctgagattctgaggtcccagttccacagggcaggagaagcctgctgactggcacaaaggccacacgcaccgagacgtttgcttgcagggaggcctgggtggttctctccaaggggaccctgggagagctggtactcagggtgtcggggccacaagggaattccaagggaattccaggaccagcaacctcagacgtacaggcagctggggcttctctcccgcgtctggacttcacggagctcaggttctggtgggcctttggtgtccaagcgtttctaacatcctcccgtacgcttccacccccgagggtctgctagcttggtgaaaagacgtgggtgggaggcgtggtggcccaggcagagccccccgcagctgtcgctcacctcttcccctcgctctcttccagggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagtagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagcatgttccagttaaattcagttttattgttttccgttacatgttcactccctgttccttctcgccgcctggtctggtgggggcataggagagggagggaggactgaaggtcatacatttctgataatgtcgctttctaaagggctgtgacatttttgtacatcttttccatcttttagtagcaagtggttgctgcagaccagaagtgaaccaaataaagactcctgctctgtgcagctctcagactcctgctctgtgcagctctcacaaagatcacagctgcttttgtacattccagtaactgcatgacacaaaacggtacctgtgagcaggaaacacattcacaccatgagacatgcacagaggcaggtgtccctgagcgaagttgtgcagagatctaggcctaggggcagtcagctcctgccgcaacacaacctagaaaaccaaggcgagaacggccccttgccttccagcagcgagggcagagggcaaagccacttccctgtgaattccaggaggattcaaccaaggctaaaatgccccgggtctgagagaatcgaatctttaattggtttccacatggggtgattaagcagaaggctgcttcccgcctgtccggagcctcggccttccctgacaggcacgcagtccctccgcccaggcccaggggacctgcttccctgcacacagtcgggcagggcaggacagcatgtgcccggctggctgctgctgcatggagaatttgacgagttttcattaacccgagagcagcctggtgagagccattttccgccccaatagcttcttcatgtttcacctgtgcacccgaggccaggaggaagtggtggcatcccctgcagacagcagcgcggtctgcggggggtgggtgtggacagcccatgggccaggctggcgtctccccacccttacaagcctgcagacaggtccacctctggcccaggaacagatgagccccgccctggaagagctggagaagaccctctgccccggggcctctggtgaaactgtctgtgcccacggctggcctgttttacttaccagcctctgcacactggatggactggtgctttctgaagttcagtagcgcacagaatgtgcctggataatttcgggaactgaaacagtctctttatccattcttttggatctagaaccattacctcacaggattcccaaagatacagatcaggcatgcaatgcctgagccgagctaactgacaagacagtggtgatgtagaaaagcagggcagggccgggcgcggtggctcatgcctgtaatcccagcactttgggaggccaaggcaggtggatcacctgaggtcaggagctcgaggccagcctgaccaacatagtgaaaccccatctctactaaaaaaaaaatacaaaaattagccaggcgtggtggcaggtgcctgtaatcccagctactgaggaggctgaggcaggagaatcgcttgaacccgggaggcagaggttgcagtgagcagagatcgcgccactgcactccagcctggacgacagagtgagtctgtctcaaaaacaagatacacactgtagaaagacgggccctcccctgcattcactcagctcgctcccctgtaaggccccaagccaggccatgggccagcggtccccgggacgtccatactccaggctctaaccacacttgctccttttcacttgtagaagcacatggccaccgcgtctcacggagggccatcagtcacccccaaggcgctgcagacctaaagtgtggagaactcgagggaaatgaaatgtttttcatacttttgcagttcaggttcttggttgtcctttactccttccccgggaggttttatcgacagctggacccgtcggactgaagagaccctgaggcctgtggtggtccccaagctgctggcgctcctgggccgtgtgcgggtggcaactcccctcacagtcttcatgggacagtgcggatttcacctcatacgtgcgacagacgctctgcaggagacagcggaaggaccgtctccctcctctaggtcatgctcactttctctgactcttccgaagtttgatctgactgttcttgcctttggtcttggaaacttgacatcaaggtgcctattagattttcagtcgtcgccttccatagctgcaggtgctgtgactgtttctgccttcagccggccgacagcaccgggcgcaacaagcttcaggacatcatgatgccgccctcctgcagtacctttaacctcgcccgggccagggtctgcctccagcccaggaccaagaccccgattccagataaggcggagggaggagggcagggggtagagggaggagggcagagggtggagggaggagggaggaaagagggtggagggaggagggcagaagaagagggcagagggaagagggtagaaggaagagggtggagggaggagagaagaggtggagggaggaaacagggtggagggaggagggagaacgctggagggcagagggaggagggcagagggcggagggaggaggttggagggcggagggaggaggttggagggcggagggaggaggttggagggcggaggggaggaggatgcagggcagagggaggagattggagggcggagggaggaggttggagggcagaggggaggaggttgcagggcagagggaggaggttggagggcggagggaggaggttggagggtggagggaggaggttggagggcggagggaggaagctggagggcggaaggagtcagtcaactcaggcacctggttggcttctctcgcgcccaggccgcgtgtcaggtgaggcagtcggtacgcagaaactgaggaagcgactgtccccaggtgccaaggaggttgctggctcagccttcaaaacaagcaaggaagagtgcagctgcatttgttgaaaaaaagccaggctgtattttcaccatgtgccccctgccttgaaaatgaactacggaatgcacagcgcgtggggggtgggtgctggaaagggacagaacaagggtccgtggcaaccacaaagcacctgcaggccagcgcttcccgatgagcagaggcgggggctggcacctggcgctggctgcagacgggaagtcaacgccaccaaagcagaggacctcagccacccaggttagcaagagggtagcagggcgctcaggaacaggtgaagccatactgtggagagaagctgaatgctcctcccaagcttcagcccacccattaggaacaaatgctctttaagtctgtttcttcatgaaacccaaagtggaagtgcctgagctgtgaatgcggccacagcgttcatgccagcttgttcccaagcctaggagaagcaagcagccccgtgacgggcacaggccacagtgtgggcgtgagctcaccccatgtgtagccgggtgctgggcccaggccgctgggtttctggggtcggcagagtgggccaggcaacaacctcacatgcctacctcactgccactcgtccgcctcgtccactcctggcatttgggataaacatcctgtctcagacacacccttctcgtgcgcccatgccacctgctcaggcctatgccgcccgcccgtcctcccaagcgtgcacacccgtccgccatccttctcccgtctgtgccccatgggacagaggcctccagctgcaccaccactgctcgttaacagctgccatccacaccgaggaagcctcttcgagcccagggagtggaggatggggctctgctgtgcacgtgctccctcgggccctcccagcagtggtagatggggctctgctctgtccttcttggtcatcttcctgggcctgcaacaaagctcagcccagcagccaggcagctccttacagaggctaacgccgggtctggtccctggtgaccccaggctgctgtgagaacttgtgacccccgagatcagaacagccttcgggtcccagagcttcccgcatgatcgtgtgtggaacagaccgggagattccagcagatatgggttcaacgttgaccaccaaccttgacaacccaagggctgcctcccctgaccatgacagccaactcctcctccacagtggctctgccaggcgccgagtccataaagggcagccactgtttggcaaggagggccggtctgccgggggctcccaggccctggggtcaggctgagagaggaagatgggtgtgagggtgcaggggcaggggggcgggccctgcagggcagtgcctggcccgtcctgcacccccagcctgggaacccccggctttctcgcttgggcctctggggagcccgcgtccccaaatgtagccacatcagagcacacttctccggcagcaacttcccaggcatgtccgtggcctcctcgggggcaggcgccccctcctggacgctgagctgacctctctagcaggactctgctcatctgcaccatttgccatttccacagaaaccctgtccccagagcccggcggagaaaaaaaccacaggggcctctctgctcaggggagccacgcggaagaggcaccctcgctccagctgccaaagcaactgagcctgctgcaaacatctctgtgaactcggacaggaaacagtgttaacctgtgtttccttccaagtcggccctggcgcatgtgaactgcttgctaatactgtgtacaatcacgccgtgcaatgacagagagaacttttcttattgatgaagtggtttaaaaagttaccctgagccttttttctttgcttttaagctggaaagatagcttgattacttatgaaatgaaaaaaagttttcctaaatgaatgtaacagtttaaatcatactgttacgaaaacaacactgtcaagattaaaaagaaattctgctccttttagtaataaacaatgtcgtgtgacactttggaacgcttctctcgttacaaaccagcgtctttactgaaggtccttccgctgcagagctgcgcaatggatgtgtggacagagctagtcggcacgtggaggctctcctggttttcgagcaggaaacgtgctgtgagcaggaatcgcgagtgagttccatggcgtccccgggtcagcgcgcgtgcaggaatcgcgagtgagttccatggcgtccccgggtcagcgcgcgtggggtcctgtctcgctggctcaccactggtggccagggcatgtctcccccagccctgagtctccgcagtggtgaccagggcatgtctcccccagccctgagtctcccggcagtggaggcagcgtgggcacagggtttgtcacagcctgtaagtgaatggaggacacaaaaataaccagagaggcaggctctgccctccgggagtgcacaggcggtttttaaaatgtgtgcgttcatgtaattaaacgtctccgtttgtttctcagggagtggttactcaatttcttcccagccagagctttgtaaacctgcgcttctcacccctcagtgaagcctgagtccagcctctaaaggtgggtcccctgggtgggctgcagccagtgggggcttggaagggctctgaaggttgagacaaggaaaacgggcgtgagctggactcagggaagccgggtcaccgtggtacctgcactgtggcccttggccatgacagtgtgtcagcttccggcagggactgcttgtgtgcctcgggacaccagtgaccaggtgtggccaggccccagatggcattgctgcagctctctcgtgaaagagtaatggaggtgactgcaacctgcgccgggagccatctgggctatgaaaacgagactggcctccagcgcccccggcctccacacaacactcttacactgcccaggagagcagcggtcactagcaagttccttccatgcacaaaggcaggcaggctgaggccgtgatcacagctagagctcggctccttttccttccgggctggggaaccaccatcccccgctccttctggaggaaggctgactcttctctgatggaaaccatcaagcacacggcgccgccacctcactccaacacccgagtgccacgtccagcgcggggtctcgcctcgtcacctgaacgacacgtggaaggaggcgcctgtggagagccctggggagggtcctgaacgtcacggggaaggaggcgcctggggagggtcctgaaccacacggggaaggaggcgcctggggagggccctggggagggtcttgaatgtcacagggaaggaggcgcctggggagggtcctgaacatgacagggaaggaggcgcctggggagggtcctgaacgtcacggggaaggaggcgcctggggagggtcctgaacatgacagggaaggaggcgcctggggagggtcctgaacgtcacggggaaggaggcgcctggggagggccctggggaggggtcctgaacgtcacggggaaggaggcgcctggggagggtcctgaacgtcacggagaaggaggcgcctggggagggtcctggggagggtctctctcaccaacgggcatcttggtatttggtcccccagtgactttgtcacctagccaatgacatcctgcttgtaccaactcaattaaaaaaaaaatcagatgtcaaactgcaatcaacactgctctcatctaaacacaaacacaaaccaactgcctggcaagaatttctaagctcaatgggtggttcccttgatgttcattccacccaacaccctcccgaccccaaacacgaaaaaagccaccgctcatggccagtccctccaattcatcctcacacagagcatggcgcgcatgggcggcagggggagcatggagaacaagacgattcatcctttaaaatcccacaaagccctgcgaggaggagctgtggccctgctgccaagcgggccggccagagtgcctcccctggtacgcccgcccaccctgcagtcaggggtctgggggccgtgtgggagggccgcagccgagggaaaggcttcctaacagccagcagctcaccacagcgaggaactgggcaagaacgtggcaccgagtacggcgtgtcccagccgcgccgcgccagcagctcccgggagacagaggccctgggctttcgtgccggccgctcacgccctacggtggctatctggccaccaagtagttcggtaaactgggccccggcagacagagcagaccacaggcccgtggggcaggcagagctccgcccaggaatccaccaccctgtgttgtgttccgcgtctcccacggttccacactgaaggggccctgttttcatcacggccgtgacagccactccatgctgggagcttgtctatctgatccccattggttctgatcagcatctttcattcaaaccaaatctttagcaacaaaagcaaaatgctttctgtgtaagaaagtgtacaagaagtttcttcctcagggctgctgtcatctttctttcaactgggttgattcaaaagtctctttttccttggaatcccacctaatcagttacaagctcctctgaaagaaaaactgtctctcataacagacaactacattgaaagccaacaagatatttcctcttcttcctccaagagcaggagggaagaaagaaccggccacacaatggcgtccatcttctggacaagggctggagccgcagagccgggcagggcctgggcgggggcgggggcgggggcgctgctgcctgcgctctggcttctcaaccctgtccgagcctcttccaaccagcttagctgagagtgtgaggaaaggaccttgattgcccagcactcagacaaagtgcccagaccggccgccaaagccggcgcaacgcaacacaagctgcagccctgtgcggggtcggtgcaacacaaacacaagctgcagctctcagggggttggcacaaggcaacacaacctgcagcctgaggggaggaggggtcggcggaacgcaaacacaagctgtagcccttgcggggggcgggcgggctgccggcgcaaaagcaaacacaagctgcagccctcgcgggggggtcagcgtaatgcaaacacaagctgcagccctcgggggggggtcagcgtaatgcaaacacaagctgcagccctcgggggggggtcagcgcaatgcaaacacaagctgcagcccttgagggggtcggtggcggggaggggggtgagctggcacaacccaaacacaagctgcagccctcggagagggggaagttggcgcaatgcaaacacaagctgcagcccttgggggggtcggcgtgggggggttggtcggcacaacacaacacaagctgcagcctccaggggggtcggcggagggggccggcacaacgcaaacacaagctgcagccctcgaggggggcggcacctgcagcctcactcctgtcagcactgccacccacatccagacgcaccagacaggtgtccccaccagggaagaggcagtgcccagagccttcccctttctgatcagcattcccatcaagtgtcaagtgacaatggaagcctgaagtgaggtcacaccgatggcagtgggcggggcccttggggccagttcaagtgccacccaccgaggcctcctgaacacccggctgcaccagggagctcagcacgtgccctgctgtgcaagagctggccgagtgcccctgagatgatcctgagaggcgacacttctcaagccatcgccccaaggtgacctgggttttcctgggcccacctggagccgtaaggatgaagaggccaagggagcggggaggtgctcacaggggctcgccaccaagtcagcttctagccctctcccagcggtgcttccacccgcccagcaccggctccgccaggagggaagtctccccaccacccttgttttcaactcccagataagaaatgggaccatagtgaatatgtcatcagccccgttatagaaaactaaggatcctatattcccactgttcaaaatatttaagatacacaaaaactgcaccaggtgtggtttcaatgctcaacttttgaccccaattatgcaaatccgaattggccttcagtcttggactggagcaggcctaggttgggagttagcgcaccacagccttcgggggcaaggaggccgcagcgctgaagccaggaggagctggatggggacacctggtggcagccatgtggggacgttgggagccctcgccctccagcctcccttcctgtcgctttgcaaatgctaatcctaaaccctaaacccgactgggacagggacagggatggtcccaccacagcctcccagagaccacgcggcggcaggtggctcccaggagtgaggccgctgcacacgaggagcccccaccacgagacccccgtgtgcagccagccagcggtgcttcacgtgaatgagaaccgggaaggtgtgcactggccctggtctgcttttcagtttcaggcatcagaggctgatcccaagtgtgaatatggatgggcagtcagggccctcttctggttttgcagaaggaaaggctcacaaagcacagcatattccggggtttcgggcacagaaacctgcttctcgagggtccttcgtgtccaaggttccaccctccagtgtggggtggtctcgccctaggcccagccctggcccggggcagaggccccgggaagactgcggtgtgcctagggccacacagaagacaccctccgcggtggtcttgtttcaagtccaatttatttcacacaacacacaggctgctgagggaatccacctgcactgcactcagttgaacttccggcccagtgccgcgtcagagactaaaccatgggagaaagttcacaccctggcctgggccacccaccttcagctctctcctgtgcgtcaggacgcacgctggccccaagagcttcactcaacacggctgggtcctgggcggacgtgggcacagcacttgccaggcgcccctggcaggggctcttctgatacgcaaggaggaaggaatgagagagaaacacattcagccgagggggaggcccgtgcaggaggggtagagagaacaccgggttttcagggaagacctcatcaaagagcccacaggcacacggcactcattagcaagctgcccaaattactccacacaccaacgtttttaaaaaatttacaaagctgaattccaataagcatccgataaacatgaaaagcctttcacgaacacccagcagccgcgccacccgccagcccgagcccgctcacctcagtcctccgcaccgctctcctctccgctgtcttcgtcgtcgaccccaccctcggcgccctcaacctcctcactgtcctcttccgagtccgtctcctccagccactcctgagtttcttcaaaagcagaatgaacgcacatacacgtcagcgcagctgaggcaggtgggggaggctgcgggacggtggtggctacgtcctggggggattccattttcttaagaaccataatgtgaaacctaactcctcttccccgacccccttcagatccacaaaggaaacagactgcgttcccctgggcttcaggacagagatccgagacggcaaacatgcaaaagcacccccataacggagcggctggccaacggggcctcctgccaccctccaccccggctcacggtgttctcacaaaacagcaaacatcctgtgccaacagttcaccacctttccctagatttgtggattttgctttagtctcagatctttaaaaactgcatggtgactcgatcccagcagcagttggggtaaaggggacgtgtgactacggcagcagaggggccctgggtcaggcagcaaggctggaggctcagacccagggcctcggggcccggctcggacggccatccacaaacaagcatgctgtggacggagcagcagatgcacccgtgtcctgtgccgccagagccgcagctcccgtcagcacccgggacaaaggacagacgtgcccagggtgggcccccctttccacaacagggtcctgttctccgtcaatctgaccgtggaggcaggagcacaggcgagaagtgtcggcacaggccgcctctgggcagcttgcagggcttgctttcgagggacgcgacacacgaccgtgggctctcgctcccgggcacggaggcaccaagctgcctggctcacctgggtccatctccaccaaggccttccacgcctccatcctgtgcaggtccaggcagtgcaggtcgctgagggtgacctggcggtcgccggcctcaaacatgcccccatagacgtagagcaccccatgcttcacagccagcatggcgttggagcgtggacacggcccaggtgcggggctgccggcctcctcaaggctgtcttcgtcctcagaccggggctgccccgccgagcctggcgcggtgagcacctgcttaatggtgaccacggtgccatcctcggccaccacctccttgaccagctgcacaggcccctgggtgccagctcccccacacgccggcctgctaccaccttcgggctcctcttttctgccccgcctgcgtttcttcttttcagacttgggtccctattaatagaccgaggaagcagagagcagcagcttcagcgaggcaggggtcattcctgctatgcccacaaggccaggcaagggtttgcggggaccacccacaagcgtggggagtgtgtgacccaggaaggcgccatccctgactgccctgggtgcaggcactgggctgcaggagcacgctcctgtctcccactagcctcgccgttcactcctgggctggggcagaaaaccccccactgcgtgtcctcactgaggggccgctccacacctccactgagaggtggacaggcccaccagaccccacacacagggcaccagccccacaggctccgacgctcaccctgggaaaacccaatcacccacagtgctggctcccagaagggctggggaagccaggctgaggggcttcctcccctttcccaagcaagacagacggtcaggcccacaagcccagctcatttactacaaacggcgagccagagaggggcccttcctcaccaaacgtttttaaaggggagctctcaggtcaggctgcctcctgcaggacagctgtccatccctctctgtcccacttccctggctgcgtcgcaggggtcagtctggacccttctgtcacagcctttgtcattttgtcacaaaacgctgccagctcacgaggtgacatttgccaggttatttccaaattttccaaggatcactacctccagatcaacccaaagtcagcttcacattctagacttctaagatccactttgtgtctggactctgcaacagtgagtttcaaaagggaaagctctctgaggtcctccgtaatcctggggaatgtcaacggccctgagatcacagtgtgagaaccgtgacactagctggggtcaacacgctctctgaagaaaagccacaggggaaacctgtgtagactctgcttggagcaattccttctaaagtaaaagagcgaggcggactgtgggtccagaaacgaacccgcgtgtttttccaatttccagcccaggtgccaccacacgtcaaaagcagcttcaggagtttgcaaccaacagcgaccagccctccttggccctttctgggtccggctgacctggtacactcagagaccctgaggccaactgggggatccccttctgggactgtcacccactgctgtgcctgtgctgggctggccctggacagcagctatgctcacgtggacagtaaagatggtgtcggaaaccagggaagctcaagggtcataacacaggctggtccacaccaggacctccagcaaacccttctcacacagagggccggggaggtcccgggcacctcagcccagggcaactggcttctgaggtagcagccccgccagcatccaggacagactaaggggaccgtgaccaagggctctccaagcctagtcacccaggacagtcagagacggaaccctcgcccctcttgagagagctcatgggctttgggggccccaataccaaaaggtgctggaggaaggcagtggtggcagggacccaagttagggctgcgcaccacggcgcatgctactcagaggttgcactaccttcagctgtccctcaaaccaacggttcctggtggcgtcgtagaagtacagatcgttgaagaactcgcccgacaggctctcctcctcttcctcgtcacagacacccccgaagaacagtgtctggtgattcggggccatggccacggaaaagccagaccgtggggtgggcttgacccccgaagggttcatccgagtccaaacccacttgtctgtcaaaagagaacaaggaagtgggataagaacacaaggaaggaccctgagagccagcccaggacacgctcaggaccccaggtgccccccagaatggggtaaatgaaaaccgtgagactgtgggcaaaaactctgctccctctgcagaaaaacagacaccattcaactcccctcgagttccacccttttccttaagagagctggcattcaacagctttccacacacccccaagcacctctaaactaggggcagctacaagccgcagtggaaaggcagggattgggcagaagcagcacacacgctagacacacagaggggcttctgtggggaggctgccctgcacagggaccctccgcccggcacggggacccttcgcccagggggctgagtggcctgcaccagccccccttgggcctgcacggggaccctccaccctgcacggggaaccttcacccagggggctgaatgcctgtgccagccccccttgggcctgcacggggaccctccgccctgcaaggggacccttcgcccagggggctgaatgcctgtgccagccgcccttgggcctgcacggggaccctccgccctgcacagggacccttcgcccgggggctgcagtgtggccagcgaggagccttcgcctggggtctgagtgcctgcaccagccccaccttgggctgcagtgtggccagctctacttcaggaagggtctatgttctctcttggcacgcgcctatgtgatgtgccaaccctcaaacagagcccaatgtgcagatgtctccccaccacttctaggagacagaatggagatttttttcctccaatgaacatttaaaaaaaaaaacagaagcagcaaatggacgtattctgtgtggtgctagacgtcacccgcccatgcccagtgtgggcgtggctctggggcccccgcctcattcccaccagcacatgactgtgtgaaggaacagggaagaccaccacaagaactcgccacacagggcaggaccctctccggtgacagaaacccacacacacaaggtgtgtcgctcctcaccacgatgctttcctcctgggggctgacgagcagagcacacaggctcagggccgccctgcgggaaacagtccagcatccaggttcaagttcactggggtgtaggctggaaagtgactgaaagaaggcgtctgtcctatcagccagggtgcagtaaggcagggccctgggagaggcacctgggccttttgacaggcaaatgggtgtggactcagattaacccttcgggtatttctgaggcctcagcatgaggaattttagtgcaagaaggaggtaaaaacactttgcacaatggtcccctctcctggggaggctggagaacttgctgtgggtcacaaaagcagacctggcctaggcattgggtctcctgggtctagcccagccctctggtcccaagccacagcctcccataagagagctgtcccctggtttcctaacggcactggggacgctaaactccacggcaaacacccttgatctgtgcctcctggcatcactctcttgctctggagcagaacaaatgccattgtctccttctatttattttttattttttgagacagagtctcactctgttgcctaggctggagtgcagtggcacgatctcagctgacggcagcctccacctcctgggctagaacaatcctcccacctcagcgtccccagtagctagaactacagacgtgcgccagcacacctggctacatattttttttgtttttttgagacagagtctcgctctgtcgcccaggctggagtgcggtggtgcaatctcggctcactgcaagctccacctccgaggttcacgccattctcctgcctcagcctcccgagtagctggaactacaggcacacacgccagcacacctggctacgttttttttttaagagatggtgtgtcactatgttgcccaggctggtttcaaactcttggcctcaagcaatcctcccacctcagcctcccaaagtgctgggattataggtatgagccactgcgcccagccagtaacaaatgcaatttttttcaaaatcaagaaattaatgattgaaaagtagcaggccacccccatccccccgcccatgctccacacaggcacggcttcttccgcttcagaggtctgtgagaactgacgggcagccactggcaggaaacgccgccaacagttcatctcagcacatgacccacgcccaggaacatgaaacgtgccatgtgtagaaggtggtgagagtggctgacacatcctgggccctctgggtgccagagccatgtaaagggctgtcccctaggtcatcccatgtcatccttttaaaaagtcccagagaatgatgattgttcccctgtgctttagtaagaaaattttgattcttagatcccagtttagctaaaagcttttagaaatctaggcattctaacagccccgagttcagtaactcaagctgacagaggccacggccgttcttggaggccgtccctgtgagggccaatagcagtctcggtgatgacttctgaagttctgtgcatgagcaacaccgacccctggctgggaagcccacacccagcctgcccagctgctgcccgcaaccaccccaagagcgaggcccgtcaccacagtgccaggcagccccagtgactcctggtggcttgtactcaaggcccaggatggttctcccttcgagagctcaagacccttggaggggcccatcaggagctgctgaggggcactgtgctcactgctccacagagggctgtctgcagggtaacagcgcccgtgcttctcagtcagtccatcatcaatgcccccaaaggtgattgcccagcagacaccagggctatggagcctgtcccacccggcccaccccgaaatgagccatctcggcaggccctccgctccgggcagggtgcaggggctcaccgccagccccacatccatgggagggtgtgggctctgcctcccgccacacacagaccagccagctcccgccctggaggcacagcacctctaccttctcttccgtcctctggcttcagcaggaacatgtctgagtgccgtgtgcccttgtccacgtctttcttaactctctgcaatggaaaggaattgtgtgagaaccgggggcagctacagtggttgcttacagaccccccaaccctgtgggcgcattttggatggaaggggctggaggccttccctgtagaccagccccaaagctccaaagcgtgcctgcagtgtgctcagggctggcaccacctgacaggctttatcccccaaatgggtccatctgaagaggccacctttctaatggccgcgatcacacagtacactagagttcctgtcggggcacgcacagcttccacagcagccctggtctgtgtggaaaccaccacaggggcctctgataccattacagagtcactctttgttcctgatcccggtggatccccaccgccttccaaataacacgactcaggcttcacagcagaaatcaagttactactgtgtgcagagggcaggcactgcccactgaaagacttctccaagcttcgaaaacaacgcgctccatgtcccttagcccttagtcttctgcctcaagtgagcctcagctggaccaggtgcactgttccccagcacccatgccctacaagtcctggtgccacacccattacctgggacctaaggttgtgagggagatagccagcaaaacgctcaccctgggtggagggcccccatccatttccatctcatctttgtatttgtttgcactttaattctctatttttaatacactattttagaagttttgtatttgcagaaaattgagacgatagtaccgagagctctcacacgcccacaccaatgtcctcccagcatgaataccttcctctccttggcgcccttgtgacggatcaggaaccggcactgacccgttaccgggagcgtggcccacacttcattcactgccccagtgctccgcagctcatcctgcccagggatcccgtcgagggtcccactggccgtttcgtcctgtcgcctcctcaggttcctctgggccctgagcttctccgactctccttgtctctgaggaccatgatagctgtgtggatggctcaggagttttatagagtgcccctctactgggactgtctgctgtctttctcattagactggggttatgaatcattaggacgatccccggggtgaagtgcccatctcatcacatcccatcaagggtccacaccatcaacaggactcatcacagtggatgctgacatcgaccgcctggctgaggtcgtgtctgacagtttctcttcagctctatgttctcacagatattgacacagacttcggccacgctactgtggtcgcaggggtagtgacacagacttcaggcatgctctgtgcctcatggatactgacacagacttcaggcacgctcagtgcctcgtggatattgacacaggctttgggcacgctctgtgtctcatggatattgacagactttgggcacattctaaggtcttgtggatatttatgcagactttgggtaggctctatgtctcgtagatattgacacagacttcaggtacgctctatgtctcgtggatactgacgtagactttgggtacacactatggtcttgtggatatttatgtagactttgggtacgcgctatgtctcgtggatattgacgtagactttgggtacacgctatggtcttgtggatattgacgtagactttgggtacgcgctatgtctcgtggatactgacatagactttgggtacacgctatggtcttgtagatattgacgtagactttgggtacacgctatggtcttgtggatattgacgtagactctgggtacgcgctatgtctcgtggatactgacgcagagttcggctatgctctatcactacccatctttgttgctcgggttgttcaacgacacacagctgccactaggagcctttacagctactcttgggtccctgtgacttgcaccatctttgtgggttcctttgagcacctccttaggctctggcaccacaagatgctcaattcctcctatatactccctgctcggccctacgattcgccatttctcaagggagccctggttccctttgttggagaatagtgttagaaaccaagaaaccaggggccgggcacggtggcttacacctgtaatcccagcacttcaggaggccgaggggggtagaccatgaggtcaggagatcaagactaatcctggctaacacgatgaaaccccatctctacgaaaaatacaaaaaaattagccaggcacagtggcaggcgcctgtagtcccagctactggggaggctgaggcaggagaatggcatgaacccaggaggcggagcttgcagtgagccgagatctcgccactgcactccagcctgggcgacagagcgagactccgtctcaaaaaaaagaaaagaaaagaaactaagataccaagatttgctgtaatcccagcactttgagagtccaaggtgggcagactgcttgagttcaggagttcaagaccagcctgggcaatggcaaaaacccatctctcccaaaaaatatgaaaatcagccaggcatggtggcatgcatctgtagtctcagctactcccaacgctgaggtgggaggactacttgagcctgaaaggcagaggctgcagtgagccaagatcatgccactgcactccagcctggacgacagagtgagacttctcaaaaattaaaaaaattaaagagaccaagatttgggcaatggatgtgtaaactgctaccgggtagtattgtttctaggccgtcccatctggtagagcaaggaaatatttgtttatggttatttttcttatagctaacatgtactgtatttactataatggaaaaaaaacattttccttttgaaacatgcaaatgatccactgtccacagagacttcatatttccacctgggcctgagtgtcctaaaactaagagggctccacattggccatatggagagtgacctgaatctcaggaagtgaaaactgagtctgggtctcttttgttctccttctggaaacatctgtgcaattccagtgatgcagtttctgcacattacagacagtgattgagactagtctctttttgtaacaggttgatagaaaatggctgtcatttccatgcctgcttttccaaacctaagggcctagcattattgtgaactgaattgacacccagagacttcatctgctggggggacaaggaaggaattcagtgacgtctctatttgtcatcagaaactcaaatcgctgcttagcttcggcaggtctctgtctccttgtagtaccctgcacctgtctatatgaaccgtcttgttttgctgacagcaacattgtcttcttagaattaacagcctatgggggaatgttttatgctacaatatttaagtacttcccctccagaccatgcaagccagagaggtggagcacttcacaaggcctgatctgctcacacgggtccacaggttccttccggcacacagctggctggccacaccctctaacagggcccatggttcgacctccccaacagcttctaactcctccttctacagcagtttcttttcttgaagtgttgtgacttttcccaaaatccaacctgtctgtcttcaaagaaagtaacagacaacggccttgttgccctctgtttttctggatcacctgtgctcaagctctattagcatacaccaaaccagctttacattcacgcagtctttccacaaaaaccgattcgctctcgctctccctctccctctccctccccctctccctccccctccctctccctccccctctcctccccctccccctccctctccctccacagtctccctctccctctccctctctctccacggtctccctctgatgccgagcggaggctggactgtactgccgccatctcggctcactgcaacctccctgcctgattctcctgcctcagcctgctgagtgcctgggattgcaggcacgcgccgccacgcctgactggtttttgctggagtgcagtggcgtgatctcggctcgctacaacccccacctcccagccacctgccttggcctcccaaagtgctgagattgcagcctctgcccggccgccacctcgtctgggaagtgaggagcgtctctgcctggccgcccatcgtctgggatgtgaggagcccctctgcccggctgcccagcctgggaagtgaggagcgcctcttcccggccgccatcctgtctgggaagtgacgagcgtctctgaccggccgcccatcgtctgagatgtggggagtgcctctgccccgccgccccgtctgggatgtgaggagtgcctctgtccggccgcgaccccgtctgggaactgaggagtgtctctgcccagccgccaccctgtctgggaggtgaggagcgtctctgcccggccgcccggtctgagaagtgaggagcccctccgcccggcagccgccccctccgggaagtgaggagcgtctccgcccagcagccaccccatccgggaggtggggggcagcccccgcccggccagccgccccgtctgggagggaggtggtggatgcctctgcccggctgccccgtctgggaagtgaggatcttcccggccgccaccccgtctgggaggagtacccaacagctcattgagaatgggccatgatgatgatggtggttttgtcaaatagaaaagggggaaatgtggggaaaagaaagagagatcagattgttactgtgtctgtgtgcaaagaggtagacatgggagactccattttgttctgtactaagaaaaattcttctgccttgggatgctgttaatctataaccttacccccaaccctgtgctctctgaaacatgtgctgtgtccactcagggttaaatggattaagggcggtgcaagatgtactttgttaaacagatgcttgaaggcagcatactcgttaagagtcatcaccactccctaatctcaactacccagggacacaaacacacggaaggccgcagggtcctctgcctaggaaaaccagagacctttgttcacatgtttatctgctgaccttccctccactgttgtcctatgacccagccaaatccccctctccgagaaacacccaagaatgatcaataaatactaaaaaaaaaaaacaaaaaactgattcggctacggtaaagtagtaaacagaatctgcatgaatttttggagaagttagacttcattctaatacattattgctggaatgcaaagacatctgagagagagatcaagtgtcaacatggagggtgagcgcaacagggctggctctggaattacttagcatccggctgagaccccagagcccagcagagctgtgcctgaacgtttggaggcgcatcggccgcacacgccaagtcccaacgggcccccacctcccgcacaatgtagtacaggccacctagcttagcctgcagccacatcccctgatgagaccccacctcccgcagaagtacaggccacttagcttagcctgcagtgagtcctcaatgcagctgctttggctcacccggctgtcggctcagacgccgacccatttcaatcatcaggagaggagaagacacacagggccgccccaaggaccccgtcaccagctcaggccaggtcacagaatgggccggcggtgcagtggtaggtagataaaggccggggagcgtttgtgggagaagacggccagacgactggtcctgggagaagacagtgctaacggcagcactgatgttcaccgaaatcacaatcaggcagggatagggtgtcggttccaagcggacgtgtgtgaacacagaaaccatgggggccgctccttcccacaccactgagactgtccatccaggcgcccgaagacgactcctaaaccacctttgccagacgcaggtccagcaacccatcaagagcacagctcgggcaagcagcgaccgcacgcaccgtgccctcctcaccacacaaccacaggtgatgagcccctgcggagacgccgcgcccctggggagacgccgcaccacatcagtgcacaggaggcatctcacgttttgcggggcttgggagagagggacccatgacgagaggacccccgcccaaccacgtgtcgcgagagcagcatgaagccgcgcgccccctccaggcagagctgctgctaaaatgacaccctgtcggttacggttagcatcacttccatcagcaccacttctagtcagcttccttttgaaaactgcttcagggaagctgctccagaagcccatgcatgtgccctgccacagccgcagcctctttggggacactgctgtcgcgatggtttctgcagagccagcccggggtccccaccgtgcctgcctctccagtcactcagtcctttctcctggaaccgggtcaagtccctctgcgtgtctgaaccgggacaaggccctgcctgcttccatacctgaagctgggccccagggcaccttcccatccacatccgagaccaccttcttaacggccaacggccactcaaccccccacagccaagacttctacctgtcgctttccaagactgaacattttcagcttcgccattaaaaaatacacccagaaggccgggcatagtggctcatgcctgtaatcccagcactttgggaggccgagacgggcggatcacaaggtcaggagatcgagaccatcctggctaacgcagtaaaaccccgtctctactaaaaatataaaaaattagccgggtgtggtggcaggcgcctgtagtcccacctactccggaggcaggagaatggcgtgaacccggtgggtggagcttgcagtgcgccgagattgccccactgcactccagcctgggggatagagcgagactctgtctctaaaaaaaaaaaaaaaaaaaaaaaaatacacccagaaacaggtgtggccacaggtctgcgtgtgctggaacatgagtagaagccactgtcgcgcccaattccccagcacgagacaagctgagacaacctgcagccggtgacctgggagagctgggcacggacctcaggggccaggtgagcacggagctctggctccgaggtcagccgggatctcccaagtcacacagtccacactcgcaacaactctgtctgcttctggtattccaggagctcagctcccaagtggcaaatgaaaggacgctctggcctctgccagcatgctccacggcctcgcggtaacagtggggcgtgcagagaacagccctctcctggttatgcatggacgttatctcctgacctccaggcgcacaatgacaactgaggtcaaaacgcaggcaggaaggagggccccgtcctcagcaggactccgcccctcgctgcccatgtgtccatggaaacagaccactaggtgataaaccttccaccgtcgcgcccccaccctccccatccaaacaccatttccaaagagctgtgctggttccctgactctctaaaggaacgagaactccccctctccagaagctcccacgacaccggaagcacatactaaggactgagtctttgacacgtgaatgttgctgggtctaaggactgagtctttgacacgtgaatgctgctgggtctgctgtcccacacgctgcatctctttcgttaggatacaagtcatcatagtcaaagcactagctggacccagactgactcggaatttataaaacgtggttacgatactgaccaaagctgccggttcttcgtggcagcgcagagcctggagggtgtttaaagtcctcccaaggctactcagatgcatctcctgagggagcctgggacgggatctggttacaggaggaggaaggagggcaggtgtctgtgagttcctcttaatctacaggcaggtccagccccaaggtcaaggctctgagcactactgtccacttcatgaacccgagctcttcacatgtcaaactctggagccttgccatgcagaaccacggtcagaatgccttcatctgatcaaacactgtcaagcacgccactgtccaggcaccaggcacgcaagtggacagaagactggccctgtgagactctcttctccgggctgagagacaatggccaagtctgtaaccagcagggaggatggtgagcagaaggacaaggacacgcagggggatggaaactggggccgccctgctgagacgaggaccatgggggttctgcatagaggagacctggcctggcttgcatctctgcaggtcactccagctgctgcactgtggtgtgatcctgagggccccggggaggcgccaggtctggcaggagagtgcagtgcatggcagtgggcaggggtcaggcactctccaagccacctctacttgctcagtgaaatgtgaggtgagggtgggtggcgggtggcaggacctcctgggagcatggacggggcctgcgtgggagagaggcgtgtgcccacagtgtgtggggtcttctctggcctgggccgcgcagcagcacagcacagctgggtcatgccaagaggacagagcatggcgggtgagggtgtaatggcgccagagcaaggacgagcttcccccagccccaagctcaggtacgggccatgtaccaaagtttctatcagttcgtgcacactgccgcttcagccatggcgcagctgaccacctgcttagg

SEQ ID NO: 56 - DNA, 266102 bp, Homo sapiens
tacaataaagagatccctctactaccctcacaggactggccattgtatcatttcttttggtacagttcataaactctaaccctttatttcttctttttttctccccttctgatcttctctctttccacattttcactttcagtgctgtatccctttctcatttttccatattatagcctcacctgctagaccaactaatttttttcttatttaaattccaaaattgaattttctaatcagattcacattatcacttttgaatctcttatacttggtcttcagaagtcctgaatgtgaaatccaaaccctctctccattcattgtattctttttaacaataacaaaattatatctttgaatacttgttagagatatattcctcagtcagtctgccttccgattttcattacaatttatcatgtagtcatttcttagtttttagttgttgtgtagcctaatctgtcagctgttttctcccaataaaacaattcaagagcatatcctttatctgtgctgggatatggagattacataatacatttggggttcagatttgtttacttcaacaaatattaagcatgactacactaggtagagtagatatattaaagaacagctcctgaccttaaggagcttgcaacttttggagaaaaacaaagacatgcacaaataatttggatattacacagcaaatacagcgacagacatgtatcagcatatgagagcacagaggaatgtattaaatacatcttggaaggcaggaaaatgaggaaatgcatccagaggcagaagaaagaggcagctggggaggaaagaggaaaatagactttccagacagaaaaaacccagcagttgtgtacaataatatgatgaagatctaaactagtgtagtcaattgataaaaaggaaaaagcttaaaaaatattcagaatataaaatcagcacagtatggtgatggtgactgattggagacactacctaactacactggggaaagactggcacagcaagagaacagggaagcgatgtgcattcatattgataggctgaggctgagctgctaattggaatgtcaagtggaatagatagtagaatgtctaaatttaatgggtaaatttatggatgaagataaaacctgaagatgcatgagaatgtttatgatagctaacattttgctcttgcttgcagtttccccaggaatttttacagtgcctttggagactcagagaaactgtcttgttctattaattcctttgcctcctttcactagtgttctccactaaattataatctccctaaagattcatgccatggtttctttacctttatatccctcctgtctcctagcatagtgcattactcttagaagagagtaagcactcagtaaagtttattattgaaaggtcctcaatagcatgaacatataactaataggtagattaaacttatgtggaacacctgtggtcaacaaaatacctatatgcagatgttccattaacagataagtctttctgagatgattaaagcaaagagaaagaggtctgacatttatgacatgactttcagatttaaagcactcaaatagttgtttaaaagaacagatctctgtttaattacctccaaccaatggaggtattagatcacattcagaaagctttaaacatggtgtctgagcaataggaatttcttccatattcttctacccaattaaaacttggggtgaatactgaaaagatggagatatatctaatgaaacataaatttaaaaaaagacattttattcactttgggacaagatcaaaaagacttagataattattttaattcaattaggaaaattgaaagcaccattattttccactcagataatttctttattccttaaggtagtgtgtgtgtgtgtgtgtgtgtgtgtgtgtgtgtgtgtgtgtgtgtgtagtttgttttatctctttttttgtaaaactctccttagggaatattgcaagaattgtttttcttgatataaaaattaaagcatggagaaattccagtgaaaaggaaaggacaaactaacatctgattccacactatttctaattctcaatcacaatatcttgataggatagaggtgttttgtaggagattagaaggctttttttttttttttgctgaaattgcttttacttgatttcttttgaagagttgatctcaatttttaaaattgtcatttaaatgctaagttctgtattaggagaaaataatctagaagaatctaaagacaagtgtatagccttaggtaaagcatcagaaagcataatttaaagagggcttgctgtggaagacccttcaattcagtattattcagagtagcaaaaaaggttaggctacaatattcctgagtgttaatttcatgctctggagctcttaggtaattttacagagtatggcaaagtgataaaagttcaggaggtccatcatctataactacttctgtagaaatataggggaaactgtaattacatcctcagaaacttatgctttcaagtaaaaggcaaataaaattagtaaaataacttcatgcaactcatggctatccagaggcagctttattcaatggaagtgctctcactgctggttcacagcaaaggttcccatgacaaccaagaatacacagtacagtggtgatgctgtttgcccagggatatcctgtcattaatataaataagtagataacgatatctagtctataggtattatgatccacagctgtctataaatgacaactgcagagtagaatggaatgctcagaactgagtttattccaagttcaattaaagttttatttccttactttctaaaaacatcaaagtatatgcttctaaattattctactgtgtttcactataattttcaagtttggtttcatcctggattatgacctttcagtgagctgggacagtaatgtggccccaggtatggtgagtaagcccacctgaaatagaaggtggtttactttcttgatatgaacaaaggctattttggagttggaactctccagaacagttaaaatgcatttatatctaaaggttcttaggtgtaaaggaacatacatatgattttaagcatatttctctactagaagtcttataatatttcttatctgttattctgtattcccatgtttcctgaaatactgtgaacttattaagacaagaacaaaatgtcatttacttttatatattgggtctaggatgagttggtttcttttatatattggggtctaggattacttgatttcttttgaagaatccttgtagaatgaaccaaaagataacagataaaaatatgcaatcaataaatgtaatagcatgtgctaaatgtcatgtgtaccagaattaacacttggcctatgagagatacagagtaatatagggcccatttgaatcctaacactgatttgtcatcctgtttatttaagaaagttacatactatagtatttcataatatagttgaacaaagtatctgttatatacatatgcacattaagccacaattcattttgcatttgtaagaaattcaatattattttgagtaatttgaaggaaacacaattcttacaatttgcataactgaggttcaaaaggaaagtccaccatctcaacccagttaaatttggctaactagtatgtaccaatcaatataaacacgtgctttaaaaaagttaccctagttctcattcctaggaaacatcagctgtgtagcaccgggattcatttctgttctcatacaatttaatttctgtaataaaaaatctatgtccattttttgatgtgtcattgctgatagctttaaagtgttatacctctctcttcccctctgtcctacatttgggaaaactgttaagaaagcccatgtgttctctcctttggtgatggtgggaaattcaaaccacaccagagtccacccacacaaaactctcagcatggcctcacccactaaaagtcataaaatctcaaaccagtcattttccccctgctctctcaagctacttcagaccttcttgggaggcctgctctgctctccccagaaaaacctcataattttataagtaatacatactttcatactttcttggtaggggtatatgtgtgtgtgtgtgtgtgtgtgtgtgtgtgtgtgtgtgcgtgcgcgtgtgtttgtgtatgtgtgtgtgtgaaagtgagagagagagaagtgtagggctgctcattagtcttaacatttgaaccatattttgggtggaggcttatctgaatccacacaatggatacaacagtttcatcttctagatcttggctatttggttctcctcttctgctcctttctttgggagggaagtaaaaagctaaaatatgcattcccaggttatgcatagaagctaacctaagggaactgcagctttaatacagcaaaaagaacccagaggagagtacagaactgatgttattattagcagaagttgaaaacattcacctgcctaattctgagttggctctggcatcaacagtctttctagaatttgttcaaacagcattattagcagagggtgctgagaagagcagattaccagattactctttttatgcctacattagattggcctcttgcagtgcatcaatataagggtatgtggtatcatttccaagatgaatgttaaggaaattcacacggacaggggaaagcaggttttctacacttaaatagcacattctcaagagggaaaatgtcaacgtatggcttattcatagcacaatagctgtttaaactacagcttagaatctactatgtgccaagcactgtgctaagcattttacattttgcatatatcattattagtgccattttactattggaaaccaaaaacagatccagcagttgtcagagatagaatttcaactcagacttacctcatattcaatgtctatattctaatgaactcattctaagacttcagatttacgttgttaagactatgaagctttttgcttcctgataatctctgaatgtctaataggcctttatagctggcaagcttaggaaagaagcacatttttttttctgctggaatgtagggagatatctgtcatagctcatagatgaaatatataaaaacactacatggtatccattattcatttcagctccattgccctaaagaaacataacaccatgaatttagatgtagcaagacaatggaataaatgcttttaattttttttcaataattatgtcaaaatagatattctgggaaccgtgagaaagtagaaagtgtagaagtcatgttgttgacttcaacatgcttacaatatacctaacatatggctcagtagtttgtctagttgttaataatttgaaacattgatttgctaaattaatataaatggtttcacattacaagtaaggtaagtattttaaaatactaacttttcaagacttcattttttagaggagtgagattcacagtgaaattatgaaggtatacagatttcccatatgtaacatactagttttcaagcattaattttaataattcttatatcctgagttagcatttaaatttattttatacccttagtctttggcaaaaaaaatgcttctgcttaaaatagcttattggctaagaatccatcattttaaagaaaattatgcataatcaacaggtatatagtttaaatagaaaacagcagggggagctcaaagacaggttggacaaattaaaagttgacttcaagagtactgaaaaattattttaataaaaatttgaagagaagaaggaatatactgttaaattatgagatgatattttatacaataatttccagcaaaatagctagctaaatggaggaatagtttcccatacagaacacttcaaaagtccagaaaaaaaaattaatgcacagaatcactagacatcagtgaagtgaaaattaaaattacaatgaaataacactacatattactcaactagaatggttaaaatgaaaaagataatacgaagtgttgacaagaatgtggagctcttagaaaatagagaatattggttggaatctaaattgaagaagctacttgagaaaactgtctgtcagtcttcaaaaaatgcatgcctcataatcaagcaattccacttctggctatatacccatcagaaatatatatgcattatacaaaaagatgtatacagtaatgttcatagcagcatgatttgtaatagtttcaaataaaaataaaacaaatatttaccaataataaaatgggccaggcacagtggctcacacctgtaatcccagcactttggcagactgaggcaggtggatcatttgagatgaggagttcgtgaccagcccggccaaaatggcaaaaccccatctctactaaaaatacaaaaattagccgtgtgtagtggcaggtgcctgtagacccaactacttaggaggctgaggcaggagaattgcttgaaccctggaggcagaggctgcagtgagacgagttcgtgccactgcactccagcctgggcaaagcagtggaactctttctcaaacaaaacaaaacaaaacaaaacaaaacaataaaatgaataaataatttataacatatttgtatgaagatgaaaatgaactacaactacatatataaagacaaatgttcctttaggcccaggagtttgagtctagcctgggcaacaaagcgagacccagtctatacaaaaaaataaaataaaattagccaggtgtggtgtcatatgtctgtagtcctagctacttgggaggctgaggcaggaggactgcttgagcccaggagtttgaggctgcaatgagttatgactatggtactgtactacagcctgggtgacagagcaataccctgtctcaaaaaaaaaaaaaaaaaaagaaaagaaaagaaaaaagaaagataacttttccaaatacagtgttgaggaaaagaagctagagaacaaagaacacactctctttggtaaataatatgaatattatcttagaaatcacaatagtagttactctggggtgggggcagaatctgaaaggtacacaaatgggggcttctacagcttagcaatatactgcctattaatctaattgctgcttacatgggtatgttatcttcatggaaatttaccacattttacatttaggtttgtgtgctttttcctcttatggtataattcaacaaaatttgctctaaaattatactggatgattgctttaaatcattaaattaaaagtttttgaggcttgaaattaagaaagcttggtcccacagggataactaagtactagaattgttttttgctttgtttgtttttttgtttttttcctgaaggcatttaccaattctttgggttccagggcaagaatctaaacaaggggcctaaacagagaaagaactcacattcagacttcacagaaagtcttatacccaaaagtcaatacctataactaggcatgctacaatctttcatgcagaacaagacttgtcttggtttcaggcagcatatttaaaacaaatatttctttcaaaaatttctaatcacaagtgtatacttgcgatatgtaatatggcattggatatttgcgtggcccaaaagttgaacatttcatttaaagtaaatctatagttagcagacatgcagttacttaaattataagcaaatcctctttcgaaaaatacactttcaacacagataatttccagagataaaatactaaagagtatgagctcacatatgtaaaaaaatatagaaaatgcataaaaaaaataaacttgcctgagagacaatcagtggaataaactgcacaggtagaccaacaagattacagatattggaactatcaaggaactaaaataaaaaaaaatatttaagctgtttaaagaaatgataaaaaatttagtaaatgagcaaaagacaataaaaatcaacacacatatttagaataaagaccaatagaacttctaaaattgaatgtctaataactgaaattagaaactcaacaaacaggtgaaacaacaaattagactctactgaaggttgaattagtgagccagaaaacatatatgaatgaaacattcagaatgcagtagaaaaagaagtggaaaatatgaaagcaaggttaagataggtgaatgacagagtggggccaacataagtcttactagggttgggatagattaaaaggaatggcaacgaggcaatatttgaaacaataatagctaagaattttccaaaataaataaaagacaccaacactcatatttaggaataccaatacattttaagtaaacttttgaaaaactcaacttctggattcattagagtgaaattgcacaacaacaaagataaaaataagaatttcaaagcacccaaaaagaaaaaagtaacactggtcagactgaaaagtgatttctcaaaagacaaggtagtatcgtatttaaagaggtgaagagaagtagttgtcaacccagtaatgcatacacaacaaaactaccttccaagtctaagcacaaaataagatagtaagaaaaccacacatgaagagaattccctactattggagagtcactagagaaacttctaaaagacatttttaaataaaaaggatggtctcagatgcaaaaaaaaaaaaaatgctgagcaaagaaaatggaaaatgtgttagaaaatgttcaccaaagatgacttactacaactataataataatgataatgtctacaatgtaatacaaatatgaagagaacaaaaatctattcttttgtattttctcaggaggacagtaaaagggtaaagatattatttaacttcagccttaagttacatatttggaaaattttttagggttattattaaaataatagaattagagtttaaaacttacaaactagaaggaaaaatacaatgagaaaagggaggaaatcactttgatctaaaataatgccagaaaagacgtgaaaagaaaacaaacattagaaagcaggataaataggaagcctaaattaatatttttgaatattataattatattataaactttataattttatattaagttataaatatataaaatataggtttatattataaactttataaattatataaacttatatataattatacttttgaatataattatattttttgaatattataattataattaatccagtgttcatgaattaactaatattttcagtttagtttcaacaatgtcaaagaataggtactatacaaatatctcttctgttaaagatgaacaaaattagaaattaataacaatgtatttatttaaaaactcattcctttggaaaacatttaaaaagtacttctaaataacacttgagtgagagaagaaatcaaagggatttataaaatacttaaaacttaataataaatatattatgcatcaaatatatgggattgtcactaaagcaatagaattaaatcactgtattagaaataaaggctaaaactcaatgcacaaagcaacttacttagaaaaaataggaaaataaacacaaaaaagtaaaggaaaataataattataaaaacaaatactaataagagaaaatacagtaatagaaattcaaaaacaaacatgaatatactaattaagtagtctggcaatttgacacaaacgagatacagaaatagaggaaaagagaaaacagcaacaaaaaaattttaaagagaaaagagaagaatgggcatagtataagagacagaggtagagttccagataggtaggtaggtagctagctagttaggtagacagaaacaaaggtagagaacatcttagtagagatagacagacatagataaaaaatagtaaaaatttaaaggaggcatgacttacctggaaaaatatagagacagaagatgtaaatgaaagaactatttcccaggtatatggaaacagcaggaaaatgtaatgcatcttggagaaatcataagggtctgagtgaaaactctttagttaagtgaagcaaaaggagcaccagtgaaaagtggtggcactagtgattccagcagataggcaaggagatctgaaaatataatttctcctacttaaaccgttttttaaaattctttctgtttcactgtaaaacttaaatccaagtaccggtgatcgtaagatttaattagagaaaaatagaatttgactcatttgtgatgcaagacaaaataaaataagattaataagtaagttatcaagcaggtcttactcaaatagcatctttttggttacaaaatgacaggggacacaaatatgattgtagaatttgacctagtaatcccagttcttaaagattattttagtaaaataaaagcagtttaatttaaaagataaggaaaacttctaaggatgtttctagagccatcatttctaatagtaacaaatgagaaaagaagcttgaacatcaaaaaatacaaaaagtttcgattaagtcagaatattatgtagtaatcaaaatgatacatgagaagactgtgtcagaagaaagagcaatatttaaggaataataatgtggtttagaaagtaagataaaaagtatacaattattattatagctccattaatatgcatataaccagtcaacattgggaaggaaaaaagaaaataaaagtggttacatcttggtagaatcatggcttaagtaattttcaaagtctttttctatatataattaggaactaataaatcttttaaatattctacttgtacttgttgactaatatgcacaatggtagcagggacagaccattagcttttacattatttttgtgaattcataagaaattcacaaaactagaaaacaagtataaaattccttaaaatgagctatataagtagagtagctatgttgcttttttcactttgataaatatgaaaatgaataataattttcaaaatatatagaagagcacaggttacaaggaagtacctgctgtatctttataatgaacagtgtccagtcaattcaatttccttaggagatagaagaataggccaagttacagcccgttggacaatatgatttcagaaactttcatacatgattagcaatctgaaaacactgaatttctgttctatggattcagcactatatgataccattctaatgaggcttttaaaaaatgtggtaatttgaggtctgaagtgggttcaaagatgtaacaaagtttggcgctccagaacataaacaaaacataacacaggtgtggatgtctaaacttttgactgtacccaatcttaacatctggtttttgtgctcaactgctcacagtcatgtaaaatgtctcaactgttaatgactcagtgttaagtgagaaaaaagaaaaattaaactctgctgttgaataccatgttgtaaaatcctcatctttagagattctaaaaatattcatagactacacccttttgaatgctgtggcaacttatcccctgaaaggagcaggctaagccaagtgacatgaagatattttctctgtttccattaaggttatattcctctctgggtcagtcaaatcaaacttgtagcacgcatgtctaatgcagaatcactgatcaatcaacgtgctcttttctgaggagtcatggagctccatatgccttatgatatttaggacatattccaggaagctaacaatcaatgaaagcttttttcaaacagacttaattaaagagaagatgaatagatgaatgaacttggggtaaaggtgttcaaatgtctctccaattttacttcaagaatgtttaaccccattgaacttatcagttttggttttatcaaaccaaaattctggatatacagatgtagggttcatctttattgaagggtttaatattggatttcctatttcaaaggaatggaaactgaaaagataatattaactcagaaatcagttgacagatgtcaaatcaaggaacatttgtaaaaaaaattagactaatgttcaagtacagatagagacattttctgtaataaaatcttatcacagaatagcaatgccactgaacagacaagtataaagtaataccaaggacaaagataaaaagttatttctatttttgaaaagaaattagatgatgtctagtttaaaaaaatatgtcaaggtataagattccaatattttatttgactatacagtttaggttgtttttcccattaatgtagaagcacattacatatcgttttcaaagtctaaatgtgttcttttttaaaaaatgataaatatgaagggcaaaatattcatcttaaaccatgagataaaaatatagaggtttttcatgccgctatctttttggtaatcaatgattgaatagtgaatattggtttacagtgcagctatttaattattaatacatttgttttttcttagaaggatttaatattatttttacattttctccactaaatatatcatttcaaaattatctacaggaatatgcccaaaagaatgatcaaagcttagaaatattttgcaactctgtatcatattgagatataaaaacagaatcaagaatgatattgacaaaaatcaggttagcacatcatctagatgataggttttcaatctcctaaaaaataatgcattacattaattatgcatatttgagctttaatgagaaaacattgtaaggatgaacaaaatcctttaacatcagagctgacagagaggtgagagactgcctagttcaacctcctttcacaaatgaggcaattaaacctgtaaaagactacatgatttgtgcagttcataaccttcatgagcaggctaatgtctcctgtattttcttctgtaccctaatatctacgtagcatagaaaaaaaaatctctttgaattgttaaagtaaaatgtcttacattgaaaggcagtacttccacatgctaaagagtaagtaagaatttaagaaaaaccatgaaacaatgtgaaagaaatcaaactgagtggtaacaaaataaacacgcttcattgtggaccacaggatttcatgaaggataatgacagtctttcccatgtttctgaagttcgctgtaaagatacaggtttaaatctcagtaagagagattgagattcaggtataaaggaaaacttagagcgaaagtcagtatactagggccaaatgatttcctgaaaggttatgaaaatgataggcatatacctattagtgaattatgctaaatcactgcagaattcagtgaaaggtatacactttaaatgaaatcatgaagcaaattaagcttttgacataggccattaagtgacaaagccaaggtaagtgtttacatttttctttttttttttttttgagacagagtcttgctctgtcgctcaggctggagtgcagtggtgcgatctcggctcactgcatgctccgcctcccgggttcacaccattctcctgcctcagcctcccgagtagctgggactacaggcgcccgccaccacgcccagctaatttttcgtatttttagtagagacagggtttcaccgtgttagccaggatggtctcgatctcctgattttgtgatccacccgcctcggcctcccaaagcactgggattacaggcgtgagccaccgcacccggccttcatttttcaatttagaatctcggtctaccacctcctcttgatagggagtgggaggctgttacaaattactaggggccccacttttctcagtggcctcaaaatcattttatttatttatttatttttacctcactaggatctaaatctgtttttagtggctttgaaaactgtttctaggactgaactactgaattacatttaagattgaactagtgaatcagtgactaaacaaaacaaattttaggaaaccattctcttcattgttcaacagacaaaaaccaacgaattttatcacttactagctatgtgactttgggctagttatttaacctccatgtacctctgtttcttcatcagtaagatgctgattataacagagtgtgtctcaaaaactagtataaaagtgagttccatgtaaagagcttagaataagagggtatacacctaattcattctataatgaaacttaaaaacattaagaatcctcaaggattacatgaagccaatctgaatcataaagacaggttaaaaagtctaaaccaaatgttagcaaataaagcagcaataaatacatatttttctatgtacctatatgtgtatgtatatttgtgtgcatatggcatgaaaggctttaaacatgagatgttctaataattcacaatgttaagagattaaaggggaaaaaccacagaaaattattcaactaaacaaccattcacgataaaaatgtatggcaaatttggaataggaggaagttaccaaaactaatcaaagatatctaatcttgatggtgaaatgtggaagcatgctctttaattgtagacacaagtaaagaatgcttgttctctccatttctatttaacagtcttttgaaagcattgctttttttggacaagtgtcctcactgtcacctgggagcttgttagaaatgcaggttctcagtgcctgacctaccactgaaccaagatcttccttttaaaaggatccctcagggattcatattttaaagtcagagaagcatccgtgcagccagtcaataaatcattttaaaaagtggtataaaatatagagtataaaaattggaatggaagaaacaaatttttgttattcacagatgatacgattgtctacaaagaatacctaaaagaatcagaagaaacatcattaaaagtacatcaaagtttgaaaagtttctaaatatttgttcgatataaaaattattagatttggatatagctgcagcaagcatttggaaaatataactgaaaattgttgccattttgtaatagcaacagaagtctacagtggatgtgaataaaaaatgtataagatcttcgtaacaaaatgtataaaatgcactgaataacactaaaggaggcaattaatagagggatacgccacaattatagctagaaaggtaaagcagaccaactgtactgatgcgtgtcaaaggtaacactaccagtcagtggaaaaatgatggatcagtcaatcgatggtgtggaaataactagttagccatatgggaaacatacaaaagtggatttcttctcacactgcacacagaattcaattccatatgtaaaagaactttacggtgaaataaaaaacttgaaaaatttttagaagggaaacattattttaactgtgattcatgaactatatgatagaatgaaaacaatgacattttatatcatctgggacattactagatgtaaaataattaagtttattgacctctaaaccagcccaatagggaaaaagggagtaaaggggagcatcttctaggcaaatgatgttcccatacatagacttgccagagcatttgcaagattccctttagaatcgatgtttggtctcttgcctatccctcctccccaggcagtcactttctctggattttttttccctctttctttagcttttccttctcagtcctggcaataggccttcaacaccacaccatcaccactccaccaattctggagggatatgattttcaaaggaacaaagtttttggagttgagttccagcactaacatatgtatggacgaagataacagtctacagctttctgttttcctccctattgctctagaagaaaacgctgccaagaaaaagctacttctaattttttcatagaaaaaaactgctactaaagtatttttttaagaatcattcttttcttcgggagaagatatttccaacacttgttgtgatcaagagaaattgcagaatatttttaaaattcttaaaaatcaatcagaaaaaagagtctggaagaaatttgaggaaggcttagaaataatttttatagaaaaagaaacatgaatcactaacaatatttttaaggcttaaatgtattatcagggaaattaaaattaattaaaaaattagtatcatgttaccactagattgacaaaaaatttgtctttcaaaaaacacgagagcttttataaactacatgtgatcacatattctttctccaatactccttgagaactactagattataaacatacatacacatacataggcacacacataggcacacacacacacatacacagtcatttaaggttaaaatacggtaaatattttctaagtcacttaaaattattgcctgtggatttttcatgtaaaatattaaactcttccaatgtttgaacttaatggttattgagaaatacgaaaaactattagctttcttgatttaatatagttaatattgcttataaaggaaagaaaaaatgcttggctacaaggtcatctcattttaagattacattgattaaacatgtagtatagacagggcatctaacccccatttcactagccagcactgaaaacttctttaaccttgcataaaatgcatgcatattctttgaaagtctttttttgtaaacgaagtattagatttttaatgtaaattataagaaatgtaatgtttactaatgccgtcaagaatggcaggtcaaattcacctggtttttaaagatcaaatgcctacttttacagtcacctttcaacctttgttttagactctaggattcgtttgtcacaggtttgcctatttgggccacagcttccttatatagggtacagagcagcattcaaaggtagtgtttaagtatatggacttgggtgctagatcactgtgcactaacacccagctcagacacttactagctgtgtgacctggggtaacttaacagagcctcattgagctttggtttcctcactagtaaaatgaagctgaaaggaggatatatttcatagggttgtagcagttacatgagttaaaatacctgagctatttagagcagtgcctggttcatagcaggtgatctaggagtgttattgttcttcacgttattcacatttaatagcaaatcatactgcaaaaaatggtgtcaatgtaatggtcattacaggcaatctaagttgcttttgctcttgacagtattttacacctttaaagtttccagtaaaaaagataatgctaataccatttataaaacagaagaacaaagaattccttgacaatttaaatatctaaatttattagttaaatcaattaattatttgttgttgctgacttccactaaaatgtgcctaatcgttttatgaatgtcttcctattccagtcagtatttttagcaggtttaattctcaagcattccaattggatgtgctggaatttggctcctattaactcatggttttgtcctagtgattaatttatcctaccagattgaataagtatatatgtatgtacttgtgtgtttgtgtgtgtgtgtgtgtgtgtgtgtgtgtataaaatttacaccagtggcaaaaatagtgatttcattttgccagtttgcaaggcaaaatgatgtttgctattgtatttcttttgctaaaaaaaaaaataaagcacgctcgagtatttttactgtctgcacactatttaacctcatgtcttattgtgtagctgagtcatgatgaatacaacaagcaaacatccttaatgttctgttttgtcagtgctgggctgtgcactatggtggctgcccaggaggaggggggcaggacatgagcactcacatcaaggatcttatatcaatttaggaagatagaactaaaacacccaaaacaacagtgagcaataccaaatggtttcagttcaacccatgatagtgtacaggagtcgaataaacaacaggaatgaaagaggggaagatggcaatagtcagggaatgtttcatggctgaaggggtcacttatccccaattcaggcattcgactaccagcttcatgattctgccatatccacatttctacatcatgatttttgttgtttctgcatcccctatatactattattaattttaaaaattctgtaatagactagttttttaaaaactgaaataaaatgtcttcatttaaagaagaaactttatatcacaactataaatggaaagtcagtaactcttgccataaatgcagcataaacagaacaaccttattagtttctatccagataatgttgccttcgaaaggcactaggctacaggccggtgttatctctgtttataagacaaagcaggtgttaataagtgttagagacttagtaaagccaacatgagactttctgctgtccttccttcttccctaccatctttcttcccttcctttcttctttcaactttcctctttctctctctccctccttcctcctcttcccttcttccttccatcctttagcaaatattcattgagcacctattatgtgacaggtaccattctaggcacagaggatacaacagtgaaaaaacagaaaaaagcccttgcccttatagagcttacattcttgttggatgaaagcagtcaataaacagataacaaaggatacagtaggtcataggtgctatgaataaaaatacagcagggaacgtcaaggtggaagaaaaagcatgaataggaaaggattactgctaaagtaacatatgagcgatgatctgaagggcaggatggaaccagccatccagatacttagaggaagagaattcccagcactgggaacaggtagtgcaaaggctgtgatgcagaacatgcttggcacattcagggaacaccagtgaagtcagagtggagaagtgagtgggtgaggcggacagtggtttgagaagatgtcagatccaggtcacttgaaaggggcggtagacatagatcatgtagaagtttaacagacatagcaagaatttgactttgactctagatggcatgccattggatggctttgagcagagagcaacacgatgtgaactaattactgtttttgtagaataactctgctatgagattagactggatgggcaaaagcaccagtcggaaaactggttaggagggtatttccattaatttaagagaaagatgagagaacagtcatgtgggaagcacaggaagtagtaaacaatattggatttgttgggcaaagtgtatccaccaccccccaaatacacacacacacacacaaatctctatctcagcacttatgtatttatggtttataaatgaggctgtttatgggcaggacacggtacctcacacctgtaatcccagcttttttggaggctgaggtggggggatcacttgaggtcaggagtttgagaccagcctggccaacatggtaaacctcatctctactcataatacaaaaaaattagctgggtgtggtggccagcacctgtagtcccagctacttcgaaggctaaggcaggagaattgcttgaacctgggaggcagaggttatggtgagccaagatcacaccactgcactccagcctgggcaacagagtgagattctatcaaaacaaacaaacaaacaaaagaaacatgagaccatttatggggatggggctgttctccctgccccaaatttgttgtcagtgactggcaatcatgccttattcatctgtaaaccttactgaccacagtgcctgataaaggtgcttaaaaagttggtgcgactgaatttcagatgagtggaataatgaaaggcacagaggaaagaaggctcacagtaggtatttggggcaagaagatctacgtgggaagtgcagaaaggcatgggcattgtggtgaggcacctctcagagaaaccgaggttcacattagaatggatttcacgtgaaagaagtagaactaagagaagtataagaggagaacgatttaagatgataggaaagaggccaagtttcatggaacctttattaaaaaaaaaagaaattccatataggttagatttaggaaatcaggattcggaaagggctaggatttactacataactttcattctgaaatccttacatttcaactatcaattcactgaataatgtcaatattttattttgctgcttttaagagataaaaaagagctgttcataactaatggaatatgtatatgcacacatacacacacacatatacatatatacacatatatacacatatatacacgttgtgtgtgtgtgtctgtatgtgtgtatatatatataatgtatatgaaattcctcaatttcaaagactggaatagaaacgttcctatagatatacaaggatcatttatactcctaggatgaagagacatgcatcatgaaggtttacttgggttaattaggtatatttcaagggtgattaaggaacaataggagatcactaaaaaaaaaaaaaatctctgctgcaaaataaaactaatggaaaactgaggcaggactaggacagcagtagagaatgatgcaccactgagaatgggggaagaggaattaaggcagatagacctggaagaaaggtggctggaggagcagatatcttgtctttacatcagtgcattcctgatgtataagggagacttggcccatcttgcataaagcagtcaggtcagagtaaaaataaaaacagatgtataactgcccagtctcttgctggaaacgtggagaccccaagtcttgtatggaagggagacaaagtcaacagctatttttgcaggtaaaagagaggatttttttgtttcctaatccaggtcatcctcatctcttgcctttacttatagacacagctttctaattggccttgcaggtcaacacttgcccatctgtgcaccattcttctcccagccaattactggcctctaaactatttttgaataaatagcaaatcttatattatctgtttcaacctcatttcctgacactctttccccactttaccccaaattgcataacttcctggttaattctttaaaagttgcctgttctaacactaacttcttcctccctccccaacccatctctacagttaagtttatgtcctcttcttatttgatcctgtagcaccttccacctgtctgttataatatttgatacacttgtaattctagatctgtcaccccagaatgtagaaaagtgtctggtacatggtaaacacttaatatttgttaaccgttgaaggttgaatgtttactattgatgaacatgaagataaaaagatagtagccgacaattattgagaatgaaagggtttttacactaatttacatttcagataaggtacagctttcattgagatttaaaaaaaactcaggtttgaaattattatagaacattgtataatttcccatgttcacaaatttaaaaaatacagtacactttaaacaaaacagagttcacataaagcatatttgataatcagctcagctccttggtgaaaaaaactaaaatttggaatagttaattgaatggctatcatttaaatattttaaatacttgttcttgaactataaataaccacatagaaatatgaggaaaattaaatttaagagggtgtttatttggagaggaattttaaaacaagtcttatgaatcatggtaaatacccttacaggtatactcagggcactggagtgcactttatgctccaacaaacccaagacttagagacagttgctagctgcacacaaacagtgtcactgtccactattttacacaaacggcaattgagtagcaagggaaggtgaattcctcagtcctgagttacttctgggtgtgcctcagatgtttaagctgcacattaactaactcatttaggcccccagagtaactattaatgtaccaaagctacaatttgagaagaccctttatttccaagagagctggaagaatcttcaacaattcataatacttgttcttattaaattgcgaattctgggcaaagaatcttgaggagtaaaattgcctatgccatttcacatgaatgatatacagaatgtgactctgaaatgtctgccattttcagagcattacacatggagagcttcctcaattttcagaggacctctactgctacagggaaaatttcggttcacttgagttagaattatccttaaaagggatagaaaaattcaggaatgcaacaacattgacttaccaagactcacaagttgtatacaccatttagaaaaagtttttagccttgaaaaggaacatcttgtattattgttaatatgaatatttatgaagcactatcagtaggcttaactcagtccctgctcaattagcttataatttaattagtcctaaatgcaaatcctctaaattggggtggttggcttttgaaatgaatgccaactaatatcattattgatggctcactatcttctgcttctctctctcatttctcttttcttcttaccttatacatacattttgctctcaaacacccacccttcctcaactgaaaggatgtaaatgaaggtacacctgcaaaagcagaagccctgtggtccacattgaactttaaaatccttattagcattttgtatctgaaaattatagggatgttttgtgaatttttatagatctaacacaattgtcaaatatcagctttgaaccatgaaaacatttctaagatattacgcaaactaaactctaaattgagttttctatttctatttgaatttcacatatctaaatttcctatgttgtttctgagagagctccatatctgtgctggagttggttcactgcacaacatttcttacaggtttagatagcacaccttgttttgtgctacattctctcttgggagacctcagttgtattacaatcatagatggttgcttactaatacagaaagtagaaaaaaaagctgcccctttgaaaactatttaataactttaataagctgctttgtaaataagtaaataaaaagatacacttccttttgtcaaagcaaactctttgatatggtctggttctgtgtcctcaaccaaatctcaacttgaattgtaatgcaaattgtaatccccacgttttgggggaaagtcctcatgggaggtgattagatcatggaacagattcccccatgctgttctaataatagtgagtgacttctctggagctctaatggttttataaggggctttttcccctccactctgcacttctctctcctgctgccatgtgaagaagaacatgtttgcttccccttccaccatgtttgtaagtttcctgaagcctccccagtcatgtggaactgtaagtcaattaaacccgtttcctttacaaattacccagtctcaggcagttctttatagcagtgtgagaacagattagtacagtcagttggtactgagagtagtgtggcactactgcagatacctgaaaatgtggaagcgactttggaactgggtaacaggcagaggttggaacagtttggaggcctcagaagaagacaggaaaatgtgggaaaatgtgcaacttcctagagacttggagggctcagaagacagaaagatgtgggaaagtttgggacgtctgagaaacttgttgaatggctttgaccaaaatgcttatagtgatacgaacaatgacgtccaggctgagttggtctgagatggagatgaggaacttgttagaaactggagtaaaggtcactcttgctatgctttagcaaagaggctggtggcattttgtccctgccgtagagatctgtggaactgtgaattagagagatgatttagagtatctggtggaagaaaattcaaaaggaagcacaccataaaagtttgagaaatttgcagcctgatgatgtaatagcaaagaaaaacccattttctgggggaaaattccagccagctgcagaaatttgcataagtaatgagatgccaaatgttaatcaccaagacaatgaggaaaatgtctctagagcctgttagacgacttcacagcagcccctcctattacaggcctggaggcctaggaggaaagactttattttgtggggtgggcctagggtccccctgctctgtgcaaccctgcatcccagctgcttcagtcccaaccatggctaaaaggggccaacatacagctcaggccattgcttcagaaggtccaagcctcaaggcttagcagcttacacgtggtgttgggcctgcaggtgcacagaagtcaagaactgaggtttgggaacctccacctagatttcagaggatgtatggaaatgcctggatgtccaggcaagagcctgctgcagggacggggccctcgtggagaacctctgctggggcagtgcagtaggaaaatgtggggtgcaagctcccacacagaattcccactggggcactgcatagtggagctgtgagaagagggcaaccatcctccagaccccagaatggtagctccaccaacagcttgcactgcgcacctggaaaagctgcagacactcaatgccagcccatgaaagcagccaggaggggactgtaccctgaaaaaccacaggggtggagctgccaaagtggtggggacccaactcttgcaacagcatgaactggatgtaagacatggagtcaaaggagatcattttggaactttaatgtttaatgactgccctattggattttggacttgcatggggcctgttgcccctttgttctggacaatttctcccatttggaatgagtgtatttacccaatacctgtgcctccactgtatctaggaagtaattaacttgcttttgcttttacaggctcatagacagaagggacttgccttgtctcagtcgagactttggacttggactattgagttaacgctgaaatgagtcaagactttgggagactcttgggaaggcataattgtgttttgaaatgtgagaaagatgagattttggagggcaaaaggtggaatgatatggtctggctctgtgtcctcacccaaatctcgaattgtaatccaaattgtaatccccatgttttgggggagggaacctcatgggaggtgattagatcatgggagcagatccccctgctgttctcatgatagtgagtgacttctcaggagatctgatagttctataaggggctttttccccctttcctctgcacttccctcccctgccgccatgtgaataagaacgtgtttgtttcccattccaccatgattttaagtttcctgaagcctttccagtcatgcagaactgtgagtcaatgaaacctgtttcctttataaattaccatatctcaagtagttctttatagcagcatgaaaatggactaatacacccctgcagtgataaacattttcatcttttgagaataatcaaaaatagatgtgcagcaaaaatgtcataccattgcttcctgtgccctgtgatgcacaatggagcaatgcagcactcctcactagataaacattctgaaataacagtacagggcaagcagtcctaggaaggcagaccacagagcttagaaaaagtacacgctgcagtttgaagtgcaaaccacaatgaggcaatgaggagcttatgtccactctcaatataaaacatatctctgttaagtcctcaaatgcctatggttctctgcagtcacccattaatgacaactaagggaccatgaagggggagacatggactggcattgtctgctgcaccattcctggtggtttgattaaaaaacactgaaactggagaggatatgtttagaaaataattgtatgcttgcttcaattcagcttttctctccacttttaaaatcaggtaaagccaaactcatatatattcttattatctacaacaattactgtttcaggaggttgacatgtcttgttacctaaaaccactgaaaatttgaatgttgatcaacatttaaaatagcaagaggaatcttttcccattgcttaattttatttttttgagacagggtcttgttctatctccctggctagaatgcagtggcgtgatctcggctcacagcaacctctgcctctcaggctcaagcaatcctcccacctcagccaccctagtagctaggactacatgtgcatgccaccatgcttggctattttttttgtattttttgtacatatggtgttttgccatattgcccaggctggtctcaaactcctgggctcaagcaatccaccagccttggcctcccaaagtgctgggattacaggcatgagccaccaggcctggccaattttatttcttacttgactttttttgttggtgtagccattctcctattgatagacactgttcattttaatttttgactattacaaagaatgtttttgggaaattttaaaatttttttcttctcatgccaaaataaaagcttataacagaaaatataggcaaaacgtgaatatgtaaaagtttctgcaatcctacttaccctgaaataaccactgaatggcatggtggttgttatggtgtgtgtgtgcatgcaagtgtgtttacaacatttatctttttctgagtataagcttatatgtaaattttaaatttacatatatgaataagcaaatgcataaatttgtaaaaattgaatggtactaaacatactttttataagatccttttttaaccctgtaaggctattaaaatattcaaaacactatcctttttctagtactatgttcacaaagtattcattttaaaatatcactatagaacagtatattacagcaggcaaagaagttcagttgaaagttatactcctaatatttgagagagataagaatggatgaagtttgatgtacttaatcctattgcaataaagtgaactttcaaatatttcaagccttcactgcaaagtaaaataagacctattcttatttcttcaaaaattttatatattataagtaggtaaggtatctccagctgaaagaaataattttatggccagctttccaaaccttccaaattgtatatcactttcttctcttttaattctgctgtctcagatatttaattaataagagctgctgtagcaaggggcttgtccataattttattgtcaacatttctgagtcatctacttctgatttgttttaaaatcaaatgcaagatatttggctaacatacaatcaccatgagctaggaatataacaaataaaccaatgacagccttctctgatgcacccttactttcatctgaaccattgtgctaagaaaaattagttttttattccttaaaagtcttaagtatccttctgttatatctgaaacctcaactcctcaactccttttttgttagttgaccatcagccatcaaccaccatccagttaaagtcaatgatgtgaactgcacgcttaaaggtaagcaaaattcttttaagttctgctttgaaaagagggaacaaaacccttggtgacaggagtttgtaatctaataggggcactgtgattaagtgacatagtgcatacatgtgtgccaggaaacaaatctatactgagtacaatcagaaacagagatcctatcagacatatgataaagcttgcttaaggaagcttgagggaggagtgacaatctttattatggaaaagggtgtagtttgggaaaatactattacatcaagctgggaaggacagctaagagaatggatgacagaatcaggatataaaaagagcataaggtcaaaatataaccagatggagttaaatagggtcacatttgaagtcctgccctttggttaaaacaaaaacatctaactgagcagctgccaagagagaaggagatggtgcctaagtcaagcccttttagttaagtgcaggatgtcacaacgatacgatgtggcagccagtgtctatctaatctaaagtcactttcattgataaataaccccaggatgaggcaaagaaaaaaaaaagtctctatgatgttctgagctaattggattactttaggaatttctggaatttgctaatctttgggccattaaattacaaaaggaggttatgagataggagctagtctaatggggagtcactagaaaaggaaagagatgtgatggtataatggtagccaagttaaggaatagaaaacatagggaacagacctgatggttacagatacaaaagtgtcacatgaaaatggaatttcaggcagttgtgtgctgggtcaccaaaatgtcattcccaaagtttactccatcgcacctggccactctgcccttgaccctcgactcagccaaatatgacatatctctggaaggctggcagatgcaagctgaacggttggccataagagcccagctgaaacaagagtacctgcttcagtacaacaaccaactctaaccaccaagggctcatcgaagatcttgccttaattcgttggacctatgcaagatcagcaaatgtctattctaatttcagactcactcctaaaactcactcttgggagctctgtgtggaattgggcccctcttcttctggtattatgttttcaaaactgacagggataggaaagaaaaacttatccaggaaggaaaattggatggaacatttaacatctcatattaagtctggcaatgatgactataaggatcttgcttaaataaattgtctattaatcattaaaaaaagaaagaaaggaagaaaatggaatttcacttgccctgtgtgtttccaagattcacaggtaggagcaatgctacttagaagtttcacggaggccaaagttcagtgaaagcaagaccaagccaatgacacagagccagccaatgacacatcaacactgacaaggagaaggatgtgcagcaataggggcacaagcattgacctttgaagagtcacatcatagctgtgttagcactgaaccacagggcactggtgtcttttttcatcctgaaaattctgattcaacaaaaaagtttgtttccttcccaatttaccttcctttgaactaattaaacttctatcctcttcatccctcaactattaaatatttaaaaatatgttgaccaatttaaggttttgaaataaaaacattatatgaccaaaaggtttgataaattctcaaaagcataacactgtctacttctctgtaggtatctcgtgagcaccagatactaagctcccttgatgaaaatagcttttcaaaatatgatagatatgctagtgcactgtattcggaaaaatgtgagttcatatggacctgtcaggatgtaaaaaacatgcaatacttggtgtgtttcctaaggagggccccgggtaaggccccagtgctgtgcttctcacattgaaaacacatatgaatcacctgggatcttactgcaatgcagatggttacccactaggtcagggtggggtccaagaatttctaccaagtccaggtgatattcatactgctggttcatggatcacattttgagtagcaaggtaaggcgtatttcccatgaagcaccattgcagaatgtttattactaggccaatattcacctaggcatttctttgctttatatattaacacttctattgacacagatcataaaatttctgttttcctttctttgaaaattaaaatatatggtatactaaaacttaaaaaaaaatcagacagttttttcccccaggtacttaagaggatacaaacccatgaaacttggcctcaattagattacagtggtccctcaggatctttggggattggttccaggtcttcaggcagataccaaaatccatggatgctcaagttccttatataaaatgacatagtatttgtatataacctacacacatcaatatactttaaagcatctccagattacttatacctaatacaatgtaaatgttatgtcaatagttattatgctgtactgtttagggaatgacaagaaaagtctgtacatgttcagtatatacacaaccatattattaaaaaaaaaaattggattgaatacacagatgtggaacccatggatacgaaaggcctactgtacttggaagtatcaataggaaatttcatcaaaattgatggtgaatttcacatagaattaactctcattttgtttttatttatttagcatatgtaagccggtctctaataacaaaataattacaatgactatttttctccagctctaaatttattatagcaacaactcaggatcaaatataatttgagatccctttgaaggggtataagctgttggttgataatgatgttgagtagatggtccaaaaagactcagtctgaacatcctcaattgtttgccttagaccaaattctaagtgattgtaagaattcatcttctttgaatacggtgtattgaatttcttaatgaactctccagcaaacatgaaaaagtaaatgatgttatttgggcaagactgtttgcttatagaaaaataagaatgtcatctgtggagttttgaaacttcatcctaaatcatcacacatggttcccaggtgaagcttgtacatatattctgaagtagaaactgctcttttaatggtgatattcagaatctagtcaggctgatcattgtcctagtctcagcttttagcctcctgtttccttcatctgaaatgttcttgcccttcatctcctttgagtctatgcaaatgttaacctggagggctaccctattcaaaattgcatccctactgataacttcctatgtcattccctgacttttttccttagcacttatcactatccaacatatattttttacttatttttcttgaatattgtctatcttttctgtagttttctgctgctggtgtaacaaattatcagaaacttagtgatttaacaattaaaatgtatcattttatagttctgtaggtcagaagtccaacacaggcctcaatgggctaaaatcaaggtgtcttcagggttgcattcctttctgagtgggctaagggagaatctgcttccttgccctttctagctgtccacattccttggctccaggcccccttctttcatttccaaagccaacaaagttgcatctgtctgaccctttttctgttatcacatctctctctaacctaaccagggaaaagtctttgcttagaaggacttgtgtgattagattgggcccactgggctaatacggacactacatctcaaggtctgtgcccctaatcaaatctgcaaaatctttttttgcatgtgaggtaatgttcatttagtccagggattaggcagtggagctctttgcaggggctattattttgcctatattcattggaatgtaagctccaaaaggtcacagatttttatttgtttgattcactgttatattcctagcacttacagcagcacctggtatatagtataaactcaaaaaatatttatttcagaaaattaatgaaagaaaattggattgggctaatgatgtcatgacaaacacatatttgaagtgcaggcgctagacatagacccttactagatttttttgttttgatttttgagatggaatatcactctcacccaggctagagtgccgtggcgttatctcagcacactgtaacctctgcctcctgggttcaagccattctcctgcctcagcctcctgagtagctgggattacaggcacctgccaccaccatgcccagctaatttctgtatttttagtagagatgggttttcaccatgttggccaggctggtcttgaactcctgacctcaggggatctgcctgcctcagcctcccaaagtgttgagattacagatgtgagccaatgcatctggctagcctctactagatgtttgaagagttaatcacttgaattaaataaaccttagtcctcatttgaaaaatgagaccatcactttgcccacttcatagagtggtttagagaatcagtcaatgtgatctgcactgaagtggtctgaaaattcttagctaaagaaatgtaaattattgatactatactttttaagtcggtcttagtatccttacctaaaaatttaagtttctttgagctcaaaatatcagccattttggtcacagttcactcctcagactttcagaaaccccattcaagatgctgaaaaagatatatgggaaaatcttaaagcatggcagtagccttctttggtttcttttttgccaaacataccattcctcagggtcattgccctagactgagtgtagcatgattggaccatctgagaagatggtgggataacagaaagttatttggagtcttcagacctcagtctagtccaggctctttttgactgggcatttccattagtatctccaagccaccctgctgcctagagtttatcattctcagctacatgttattaaaacatgttagcaagtactgcagtggtgcagaagaaaggccctaagagccttattgtttttatttccttaaggtaggactagaacataatttaactaacacactgtcttcatataacttaagtttataaccagtatcatagaaaagataacatgcccacaaatacttgtagaattattttgctgatctttcaaaaaatggcacttagaacttttatcatctatttttagaatatttgtacaaggaaatgggcctctccaattttattgaaaacatttgtcaattttattaaattttttaaaactcagaatttgcttggaactcatatgcttatatttactagaagactaaaaatctaaaggtttaagatagaattttctattgccttagcaaatctgtaatgcccaaattagaaaacagttatttttctccaggattgatgtaattaaaacactaaagggtgggggggtcaaacaacaacaaaacagtcttaatatagatgtggtttgtttctctgggcctgtgactacatatggatatttggaaacattacagtgtttggcgacaacaaagctattcattgttagtcaacagatatgcacactgtggtgaaaactcaaccaataaaattgttaatttaatgcagtgattctcaaagtgtggtctccagactagcagcattagtgtcacttggggtcttattagaagcaaaaaattggaggctgtaccacagatctacagaattagaaattttggggaaggggcctggtaatgtgtggcttattggcccttccaggtgattctgatgatcattagtggatgcccttttactttcttaccttaaaatatcttataatcttgtttgatagtgtatatgaaaaagcacaattgctttttaaaaggtgaaaatctgagtcagcaattaaggctaagtcatatctaaaaatcatgtgggcagagtattttgaaaactagatatttgaatcagctgaaaaagcctctgctgcaacccaaacctaaaacctcccctaaaacccaaacctaaaagtattatttattcaataacttacataaattatccatgtaaaataaacattgtatatattaagaaatgcttttcacatgttaattgaaatctagcttattttcttggaattttctcttgcattttagacatattttccagagattgattttcttgctctaaaattttattggcaacccaaaaaaagcaaaatcaaacagacaagccaacaatattctcatataatcaaccagattttttaaatccagagtcttaaaaatatgggtattttcccctgcgagttaaataagcacaaaacaaacatattgtatggtctatagttttattttagtaactggaaacactattttgcctgcattccaattgttataataaaggtgaagcaaaagtcctgagacagcctcaaggatctggtggctaattctttcaacagaaccaagggcagggtccgagatgacaaggtctgtttcagctgggtctcaggtgagtgtccagggtatacagaatggggttgaagactctttccacaagagcagcagaatagtatgcacatgaaagtaccccattaccaagaggccttgtgggatgaacctgtgtgcaatggagttacaccatccaggacttcctgagtagaggattttgggttattggtaggcaatggagagccaatgagatttcaggttgtggatttacatatcacagtctctttttaggaagatgaactccagccaaagtgtaagctctaaactgaatcttacagagcctgttgtcaggaaattctggcaatttctagcttgacaaaaggccaggccaaagcagtagtggtggtgatggaggccagaatgtgagaaacctttgggccaggtttgaatgtgatggctgaaggaaaaaataggaaacaaggtaaaatcttgggcttcttgttaagtatttattaatattgggtatgatgcttattctgcattacttatccatgcaaactattgaggacaacaagataattttgtgcttagattggtgtgtgtgtgtgtgtggggggggggtcctctatcatgtatctagctgattcaaatcatttttttctaaatgataggaacaggtgaaaagtgatatccctgggagtccgagcaagtagggatgcatttcttaaccagcagttctttaagtggaagtctgtgaacctctaaagcagcggagtcatgaaagacatttagaaaaatacagtcacctgggtcctgtccccagaaagtctgatgtcatttttctgggtgtctggcccaggcatcagattttttaaagttccccaggtgattgaaagtggataagaactaatgcttgaaaatataagtgaaggcttttttcaattagataatataactttaatttcattctgttgatttgcctaataatctgttgtgatgctaatgaaaccaaagtgttacatatttacctcctagggatgatgcaaaaacaaaaagataatatgtgataaagtacatcaagctgatacctatttgggccctgttgtcaacaatagtgtttcaactttttcctacagggaataaatacttacataaatcactgggaaaatacagcaaagtagcataatttctttgcttttacctttaacacgtgggctataaaattgtctataaaacactatctgccacaacttataataaatacatcctttttattgacataagatgggtaaatatagtttttaaaaggcatcagaggagctataaaggcaaactggatgtcaacacccattttgagggggttaatttttcttccaggaagtttataaatggcaggtcctggaaatcctaaaatcgctagatggactttgccttgcacatacttgacattcaataaaaattctggaaatgcctgaaaaagatcagcacatgtgttgtcttaatatagcacagtaacattacattgtttgggatgggttgtgctgaaaaagttgatctcttccaagacttaaagaatagtgtctgaaatttagcaacaggaaatctgggcagatgtgtaatgaaagtgctgtgaaatgattagaatatctaaaacaaagaataaaaataccatggatttggtaatattggatacacgaaaatggaatatatcaaatacacatgaagttctatctggaaaatttaaaaaattagcttttgggccaggcatggtggctcacgcctgtaatcccagcactttgggaggccgagatgggtgaatcacaaggtcaggagattgagaccatcctggctaacacgatgaaaccctgtctctactaaaaatacaaaaaattagccaggcgtggtggcaggcacctgtagtcccagctactcgggaggctgaggcaagagaatggcgtgaacccgggaggcggagcttgcagtgagccgagatcatgccactgcactccagcctgggcaacagagcaagactcagcctcaaaaaaaaaaaaaaaaaaaaaaaaaaaaaaaattaccttttggctacttttaaagattttccacatgaatgttggaactacccaactttcaatgaagaagtcttagctctatgcatttgcaatatttaacttctcccactttttccaaatctcttagatttcagctgttatgacacatttctaagacctttattcagacccttacaggcttttgaaaagactcttttttctttaatatgagatgtattgtgtacctattacactgaatggcactatagaaaaatatggctaatctgtatttctgtactctttgtgaatgacctaaatacaatgtttaccaccacaaatttggtacaacctacatgaaataagacttcagttttaaatataatactgttccacatagtatgacaaatatatacttggtatatgaaccatttggtatgctacaatacgacccacccccaatttaaacaggcttatctgaagtttacagaagatttaatatagtttactagatgattaaatataggtatggttgtgcgtgtatgtgcatgcacacatattttgctgagtggttaatataaaagctatgatagaatgtgaggataaacactgtattagctaagtactgtagagtaaaagaattcagaggacctggactaggataaagagcacaggaaaagaagatgagatttccataaaacaagctttgacagctttgaccaactcttaactgtctgcctgtagtctacattatgtatgagcagaaagtttgtatttcacatagaagctttccagttattaattaggaaaatgtttacatatggtatgtcacatgagtaggtttatctccttagccgaccaaagtaatgcagatattaaaaagaatatgttgtcagaaataaattattcatgcttcctaacttttctaatttggtaatttgaaaacattaataggatttggtcattcttaattgtgttgatgactatccttgctctctttattctcaaggctagttgaaatttatctcatttatattaatttttctgtctgtggcttctcaaaagtaaaataacttcagaagcttcataagtatggagaaaatgttaggtgaaactttgcagaatcatttataatttatatgagatttttctttagtttttgagaactatcacttgaatatgtaatcatcaaacaggtggccttccacttatttgatatgatagaagaaaacttctaacattccaatttaaatattttatttgaaaattcactgctataataacactataacattaaggagagctgtgttgtaaacatagtccttctttttaaaaatgggaactcttattttatcctgtagctgttatattcatctactcatttttagtgttgctttcaccaaacaacatgtctacagtaaatatatttccattttatgattacagggaagtgattcctaatgaaaatgagaacagagtgctcaaattggggttagaccatccctgttgtgtcatagtttccactgttgaagtaaaatcccaactgaaaaataataggtcttgttagttggcaggcaggtttcactgagtaaactaagttgctttctaggattttgtgcagaaaaattctgcaatgctaaaattctgcaacgctaaaattcacataacacttaaaactgacatcgagagtagtggcccaatcactatgggagtaatcaacaactgtaaaagttttttggctttagcctctgctgtgaaaaagcatgagaagtatttatgagaataaagaggcctaagggattgcattttccacagtttattggacatctctacttggacaaccacagacttctcagaccctactagcccaaatggaacacataatttcaccctcaaactcactcctcttgctggaccccaaactcagtgaatggcctactgttcttctagttgtcccaagtgtcttcctgttcctcgctgtcacacatattgaatgccagttcccgttcaatctatttcctaagtagctatttcctaaatctctttacttttcattctccccttgctgctggtccaagccatgagtaccggtctgaattattgcagcaatgtcccagctggtctcctttccttcagcactgtccttccccaatacactctctacagcacagccaaatactacaacctcaaagactttcccttttgttggaatgaagtccggaattcttaacatggatagcaaggcctgttattttctcttccttgtattattctcagcttcatctcccatcattctccagagcatgtgcaactgtcctctctgcaccctaaactccaccatatgcacattcagtaatgtggtaatgtcaagaactctccactttccaactttgcatatgctcttgtctctgcctgccctgtccatcatcttgctaatttctattcacactgtaggctttagtgcctcttccatgaaccattcatgaactccacatcacccagtcctaaaatcaaggatgactgcttgcataacatcctatattctgcctcatcctggaagtgattatacttcattgtaattgatgtttactcatctagctttaccactggacctctggcttcacaagaatcacatatgtgagtatcttgctcactgtacaaccttagcccattatagtgataagcccatggtaggtgctccacaaatatttgttaagtgaattaatctgaatgcagatatgtacaaagaccacagagttcagatttttgtctatgcccttagctatcatgtcaaagaactggagggtagtgcataataactagctgtcttattacaacgtacctccctgcaatacagtttcacccaccctaccccccaaaaaattctaatcactagccagatttaaatctatttgactctacttctttcagtgttggtaagagctatagcagccattacttaagaagagagttaaattactaatatctgtctacccatttctctgagaaaatgaaattacttctctacataattaaaacaccatttctttgaacttgatgaagaagccaattttcttttgtgttcctgcctcaaaaaagaatatatgtctagagagaatattagagaagttattccataagatataactttctgctagaataaacttcattattcctacaaaattatggaagtagctggctatacttctctgcttacctcttaatttttcaaaaataacaaaaataacaaaactaaataaaagtctaccccatattttctaaaatagaattctgctaaaacacacacacacagacacatacatacacaaacacacacacacgaactatgaatttctataccattcttcaaaattctaaatattgtcaaagtcattttaagagaaacagaactagtttagttagtgtacatctgtcctatggtattctttgcaccagtggatctcagactctagcatacatcagagtgtcctggaggtctttgtaaaatgcaggttgctggactgctcccttccacctagagtttctgattcattaggcctgagatggaaccagataatttgcatctccagcaagttcctaggtgatattgatgctaacctggggaacacgctttgagatgtgacttatacgtgtaactaacagtagggaagcacatttagttctgtccatgcagttctatcaggcattttgacatgtgctgtcctcttgctctctttctttcattttttttggtaccaatatctaactcagcattactgcctaaatacataaagcctgtattccatgctgaaacttaacagcacaagtgtacatcatttaaaaaaacgaaaacaaaaaaaaccaaaaaacagaaaaaaagagggctatttctgcaagttaaaaaattaaatggaaaaacaaccccaaaattgctctaaggaggttttgccttcaatagcaaaacatgttttgcctcaattgtgatttctttgttcgggagccaaggtggcaattaagctggcacaaggagcaggagccatttatttaatatgatgacagcgtagccctttgtaaatcctggaacaatgagggcccacacacaggctcattccaagttctagttccttctcttccctgttgctcagtgtgaattctcatagccacaaaggaaggggaagattttcaatcctgtcacatcctcccccatttaaaccatttatagtcttaacttataagatatgagtaagaaatcttctttaaacattttgcagagctgatcatcaaatctaacaaactggtggttttgaaatctcctttgctccaaagacattccattaacctctgtgtcctctgttgtgtcattgtgctgagaagagcaagttaaaaatccagtcttaattggggcttggtggtaggattatttttatcttatagatttatttcaatattcattttaggaagaaagaagaccttaggaaggtctaattctcatcagttctggcataagctgagttagggatctcagaatttaaagaaacgacgcccttaataatggcatctgaagaagcaagtgtaccatgctgtgacaattacaagatactacatcagttcccatcctctactaggctcttttaggatggagactctgtctggttcactgctttatctctataatttacaatagtactcagaaaatagaaggcgctcagtatgtagcaattattgcctgactggctgtctctgtaagcattacagggaatgtacaaccaaaatgtataaagtgtaacatgacaccaaagttcataaattaaatgttatcaaaatagattgtttttataaatgaagaaaattaatcagaagatatctttttagaatataacaacctctaacacccagtctacaaatatacccatcatcaaacttctggcaaatgttcaaagtaaataaacacctatcatgacttaaatacctggctttatacttcaacagtgttcatatgagtaaaaacatttttgcttaagttgtctaccagtttataatatgggaaggaattccccatgggatactatctcctccccctttatatagggaatacaagtttggctaaatactttatcataattgtgcagaaagcacatggccttataaaagggcaatcacatatattatcaatgggattgatactattatcaatggtttcctaaaagcagcctctccattttgcaagtctatcaacttatagttctttaccttcccttcagctgaatctactcacttcaggctcagcctgagttcctgaaagaatcctgccagggtgggacccattataaggattttaattgcatctaggtcatgacactcagatctggatctaggggtgactgctggcttctgcatgatctactcttcttctcaggctgcccattccctgagatctacttcatggacactagatcctgtgcctgatgttcaaattaggatggcctcataccacaatgttttgttgccccttctagctttggatctcctgtaaccccaaatagcctaatctatgccgggccctcttatgcccttttgatactatttctcaaatgactcacaagaccagcctctaaggtcaagctagttctcccaggtctcttctagtatcctagtgctatttttttctctgccaagttctgatttcttttccagtccctgttgctaaaatcctactgaatccctcacagccacccaaatcctggcaaggtatgattttaccatcttaagttcattttcagggctgagcgtataataatgactggtcatgcagcacccagtgatcacactgtacagagagtacagacattgggatggaggaagggcaaaaagaggcccttgatactgaaacatattttcagagagtaatataattggtgaattctcatatgctgtgaggatcaaattgatgaaccattttagcactcccacaagaattctgctccctcatttctgcacagaatttcatcttatgaaaaagttccacaattgttaacatactatagcatctcttcatgccaagtagttttgtattttaagaattacaaaatgcactcatcaaataattttggcacataatatatatttctaaattccagaacaaatctctctcttgaaattctatttaaaatacaacctgggcttgtacaccatccagtatgatagaaaaacatataatcaattcatagaagaccaacacctgccctacaggtgctagaatttgacatcttgttgaaattagattgaaatttagtatacagtatgtaagaaaaaaggcagactacaatatttcctgctagtggacatcattcaggcctcagagatgaaatgtgcaaaactcttctagaaatactaatcaactgaaacaagccgcctccaaaacagtaatgtggtcagtctgcatgctgccaggtaatttacaatccatgacaagcagagccaagtgaaagttatttacatttattctactggtagaatagaagagatgagagtgaaaaggatctgctgaatcagatcatgtttgactgaggagtgacagggaagttttcttcaattaatagccagctgcataatttgagctaatgccagctggactttcatcatgaaacgacacagaaataaattattctgtactcaggtgctggcatagtgaagtgaattaatccacttaaatctggaggagggagagagaaagtagattacactatctgaattttttgagcctgttttagccacactttaaggatactgaggttcatgataattattaaaatgtccaagtggatccatttagactcaaatacttgcttgaatgaacaaattcttagaagggaggaaccagagtagaaatggctttatcaaggtcatggtggtttctttcaccaattagtgaaattcatattcaactcagaaggtcagggggaagtgggcaaaaagagtcttattaagaacaactttataggggaattcttgagggggtaaaaaggtgactacaaagatataaaggaatccaggacaggtttagagaggtcaactgcctgctggttcattcagaaaagattaacagacccagctgctgggacttttctggctaggcatccttcccagtggtcacaagtcaatgtgtctcctggctgcttggctatgttcccatccgtctggatggaagagcgcccacccctacacgccagaacttttccttaggggaaagttactgaggttccacgtcaggcaaactttgctcacccatcacttcaagtaaacaactcttctatggagatttcttagagaaaaaatgcacttgaaagcatctaaccaaagcaatgaaggtggaaaaaacaagttatgtgggaatctgagtatagaatatacagacataaaataagctctccaaatgaggaagcagtcacagcttgacctctgaattgtttgctgtttgttccttcaatattcaaactgtagccctggaaatacaaacacaaacttctaaacactcacaggcctgtggcaacaaaatgctacatgccagcttcacaactggggcatgcagaccataaatcctgtagtggcaggaggggaggtgtggaaatagactgtcatcattctgcagcaaggaaaactaggtacaaggaaaaggcaactggcaacacattcctggattctctcattcattgaagaaggaactcagggattgaattacccaattgacgctagttctacccatgccagagggcaaaagttccaagactgccacaggccatggttgcttggaatttaggcagaggtgcttggtccttagagtgtagcagagagaagttctggaaaaggagctcctcatcgagtctggtaatgagcacttctattctgacatggatttcagaggactcaggggacaacgtgcccagaatttaacccttttaatcagtcagcatgagagataaatctaatttagctatatgagactgatgagaaacagtctttgccgtctataacacaaaaggaaaaggacaaaataagaagcccattacttttagttaacattcagagcaacaaataaattcctacaatcacatagcacctggttccatcaatggttggttagtctgggagattctaagctattagctggaagctctctccacagtgagtagtggggagaaggggagaagcgagctgttagctgaattagcaagtgtttttacaaatgtcatatgtagtgtcaatgtgtgtcctaaatgtaacaccctgccaattcatcaatttatagacagaacataggcacaatttctagatatgagattgcatgacagtgtttctcaaggattagtttatttctttcaacacaccctttttgatacgaactgctttattttctagcactcactacatctcactcaaatgtgtggatggcaacagaaaattttgatcattactcagagtactgattttatacattatcatctttaaccttacagtcttctgaggttaaaatccaattacataaaaagcaaaagaacctcagaggtaaagagaccagccaaaatataactatgccctagttttacccctgtatttttattattttgtggggtaacttttatttgccagtcttccttaaaattgtaacttctttgaagatgggaactccatattattcatcttttcatcttcagtgcctagaacagtgcctggaacctggtaggcagtcagaaatgtgagaagtagatgcaggccatgcagccagtcagcaacagtgctgggttttcaatgcagaaatgtctgattccaagaccactcacgtaaaaaaaaaaatgttgcagtttatcagtgatgtttggcaaaagaatggatgttgatattagtttacccagtttcattctaggtagttcacaaccaggagcttctcaagaaatacttgtttacagaattcatgaatccaaattagctctgtttcccaaaaccatagataactggaaactaaaaattggataaaagtcagcttcaacagaagaaaaaagagtttgtattaaatatgaatgagcatttactttgttaaatgatatgtgggcttttcacctagattacaggaaaattactctagcatcaatttttactttgaactttgaagaactttgaagagctatattgagtaaaacccaaagtgctctccgcatgaaaaattctagtttgcccctactgtaaaaattcacaatataaatataatcatgagggtattttctttcatagcatcagtcatttaaaaatacaaatctttgaagaaaaaaaaattgttgacgaagtaaaatagcattaaatcctgtaaaaagattacaggcacaaaacctgaggattttacttgtaaagttttgttgatggagtcaaatactcacttgcattaactctctttccaaaccctgagtccaccccttcgtattccacttgtaataactaatgttaatagcaaaaatatatttatactggaatgaacaataagcatacaacagttgtttggtttaccaaattccctttcattcacagcttaaaatgtaaccaatttagctatgacaatgccagcttagtttatccaatagcacagtaagcactattcctagagctcataattttaggagctcatagaaatgttaaatctcttttaaaatctgaaaaaatgagtacaaaacagtttagattatatttatctttacataaatgcagctacaaaatataattttgtattttttatgaggaggggacccacaaagccaaaagtgcgttgcgctcatcaaaatcatagtgagctagggtatttttaatctttataaaattgctatggcattattcgttgctggaatgccaggagcatgttaatattatgtgccttttatttcttctcacccactaaaaaaatctaatctcacgaaaaatatggaaaagtcttatgaattggattggatatgaacaggatggatatatgacagatgtatacagatatatgatgggtatgaataggatgaatggatataaatcacaaatccaatttaactgggcaatgaaagaaaaaaaattcctaagaaagccttcctttcccctatctcacatcttttacctagaaagcaacaatttagaaatgattacaacttcagagaactgaaggaaaagacgaactaccagaatattgtggcttcataaaaacaccaatttagaaatgcttacccacaaagcttctttttccccttaacactggatttgctaattgaattgagcaaatcctgaatccagctggatatctcagtatgtagtaacaccaaattactgagttagtactgaattaataatctgaactgggtgagtatactcactaactttactcagttactaaaaggctagtatcaaagctaacgtcagaaatgcccttctcatacagtacagcataaccaacaacagtagttcttgtgggcattatgctttcatgccaaccaagccacaccttgattttctgactgtgttgcctatgagttggttctatgttcatccattaataggatgttgacttattaataaatatattatctaattcttcctctacctctaactattctgtggaatagataaaataaggagtaaaaatactttcaattttgaagtatttgttaagtatcttggcatagaaaaaggcaagaagtaacatttgaaataaatttgtaacattatctgtgaattttatttatctatgaacttctatcagttttttataggaaaaaaaggggcagtatatacataattcaaataccaatagttggaacagaaatttttaggatttctagcacattctaagtctcttttgaaaaattataaaatcaaattagaatttaacaccttgcctatatgaatgtcataataatatagaattatatgaattatataagaaggaaataagtaatgacaacctcaagtaaacgttcacttttttcacagccaaattttgacttttttgacagttttatctcagataagaattcctttttcctttcaaaatatcattttcacaattatgctgtgaaatatgtggtcatctgatattataggaaagcagaactttaaaagacttagaactacattcctccctgttgtaatgagatactcttcacatatgaccattttttctggttacagtgtatctctgaatacttgtcatgcatcttctcctcttattctgataaagaattctgattttcctttgattaatccccctcctactgatggaactgacctccacaaccgggacacacagaggcctggtcagtcagtcacaattgactcaaggttgacctgtaatccaagtgcacacgtttcaagtcagccctgggttttccttggaactactgggagatgtatgctctcatgtcacaagaattactacaggcagccttgtgctgtctgagctttctttgctaccacatagagaaagtcttagaaacacagtgagacagaaggagagaaagagaaagacagagacaaacgctcaatcaaatcatgagagggcctgcagcaatcctcacaaccattaaaactagctgtatcctttgaatttttgagtttcaagatcctgcaaactgctattttgtttaagtcggcttaaattcagtttctattatttgcaactaaaggagaaaactctaatactgtatttcaccacatgaatattttcaatgttaaggaatataaaagaaatcttgatatgatgcaagttcactcttgcttacttactctttgctatctttatatttgattgacaacaagggactccaactgttgcttgttgctccactggggaaaatttatttattcattcattccttcgctcattcattcaacaaatgcttatttcacacccattaggtaccaggcacccacctaggttctaaagattcataactcaacagaatagacaaatgttctaccttcataaagcttacgatctggtgggatggagtcaacccttaattaataaataaataaaaatctaagtgtgctgaatagctacatgtgctacagagaaaaataatgcaggaatgaggatacagaaagtctgcacttgaggataggttttgattagttgtttttaaaaacagatggtcatgaaaggtcttattaagaaagtgatatttgagcaaaggcctgaaaaaaaatggagttccttactggggaaagtatgggtcctacaacagagaatagtaagtctcagctctgcagggtgcatggcaaattttccttacaggagttcacctagttacacaagagagaaactcccatgacaccccactagaacttttttctgctagctctctgagggaactgggcatatttgttctgtttcactgggcaaacagaaataggagttaggggtggctgtaggttccacgaatcattattattttcaatgttcactctctggcgtaaaggctgtgaggtgaattgctgactaattttataaagcacctggagctcctcagggcaaaggcactatgtcaacaccaacattaaataaatagcaataattggccaagtcctctggtggtataaggcaaataaaatatgttccctcttggaagttcatgacgtctgccaggttaagcaagaatgaggcaaagcacttttagaaagctactttttctaccattgtatatggcctccaaacagccagccactgtgaaatgttaagtgttcaacagcaaattaaaactgagtgtgtttttcattcactatcacaacaaggtactaaataaccacttgagatatttgttgtacgttatcattttccaggcagttttactgttagctagaaataagagtagagtgacattcgtttgattagagcagaaccattttccaccaatttttagagcacatgcaaatctctttagcaaaaggactttttcaagggttgaatctcttatagtttctcaatgtgaatgttaattaaagaaacctaccaaaaccaagaatgatttcaaatggttatagggtttcaaatggtagatgaaacatgaaaatatatataacctattaacaagatatatttgtgtctctaagaattctataggggaatatacatttcagtgaaactctgtacccacccaacccactccacagcaaaacaggcatttgtgagaaagcgctatatatatacacacaaacacacacatgtacacatgcacaatttataaataaacatcaggatgttaaatttaactaattttaactaaaacaagggatagctcaggataaacttggttttactctactaactccaaagttcaataaataataacaattttctcaaggttattaaccatcaatactcatagaattatgaaatatttttgctaaaagcatttagaactaatctagtatgattcctttatttcacagatgaagaaacgaagtgtcacagaggtctctttgctaggggtaatctatgtgctgaaaaccacctataacactttgaaccatacctgttgttggtattttgtgatgtccgtctacatgttttccttgaatgactatatattttttattataaaaatgggctctcattttatgtattttttattttttcatttaacataatgaaaatctaccatgttaaaaattatccttatgcatcagtatcctatcatacacatttaccttgataacatatcaaggtatattgtgctaattcccgctgctgaatatttggctcattttttttcttggcacattttcagttttccactataataaacattgatgtaactaaatcttttcacatattcttaatttttttcttaggataaattcttcaaagtaaaattgttggttcatagtgtgacttgaattctcttctagaaagctactcaaactttcactttcattgctaatgaataagaatgtcctgactttagtcaatacgctgaatttgttatcatctagttttgactttgttttttaatcttgaatactctttagagaaaatgttagttcactattgtttaatttgtatttctttaaagttggggttttattcatgtaactcaccaattgtgtttcttatggattgtgttcattttcctggaagaaaggtcatttttttccttattaatttctaagaatttttttttttttgagacagagtctcactctgtcgcccaggctgaagtgcagtggcatgactcagcttactgcaacctccgcctaccaggttcaagagattctcctatctcagcctcctaagtagctgggattacaggcacgtgccaccacacctggctaatttttgtattttttagtagagacggggtttcaccatgttggtcaggctggtctcaaactcctgacctcgtgatccacctgccccagcctcccaaagtgctgggattataggcgtgagccaccccacctggacgatttctaaggatttttaagacattaaagtcaatgtctctttagtaacactggaaatagaatcccacccttttcatttgcctttacgttttctttatggtgtttttgatgtgtagaaaaatttgattccttaatgtatacacatctatcagacattttcttcatgctttctcgctctagtgatatgcttagaaatatcctccctatgttgaaatttaaatactcatttttattttattttagtaattttaactaaactactttttagttgttacattaataaaattatatattatatattaatgaaatctttatttaaataaatatttaataaaatatatatccaatgtatatttttatataaggtttaaagaaagaatctaactttatattattttcccaaacgatagctgttgctttcaacaccatttattgaataatcatcccttttctcattgaataaaatgctacttcagtcacacacacacacacacacacacaaatacataaatgagtcttatttgaaatctatagtctatccaaatcaactttatctaattcttcatttgagccaccgtcctaattcttacaatattatatattacatgatatatgttactgtaatttttatgatataatctctggaatggtgtgttctacatccttccaacctttacccactgtgctttatttcaactttttcttgattttcccatgttagcttgatttttgaaatactttattaaaatcaaaaataaaatgtgattggaattgcctatagtggaatgaatattgtggattgtttagcattagttaagacatttttgttttcttcacaacaataccaaaaaaacccttctaatttcttattattttcactcataaatataggtgtagtatgtttttgtgactagaatcttgtgctatttaaaaagaattggccgggcacagtggttcacacctataatcccagcaccttgagaggtcaacacaggcggattgcttgagcccaggagtttgagaccagcctagggaacacagcaagaccccatctctacaaaaaatttttgaaaaactgtccaggggtggtggtggatgtctgtagacctagctactcaagaggctgaagcagaagaattgcttgagcctaggaggtgaaggttgcagtgagctgagattgtgccattgtactccagcctggacaacagtaagaaagtaagtaaataaagaggtattttatttttttcattataatatctaactgattattactttctataaaaaagctaatagctttcttatatgtaattttgtatttggctacctatctgaattactgaatcatttctaataacatttcaactaattcctttggctcttccaggtaaatacccacatagctataaagtcagttttcattttatattttatgtttcaagttgttgtactagaacaataacttgacaataactatacaacttcccaaacaaatattacatacaaatattatgttacgtcttattgcttataactaagctgactttaatagaaacgactcacacttaaaaattggtttcaccattgaaataaacactatattcttctgttgctatttcactgcatccttttaaaaaaaactaacaacaaatggatattaagttttagtcaaatgccactgtggcacctgtcaatacaagtctattgctttttctttcaccatattaatatgatggattctgtgaccagatttgatcaaaattaactatatgtacatttacagactcggccttatttgacatgagcatgaatcttttaacaaaatgcaagattcaatttaccaagttgtatttaagattttatctaccgaaaagtaagattggttgagggacttccttcttattgcaaataggtctacttgatagaatgaattgaaaagttgattttcttttcacaaactctagaaaatttatataacatactatttgttccttaaaagtttggaaacattttctcagaaagtctctgtgcctgacatcttttgaaggactgtttatttaaagcaatttttctaattttttttctgacagatatcgctttgtcaaggttatatacttcactttgtatcaaatgtggaaatatatatatttttgcaagaaggcacaatttaatcaggattgtctctctccctttccgtatgtacatgtttctgactcatcctaggcccctcactttccctcactcccatagaactgtttcaccaactgttaggtatgactgctgtctcattctctctcaccacagaaagctgggaaaggcattttaggaggtgagaaataaagcatcctctctcaagtttttgccatcccccaagagttatatgtggggtctccatgccaacagtccactcctctgagatggttttccctaatcacccgcaagtaacttttcacttttaactttaaaagagtgagcagggctccccttcctcataacctagctgcgaagcaatttaataggtgttccatgaaatttaaaagcagtagtaagattcctaacagagacactcctcaactttctccattctcacagcctgtctctagatatagggagttctttggaactaatttctgaaagaacacgtactttttcatattatataacattctaagccacattaaaatgaatgcttggtgagatttttcaagcagatatttaaattattgtatgccactgagaaagattaacagggcataataagctatacttaatattttaggaacgagtatagtaaactattgtttaataaatacaaggcaaggcaaacattacaaagtgaaatgtggaagaactaaagcttctaaaataattgaaccttccctctagcagcccctcacagagctctccgtcattaaccaggagtataaaaaatagagcaaagtatataatacaataatagctatagttttttgagctctggccacatacctggcataatgctagatgttatacacattagctttcttcctcagggcagccctaaggaaaaagagcaaaggagggctgatgtggtttatagctcccatatgccaggccccaggatggatgagtttgtaggaactagagtctcagatcctaagtccatagagttaggaagacacaattaataaggcaaagttcctgctcttgacattgtaccactgtttcaggtttgactcaactttttttctgaaaataatgattaactttttatagttgtttacagcctgccaggcactgttctaagaactttatatgtatcaacttctccttgaatcttcacaaccactttataaagtaagtatcatgatggcccccatccccctccattttttaggggagaaaattgaggcttaaagaagtggcctgcccacagatggcaagtgaccaggccagagtccacacccagactatttaactctagactccatttaactctagactctaagcttttaatcactaaactttcagaaatgtctaccaagaaagatggctaaatttggcgagcaatatctaaaatcaagtccaaaggaatatgaataaaagcatttgaaagagaaggctatgatttctcacactatgactagcatttttccttaggtgtcatctatgctgaatctccactgggcaggaaacacaatgaaatacaactgaaactgaatggaaagttaaccatgaaacgactggaggaatctcagtcagaactaggtctcgctttaccaagagaggtcagtcatacttgacaatagaggctttagggcccttttcgatgttccacaccataatttaaatgatgcagtaaaaacagaaaaagcaaagagttaataatcatctgaagaaatgtgcttccattctaaacttccaagggggttgggggtgtaagaagactaaatattgtggaaagcagcttggtgacatctgaaaaggctaaaaacagaactaccattcaactcagcagtcccattcctgggtatatacccaaaggaatataaataattctaccataaaggcacatgcacacatatgttcgttgtagcactattcaccatagcaaagacatggaatcaacctaaatgcccatcaatggcagattggataaagaaaatgtggtacaggtacataatggaatgctatacagtcatacaaaaatgcaatcatgtcctctgcaaaacgtggatggagctagaggcattatccttagcaaactaacgcaggaacacaaaaccaaatactgtatgctctcacttgtaagtgggagctaaataatgaaaatacatggacacaaagaggatcagcatactggggcctaccagagggtggagggtggtatgagggagacaaccagagaaaataactattgggtagtaggcttagttcctgggtgatgaaataatctgtacaacaaacccccatgacaggagcttacctatattaaaaaaaatctccatatgtacccctgaacctaaaataaaagttttgttttttaaaataagatgaaatgcatagggcaaaggtaaatctgtttgtggaaaaacagcaaaaggaagcactgtttcctggcaataagtataactcttttcttaaggtctgcccttctccttaccccgatctccaacttgttggaaagctaagattattgaccttctgtgaactctgtatctagttaacttctttcattcaaccctttagggactcaagcaaacagcatcactgacaccattgacagtttgggattccaaggtggctatgcaaattaatccctgtctcttgctccactcctaccctcatcactaatcctcacttctcctacaaaaggacattgttatgaagcatcctcgccttgttttcagcttgtgtgtttttgagccagagcttcattagaatatgaccatctgtgctccctgggaccttggtcacctcaatttatttgctggaagatgtggaatgatcctatttcacgtgaatatctagctcagtttcctctatttctctaaatgtatctcaatgtcttttgtgctttctggaaggtattagagtttatggaccttgctcttggttaacattaaaaaataagctttctacataatatagtgtaaaaaagctatgtcatttcttcacttttctgactactaagttctcttgagaggcagtgagtgtcacactgcactactagtggcctgcacatctgagacagagtatctcttacacacttgtgaattaattcctaacttctgtataatattctatttacattttttattcaaattctctctcattctctgtacatttctttagcacacactagatgtctgctgtgccaggtgactctcacttattcagcacagcaaccctaagagacacacacatttagtactgaaatattagagtggagagaacaatggtgaggcaatgaggttacatggtcacattcttaccttgggaattctgctttgctgtgaagcagtgggtaaagacattgactattacagcactcactgtttatccaaacagtatcccaggggagaatacatttcagggttctgtacgaggaaaacttagtctttcctgagaaatggatgttgtgttcttctcgtctagcatttcttttgttttcctgctaagtttggccaccacgtaactatgagatgggtttctgggctccttcagaggaagcactatgactcttattattgaaatattcactttctcttcacccaattttctctttttaacattctgaattaaaaaaaaattattgactttgtactttttgtaacttactgcaaatccttttctaaataggcagggcatgaataaagaaaggatggaaggatggaagggaggaagggaaggacaaaggaagaaagggagggtggcagggagaaaacaaaaacaagtaggcaaatacataaaatgacttaccttttgtaattttaaattattcaagtttgttttctaataaatataaccttaatgaaatgccatctctaaaaatcctttatacaaagcttttcaaataataaaaggaatacgagtaaaatgatgaaataaataaactttttgcagccaagaagtctatgatctaacgtttcttgttcactatctctcaaggttccccaagagtaaacatatgccataaggatttttgctaaatctagtcttaaaataggaactattctaaaattaaacttctacttttatccataaggccatttatatcattttaagcaatgttgtaacaactattggaaataccacatggtctggttttacataaatttgcaatgtatattatcctccatcaccccctacattggtatagaagcttgttccaatggtatcacatagtgagttttattttctggccaggttggcattttgagatctagaatctttatatgccacccctgccgccattgccgactggctgtgtgcctaaaagccagagacactgggcagggttaaagattgtggccaggtttttttttttccactttgtcaaatgtaaaaatacaatgatggtttgtagagtatacttcagaaataatttagtcagtaggtttatgtctaccaatatatatcctatgagttaatataagcagttcacactaacaactgtaggtgatgtatccttcttttagttgctgatactgtgagagaataaggcattttatttaattaaagaatgagctaaaatagcaatgtggaaatacagaaaataaatactgaaaccacacaatgctaaacatgaatcagcattcctatatttgtaagtgaagtcacctaaagggaagaaagtataaacagaaaaggcaataactgcatcagggaaaatgagaacctatggaaggaaaaagaccagcagtacctggattcagcttttctggttggaaaggtctagagacattaaaatcacacctgtttataaaattatgtatatttaatattggaatattattggtggctctagagggcatacacctggttgtacaggaaccgtaaggtttaacaatactactaaaaaaggaatgtttatagatttagatttattgcaaaccatgctttcattttttcttcctataaatctttcctgagcatctactatatattaagtgctactgtagctatggagatacaacaagacaataaatatgaacttttgttggagttcacattccagtcgaagggatatgaatattaaacaaaataaataggtaaattagaaggtatatcagaaaatgacaaggacaatagagaaaactttagcaggggagtctgggagtggggttagggattaaaactgcagttctcaatctaatggatagaaaatgttacattgaagtagctttggggtgaagccttgaaggaagtgagccacgcagataactgggtaaaagcatatcattctcttgtttagatataaatgtgctgagaaaaaaaaagtattttctatatataagactattcctctgaagcagtagcatgcagatgactgggaattgtagaagaggtgtcaatgccaacaatttgaagaaaaataacatattttaatgttgaaacaaatagagaaaagtaagggattgaagagatattttaaagagaaaactgaaggtgttaaaaatgtgcatctgataccataaatccaggctactcttccagacaccaggctcacatgttcaatttcttctggcatgaaaaattccagtggaaaaagtcaaagaagctcttatctcttcgctgaagcagtcatgctagggtaacagctgaattcaggaaaacttaaggaaactaactttcactgcactcatactatatgtaaaacatcatacacataatatgaatgtccaattttagaagtatttaaaaaacatggattttatatagctctaagccacatgaggtgtgtatgaggttgggggtagtgaagctcaaaattgtaagctagacacttcttgaaaaaaaaactaaatgcagccttcactaatggcaataggtagaaagagaaagagcatgagccagaaatactcatatttaaatcaaattatggctctgtgctctgtggtcatgaggaaactgcttaatatcatttacttcatttattaaatgagtctattagcaacaacacatgtcaaattcctaacatggtacctgtccatccttcaccttatgagattattaaattattaaattttgccttttgagcaaaaatattgatttattgaaaatacggcctaaaatatatgccaattatgctacttactataatagtttaacatacaacagcttgaaaatagtataattctttcttcacatgagccatgttatgatttccagtaatttgggacccactggtatgtgggattcattacaatgttcttcaaaattatttcatttattacatggactttgtttaaggaaacgaacagaaaaaaattaaatgtttgttttggagaagtttcatgctgttaacttcaaagcccctaagcctccagtggccctcttggatataagccacagatatgagcgtgaatgacgctggttgttctacatgaaacttcctgatgtgaaaacttttcacctataacctcaaaagtcagctatagctaatagctcatgagtatgtttccacaatactgaacattttgataaaatacactttaaagacttcctgattagaaaagattaaaaaaaaatgttttcctaggattatactggaaattttgagaagcttcttacagcactcaaaaagagttcttgtgtatttgttgttgtctggaacgacatcatcaaggatcaatcacattctttaagggctaagtacgttcacaaaatttccatttttctctccaaagcacatggaaataatttacatataaatgaagaaacatgccaccctttaaaaataccagtttcttgacatatagtccaatggattgctacaatttcaagtctttaatagattcaagttgaaaggaatggcatgtcatttgaaagcgtttccaaagcacaagggcagccttgttttgcaatgtttctgaaatatttggtttaggacatggcaccagagggcttggcagtgaatactccgaagaaatgtaaagtttaatcaatccatgaaaatcagtcccagatgtggcttacgagtgacaccatgtttttaaacataatctggcataaaaagttcaaaggtaatagatatcagaaatatattcctagtgataaaactgtaggtaaagtttatttaaacctttattatgaacccactacacgcattatctgttttatgtcttatagcatgtaaaaaggtgagaaaaacatactgtcctgaatatgctaccaatcaggtagatgaaagcacaaaaaaaacccattcattcattcactcactcattcattcaacaagtatgtattgaactccaattcagggttagatactcttttggcaccatgactgtgagatctggttcttgttctccgctatctctgcgacttttcatctttagtggggagaaaagacaggtaaacagttgattaaaacctagtaagaattaggttcaagttttcacaggatgtggtgaagctcagaggagagagcagagcactggtccagttctcaggtctggggcctggaggagaattgccaagggagatagagattgagcatagtcagggaagggtaatcccagcagataaagcaaactgtgtaaatacggggaaaagctagcaggaaacaggcaacaataaattcattgtttctggagacagtcttaatgggacatggcaaacagagagaggatactagtgagagagccaggtgctgcgttcctgatggccaaaaggtcttgttggagagtttgtattttatcttcagggatctggaaagccttgaaagatttcaatcaaaaagatatttaaaaacatgacagagtaagagaacactaagttcctcacttaaaagttatggcagacatttcaaaactgttcaccaatttccagttttcttcttccaaccccacaggaaaattgtacttccctgcctctttgaggttaacaaagttgcattgctttggaaaatgaaatatgatccacttttcggggtggaagcatttaattgtgacttctggaatctctaaccctttcttctgtcatggtgaaggtagacacctgtggtttatatggcggcattgcttttggcaatcacatggagactgctggcctgcggggttctcagatccacagtggggtcgtccgttattggagtattattttgcctaccatgactagtacacgtattcaagtaatggagatattcttataattaacaagctactagctctgatttgtaatttgctcaattagacaaagttaagtgtgttccttgttaaaagtattcacctgtctaaagtttcttgtcttagtaaagcaagtcaccgcttccagattttggaagtggtaattaacagcgttttgcttatggatttacttataattagtttttgtttttggaaatttgaaaaatgcaaagtttaaagaagagggtgtacatttattctaattacttttagaaagaagtagtacatcagtaatatggtctcagtgttaaaatattttaaaagggaccaggcatggtggctcacgcctgtaattccagcactttgggcagccgaggcaggcagatcacctgtggtcaggagtttgagaccagcctgaccaacatggcaaaaacccgtctctactaaaaattcaaaaaaattagccaggcatggtggcatatgcctgtaatcccagctatttgggaggctgaggccggagaattgcttgaacccgggaggcagatgttgcagtgagctgagatcgcaccactgcactccagcctgggcaacaagagtgaaacgctgtcaaaaaaaaaaaaaaaaattaaataaaatgtagattaactcctgaaagtgaatactgtacatgtttgcatgcattttattctttgtaccttgtgactgctggctacttactgccttcctcctgataccagtttttctctactgcatatgtcaataaatgtttagaaatgcttgaagaatacagagaaagcccaaagtgttttttgttttgttttgttttgttttgtttttttcagaaatgcatctaagtgtctccttacaaaatgagagaattcattgattagccattctttggacatgctcttaaacgtcctctaccagaaggaatttcatattcctatcacaaaagggaaattgcttattcttatgtttataacaccagatcttttatttgatatatactatgtgtatatattatacaaataagctctttataaaagataaccatgaaggaattatttcctgaaacggcaaaatataaatttgcctgtaaaatcagaatgccctagccaatcttttgagatttgaccaggatgatcctgtgggtaaggaaactaaccctttcaaattgcatgaaaattagaagacaaatgaagatgttgtgaatggaaattcatttccaaataaaccactgggataaaaatcattagaataatgctagtttcaaaatctatgtttttccgtctctttgtcactcacaattatttcaaatatgttcactttaaagtacagtatatatacctagttaggttgagtcatgttttagaaaaattccttagagtttgtttttaagcaaaacaggactgttttaaacaaagcagaaccttaacaggaaactgataacagtggccaagaaaagcatcttattttctattttctgtgtattagaaagaaaccctatttctcacttcctcatatggtaattatatctcggtggaattgaatcctcaggacaacagggcatgttattgtgagatattttacacctggcttaaccattctgtaaaatcagagatagtgactagcccagaggctctgtctcacttccttccggtgttgcttagctattgataaatattaaggtgcatgtgatttggctgctaaaatgaagaaaggatgtcagaaggctatcagtttgctgaatcaaacagcattgccacagggctccaagctggcagggcccctctgggcattgccaggtcaccaaggaagtggctgggtgaggtggcaacaggtgtcagacatgctgctgagcagatgatctcagcaggcctgaggacagaagagaaggttaccacacaaagtgcttagctgtgaccgcagaggaatttcagcatcaaaggaatttgagtagaaaaaggtttcaaatttcagttaacccagggttgaagcagcaggactcattgatagaaagagagaagcaaataaaagcccacactagttaacataactctcaaataagaatgcaattatctgcagccacagtagcccatggaaagatatccctaaccagtcattcagttgagacatagggacatcacctgggtggaaaggacccttacaggttgtgaaggaattataagtgaccattagtgagtggtcactatgtaccagacacagctgtaagtgctttatggccattaattcattccatcttcacaacaacactctgaggtaagtattcatatttgccttattgtacagaggtagaaatggaatcataaaaaagtgaagacatcagccctagctgatacagcaagtacagaggagagccagaatataaacctaagaagtctgtctgtataaaccatgctcttagccaccaagtttcaccatccctcacagggagaaaactgcagagcagaaaagttctggtcttactcctaagaagagatgcacattacatacatgaaaagataccaaacatgacaacatagaaaatgatggatgccaagtgagtgccaggaactatagagctgttgaaagagattcattgcaaaacaggttggaataagcaagacaaacttgagaagtggattctcacattgagtgtgaacaagcaggggcagtgtgatgtggaggaagggagcatgtactctacaggctttagcttcagaggggcttgggttcaaatcccagctctgccacttacaagtcatgtgagcttggggaagttacttattctttgttttctagttttcctatctgcagggatagaaaaatgctatttcaaaacactattcatgaagatcaagcaaaattagttataagcaggtctcagcatacttggtacaaggtacacatttaatatgtgtactattatccaactagggagagatagaaagggagcttcaggtgagaggaacagcataaaaaatgatccgcaaaagccagaaataaaacttctatgagctcagttcaagctgactgggtaggtaaatgtctgccatgaacttggaagtgagagagaatctcccttggacactcattaaggggcctcaaagccatgaagagttgccatgtggtccttccagtcaataaataattttgtccaaacacgagtggaagaaaaaattaagagacacccggatggggaaaacccattctctttttggtgagacaatctagccagaaggacactctcgccagctagagctctgcatatccaaacaagcacaggtaaagtggaagaactgaccagaagaggagaaaacatgaattaattaattaatcaaagaaacacctgtaaggttccaagtaggtggcaggtaggctgagtgttagtgtatccagtcaggcaggtggtgatgacaaagggcccccaggaaactcccatttgtgtgagtgagaaaggcaagaaaacagcatgcacaatgctacttgaggagcgatgtttgaaaaagtgatgcacaggttgcaggggatgcacagaaactagggatgcagcactggagtggggtgagaagcttccaagaagagacaagccttctgatgggtctcaaaggaagaggagggtctcaccaggcaaaggggttgggggacacattctagtcagaaggaacaccatggacaaaggttgatgaatgaagcagaatgatatctttaagaagctgcaaaacactttccaccaggagggtgcagctggggtgtggcacatgaggttgtgaaatcaggtcctaaagaggctggaagaatgtgtaggaaggagatgggctccgcttggctcttaggtctctgcagaaggaaagagaaggagaatgggacaggtggtgagactggaggcctgtacactatttagaaagttactgggccaggcacagtggataatgcctataatcccaacattttgggaggctgaaccaggaggatcgcttgagcccgggagatcaaaaccaacttgggcaacatggaaaaaccctatatttacaaaaaaataaaaaatgagccaggcatgttggtttgcacctgtagtcccacctacttgagaggctgaagtgggaggatgccttgagctcaggaggttaaggctacagtgagccataactgcaccactgtactccagtctggatgactgagtaaaaccctgtctacaaaaatgctctaaaacaacaaccaaaaaaacccagaaagttactgcatggagcccagaggagaaatagttgcagcatcactgggaggtgtgggtagtggggtgaaaaggctatggcgtaagcctggtgaggaaaggcaaagcacctgatgctccttggcttcaagtacagatggcaaagcaactgggcaaggaagtccctggacagatgctcaggatgattacagcttcagaatgctgaagtgcagctgtgcctatgttttcttcctcctgtcctctgccacactgtccttcgtcaccctctggggcacctcccctcatatgagaattgagaaatggagggagagtacatgagtagtggggagacaccaagacagcagagcatagtgaagagaggaggagaggggaagcaaaacttaaaagagactcaatgaaactgggagtgcttttgctaatgccactaggaaaaagaaatgtgaaaataaaattttatatataaatacaaacacatgcatatgagtgggtgggttaaactactataccacctcttagccagaatgatcttttctaattagattaggaaatgaaagtgttagaagactgaatgggtaacatttgaattttccttttgaaagatgggccatattttgactttagaggaaacacagatgggaagtgcattcttgatcttggaaatgttgtgatgatccatcactgtcagggtgaagtaaggatctttagcatggccaccagagccttatctcccacctctgtgcctgcctccaccctggctcttctgctgcctttatattaaacatttgttcattcaccacataaggttctctctcttgccttcttttcctggttaattcttactgatcctgcaaatcacagcctgaactactcatcctcagagaagacattcctgattttccctgaacagataaaaaaacccttcacagatttttgaaccctgtgtgtctttctcccgtagcatctgatccagtcacagtttcatgtgtgtgtgtgtgtgtgtgtgtgtgtgtgtgtgtgtgtgtgtgtgtgtgagagaatgagagagagagagaaagagaatttgattaatgcatgtcttccccagttaatcataaactccataggggcaagaaccatgtctgatttggcatctacgaatgagtgatgaatgcaaataatgtttggctatggggggatgaggtgtggccatgtaggaagatgatgtcagggtgtggtacaaggttaaggaagctgcagctaaaaaggatgccaacttaatctattttggccattttgtctaccctaagtattatgttcacactgtatttcttctttctggactaagaaaaaaaaaacatgtttgcttgtggggtctttttttccttctaaaatattagactgcaaacaaaggcactgttgggtagtatatttttgttagcacccaaggggaaatgactgtgttcttgggctctccaatttttacattacatgttttctacatgagctttcaacctaatgtaagaattaaatgcaaatttgaggcatatgaactattttatgcaagatcttaaaattgttttccttgggacgttcattgaaagtatggctcattactgaaaatctattcttcagtgtgttcctaaccatctagccacgtcaaaaaaagttgctttaatatctgaagccaaatcgctgctttcctttgtgattacaaggactctcttggtaaatcagagtatggccaatgtccagttgctaaaggtggaaactacaagttactattctccttaagttaccagcaagatacagtcaacatgtagttctttggtgtctgtcaagaaagtacagagatttataggtaaagaagtcaattttcttatcatagatatagttgtcatatggagagtatgctgattagaaataatgaaagcaagagataaacttaaattgtggaattatctgagaatttccattatccatgtcccaagttaactgcaaacaatataaagttgactatatcaatttttatgtacagaaaaacatttgggacacaaatacattttaaaatcttaagagtttgcagggtaaaaaacattttgggggaaaaataatttttctaagggtttgagaaaaattcagcttatatttatgtatttcaacttcagtaaggataaatggaacagcaccactggaattgaacaattaagtaagcaaatgatggatggtagtttttcactgttggagtggaagattatagataagcaagaggaagaagctagaatgacccatgtggtaatgagttagatttgaaaatatcagtatgaactaatgcttatctatctatcatctatctatttatgcttcctgattgttagatatgtgtacatacacaggttggtatacacaaatatatgtccttgctctgtcagccaagaaggccaaaaggaaatgacaacccaaaaacaatgaacacacctattgctcaaatcttggtttttaataccattttccaatgaaaggaacgtgtgctccttggagaaatggctgaatctatgatgaggaaggagttatattgttgataagcctcaagtattgtgtaatgctagaaaggatgaaagtgcatcaaaacaaaacaaacaaaaaacagaaaacaaaaccaccacaattgtggggatgtatcaaagggacacaagaaatagtacccaatggccaaagctggaacaatttcacagcacgattagtatgacagtagtggattataacctaagcataaaataaatatccatgagtccatactgatatacataaatgctgaataattaaatgagggagaataagcaaatcttctgtggagaagaattgcaaatattttatgtagattctctgccttcaaggagatggagtataacaccctcttaagtgtgggttgtttatcatgacttccttccaaagggtaggtatgaaaataataaaaataaggaaaaataatacatttatagtggaaaaacctgaccaaatccacctcgatcaggtgatcaaggttaacatctttagtcatgttgacagtgtgatggaaaaatggcacattaccctctgtggtctctctccccaaaacactaactacagtctaatcatgaaaaatcaatcagaaaattccaactgagagacattctacaaaatacctaatcagtactcctcaaaactgccaaggtaatgaaaaacaaggaaaatctgagaaaattctatagcaaagataaatgaaacacgagaactaaatgcaatgtggtatcctgagtggggccctggaatagaaaaaaagaaccttaggtaaaactaaggatatatgaatgaatagggactttaaataataataatgtaccaatactggttcattcattgtaacaaaagtatcatactcatataagactttaataaaaggcagtgggtgaggggtatatggaaactccctgcactatctttgccatttttctgcaaatctaaagctgttttaaaataaaatttatctttacaaagccctgaaagcctagaaatttaaagtaaactcgtacaatcaaatagtaaggcctaatcttactgacataagccaatatttaattttctaacccaaaatacaaactcttcttcacatgttaacctctatctccattttctatgtctacatttctttagaagaccataaatcacgctatattatcattaattagagccaagttaaaatgttaaaattgctaaacatatgactcatttaaacaaaggtttactaaaagacaggaaacaatttacaggaggtatgcattttctgcatggttgcatctttcaagaagacaaagaaagggattaagaatacctttgtcctaagatacaaaaaaaccacaaggcaaaaagtacgacatataaagttttacaccaaacaaaaaagagaaaaatttcagcaaatcaatgttatcatctacttatgattttttatcattgcaaacaacgcatgtttgtccatccttacttcgccacctggaccaatgcaggccatgtcatatgaaatgcctgttctgaccattagaacatccagactcattctggggcttaatctcttttactgcaggtgcatccacttgttatatttcagattagcagcctcaaagaactagcctcttcccagtacccatccttcaattactgcatcattttctctaacaattgcagtctttcaaccactttatatgtgacaaggcatgagcttgcttcctctcttgtcactctcctgagtcctcttctgtttgtctgcagcccaaaaggaagcacaatattccagctgaggtctgaatgatgcagggtcaagtgcattcattacctctttattttgggttattctggttctattaatacagcttaagatgttatgtgaaatttccaaaataggttccatattttaccttcaaaactgtatggcagacacaaatactacattatctgtgattaccgtgaatgaggttagcacattattatgtggttgtgaatatcatacttggcttcctggagaccgaatattcatgtatcagggccctcctgtgatgacacagtcagtggcgccctcacaagggcataccttctagccttgtcttattctttaaaaaaaacccacattctttctttgttctagctacacagctggaaaatcagaactgaacataatagtgggaagagagtactctttaatctcagtatttaatctcctgatactttctggacctctgaaagtattaatacatgcattcccatgagaaatattattgcttctctaataaataaggatgtcatacaaaattaacaaattaataattcaaggacacattcgggtgccaaagaatacagttttctaatttttacaggaaaatatgtaaagtaatataaaattttcacttgtaaatagtgcaaactgtgttagaaaaaaagacaatgcagatgagagatttccttgaaatgctcttaaaatcatgttattgatccgtgtaagtcagctatatcaattctactgatcaagaaataggtattttaaacacaatgctttcaggagtatacaatgttgacaaatatgcaaaaaaaaaaaaattgcaaaactccaagaaaatcaaataatgaatgctagccaaatttctatccgaactaagctaactcaatgatattatcgttgtctttaatggagaaacatgaataaggataatctttagtggacttagattaagtaatacaatgaatagctataaaatttgtggatcagaattagaagaggggaaaaacacattaatcaagtagacatgttaacaaaataatggattagtcaggattacatttgaataaattagcaaagcaaaagaaatacattaaatatctaatatttagtaacttagaagagaaaaaaatgctgtgtattttacatactaattcatacacatgcccaacaaataactaccgtttccagtcttcatgtgcaccataacatgtgtaacatatgaaacaaaaatttgctcctccctgatgtatattggtatgaaaatcttttaaggtaacatgagaatgaaagagattcttcttcatgctagacatagaggtttttaaacacatcatttggctgacgtaaagcacatttgcaataggcattagtaacctcaagttaagaacaatatatgccaggctgatgtactggacacttcctaaatactgtactcagcagttttggagcacttagcaatgatgaattggtgtgaagactcaggtactgaaaggtcatttccctttttttcttgaatcttttgcttgtcttgattgacgctctgaagaagccaaggatacagaaggggtggagaaagcacgcaacccaaattacccaaaggagctgcttataatgaacttgaatgaagatagattttggggagaggtgggggaaagtggccacaatcttcaatattcttttgaagtgttactgctttcaaagttgtgatttttctcaaggtaaagctgtttgacacagatagactcatctgtcaatcaaacatcttttactcatggccaggtcaaatacttgactattctagtagtggtatcaaactcttagtgccaatataaaacagccaactcacctagccagggaaaagaaataataagaaaatgaaaaagtgcactgagcctttatatcctgtattcaagaactgcatttcttttttatttagttgttttgtcattgctgtttatcagtttttgtttttgttgttttgttttatgatcaaatagttttagggggataatatataatagccatgtcacacatttctgaaagaacaacttatttcacctggccccataaatggaaatatttcataaattccagaagctttggcattcgtctacatcctctttccagactgcttgctatttcataatcattttcatgattctcattttccttatgaattgaatttgtgcttgaaacatttcaagcctagggaagcaatcttgtgagctgacagatcttattgggagcaaccttgttcagaattttgacttccacttccactcttacacaacaaatgtccacgtatagactcaacatttgcctcaaaaattcaagtctccttaagaattacaaaaggttgtatcaccctgtaagactgttgccattacagatggcataggactcaggattctaaaatctagtgctataatgggctataagttgggttaaagaagtgagaatgctgtgcttttaacttcaaaatttggcaagacataccattttttaataagaaacatattttttatttggattatccttttcttatactatctattttattatactttctttaatagtatttaatcagattttaatgaaatctggtacacaggttttttgttttgttttgttttgtttttgtttttgtttttgtttttgagacggagtcttgctctttcgcccaggccggactgcagtggcgctatctgggctcactgcaagctccgcctcccgggttcacgccattctcctgcctcagcatcccgagtagctgggactacaggcgcccgccaccacgcccagctaattttttgtatttttagtagagacggggcttcaccatattagccaagatggtctcgatctcctgacctcgtgatccacccgcctcggcctcccaaagtgctgggattacaggcgtgagccaccacgcccggccgctttcttttaattataaactaacaatagtatttacaattttcaaagaactttcaaatatactacaatcttccacagaaatccataggggaaaaaagggacaggagaggaactaaaatatatcaaacacactaagttgagcagataccatgatttatatatgtatatcattaatctttatgcacaacttaggacaaatttctttctgatcttagtatcataagtggtgtgcttccctgatccatcaaattgtttatccaatggacacggggatttgtgtttaagcttcctgatttaccctggatcctaggaagcttagtgagaactttacattccatcttgcatacccttggacttcatggtctgcttaactcttgaaagatggaaggccctctgcctcccttgagatctaaacaaaattgatttgaacttcctaatttcatgaccagtaagaatcccaaaactcacctctaaatttctgataatttcctaaaggctgggctcattgacctgctttgccaacacaacacagctcattttgattcacatgccaccaacaccatcaaaatcacttacttcaggtactcctgaggcttcaagtaagacatacatatattagtggtcttcccacccctagcaactccctgtaccctccccaatacccctcacccaccgaaccactgtcagtactggggagggatctgtttatggagtatacccgcagttctcagccttcccagggcgaattttcctcatcctgtcctctctcctaatttctctgcctcatctccatcattctcattggctctttagcactaaattcttcttctgttatgcagagaagttttcacccttagagcacttgagcacctacctatagtcagatcctcagggactttcttcctatcccaagggcacgttcaaaatagctcttctaggccagctgcagtgactcactcctgtaatcctagcactttgggaggctgagatgggtggatcacctggggtcaggagttcgagaccagccaggccaacatggtgaaaccccatctttactaaaaatacaaaaattagctgggtgtggcagcttgcatgcgtagtcccagcaactcgggaggctgagctaggagaaccgcttgaaactgggaggcagaggttgcagtgggatgacatcacaccactgcactccagcctggacaacaaagggagactctgtctcaaaaaaaaatatatatatatatatatatataaaaatatatatttatatatatttatatataaaaatatatatatttatatatatatttatatatataaatatatatttatatatatatataaatatatatttatatatatatatataaatatatatttatatatatatatatataaatatcttctagcaaagacatttttcttccttccccaagaggattctggtgccgtttgtaaaggtaatatatatatatatattttttaactattacatacatatgtgagtaggaacatcataccttatttctctttgcccttcatcaacattctccctataagttatgcacatataactttgttggttgtcttaaatgctgcctgggaaaagctgcggtttaaaaatgacaaattaaataatgtattatctcattgaatccttacagtaaatctgggtgattggaactgttctatttttctcttataaatgagttaagtgatgctcataaaaggtgatttgctcaaagttaaccagtcagcatcagagttgaatttgaacttggttcaatacagctttaaagcatgggatctttcccttgcattgtactactggttaagagagagaggtatgaaaccctcgaatgctttatcaaaatatacctgtcacttcctcttcctacccactcttcaacctccagattttcatactccttattactttccccccaacaaagtcttgcagttatttctgataaatgatacaactgccttccctaatgacattctccaatcctcaccatctccatcacactgagaactatggctttttaaaacattgaagttaatttttcaggatgttctctgacaaaactacatataatgatataaaatagttattgatactctttcataataaagtgagaataaaacctcattctatacatatatagtgtgattataaccactatactaaagaattgatatatttaaaaactcaaatataggatatgtatgctagaataatgagagaaattaattaacactgataatattaataaaaattatcatttctacaatgagactagaaaggaggaggccagatgaggcagagctttatgctgtattacatataatacaaagctagtacattttcttggcaagtgaagagatattagggagatgatttttagagcttagtttgacagtgaaagatgtataaaaagaacgaagagccacacgtagaggctggtctatgtctgaagaccacatcatgtactgtgatgaaaagtaattaaaatgaaacatcaatgttatagatgcagaaaggggcataatcaagcatcagagccagctgtggagataatttacagacttttatctcaccagcaagataaaacatacatatcttcaaggaaagaaagattcctatatgaaagtgaatgagctagttattagttttgaagaaatggtgtcttagataaggtgatttgtagcaatagcatttagattttacagatacacccagttcggcaggatggttgcttctacaaatccagttaaactctcccaagtgacagaaatcaagatatgtgggaattatttatgctcaagatgacaatttttatagaaacagtatctatccccccaaaaacatgggctatatcctaaaaacctgaaattaatattaaaagccgtaaattcccaggacacaattctggaaaagtaatgtttactctaaaatcattttattgagcacctactatgtgtcaggcactgtgctaagaacagagaatctaatgaagcagggcctgagtaagacagtcataaacagaaaatccatcctgtataaggtaggcactgactcaacatgggagggcacatcagtcgattcttgctgaggcttgagagatgaggaggtataaattatccctcataattcaaacttaacccaaggtattgtccctgtatttactgaacaagaatgtgatatagaagaggcagtttagacctccaagcaacctatagttaatgggtaagatctaggttggaagtggcctgccactgattaccctaggcaacctggttaaccattcacagctagttgcctaatctgtactataacaatatttattggatacttactgagtgacaggtgttctaagcactagactggttttctcatttaatcttcacagcaaccctatgcaatgagaactatttactgtccctatgttacagatcatggagaggttagataagtgacccaaggttgcacccttagtaagtagataacaagcccttgccacagacttgggggatgattaagtaaaatgatgtctataaaaaaattagtctatacttggaatggataacctgttaaatgtgatagttattatctgtattattttttatagcatacgaccctaccttatctcaaaacatagcacaataacattatttgaaaaatataaagttatttaattaaaatttcccctgacaatataatttttatttatcattcttttctgtacacataattatttattaagaaaaaatttaaaaagtacctattaagtacaacaccatgctgggtattgtggtataaagtagaaaaaagtagtcgaggtggctactgcaatgaatagaacagattataatgttaatacctggtctcaaaggctagcttggtctcagaaagttctttgaagcaaaaggttgtgtgcagtgaagatctcacagaatgtggtcaccctttcaaatgatgacatcctgaggcaacttagcattcaacctctctcaaaaatcaaatctggcacagattattttctaaaaaataggacttttcccacaaatattttcttcttttaaaattaacacacccaaaggtttaagactcaaatgccttactttaggacttgtaagaggtctctttcactgatctcaataccactacggttttctcaatttgcccactgtcacattgctagctttcctttcttctctagaacatcaagggactctccatcattacgccaattatttgttttaaacatagtgagcaacccaatgacaaggttcttaagattgaggacttcatatcatgttatttccttaaattaaatggaggatatatgaaaaaggaagggcctgagacctttatcaagagaagagttgggaagatatgagaaatgtataggttgcatatggaatatgttttctcaaatactgtggatatcagcattaacgggcataacgctgctgtcttccccatgaaaaaggctgccatttaaagttaggttttgtggagaaggaattaagcaaaatacccaaggtagacaggctaaggatattccataggagaggccaaatacttgagaaaagcatcagagctcagtcctggaggtgtttgttgatttatgtgtggtttctctgcattacctttaatggaagaacaattatgcctgaataagacagaaatgagtaaattaactaggtaagatataagatcatagatttttatagcaccttagtgatcagttaagtcaaccttctcattttcatatttagaaaagaaaaatatggagactcaagggagaggaagaatgaagttccctgacaagtgactaagacttttagaatcttatttagagttttagagccacagcaaaaattctacaaagcaagctctgtataaagtagtggtgagcactgaatgctgacaataatagcggaagctctgctgagatgattagaagagatgaaaggaattcataatattggctaaagtcacagtatcctccagggtttattctcatgacctagaaaattataaggctatttaataatatcccttaacttacatattttatttgtcattttctcctatttatcttggagacataaaagagaatttaaatgtataaatatttaaactgggttacatcagttctggttaaagtcatattatgtttccttatttccagtacatttctcagagactggtgacactttcaagtaagcttcatagcggttttgaagaaatttttgtaaaagcaggttacatatatatggatttgtgacattctaacataaaccacagaaaggttcctattaaaaagggagcaaagctgaatcattttggcttttcttcccactgtgatttttattcatttgaagataaaattcaaagcaaacatcttaaagcttctgtttgtcacccaagagttatttcaaggcagcacaggaaatctcacattttcaaaaaatcaggtcatgaaaatggaactgcaatctaattaatatgttcataaaacagtttccaccactaccaaataaaacaacaacaacaattaagatcaactctgtattctttggaatcccaagaaacacaatccataggagacattctcatcacaaaacagtttcaaatttaataattaagaattgtaacatttctgtcacatctctactcatttccctgacataatactttgtgtaaataatttctcaagtagagtaaaacgtcttttattgactggatatattcattcaacatcactgacctttttccaacttgtttgactgtcttgtactctctcttcaataacctttccaattccccctagtagctgttccatcatcttactaagctcctccacctgctcctccctggtcctctttctgagatgtgatcttgaattccatttaatacttcccagagaaaacacagggcataaaacaaaaactccctcaggctctccttccacctacctaatctccacattatctgcattctccctccttttcctccccctatcccagagggtgtcatgtccacaagtttcccagctctgtatcagaatatttccttagggacatgcttcctactcttaaaagtgcttggtgttcttcactagctactgtgtttttctcctctccttctcctctttcctcctcttcttctcctcctccttcgttcttaagcaaaattttgaaagaagtagtttgcacaacttttctctgcttttattacccctgaaatataacttacccccagacactcccttaaaccactctctgaagtattatcagtaactactaattcccaaatccatcaaatatattttcactttgaaacttaaggtatttggatcaagtcagttaagttgtttctccttctgactcctgtaacaacttgtatatatctatattaatatgctccatactatactgtaattatttgtttctgtggctgttctccagactagtttatgagtatctccaaggcaggactcttattacattcatctgggcatcccctatgaataaataactcagtgtgttccacctgttccaatataattcactaaccatgacatttttcagtaactcagaaattgggctattttatgattaaaatgcttctttggcaattggatctgatttcagataatactaatattctttacttgagcacaaaatgaagtttaaagacatacaattagttgaatattttgaagaaagtaataattatggcagcaaaacctaaaatgtggatgatcttttatttttggcaaagcattctcaaaaccatttcatctgtcacaaagtaaagctggagcccgtatcaaagcagggccagagataggcagtttgaacagggctcaacaatgccccgcagagatggtgaatagagctgaattcatctatgctccacacaccaagtgtgtacccagtgggaagagtgacttttgctttgaacagaggctctgtccattcaccaagtactgtagtttgcatttctacttcatctgttcaaagtgtgacacctttcctaatatatcgtccagagaggcactttttagtgaaaggatcctataggccacagtgaccttggaaacagagttcaccacaaattccttttaaatttctcattctgagaaaatacagaaagagctgctgacacagtctaagtataggtcattgttctaacattaaaaggaagagtttctcaaggaaaggctattcacattcagtaagcatcctacatacttagccaggctgctaaataacagggtaaatctgcttattttctctggtctactgctaatctaattttcaaaaagatccataaacaagagtgctaagtcatctgccacaagaacaatatggtggattaaaaatatattgggctctaaaatcaggccaggcctggttttgagtgggtcagcttccctagcaatagatatatgaactttcagcaagttatctaatctctgtgaacattaccttcctcatctgcaaacagggatttggataagaaattctcagaaagttatattgccattaaaggatgtaacttatgtgaaaacatatggcatgcagaggagtgctcaacagtgttgatctcttccatgaagtatatgatagttatacaagagattttggcatgtcattgtcaacattctaataaattcttcttttatttttttgagacagggtctttctgtcttgcccaggctggagtgcagtggcatgatcatggcttatcgtagcctcaaccttctgaattcaagagacactcccaccttagcctccctgagtaactgggaccacaggcatgaaccaccatgcccagctacctttaaaaaaatagagagagagacagggtctcactatgttgttcaggctggtctctaataaattgttattaccaatgtgctatgagattttctttaatagcctacttcttaacatgaagtgggtaaatatctgctgtaatagttttcaaaagtggtaaaaactcaaagagctttcagaaggtcacacaaaacattaacactccagaagctgaattagaaacctggagtgctttttttaaattatttttttttagtttatttatgtttccagccaatagcctgattatgtagactctagattatctatccttgaaatcatatatggagagatatatatgtataaattttacacaacataatccctagttgtaatatattgtcttgggtatgtttataggctggtacttctcaaacaactggaaacgtcacctaatagtccatcaagttataagcagttgcagcagttatggcttggagacatttttgagctattgcaaaaatgtggataatgctatagctagacagagtattaatgagcattaacgtttgtgggatatgattgaaagaggagagaaaaggatgagggatttttttaaaaaggaacattcgacctatggcaataaaaaactggttgtttagtttttttgggttcttctttgcatctcagaatttgaaactattttcaattttcctttacttgcctatttttctctgaacccaaatacctcaacattagtgtaagtaactcagtaatagtcaactaaaaggaagaagcaaaaaggagtggaaagtgaagaatttaaaagaagctaaaacatcatacattgttagtaaataattttcatatgatgaggaataatttcttatttttttccttttgtaagatttctaagacctccctggcttatgccactcagtcctttgaagatgtaacctcacagcgatttaaagtgcacaaactattttactacagcagaaaggctgctaggactaaagactatttttcatttccataagttgtaagcacattgatattactaataacaactttgctcctctatcatagcatacttaatcgaattatttttaaaaacactaaaacataaacatttgtaatttcatttttaaattccaaggtattactagaaaaaattaaggggcatacagctgatggcaacaaaagacagtaaaatagaaagccaagagaaaagttttatgtttaataggatcgatatctcatataatggaaaatctttgctacactatatctaaacctgaatttctgccttaaacaatggctgactttaacattgagccctagggatttgtgaacgagatgagtttgtataattatgagctccatctaaactttattggtcctaagtgtttacaagtaaattgtatttggccccaacaggaattcagaattaagctggcagtctggtatttatattttagaatttctgggttgttctgtaacccagaggaagagatgttaaagaagcaaggtcagctattacctgcaatttcactggaagacaagcagacactgcaataattttaagttaactaaaaggagcaaagctccattatcttacatgagacttgatacgtcatttccttcaacgtatacatagtcatcaaactcaatattgctcccaccccctaaaattctaataaaatataatgtattggtcagaacacatactctggaaaatgcacttctggattgagtttctgtaatttcaatgtatgaagaggagaaaaccttaaaagatgaaactctatgaggctagataggaaggattatcttttcattagaaggcaggccattctgactttctctgaatacgtattcattatattagtagatttaaacacatatacatgcaaattatgaacacatatatgaatatattatcaatatactgatttatatcttgcttcattccataaaggatttagatcaaaacagaataaaacagtatgagttagtttatgaattgaatgcttggtctatagaggaacaatcaaacaaataactttctagactaaaccttttagaaattgatacctggaaaaggacagtctaatgaaagaatttagggtcctagaagaaggaaaaagatgcctccatgttgagtgaaagtgccacagtcacctcattttgcctcttcactggagttacctctcagcatcacaaagacagtttaaaacatttagatgtcctacctttaaaaattaaaccctaagcaccaaataagcaaatcattaatcaccttccacaatcattaatcccaaatcttcctctggtgtcctcagaggggccctccatggcagcattccacagcctctcctagccagggcctttagcttctatcttccactgtccttttagccatgtgaatccatcattaaaaggatgcaaaggtatttaaataaaatgccctcctaaattgtttagctatgaaattcaattgcattcaacatagccttgatgtttctggcatgaaattatagtatttttacaaataagattataaaaagttgttatatatcttttaagtcaggcaaaaagctgaacatgttagtcacactgtgttaggtcattcatgttagaccctggcatgtgattccaggtcataatgcttctaaaggtcctcttaactgctgctacatgaaatttaaattcctagaaagctgacttgcatttcccttctttcaaccatgccatacttgttcctgaatgccaggctatctctccattctaacaactagccagaaggaaaaataagaagagctatatagtacttatctatccagtgaggcaaacccttatctttgtttggcttggcagtaaaaagactgaaaagtgtaatggaaagaagccttcgcaataaaatcctccagctaatatttctaatgtagcttcaaagaagaaacacacattcttcataccactcttttagcacggaaggggtagtgttctattaaaccaagtaataggaccacttattaactttaactcataactgataaagagtgaatttgtaatactattgctcaataatcaacacaccagccctagggcaggtggatgagagtacaagtaggaactctgtgcacaggcttctatttcaattactacttctggtaaaatttgaagactaccctagacctcctgtgtctcagctttttctcattcttgcttctcaaaaagcaggacagaaagaggaccagcacatgccaagtcccgcctctccaaagggtacagagcctttctagagatgagctagggctcgtgaaaccaaagcacatatgtcttttacaatgtttattattccttagcactggcctgttgccaacttctgatcggtcccttcacgaagaaaaggctctaaatgtgagaatgaggatagggggagtctttggagatgaaaagagcaatttggcgagacctttattctaagcacgataattcacgagcctgaaatctcaccctataggggctcttacagtaggacaaagggaaagagggttttctgtcaacaaacccctacaatctcttactgcagtactggaaggggaggctataaataagaggaaaacaacaaccattgagaaagtcaagaaccaagcacaaaattaattaggtcacctggaaaaaaaccaccaccttcttcctttgagtccaacatcatattaatgaatccctgcaaggggcccaggaagagtaggagttatacagagcattaacattctacattggcttagtttggccacaacaacaacaacagattggtacgacatgcagtgaagcagatgaagggttacctaactccaggcacaaaagaaaaccaacaggactctcaacttctccatacagctttcaaacatatgtattacagatctagaggagcatgaataagcaaatttgcattctttccaaaacttcagagttgaatagcttatttctttccagtcaaaagtataggtgaggctaatgcaataaaaataaaaagtgcttataattgcaggcattcaaagagtacatggatcctatgtattacaacataaacaaatgggcttaaacagcagaacttaggtagaacaaaaactgttgctttgtagcaaggtacacttgatagaaaggagactggtaatttcccctcccaagcaaatcttaagaggtataaaatgaactctgaagaaaagcctaaggcatagaagaaaaataattgacaaatgcctactacgtgccaggaactgtttccaggatcttttaatctcaagattaaagactattgatgtaaatttgtctgtaagaataatgaggaccttattgctgatgcctgaccctcaccaacagaacaagcaaggcaatggcaccaaggctccccctgactaggaaactctggtgatgcagttggaagtgggccaccgaggtttgcaggcatgtcacccaagcattctagagactggggatagtagctctggtcagcaaaaaaggtagatacgccacagcatcgactctggatggatctggtgttgttagaaaataagcacctgcctagagtgggagaggatgcctcccatccttctctgcaatggattttttagctgaaagccgaaaactctgtaacaaaccagcaggtgattttggtggtaccttaagctctcagggagctttcatttgagacattgtcataaaagcagctggaaagccctccgaaacctatatttaggtatctattattcatccagagtccagccagaacatttacctgaaagatatactttcaaaatcagacaaactgcatttccaaaacaacccatgttagcagacactaagccttaacatgtgcctttattatgcattcacaaagtttctgctatgaaagtcagaatccagctgaccctaaaggtatggcaaaaacaagcaattttaaaataatgaccttttgctcttataaataccctcagcaatgagttcctacacacatttagtcataaactccagcaagaaatggcacatgatatcacatgtccagggacctgaatgcattgcattgaaccttaatagatgaccaaatatcaaggcactaagcaagttctatgagagcctgagcacttcctgattcatatgttagaattctactagaattctactggttcattctggtagaaatatttcttgaatagctaaaatatccttaactgtgaggcaccaacacattttagcattattttaaaattgagtcaacattctaagtttcccttaaccttcttttagaaattcagacaaattgatatatcagaaattcatgtgtgcccttccccagggaattttcaaataaaaatagcaaaacaacaaaaaacaaaccctaagcctcatctttaaaaaaatttattaaattgttgccattctcaaagtttttttcttcctccatgaaatattagcaatttaaatgttctcaagtcctcatgcttgacttatttggggatgcttcatattaacaaagtatttttattgcataaccattactttctcagacaatattcggttttgcacagtttacttttcattctcacttgataccaatactctagttcaagacaaatcctcatctggtacctgtcacggaatttgataattctgagttttacaaactgaagggaatattgattactcaccatatccaggaatgccttctaaagggaaaattattcacgtgcatcatgttcgcagatcttctgtcattaatatttttcttgtctcctacgttacatgtagtgatttttacagatgaattccaactctcttgtttgagcagctatcgtgggcaattattgcaacaagtattgaatcccaaaaaaaaaaaaaaaatctccccccaccaataaaaacaaatagcaattacaaaaggccttccaggatttgaaaaaagaaacatcacagagcactgcaggtatgggtccatccatttaggttccactagttagtcaacatactaaaataaccagttcaactaataatcctaaatggtggcaaatattgtcctggtaaaatctaaccgccttgagtgtaaattaatgcatccttaaggaaggactctggaatgtgggaagaaaggagtcaaaagacagtttcttgatatccttgttaaagaagtgttagaagggaaatggaaaacttcaggttgctttgccatgctgtcctttagaaatgaatattgctttttcttctttcttaggcacatattcatgtatggtcactttaacgcagtgctaccgtctgagacgtgtcggacaaaggcctgggcagaggggctagaaaccatgtatcaccaaagccaacttctttcccagatttcagaattgctggttcaactgcaaaagtaggaaggcaatgagtaatttctgctctgcaggacaagattaccattaactaccatcatgacttcagaagatgctgtcacgatgaaattcatttctgctgcctaaccccataataaggctggctgttctctttaagtaaaatgactaagctattgatcttttcactgcagaatcccctttattttgttattatcaaaaccatgtgggagcttttcatattttgccttggaaagaaaatgaatttcacagctgcaagtcagacgttgtctaagaattcttcccccgatgtctttcttttcttttttttcctctctcaatctcttttgtttttcaccccaaattcagttttccaataggtgtcatttattctgatgctctgacatcttctgaaagattctcatgcccaagctatacagaccttgcatgcttttaaaacacaatggcaacaggctcctgctggagtcccccagcgccgaatttccagcagaacctttggaatcctcgcagccgccttgtctgccctgggctgtgccgccccagctctgatcagctcaggacacttgcaggctccgtggtactgtacattaactctgcagcagcctggctcagctgcagagactgctgcctgacaggggatgtgctggcgtcaagggggccctctaggtgggttcccagacattgcagagccgcgcactccttgctaacctccaagtaagagcaagcaaaaggggttaaaggaatagctcgccctggaagagcagacttctttcagtaattaccaggcaagaaaagctaaacaaggagaagcctgtaaaacacctcacagggaaattacgccttaaacaaatacggagggaggattttttgtttgctcgttttccttcttacccagtgaaaaaaaaagaaataaaagaagtccagagataatttgcaaatgatagagtttggtggatttcactccttaaaaaaaaagcaccggggtggggaagccttgtttacttgatgatttgtaaccatttagctgcagatgaccacatggtgatttttggacaggaaatcctatggaagccggttctgcagaagtcagttgtacttcaattgcaattgcgcatgccataaaactgcttgtttgattagggggtgtgtagatatgaggaatgctgagataaaacgttgcaatccctatcactgatgttttgcatttcttcatgcttgctcctttgttgcaaaaattctgttcaataatcccccaaaagcaccccatcactgttgatgccattttggagcaagaataaaatagtaaactcttgtaatagtaggttggcacttaaatggtatttgtttgaaatcagtgggagaatggactttgcagtagaagtacactcaacattaatataccacttttaacttaggtatttaaaaaggcttttacgcaattgcttgatattaaatggaataccggcaacatttaatataacatgctattatcttcatttaggatttccccagtgaggtcctgtcattgcagaaaatattacccaagattgggtggagggcatgtcccataaattcaaaacctagtataaagaaaactaatcttaaaaaccaccataatttggagaattttcattttgatcaaaagatgatcctaaaaggaggattcctaggaggaagaagaactgggtgattccttaaaagcaatgtgaacttgtaggttcagaaagatgccactacagcataaaagaatcttgagaatatttgttgagatttcctgtagcctaggcagtgtcctcatgacccctttttgctaaagggactaaatctcttccataaggtcatttgtaatctggcccagaaaacttcagcctacattgtttttaacaagctttgaatgttttgaatcaagtaattaaaattttgatattatattagacatttaaatattattatttaagagctaggaacatctacaatgccccaggtcccattctaagatagttacagtattaccccatttaatccacacaacagcactatgagttaaggactgttactagccctgttctccagatgaggctattgaggcactcagatgttaagtagcatgtctgaggttaaatatctagtgagtcactatctgaatcaaggaagtctggctccagagcctgtacacattaccacaatattctagcacctctgtaatcataataataccaccttgttatacttttatactttctaaaatattattgttatatgtattattttggcatcacagaattatgctgaggagattaagacatttattatgcccattttggagatgccaaaaagattgtatttgttcattatcaggcatcttgtgagcagtagatctggaagagaattcaaattatttgactctggttagtgatctttgatcatgatgatgataatgatgggttttaattattttaaaactaacattcagtccttatacaagagagtaggtctccatagaaagtagcaaatgcaaagattttttaaaaagatgtaaaaatatattttcctttgtaatgaacatcatttatctgacattattttcttagtccattttattctactctgttcatatgtcaaaccatcacctatgggtgataggatagtaagaatacctctgaatctttctccactaccacacagttcaacattcaatacttgttagctacatttccatttgcgggcaatgatataagcaaagcactttataaataaaatacaaatgatttggccattaaactactaaatatacttaaactaagaggacattttagctgaatatttttaaagtgaattttcgttggatttttatttttatacatgcaactgtctagaataaagtctaacaaattagaacaaaaggaaacacaactgagaaactatgataaataacagaaaagccaaatttctgcttgaaagatagcaaagaaaaaactgtaatttatttcacagttcagagaatcaagactacacattattaaacaatccaaaattgaatatttttgcagacataaggcaacaaatataaaagaataggcttgcttagaaaatagaaataactcatttccagcattttattccatttatattagaaagagggtcttaagagttatgtctactaatttataggctgatactttacaaatttaatacttcctacatgtatggccttcaagaaacaacagttaggcagaactaataggtttgtaatctaaaaacaagttgtcaaaaatgaaaaaatgttgttgggttagggtaatgctaatctattttgttacactaaaagataatcatcctttcatgaaacttttaagaaatatcaggaagccagttctggttgctcatgcctgtagtcctagctacttggaaggctgatgcaggaggataacttgagcccatttcaagaccaggctgggaaacatagactctgtctctaaaaaaattaaaaagaaatatcaggagtaaccataaaagattatctttatggctaatctcagccccattatttttatcaatacaggagtgcgaattattagcagggcaccacaaattggcataacctcagtgaagtccctgcagctatggcataacctcagctctactagagcaaagactggtttgttgttttgttttgtgtttttttttaaattttaatcccacagcaagcacaagagtaagtgaacttatattaactacccttaaatgaggctgattcaataaaaagctcaattaattgataaactacaaactcagagcaaaccaaaatactttcaacattttcattgaaagatcgcttaatgcatccagaatcagagccagaagtattaactagccggtgtcccacgtccttttccaataaaacccttttctctcatggttatagggttatgctcataagagtgaaggttttcaaactaagtttctgggaaccctatggtttttcaaagttgcatcaggtcagctgaggggcaaggtactttgtgctgggtctaggaagccaggtactttgtgctgtttcaacaagagctcttctgctttaactagttttatctcaaagtttgataatacatacaaaaaaagtctggctctttaaaaaaaattacaaaaatgtaacagtagaaatacagaattaatactttctacacaaattcttatctctgtaatatcagtttcagtatttcatcctcttaaaatgccttcaacttacacacttccttcacaatgagcataaaagaatgattaagttcaacctttatgctagtataagcatagtataataaagtcacaccctagttcctgaggttgggtatttcctagactctttagtcacttgtacttatcagagggtgtgatgagttacttcattgattttccctgagtttcactttcagaaagtaactttaatgtcaaatgttaaggtatatttttttgtcatcattgcattttggtataatcaatagctaatgtcaatgtttgcctcttaaataacttgatgaaataaaactcctgtatatttagacatcaaagaataaagacctaaaagatgacttatttatcttatatgaataccaataatcagttcagatatttttggaaagtctccattctttcaagaggctggattacttttgtcccttagatgtcaaaaacaaaacacttggtccctgtattctacatattgggttcatataaatatatttacacatacaaaaacttctatgtacttttcttagcacattctatatactattaataacagtataaatacattatacacaaggatatagaagctactgtcacctggatatcttgcaggatgtgactttttgcctcaagctccccccataaatatatattttttaccaataaaaaataaaatttacatgagttttcacatgtgtgtatgtatgtgtaattatacatttttttctttttattgcatatatcatcaactaataaagaggtgagtgtgccatcagaatgagacctgaggtggctgtgcttccaaccccacctcccagcaagaaaagaacattcaagaccaaattctctatctcacctttacagaaagccaatcccccaggaacagaacagtgtcttcttctctatatttataacaccaaaaacattgttggtactcagtcaatgttaactaataacgatgttgatagtcatgactttccactcctggcaagttctagcaaagtctgaaggcatgctgttctgaacatttataactgaaatacgagaagcctttcatgaagccgcagtttcagttgctgagagtcagggaaatgcatcatgtttcagcaagttgctagtagctactacattcaatttctacatattctcataacccagggtacaatcaccaattagaaaagaaaaaataaattcattaaacacctagtttcatcacctaaaaccagcaaatgctttgttgggacttttcatgattcaactaatataaaaagccattttggatcatactcctcaaggttaaatcttctaatcttaaatgataaattcttttacagaagaaaaatctcataatatgaaatatatttcataattggaatatttagaatgcttgttaaattttacttttaattttttttttggaagtagaagacttaaaagcctaatactgaaatacaaagaaggcacttaatatttatacttaagaatcaaaagtggaaaaatgttcacagcaagtttaaagacaaaaaagtcaaatgtgtataccatcttggagtcctaagatgtgaacccttattttcaggttctgccttttactttttgtgtaattttgaccaacgcatgaaacctctgtgagacacaatttccttatccgtagcatggaagtaatacaaacacttagattattataattttaacttattataatttaaaattttttaataagaagagctctttaaatgttgtttgcatatacctttaaaatttgcttagtaaaatataataaaatacagatcatttgttttgcaatttactggaatcaaaatggaaaaaaaagaaaaaatacaaataatgtaatgtcaaaactaccttctgaaatggaattacatttcatttatatcttaagcttttctaaaggctttgtataatatttgtttagaaaattcaaaggagcaaaaatatttctcatgtaataaaataaagcccaacttcaaaacttactcatattatcagctgggcatggtggttcgcacctgtaatggctctcaaaaaaaaaaaaaaaagagaaatgttgtaagaatgcacacttattctttcatttatcctgattagatgtatccaaaatagatttgctttcactggaaatttaattgattgttactgattgataatttaattaaacttctgatgacagttcttctatcactcaacctcccagtaaaaaagtaacataatccagctttcagttcctcacataaggagcttggaagttgccaatctgtcctaacaacaaaaaagctgaacaaactgaaaaatcaactcttcttagatccataagagaagtgaggtcacagggcaaactgctgcccaaaccactggtgagatagacagtaggctatggagaatcacaacataccggagcagaaacctccaagagaaccagtgctggggtagaaaaacctcaactataattgacaaatcgttagaggctgagtgcaggcaagtctgaaagttgaaaaactccagaggaacccagtaatagggaggtccccacaattctgtgtgttttacctccaggagtgctaccaagttctcacagtaaatattggagaaaaattctctcatgcttccagcaagagaagggaaaaagtacacatctttaaatctgctgaagcttggttcttcctgaggagaaactagttaatcagagcctaacctgctggggttttttgttccattttgttttgttatattagagcctcactgacctggggaaagaaaaatgcccaactccagcccactctagcctaccatcaaggagaaaggaaatactcaattccagcccacgttagccattctctctcacctatggtataagaaaaaaaaaacctgaaaaacacttaggagattcacaatccagaggcccaggctcaccaaaagtctgaaacctaattatggaatgatagaaagcttcccctccactgccccttaccacaccaccacccacataacttttttattttatttatttatttatttatttatttatttatttatttatttatttggcagagtttcgttcttgtagctcaggctggaatgcagtggcacaatcttggctcactgcaacttccgcctcccgggttcaagcaattctcctgcctcagcctccccagtagctaggattagaggtatgtgtcaccatgactggctaattttcgtgttttcagtagagatgaggttttaccacattggccatgctggtctcaacctcctgacctcaggtgatccacctgcttccacctcccaaagtgctgggattaccaggcatgagccaccatgcctggcccacccatataacttaaggcctatttacaggagttccttttatccagtacatgcccagctatgaagaaaaaattacaatgcatagttaaaggcaaagaacacagtttaaagagacagaagaggcatcagaactagacatgccagagatgttggaattatccgtatgatacaaaaatggaagatatacatcaatataaatttgtgcaaacccatagaatatacaatactaagagtaaattctaatgtaagctatatgttttagagataatgatgtatcaatgtaggttcaattgtaaaaaaaaatgtaccacttttgtgggggggatattgataatggggtggctatgcatgtgtgggggttggagtaaatggaatatctctggacctttctgtgaattttgctgtgaacctaaaaatgctttaaaaaataaagtttttacaaagttacatgacaagcattaacattttatacccagaatatgtacaatttttatacaatttcaaatttatggatgctaaaattgctatttgtaatgtcaatagattccattttctttacaattgcttgaagcaaagatgtaattttatcaagaatgtttaacacatattttgacaatctatttataaaatctgaaacttatcacatagtttcattttaactagattcaatatcatttaaagtttctttttaaagaggaaacattatttcatttaggaaaccatgcaagttcaacatgggaaatacaaaaataaaataaaataaacacacaagaaagaagcaagtcatccataattccattcccaaaagacaagtcagtatacttctttccagtcttcctcccctccaggaatagtgggtttaccaccgatttttatgttgttgtaagaatatttcaccgacctctgaatttggtaaaaagtactgcctggaaaagaactcttttatttgccagatggcacatggtaaagaaattaccatgaaaatactcaaacctctccactctcacaggtttactggggaaggcagttcaatcagatggggcttacaaaagttattattctctttaaaactcttgtgatgaatttttaccagtagatgatctcaagagggtattcctctggatgtttctattcttaactctttagttttgatccacctttaggtctgcttgtatatttctttttaaaaatcttaagtagtatatcgctgcatatactactacagtagtaggacatagtagatgtattgtatggtccaggtaaaactaagaaattattcttcctacttttagaatggaatacaatgtgtggtccaccatatatattgtcaatctaatttaacgcttctttaatattctgccagtactggtttttagtgctttttaaaaattatatatatatatatttttgcagtgttttcagtcactttaataggaagctggaagaggctgcatcagaggctgcaggtaaaatgccatttaaaatccaaaggccccatccaccacttctaacccatgcacatatataattacacatcattggcagttaacagagttaggtataaaagcaaatatgactatgttatttacaaatacatatatttgtatatatttataacatatgtatattacatatatatatacagacacatatatgaaacattaaaaatgaaaatatttcatttagaaaaccatgcaagttcaacacgagaaatacaaaaaaaaaaagaaacacacaaggaagacacatatacatgtatttttatttcggcatcttgaattgactacgcagagacattgccactccatttttaagttatttttgaaatagatgactaaagattatcatcagcatgtagtggggtacatgctctaggggtagtggggttttctggtctgttttgtccttggtatatcctctaatgcctagaatagtatctggtgcataataaggactcagagtccttattatcttgacattgactttgttaagtattttattatcataaatatttaataaatgagtctctataccaaacatgattacttatgtctgcctatgtttccttctaaagaccttgcctttcctacacttcaccattataaaatctgatgggaataagcatgataacttgactcactgacatctgattcatttactaggcagcaaatattaatatttgctctttggaatgtgaaatgtcctaagtgaaattgagactctaatcagttcaaggtggggttgaaccaaaatgtcctgtagactcaggggctgaagttaccattttgggttcagtgcaaactgataactaaagagacagtggcaattacagggagaaggcaggaaagaacagaaacacagagacaaaaagaaatcggtgattgtatggccccaaagagagtagctgccttaatttcagttttcctaatccaataggccctgctatacttgtttctgttaatttctgtatcttcatagtaactatgttcccccttttctacaggagctagtctgagtcagcttctttttttgcaatcaacattgtgatgagtcatcatataagaaaccttatgttgctattcataaattatttccttccctcctgaaataaagtcatttaaaattaatgctatattgtaatattgaatagctacaatgaatgaacttgacattgaattaatggttacatgatcaagtggcttaaattaaaatgcacagagtggcgttaacaatgtatctacatctacatccacatctagatgttctggagactgttctttttctctgactgacatctattacacttccaatcaaaatactagcttctcattttctcgaaccccttttcacagttttcttcattaaatgtcagtttgtttcagataaggagaggtgagagagagagaaagagagagagagagagattttggaaaaaaaagaaatactgtgatatttttagatttatagagagaataatttagtactcaaaaggcagaattcctttttaggaaaaaaaggatattcagataaattttttcaaataatcatttgaaagcttaaaaatataaaaatgtatttaaactagaacccaataatttagaataattaatagtttcaaagtcactgtagtataattaagtagaataatctttgcattcaagtgtagaataaattcaaggctagttattaaatactagttgcccattgtggacagatgccctctcattcacctagcattttacacactcttccttgctgtttttaacattctgactcgagggtgaatctataatgctgagcacttgaaacttttaactcgcctacctctctctataattggcatattccattcctaaaaaaatcgcaatagactatataaatcacttaataggcacaacaaagcaaaacatgaacaatacacgtcccaaactgatgagacacaaaactattaatgtgaaactgaattgcctagctctgtatcttatacttttctctctgggaagcacatttgaaatgtgggaaataattcaatggggaatataatgtgattttatctgttgtttttagttccaagatttgtaaaatacataaagacacaaaagagctttaaaattttccacaaaataaagtagcaaacctgatcaaatagtaaattcatttttaagatttctcctcttttctcactgaccctccctttccctttagattagcaatcaaacagggactggagcaaaaataaaaagcaggaagtgggcaacatagcacatgacaaaaaaggattttgttgtcagaatcctcagcacgttttattgatgtttgaaattcccaactcattttcaaaatgaaaatgctacaggaagcaggaacaaagttaatgaaaatataaatgcacttttctcctcgtcttccataaccactcactgattagaggcacagtccatttgagatgaggctgctgcctgtgtgtgtgggagggttgaatattttttgctctgggaggagcaactgtgatagccccaaatccctgacagcctctcttcatagactgcaggtctagtgtgcaggtgatagtgctaaactcccagtccaagggagtctaaaggaggaagccgtgaagaaaaaggaaagtgaaacagtggactaggacagaaggacattactattaatactaattttcagccagtgcagtggctcacacatgtaatcccggtgctttgcaaggctgaggcaagaggatcctttgagcccaggagttcaaggctgcagtgggtgacaaaatgaaaccctgtctctagcaatataaaaaataaaaatcctaactttcccattccccccagtgacctgctgttttccacaccttgaatgcacatctcttttgggatccatttgctggagcagaggtgttttaaagatcagaagcatatttgctaggaggcataaataattttcccctcaaatattagagtaagaaaggggaagcacgcaagaaagatacaaatatgatatggtattgtcaaggtagttaaaaatatttgtaaatggatatcaatattgtaacatatttgctgaaaatgaggacatgtagtagatagcaaaatgctgttttttgctttttctttttttttttttgagctcttgttgcccaggctggagtgcaatggcgcaatcttggctcactgcaacctctgcctcccaggtttgagtgattctgctaccttagcctcccaaagagctgggattacaggcaccaccaccacacccagctatttttatttatttatttattttttttttatttttagtagagatggagtttcaccatgttggctaggctggtcttgaactcctgacctcaggtgatccgcccaccttggtctcccaaagtgtaaaacacattttatttgctttcaaactgtccctttaaactttatttataaagaacatcttatgacttttctgggtactgttaggcaatagagacctttgcattcatgctaaaccatcatctcagactctatccagaaattagaatgtccatttcaaattgtaacccaaaactctaaacttgattgaacttacattttctcccctctcccagctgggcccaccacagagtctctgtgtgcagtggagtaagtgggtggcattgagactgggttgctcttccccttccttggctatccaggctggctagccgttggtattgactcctctgggattggaaggcacagaaagtggtgaggaaaggaagaaaagagttttgttttgttttcctgaattagtgccatcgtaagatggcatcacatgttggagacctggcagatgttgaaagctgcctctttgtctcatggtacttttgtgggttcataattggtatccctgctgggtcctctggctgcaactcctttgactcaagcaagagccttgttttccaattgctgctgattaaccagcacccccatcaaggccttggttttctagtggttccatccctaccaactcttgctcttggagccaaactggctttcccagatggtcctcttgggaaggacatcaaatggctgaaggccaggtctctctttgagcttaatgtgagttagataactgcagcccgctttaagagagggtagggttggactcacggcactactcagttctctctctcttaaaaatatatcttcacaagttcttgctcaggcatgaaagggtgcattttctgcctttggtcctggtgtctggctatgactgtccatcctgtgtaaatgaggagagtaagtctgagcaaaaggacaaagtgctaagatggcaaagcagaacctgggtgatgtgtttgaacctcttaataacctaccctggaatagcctaccttgaaaattcatgttataagacagtacattttcctcatttgtttttgttaagccattaagttgggggctccagacttgcaaccaaaggcatcttaacttaagaagtttaccataaatatttattataacccacacaaggggatgtctcagtaggtaatccagttagacagcagaggaagtttatgtttcctcacttttcttcttctttccaagtagctggtgggtgagctcatctgctacaaaacacacttcaaaataagatctttaagttaattttcaaattgaaattgctattattgaaacaacagttgtgatagcacctgcgataacaaatgtaaataaaaacaaataaaagctatgctcaatttgtggacccatcatttctcagtaggcttggatctctagagttcatggggagacccaagaggtttctaatattacaatgtattaccaatatccagggcaacaatcacatttcatcttagaaaatcagaagatgatgtatgtgccaaaaacctttggaaattgaattgtgctttatgctgaattctgtttggaggatctagcaaggacccattttactgttccatcctatgatgtgggtgtgcttatattaaatcactttcagagaaacactaggtgactaatttgtgacaatgatatgtttgcagactaacacattcgtaagaacagcagaataatgagctaatttgtaacgtaccagatggaatgtactgaaagctagtggcctaagctatcataattgtcctttataatccaagaagtcatttctagtaatcttgctacccacaacattgtttttatataaacaggtcacagtagaactaatcctcttcccgtgaaggcaggcctctgttatttcagtgtgcttgcaactggggagctgctgcagtgtgtggttctggtttgctttttttttttttaactcctatgtctgaatggcaccctataatgagggatcattaatcttaactgttctgtagcccatgtcattgttgttattttcttttgaagttgtttcttccgtaatttacacacatttaggtatattcaaatttatacttgaactgtctttctttttcctctatgtttgtgtgttccagctcactgaaataggaactgaatcctcagcacttttgagactgcccatcccaaatcaatccagtgattactttaaccttcttatcattagtctcactccctctcctttcgtgctcaaccaaaacttgagatttataaatctgaaccccaatttcagctctttctccattacatctcctcagagccccaagtgtaaactagctaacttgtactgctaggttaatagaaatttttctaaaagaataactaatatcaattttcctcaaactctttcaaaaacttgatggggtggaatacttccaaactcattttacgaatctagcattgccctgataccaaagccagagaaggacactacaaaaaaagaaaactacaggccaaagtttctgatgaatatagatgcaaaaatcctcaacaaactagccaactgaatttaaaaacacaataaaaagactgttcaccatgatcaagtgggattcatcctagggatgcaaggatggctcaacacacacaaatcaatacatgtaatatatcacattaacagaacaaaggacgaaaactatatcatcatttcaatagacgcagaaaaagcacttgacaaaattgaacatcctttcataataaaaacccctcaacaaattaagtatagaaggaatgtacttcaacaagcaaaggccatatatgacaaacacatagttaacaccatacttaacaaggaaaagttgaaagcttttcctttaagatccagagcaagaaaagatggccactcttgccacttctattcattataatagaaattgcagtatacaaaatcaacatacaaaaatcagtagtgttgatatacactagcagcgaactatctgaaaaagaaatttttaaaatcccatttataatagttacaaagctgtataacattaaagatgacacaaatgaatgcaaagatagttcgtgttcatagattggaggaattaatattaaaatgtccatatctgaaacaatctacaaaacaatctacagattcattataagccctatcaaaattccaataccattcttcacagaaacagaaaaaaacaatactaaatttcatatggaaccacaaaagacattaaatatccaactcaaccttgagcaaaaagaacaatgccaaaggcatcacattacctgacttcaaaatacacaacaaagttgtagtaaccaaaacagcatcgtacttacataaaaacagacatatagaccaatgaaacataatagagagccagaaataaacccctacatctacagtgaacttattttcaacaaaggtgccaagaacatacattggggaaacacaatctcttcaataaatggtgctgggaaaactgtatatccacatgcagaagaataaatataaacctttatctcataccatatataaaaatcaacctatagtggatgaaagacataaatgtaagaataggggaaaagctatatgacactgatttaggcaatgattttttgaacatgactccaaaaccaaaggcaacaaaagccaaaatagacaagattgcatcaagctaaaaagcttctgcacaacaaaggaaataatcaactgagtgaagagacagcctacagattaggagaaaatatttacaagctatacctctaataaggaatttgtatccaaaaatataagaaactcaaacaactcaatggcaagaaaataaccttattgaaaaatgggcaaaggaactaaaaagacatttttcaaaagacttacaaatggccaacagacatatgaaaaactattccacatcactaatcatcagaaaaatgcatactaatactacaatgagctatcacttcatacttgttagaatggctattatcagaaagtcaaaagatattaagtgttggcaagaatgtggagaaaagagaacccttgtacactgttgatgggaatgtaaattagtacagccattataaaaaatagtatggaggttctttgaataattaaaaatagaactaccatatgatccagcaatcccactactaggtatatatccagataaatcctgcatgatctcattcatatgggaaatttaaaacagttgagctcatagaactagagattagaatggtaattaccaggggctggggcaactggaaatggaggtgcaagtgtgatattgatcaaaggaaacaaaatttcagttagataagaaaaataagttcaagaaatctattgtacaatatggtgattctagtcaataacaatatgttgtattcttgaaaaatgttaacagagtggatattaagtgttttcatcacaaaaataaccatgtgagttaatgcatgttaattttctagatttagtcagtctacaatgtatatatacttcaaaacatcatgttgtaaatgataaatacacaattttattggacagttaagaatatagatataattttaaaatttacttagatgtatatcaagacatgccatatgtttgaatacagtcttgtaaaaacagtttttctgaagaaagcgtggttttctggaaggagcacaggcttttagtatcatcggacagacctgagtctcttattaccactttatttacttagtctcatttcccaaccttaaccaaatcttaattttttcgtctggaaaacaatgatacatatctcctagatttcttcaggattacattagaaggtatagattaaatcatgtagcacatgcaagtactcaatgcatagttgtttcccttgattcctcagatgtttgccatttaacctgctgactgcaatggtgagaatgttaaattagggaagcaagaaaacagcagtgtagaaataggagaaggatgaataacataagcttctaagaagcaattattaatgcaacgtaagctgggagggtcgactgtaaacagccatggtatggttttggtatcatttgccttaaggagagtctataaattagagtaagaccaataacccagaagaaaaatgggacatggatgcaaataaccatcacagaaggggaactataaatagtcaaaagccatttgaaaagatcttcaatctcactgataaccaaaaataaatcaaactacaatgaggtattttgcctatcacattcgtttaagattttttttaaaagactaaaaatatgcagattgtgagggggtgggaaacagtacacccatacacagttgttagaaacatggattaggagagacattttggagtacaatttagcaaatttttaaaaatgtaaaccatacataccatttcagaacaattacatttgtaagagtttatcctacaaaaatgattgctcaagtgcacacaaacatacacacacatacacacattcattttggcactgtttataagaccaacaaaacaacaacaaaagtctgtttctttctctctgaccagatattaaattcctggggagaaggtcagacctttctacctcctccccagtaacttccaaacccgtaaacatgtaacagggttgaaggtgcttaaaactgcatattggctgacaaaacatcagaatatttttattatgtataaagacaattatatagatttataaaatttgtaactgacttgctatttccaaaggtgaaaataagtattcaataattggcaatgcaaaagtttatttttttctatccattggaaatttgtgaacattttacacaataattgagttttatcaactttccaaatataagtatttcttatttgtatttcagataataaatttgttatttctagagacttaaagtatttaaagaaaatcaaaacatcccatcaaacacaattttgttcttaagtctctctttcttcttttattctccaaccctgcctcccatggtatatacaaagctttgctttgctgccagactttctctaacatctaaaaagtgtagaaagcaccgttattataggctaaaattgatctcatttatcccaggagtaccaacattctcaaacaggggttcaaactcctgttactataattcttgggcctgttatttcaatgagaatctaattttcttgcaataacaaatggggagatgggagacagtgtcttccaattacaaagaccatgctcctgatattatcagcaaagcgtacctctgggtcactttcaccagaagcaggtttgggccttagttacaccctctggaccaaagtgatgtgaatttaagtgtatttgttagtgaactgtctgatctgggctatggaacagactaaatggaactaatccatctaaacgggaaactcattagacaggtagtcagcctaacttggctactttattacagatagatccaatattaaaaataagatccaatatttaaaaataaaatagtaccttctttttcagggagaactatactaaataagaacagttgatatacatatattcatatgtagatgcagacatatatagatatatacatatgtatatacatgaatatacatgaagtaagagtgttacagtattctcagagcaatgtgctaggaaaacaccctttcatctatgtgaaccccagatcaactcgtataaattctgtatttgtatgtttctagcactataaattgagctgagcttctcaaaagaatacattgtattaactaaaggaattcaattaataattagcaaagaaactaatcagctttcttccacataccatttagaaacatgcaacagcacattggaaatggcagcaggaggagagtgaaataaagttaatattttttcaagtctgtcttctggggaagactttgtgcattgagacttagacaagttatttcctttaatacaataaccttataaagcatgtactaatattccccagtttatagatgatgaatctgaggaacctggagaggttaagttacttgcccatggacctggagagtaaatggctgagctgtgcttggacaccaaaacctacctttgcccaccatactgggagaccagaattgtcctgtggattcggagaaggctggacaggactggttggaggggatgcaattatggaaagagtagatggagtaataaagaacataaccttcgtaagtagtaaatgccaggcactgtgctcaatacttgacttgcctttcctcatttaatcttccacaaaagtactactagtttgtccactttacagtgaggaaaacaaagcacagaatagttaagcaaatcacccaaagttacacagccagttagcaagtcttacaattaattcataatattatttcattgtttattttccccatattcatctctctttttgttttctatttctttcttacagaagggggggaaggggacatgttttataatttactgatttcatatacctttggaagttttagtgccttttggttaaaaagtaaccaatatttttccctacgtttcagatgccaagaggctatttagagatattgggaggcactttactgacgttctgcttatgtcaacagatacgcgtagaattaggctgtaatttgattcctaaccctattgatgacttcctaaaccctcatcaaaaacattttgttttagttccccatatgcaaaatcaaaataaagaggtgtctttgtttaaaaatgctaatatatgatttggcaaaggctgacattttatcttgtctccttggctgctgttttaggattattcatctagcactgactgagtgcccagcatccatgcccctcccctttcctatttattatcaggctgctgcagtgcagcgttgaaacatctgatcatttagatcattaaaaatcaatccaatgaccaaatagttctgtacgttttagagaaatgacagaaagtgcagtattagattgctattaacttgctctggggttttctttttacagctgccaggaaagtcatttggtaaaattgattaaaccagcatgccaaggaggagagcggaaaagagcagagaaatgcaaacacagtgagcttggaggggagggcaatgtttttcttgggaatgaagtgagatgtcagtagaggaggcagcagggggtaggtgggaggagaaaccttgcatatagtgagcatactataattagaggtacaagagattcaagatggtaggatacaaggaaccacaatgcggaaacaataaaggaaggaagaaggaatgaaaaggaagcaagctatccatgcgcttctaacatactgtctgcattggttacactgcacagtttgtctgaattaatccaagagacatcactggtacaataagaagaagctgatttgaggatttccatagataaggctctttcaatagcaggagtaggtagggaagagtgcctagtttcctacacagtgtggtttatttctgtaagaacaattaatgaagaaaagaaaataaacctctctacttgtgctcaataggacgatgagtgcataaaaattcacacatgccttcccctaatttgttattatagtggccatacatattccttccctccaaataggaactgtgttccccttacagaattgcatttctcctttaacacgtttcaacaattttttgattaatccgaaaagaaccctggtatgtgaaatcagagagtgctgacaaggatggattttaatgtggggtttctgccactttgcctctatttctaattcctccctatgtcctatttaaagtcacacttagctcacacagcgcatgcttctagagaagaggataagcaaaaccatcaagaatttatttgctgtgtattatgtctgctaacatttcaagtataacaaccacctaaacacaagggacttaaaaacagcattaaaactttaaaaataaagaaaatattctgtggatgagtgcatgtatttccttggatattggacattgaaaatgataagacacaagaaccatttaattgcataggagaacaccaacactagtctaaatgaagtaacccccttgagagaagttttaaattgcatttaccctgtcctgggtatgctacttggaagaagctatgatttagacagcaatttttggcagccaagatttacataagagtaagtagccttcttgaatgagagtggcagccagcttccatgaagtctcccacctcctggcatttaacatacatctttgtagagtccccctcccactctatcccaggattggttatcagacagcagtgatgacatgtcactttcaagaagagattatgaaagactgtgtttgacttctgtcttgggatgtctctgtcttttgtctccgtctctgtctgcctatctgtctctctcatctctcactctgggggatacaagctataatactgtggttagccctatagagaggcccacatggcaaggagttgaggctttccaacaactatatgagtcactgaggaagcagctgagccttgagatgactgtagcccaagccaacaactcgtgagagacccttagccagaaccactaattaatatagagaaatactgagcaatttacatgattgaagatcatatgtagagagatatgtcataaaaggcaggattggatgggaagtagaaggatatagatgcaaaacttcaaggaagaaggtgtactcatcattggtgctattcgtcaccattctcagttctccctctttaaggcacatggcaagattgcactttcttgcccctttgaagttaggcatggtaaccttactttggcaaataaaatgtgagcagcatgagaaacacgtatatctctctaatttgtatatgtacacacacacacacacacacacatatatatatgtagttaatctgaatatcactatgatttgatgaaacaagacaaaaaagaaaaaagatatgtgagcagaagcaatacgtgtcacttctgggggaaaccactgaggtctgtgtatgaagtgccctgtcttctgccacaatgactgggaactttcccgactgtggtgtctcccattaactgtgttcctaagtgaagagcagaaccctctccctccaccacaaacctgtcatgaacatgtagcttgagtgagaaataagcctctactcttctaagcaactgagcttttggtgttgttcctgtagcccattctcactaaaacagaaaatgggtctctgactaagaattcactctacagaaaaaaggaatctggtatgaataacccgaacctcagccacaaactctgagcttcctgaaaggtgtagtggttcttggcagattgtggtgactggcatatgaactctcctaatcatatcccggaaatacaaagagttgtgtggagaactgaaagaacttttttcactagattcctagaatttgagagctccagaagcagcacagctgttggcttcccctgagagagcaagaagggagatgtactctcctttctactctgcaggtgaatagtgttctggtactgccctagatacaacagagaacattcatagctggaacaaactggttggtgtctgccgttaggcaatcaagagactaatgaacatgggtcaaggtcactggtagagcagagaccagtacaaagtgacatcctgggcagatccatgcaggggcaattgcaaggcaccccccagagtctcagagatgctaagtgaaagaggttgtgtgagttactgaggtttatgctggagaatatgagcatagagctattgagactggagaactgattttaatgtgacctaatttatatctaccagcttgaagattaaacatctaaaaccctattacttcattactaattaattatgtgtttgttacaataatctatctgacatcacactgtatcatgtggcattatatggttccaccttgatcagctttcaactcaagaatttaaaatcctcttcaccaggatcttattttggtctagaacagattaatctattctcaactgccacatgtttttagacactatacaaataacattttaaaatgttcattgattcaaagcttagtggcttacaattcagtgcaaaaagacatgggcaatgaagcaaagatgtgagcagttcagctgaattaacattttgagtatatgcacattagtcctttggatgggatcatgcctcaaacccattgaaatacacctcaatgaaacaataagtaaacgagggggaaaaggagactacatgaggttttgagtggtgaagacatgaagtctgtaaggctatggagaataattaaatgtgatatttatatttcaaaataggtaaaacttgataatggcagaaggtaaggagtcagtggagaaaaacagaaaatgctggcagaaagaaacaggggctaggggtacaaggtctcttagaaagtgggaagaaatgggatctagaccacaaatctggatgtccttacagaggattcacatacaaatcttattcaaatacatcatggattcgtactgaaccttcagggtagattttaatgacaacctggttgtcttagtccattcaggctgctataacaaaatacctgagtagattagaaatagcagaaatttattgctgacagtcctagaagctaagaagtccaagatgaaggcatcagcagattggatatctggtgatggtttacttccttgttgatggacaactatctattcactgcaagctcacaaggctcaaggggaaaaggatctaggcttctttcataagggcactaatcccatttgtaagaaccctgccctcatgacttaatgacctcccaaagccccacttcctaataccatgatattgggggtgaggatttcaaaacaagaattttgggaggacacaagcagtcagatgatagccctggtttaacccatatggctcatgttctctcccctagcacccttgtatttccccttgtaacactcatcacaacctgcacttgtatattcatttatctgtctgaatgcccgtctccacactaggatacaaacttcttaagggcagggtttacatctgctgtggtcactgttacacaatctccctagcacagtgcctggtacacagtaaatgttccataaatattaatatttgtggattgatcaaatcaggatagacacaagaacaaatttaagattacttagcttattgtcccaatctcactttggcccaccttactttgtcacttaaatgaagtcctagaatgaactgtggcccagtagtccttatacctttgtaaaacttcattgatattgagggatttcaatccagttttgataatatagcagccaaatctatccacatcactaaagccaatcagccagactgtcattcttactctgatgctatttagaatgtgcaatgagccaccggattccacttcctaaaaactaatttccctagagcttctgctctcttattttatcaatgcccctgaggtcagaaactatgattttgtctctcctgaacagcacaatgtctcattaaaacttcttcctataagcttgagtttttctttagaactgcaaggaagtttcaaggatcatgaaggacctttggtttgatatcagctatttttagtgctttgagagcaacagcacagtcaagttcactaatgacctaaaaacaattaattcaatatatattctgattccttgattgacactgttttttttgtttgtttgtttgttttagatttggaaaaaaattactgcttgttcaatcttttaaaaatggatgttctaatttttttttttacagattccaacaaccaagttggattatcgtatttgaatataaatatgggcaagtctgacaatccaataatttatattttatatagcctgcttctacctaaggagaggaagatagacagtaattatttatctattcaacaaatttttattgactgccaccatatgctaagaacaactctaaaggccagggatatagcagtgaactatgaaataactagggctcttgagtcgtggtaggagagatgaaaaataaacaaaaagaaaaagtgaaatctatataaggattatatgataacagtttgcagggagaacaatttaaaaagaagaggggatggggaatgccaggaacaggcatggtgaagatataattattaaaaacaaaataaaaggatagcctcactctgaagatatccaaataaaggatggaaagaggtgaggaaagaaaacaatggcatatcaggctgatgcaagttctggctgaaggacttgagaacatgaagtacctgaagcaggactttgcttggatagttgtgggaatggaaggagaccagagtgactggaccagaggaggaggagtaggagctgaatctgagaggccacaggaaaaaatagtagattattataaagaccttcaatttcattttgaggaaaatcagaagttactgaagtattctgagcaaagaagtgacctaatgccacctagactggagcagcctcactctgctgaggggtgcaaaacaggctgaagcagggacactggtcaggaggtggtgcagcaacacaggtgggaaagttggtggccggaaccaagctggttgccatggtgatggtgagaaatgggcaaattctgggttatattttgaaagaatgctggctggatttgctgattggattggaattgggagtgtgaggaaaaaaagagtcaaagacaacaacaaagtttggtctgagatcaggaaggctccaggaggagcaagtttgctgggaaagagcaatactttggttttggacatgctcagtttcaggtatagaggagacatcatggtggaaatgacaggaaggcagttgaatatgaaagtctgtatcaggtgagagatccagatcggtagagacttgacaaacaatggcatatagactttgaagtcttgtgattagatgaggtgtaagagatacgcagaaggaggacagaagactgcaaggactaagcttgggacatgtccatgctaagactttggaaagctgaggaggatgcagcaaaggaggatgcagagtcctcaagggaaaagggggaaagccaggggaatgagatgccttgagaccctggggaagagagttgtcttctctaaatggtaggtattcagcatcagtgtagagacacctgctttgtaatatttatttggtcatgggattcacatgccttgacttacacataggttaacattaaatttaatttgcatattttggagaattgaccaatttataagagagaaacaagaggaaagaacaaatgccagaacttatgaaatcttcaagattaactgattacatatcagtaaaccaaaattacattacattaagactgccgttaaattaatttagtaatgcttcaccatgaagattatcttaatatttggctcaatttttaaaaaaaacttttttcttaatttttttacaaaaaaatttttctataactcaaaaaaatattttgagttacagtttacacattaagggggaagccattctccattcacatattcccatatattatataagttgaacttttttccaggcaactgcataatttaagtaagttctgacccatttcttagtcactgccctgactggacttgacctgactggggagcacacattgagttcaaagaacactctgctctgacattagccccataggaataggccactttaaaatgcaaatatgtaaaattaagaaggaagataattatattggagtaagcatcttattttggagaaaaattagaactgaattttatgccaatgataatattcaagctttgtattatcatagaaattatgattttgttttatcttttaactaaaaccaaagtcaaagatttcttacaagtatgagaaaagtgaatttaaaaataaaatagagctatatgagatatgtgcagcattgcttctattattgcatacaatcatagctcagaactgtaagagtctatgttactacacataaagcaacaatatacaaacttctatgtaattgtattttccccttttagaaatggagagaataccaatcctgtttacctaatcagacaagattatgtattttaaagcattttaaaaactatagaatatcgcacaacaccaacggagtaattcagtgtgactttcctttaatggatgaaaagttttaaagcactagttattcttcagttggtaggaaggcatttatctgtaaattgatacatcctcaggcaactgtgctgatattcaaatttagttattcaaaatgtggctttcatttttttttttttttggtggtagggtctctctctatcatctagacctgagtgcagtggcacagtctcggttctgcaacctccacctctcaggctcaagcaattctcaggcctcagcctcctgagtagctgagactacaggcacgcactaccacacccagctaatttttgtattttttgtagagacagggttttgccatgttgctcaggctggtctcaaactcttgagctcaagcgatctgcaggcctcgacctcccaaactgctgggattacaggcatgagccaccacgcctggctgggatatttttatgttgaacattcccattctagccatgcgcttcttacctggacttcattaatatatatatacatatgttagaccagcattttgaggttagaaatcatgaatcaaacagtaaggtttcctgggatatattagacaaaacaaaattgaaccctggtatgtttgaattgggagtagtcctggtacactatgactttctggttcagagataaaagccttaaatggcctcttaaactttaaggattcttagccattcaatatctccctatgccattttgatgagactagtgtaaatgaatcataggcacatagattaaattcccccacgaaatactcatgactatgaaacatttaagaaaaagtgggtaaagagtcaaatatgttttgctgactcctcaatattttcaagatggacacagacacagtcagcacattcaaaacaagctaacagtgaccaaaagtgtctgcatttgctcttatatcaccagtctttatgtcttcttcaattgtgaggaagaaaagctcttcaacaatacagttcacatttcagtctcagtagctggggtaatctgatctcctgattttactctaggcttactttgaatgtgaccctagtaagtttaaaattctttatactgcctaccttacactcctgactagctagttagctaaatagaaatgagggttagaccaaaagaggactatcttacagcgaagtataggtctaggcagttttctatctatttagtgaattattacagaagtcctcaaaatggccttctaggagtctagaaaaagtaaacgtattttccataagcatccacaatctgtctttttttttttcaattatactttaagttttagggtacatgtgcacaatgtgcaggttagttacatatgtatacatgtgccatgttggtgtgctgcacccattaactcgtcatttaacactaggtatatctcctaatgctatccctccccccttcccccaccccacaacaggccctggtgtgtgatgttccccttcctgtgtccatgtgtcttagtagtaaaaccaagaaataatctcatctgattttaatgcaaattacacccatttccaaacatgctggctttttaaaacaatattttttattaagatttacaatggaatttcaaaaatgcagccatttacactaggttgattcttatttcactttatgtacatgagtggtttttcagctttaaagttttaaagaattcagctcagtattttggtgtttcagcactttctattttgaaaatgagccaaatattgatgtggtcagatctatgatccctcaaaccattaaaagttataactctgtgataaatataatgtagcagtgttccaaattggcaactcatattaagtttaagaataggaattacctacaaaaaatttccaagtcaccatatatctgtctctgtgataatgtcatgctccctagcgatgctctcaaatggtagaatgagtcactggcccttgtcttttcaaattttatccatgaaaataaaagtaaactgctaaagataatctagaattttgtactctagcaggtttcaaatataattgcttctgtgttttttggtataaagttgctcccatggagattataattctgatttttttcctattctatgcatttcaagagctaaaataagtgtgggaaaggatatctatatatatctatacctctatacgtattccaactaagatagtgaagggtttaactttgtgtattacttagacctaataattacatatatatatatatatatatatatatatctccaagattttaaagtattaggtaataagtgcacataagatttcgtactttttgtcgttttcttcttttaaattatgcatcagattttcttgtctccaattgctgagggtgtatcttctcttcttatttgctatcaacattatgactaaaaatatatcctccaacatgtctaaaagtcttattttagataggtggatttcaaaccttgctttgcttatgggtaaattaggcaaagagagggtgctgtggtggaggagctccatcgtcctccatcttcaaccttgaagagctcaatttggaaaccagtgtggtagccctgtatagtgaaagtcatttactaacttctcttccatggcaaccacagtaaatattatgctacaatgtggactctaaaataagagattaaaagctaatattgatctatgaatgtatgacaataatagcaccacgaataaacccaagtccaacactttattgcgtctcccccagaaatcatgtgttgaagtcctaactcctcgtacgtgagaatgtgaccttactggaaataggattgttgcaggtatgattcattaagtgaagatgaggacatattgcaagagagtaggtccctaatccagtgtgcctcacgcctttataaaaagaacaccatgtgaagagacaaacacgtacacagaaggaacactatgtgaagactggatggatgctgctacaagcaaaggaactaccagaagctacaagagagaactggaacagttccttccctagctcctttacagggagcatggccctgccaacacctcgatcgtagaattctcacctccataactgtgagacaacacatttctgtttaaaccactctgtttctagtactttgtttcagcagaaaactcatacaccactcattcctcaattttctgcattctgacttcaactcctaccataccaatgaagtgcttttcactaagtagtggcctcttttcaagtcagtcagctcattctacttctagcttttcaactactgactttccctttataaagcctctcttgatcattattttctgatttttttttttactaacagttctgaatactcctcatttcattccttcaacaatcattgagagtttatgtgtcatgtaaaaaaaagaattcttcgatgcctaaaagtttctatgttaaaggaacataaagttgggtgggagagagaagtaaatcaatgagtagattttcattgtacacagtatgagaataaacaggaagccctcttaagcccattctacaggtttaggcagacatccttttaaaagatgatatatcagatatgagctggaacatgaggaggagttaccttgacaggaatggaagatgtaagacctgagccaagaggaagagggtgttctaggcaaaaacagcaaagaaacaaaggctcagagacaagagagaatcatgaacgccagagaattgtgatgaaaactgtgtgcagaatgaaagagaggacctgacaaaagaacagaacaggcgtcgggttctgatgggccatatatgccatgttacagcttggcctctattctgaaagcaacagatagtcactgaaaagtcttaagcaggaaatatatattatcatatttatcctctagaaaaaaatgttctgagcattgtgtgaaaaacagattagtgggagtaagcaaagccaaacacagaggatacagtcaggaggtggtggtaatatttcagaagacagatgatggtggctgctatggtttgaatgtttctccccttccaaaactcatattgaaatttaatagtcattgtaacagtattaagaggtgggacctttaagaggtaattaggtcatgagggctccaccctcatgggaggcattggtgcccttataagggcaagttcagtcccttcttgctctctcctgccctctcactttccgccatatgatgtcacaacaagaaagccctcgcaagatgctggcacgttgatattggactttccagcttccagactgtaagaaatgagtttctgttcattataaattacccagttttaggtattttgttatagcaacacagactgacttagcttaacctaaagtaatacccatgtatataaaaaactttggagaatactagaggtgaaactgatatgacttgacaattgattggacatgagggataaataaaacaattcaaaatgattatcaagtttctggcttgtacaatttaataaaatctgatgtcactcattcagactgaaatatgggggaggagaaaagggggaggtggtagagcagattggatgagatgggaagggaatggaggcaaggaggctctcttggacacatcagtgagtttggacatcttgtgcagacatatctaaaatataagcctagggtctaggatatccagatgaaagactgataaagggaatgcctgagaaggcatggatgtgaagaagaccaccagcatatcacaatcatctgtggaatttctgaataacttaggtgcctgggccccaatccctagtaattctgattcagatgatcgagcatagcaagcggatggctgcattttaaaaggctttgcaggtgattctgatgcatagccatggctaaatacctctggaatatggggtaacagcagaaagtgctgacgaaagaacactgccatttcagtggtaggcagaggatcaagaaaccccaaagaaaactgacaaactgcaggctgttagctaggagcccatggaggaatagactgttttatgcacagagagtggcctacactcttcaaatactgaagagaatctgagtaaaacaaagactaagaaaaaatttcctggatttagcactaaaaatgtcagtatatttggtgtaggaaagtgcaaaattgagagtagatgcaaaattatttggctgttagagggaggaaggcagtaggcagaggaggacccatgaaaatttgctttagcactgttatgctttgctttttgaaggaagtgttttaagtatgtttaaatacccatgttaaagacttagtccatggctaaagctggtgatccaagacaagtggcaggtgaaggagcaagtcaactgaaaaggcagaagcaggtgggactcaaggtacaggagcagatttctacctcaaacagaaataggatggaaatgtccatgtgaccaagagacagagtttttattgggaaaaaaggacacaaggctgactagagaaatgaatgggattttggcagtattgaggctccatccaattgggtctggagagtatgaacttgctgtggcaccagtgtaagtggttgtgtttttctctggaaacacaagggttaaaaatggggagatcacacaggtggattaatcctggcttgttatctcctgtttgggtttatgaggagaacaatgaagggttagcaagaaagcagttgagaaataagactattaggtctttaacgtaataagaggagctagaaagaaagaaaactatgcttagagtgtgggatatttgagtttaagattttgaggttggttggagcagttctggctgatgacaaagttcagagtgtggccatggaggtgaattgccaaggtaaaactgaagtcaagatcagtggatataaggaagggggatatgagaaaataaggttctcacccttgattgcacattagggtgatttggtggctataaaatctttcaacacttcagccccagtgaaatcaggatctttgtgggtagaaccaaagcatgaatacttttaaaagtacaaagattgagaaccacagaactcagctgtctgttttgtctaactgaattttgaagtcactcaaggtcatgaattgtagggatatttttggtttcaagacttttactcagcaaagtattgagatgaagagaatggcaaaatagccagcatggggaagaaacaaagaattccaacagctcttaaatattttgtggtttattataaaaagataaatggaacaaggattgtattgtcagacttctttcttatgataacctagagaaatctcctatactctcatttcctcttttttttttgtggccccctagagtaggagtataaataaatccccactttctttgtaaaagttcaattgtaaaagttcaattaggcaagttagagctataagcctataaaacactccagactcaactctgcaatttccatcttcacacttcaggtggctgtcttagatttagtttcttagactagggcctgcccttattagtttttcaattaccaccctcttccagagactgggtaactgatcaggtctattccagaggttgtatattagcaataccctttgcttcacacaaaaaaagctaaaaattaatggatatcctttatgtttcctggagtgagcaccttcatctgagatgcattgaataggaagccagctgagttcttcttgtcaccatggtgactttagcatccctgaattataggttctcacaggagttcacccaggtgaaggctttgaatatgatcagaaagcaaacctgctaggcccctaaatgatgcttcagcttacaaaagtatcaaaataatgattgggtattccctagcatagtggctaattcctagtagtttctcactgattaaatctgaaagatattttcctccctgttctccttcctgcagcaacaaagcccaggcttttcctgggaagtctaaggttgcaaaagatcttggttataaacaacagtagtcagaatgtccctaggaagccaggcttttaatttatcaagcattccctggcagtgaggcatccaaatcattttacttgactttttccttacctgataaatcagcaaagaacaagaatatgatgctaaattagtctgtgcaagaatgaaagccaaagtttccaaattttctgtgcccaacaactatgtgaaatctgagaaatgaactccaatcagtaacattaatgacttaaatttgtatgactttacagttcagtatatttatacgttatagtttatattttcatatcttttatgtcatctgatctttaaaagagttacaagtattgcctctttttaaaagaaaatgacttctggcttcagaagataaaacttgccagaagttaaacctgaaattaagtggctcactggaccccaagttcaaaatcagatattttgacttagaaaacagagttctttccgctacactattttctttatatatatatatgcacacacatatgcacacaaacacatacccacacactatatatacgaatgtatgcatacacacatatattttaagaggaaaatataattccagggggaaaagtattattgcaggtatcaataaccatttgggacaaatttaaaaggtcttaattctaatttgctgtgaaaagtcatgccagagttattacagcatcaaaaagtaaaacaaaacaaacaacttcagttccatctgatgtagctgactttttgatgagactaaaactgtgtagttcatcatctccatccaagttcagatctcaagtctatgatcttgactaccttaatgtatggctattattatcttgatgatcacattggctttgctttcggcacaccccgatctctctccctttcttctgattttctccactcaaaacaagaggggtatttttctccgacatttgtctcttccatgcccaatcttaaggaagacctactgtagttgccaaagcgcatcagcacctgggagactattttagaatgactgacatcattctcctgacactcaccatcagcccaattctcaaacaacataaggtctgagaacacagagtcgggtgctgtaaactcaaagaagtactttaaaccatggcaaattcatcacccctccaaagtgctgactaatatcttggggctagttcttttccaactcagctcatatcccattatcaccacatctcttcagtctttttgtcctgattctttatcgttgtgatcaccacccagtaagaaaacccttcctttggccttgctcttaccatatttcattgatattatgatgacactgattgtgagatgcattattaattgcttaatggtttttcaggacaaaaataaacactaaccttattaaatgagcacatcaattgcatgactcatccaaatttcagaaacgttaaaataataaataatgcttcaaaattgtcaaaaatacagaatatccttgctcacatcctcatttggcatagtttcttctgctccaacattttctgtaagaccctaccctctcactttcctgtacctctagtacagtgctgttcaatcgaattttctgtggtgatgctaatgttctaaaatctgtgctgttcaatattagacaactacatcttacacctaggccaaactttttcttcctaagctagcttgccctgttgccctcaataacaaccttaatcacagtgataatttcttcagactcacctccacttcactttagaaagacaaagtcgtggacttggtcacctccagccctgcatcccagtgcttggagctctgttgttctgttccatctccgaggcttgaaactgtctcaatttcccctctctaaataaatctattatcttcctatcacttaaacttcctagctcaccctgatcttggtatgtgccctcatgagaacaaccaggtccccagagttccaattcctgaccttttataaaccttgatacccaccgccttctgtaccttctagactgttgagcgttactagaaaaaaagattagtcatcttgactagatgttcaatgaatcgtgctatttacatttaaggagggttcaatgtttctctgcaatgctatttttaacaagtgattgaaaagctttatgttacttttaaattcacaacattacctcactttcctttactgtcaatagaaaataataatggcaatgatagtaaaaaatagctaacatttctgtgcatttataatgtggtatatgctactctaagcagtttatatgcatcatatcagttaactatcataaatattatttggccttactattttttatcactttacagaagagaaaatatatataaagcagccccgttgtgttgagaggatagaagccttcttacatgtaattgctttttctccctcatttgaaaccactactcattttctgttcttttcctgtatttcagaaaaataagattttcactttccagactaaatggatccatgcacgctcttaattctatccccattctatccttcaggacgtttctcctaattccatcccctgttccatcctttggggccttctctgtctctgacatcttcagtctatccctcctttccttcacatactcctgccccgatcacaatggttctttccactctatctacaaattctcacttaatgaacagaaagttaaaagatcttctcccgaatttgtcatttttttttcagtctcctccctttgctttacccctttaagcttcctgagagactgggaagggcagtgtgatgcagtgaggaacatgttcccaggcagccatcagggaggaggccacagagacgctgtggcacaaacgtggtagtactcggctttaatctgcaatggatgagaatgtctgagcagactgatgcacagaggaattatgtggcctctgccttgttatccaactattgagacatttggtctacatctaattaagaattatttctggcagtttttcaattacatggttatttcttcattttgcctggtagttctttatttctcaaatggtagaactcttagcattcctttaagcctttgcagtatgatttctgcctctatcaattctgattgctataattgagttcctaaaaagtcaacatgtgaccaagctttttggctgtgattattgtctttcttagcatttaaatacaagatgatcagccaccctaatcttctctccttttcaaatataatggaaacactgcttaaatttattgataggaattccacatcttggctaatacacaattctaagatgactcctattaccctcagccctggtgttactccacggttatattactttacatggaaaaaggaatttttgtagatgcaattaaggttactaatcagctgaccttaagataagattatcagggtgggtctaatctaatcacatgagtcctataaaacctataaaagcagagtgctttctttagctagaagcaaaaaaggaagtcagagagatgaagtgtgagaggggaggtcttccacggctgagatgaagatgaccaatgggataagaatccaagagtggcctctagaaggtcacagggggctacagccaacagctagcaaaagaagagggatttctatcctataattgcaagaaactgaattcttccaacagtggcagtaatgatcttgagagatgaccttgattccagataagatcacagctggttagcaccttaatttcagccttgagtttgagactctgagcacataaaccagccctgttatcctgaatttctgacctaaagagctgcgacattaaaaaaaaaaaaggatattgttttaagttgctaagtgtatggaaatttgttactcaacaataaaaaaagactatagccaaaacatctggataatttattgctgcatccttcatatcttagataagaagacggtgtctcataactctgaaacataaatttctcaatttttctttaaaataaaggtttgctcaagtgtaaattagaaaacatatgctttattaaaagaacattctctttcaaaaataaatacacgactatattattcatggattctttatggcattacaaaccaatgactgggcgcggtggctcatgcctgtaatcccagcactttgggaggctgaggcgggcggatcacaagatcaggagattgagaccatcctagctaacacggtgaaaccccgtctctactaaaaaaacaaaaatacaaaaaattggccaggcgtggtggcgggcgcctgtagtcccagctacttgggtggctgaggcaggagaatggcatgaacccaggaggcggagcttgcagtgagcccagattgtgccactgtactccagcctgggtgaaagagtgagactccgtctcaaaaaaacaaaacaaaacaaaataaaaaaaaccaatgcctggtttccattttagggtccgttaacattaaagtaatgtttgttggattctataaaataacagttggcctctgaagtatttaatgaaatgaggtttctatacatcaaacatttaaatgaaagtcaacaagagaattagatggtttaaacacaatggttatatggaaccatggtaatggtcatttcataaagtttatgtgtatatcaaaacatcaagttgttcactgaaaatatatacaatttcaatttgtcagttatatcccaataaagctgaaagtactattgaattcttaaaaaatatgttgaaccatgcatttctttattcaagggtgactgctttacagaacaaatgagtgacttaatttcttaatttggaaattctattatgtaattttagttaagctaactgcaagtttgcagtttacaaaaatggaaagcttttttataacagtgagatcccatctctacaaatttgttttttaaatgctaaactaaaatagaagacattaatattttaatagtgaaaggatgagcattagtttaactttcagtggtaaaaaaatcatattaacatccaaatcatgtaacaagttatttgcagtatgagaatagagtcaatattttgattaaataaattaaggtaataactttaatgaacgctgagctaaaatactaaaatgcattgatgaatagaggcatgtctagaccttgcaaatatatatgcttctattgcttcctatgcctcaaacataaataagatctttaatttctgtctttattatgtctgataaatatgctcctactttgcctttgttggctctataatcctccaattataatgcttctgttgtttgtcttattcttcaaaatagcccaaaagacctatcaggaagctttggattttgtacacatttaatttttcatacttcccctattcacttcctaatgaagggtctactctacaaccacattcaggcaataagaattagttaggtaccaacttagagtctagtccttccagtagcatttttagttcttcaggtaattgtgacttgactcacttaaggtcatcaattaccattcctcaaatttaactggatggtgataagtttgaaggtgtgaatggtattccaatagagaataccctgtgaccatgtattcttttcagaaaagtcacaaagcaggtgggatattttgtcactgttcaaagattaaaatgatagtaatagaggttatttaaaaatgttccaaattctagggttttatcttactattctttttccaaaactggagcatattctaagttcattgccacatgtatttcatattttattcttacctagcactgaattttatataagcaatatgctttctatcactttctaactgcattatgtattatcccttcaccccaccccaaagccttttgttaagccagtgatatcaatgaatgcctcctttaggggtgtggttcaggattcagtaacacattggagtatgtgctatacttcaaggcacattggagtatgttccttgaagcatcagatttttatgtgaagccaaaatagttttataaaatatagattgttattcatagcaatggtttttactgccaacaatgagagatgtttgctagcctttggttacttcctgagcataaaatcaccccagcactgcttatccctaaggcagaggctgaacaaggatggtgagaatctatatactttccagggttgagggaagaaatgagcccacacgtgacacctgctgactccttgtacctgcacccatattttatcctcaagtaagggatatctcagttcattgtccttaaagacatgtttctcaaagagtcattcttaaagttgtgtaaaacagaatctgtacattaattatctatgcctactgcttacttatctgaatagcaaagacaacaacaattaaaataaaaaattgctgccacagaattcactataaatgttaatgggactctcaagacaacccctttacagcttttcaaaacttcaaggggtatttttaacttaataatggaagaagaaaatgcttgcaatacacccaatacacctggtaccataaagaagaacaaatcaactgggagctgtgtggtgtcatgagagggcagcaatgcagggcagtgttgtggaatttggcaggcagcaccgggtctgaactgaattatcactattatatcctcatctatgcttctatgtctagaaatgtcccatagaacttcctgcagtagcagaaatgttctatatctgtgctgtccaatataatagccactaatggatatttaaatttagatttattaaaataaaattgaaaatttagtttctttcacatatggctagtgaataccaatttggatagagaatgagattcttttttagatacttataccacctattacttattgagccctaacctcaagccagaggttaaggatctattttgtaccaggcactgttctccaagcccagaatagaacaacctccaagacaagtagggccctggcaccatggacttcagactagtgtgggggatagaaaaagaataagaaaataaatgattctatgatttactttggcatattatatagggcaagggactgtgtgtgctaggaaagggtaagactgttcttagaaaaggtagttgtattagtccgttctcatcccactaataaagacatacctgacactgggtgatttataatggaaagaggtttaattgactcacagttcagcatggctggggaagcctcaggaaacttacaaccatggtggaaggggaagctaacatgtccttcttcacatagcagcagcaaggagaagtgccaaacaaaaaagggaaagccccttaaaaaaccatcagatctcatgagaactcactcactatcatgagaacagcatgagtgtaactgccaccatgattcaattacctcccacttggtccctcccactacacgtgcggattatgggaactacaattcaggatattttggtggggacacagccaaactacatcagtggtcaagcatggtctgtctgagaaagtgacttctgagtgttgttatgggttgtactgtgtccccctatcaaaattaatgttgaagcctaacctctcagtaccctagaatgggaccctattggaaatagggtttttgcagatgttattagttaagatgaggtcatataggagtaagatgcaccctacttcaatgtgactggtgtccttgtaataaaagggaaatttggacacagagacatgtacagagagaagacaaagagaaatttggacacagagacatgaagggaaatgtggacacagagacatgtacagagagaagacgaagagaaaatacagagagaaggccatctacaagctaagaaaaggacctgaaacagatccttcctcacagccctcggaaagaaccaaccctgccaacaccttgatctcagactcctagcctccagaacggtgagataataaatttctgttgcttaaggcaccaagcttgtggtattttctatagcagccctagccgactaatacaagtggcaacttgatgaggaagccatgcaaattgcgcatgtcatttaatcctcacagctaccctatgtgttaggcattggtgtgtccatttatcagatgagaatttcaagttcaaaactatgaaaataatttgcctgaggaaatattgctcttatgtggcagactcaagacagaagtctgagttagcatgatccctgggtctcagtgtttcttattatactcttttactaccttgacttatctaaatacactcacatctgattcaatgacaatgaaacaattaattttacaagtaaatagattagtttatatggttatgtctataccgtagtttcagttaaaataaaattttaaagtctagcaaaggtgtcttatttggcttttccttcaaaactaactccgtatttgattgttgaatctatctgtgaatattagcctttgaagtatggagatacatacacttttatgcatatgcacacatacgcacatacgtctatatataattttagtctattttatagcttacattttagattaatttaagcattgtgatgtaaagtctacagtactcttttctcagccttttccccactaccttcccttgtattttacgtgtccagcctgacactcatattatcttgcttcaggatacatctatttcttaaagtcatttttctatgaggacaatcacaatccccttataatgaatacaagcatgtttatagaccctcaccttcatcaaagaggcttcaatgttctcttaagagtgtatgaagctggaaatatattctgaaaatataagctcaacacctgccttcctgaaaatatgggtggtggaaagcccttgtgagtggatagcccatgatttgtttgctcaattagtgaaaagaaacacttcaattggcaaaaatgtttgcccaaatgagaatggctttatagaaatgttctaaatatggcctgactctaatcaagcaatgccatctgcttgatgagtgacaaggtcacaacttctataatagaagcagtctccagtgccagaaatgaatatacagaagtccaactgctgcctacactaaacatggctacctatgttgtaggaggcctgcacgtgtctgttagcttcaggtatgatcttaccaagaggcactttcattggtcttgatcctgctaattatgaggtgtagacccttggctgagtcacttaatattcctgacgctcggttttttttccctagaaaatgtagctaacaatttctatgtctcatatttgtggaagggataaaatgaggtcatactcttgaagacatcttgtgaaatgcaaagtaaaatgtaagcaaaaggcacaatttttccacctgtaaggaatggctcctagaataaaaaattactttgaagtactttttgagtacttattttgtaccaagcacatggccaataactttatttgcattatgtcattttatctcataatgacactatcaattatgtattattacaactgccatcttccagaagaggcaactagtagtgcttaaatggtttaggtgagttgcccaaagttccccagctagtaagtgccagagagtagatttgaacccacctgtgttcttaactatttcttctcttatcccttatgcccctgccaacagttaaaaaagagcaactattcttaaaactatattactgagataatttacttgcttttgtttgtggagacaaaaattttaagatcattatttttcaattgtaagagaataaagatggccaaatagaaacagctccggcctgcagctcccagtgagatcaacacagaaggcaggtgatttcagcatttccaactgaggtacccagctcatctcactggacctggttagacagtgggtgcagcccacagagggcaagcagaagcagggtggggcgtctccccacctgggaagcacaaggggctcgggaactccctcctctacccaagggaagtcatgagggactgtgccgtgaggaacgaagctacccagcccagatactatgcttttcccacggtcttcactagccacagatcaggagattctcttgggtgcctataccacaagggctctgggtttcaagcacaaaactgggtggctgtttgggcaggcattgagctagctgcagtttttttttcataacccaatggcacctggaacaccagtgagacagccattcaatcccctggaagggggctgaagccagggagccaaggggtcttgctcagtgaatcccacactgacagagcccagcaagctaagatacactggcttgaaattcttgctgccagtatagcagcctgaagtcgacctgggatgctctagcttggtgtggggaggggtgtccgccattactgaggcttaagtaggtggtttttccctcacagtgtaaacaaagctgccaggaagttcaaactgggcagagcccaccgcagctccacaaagttgctgtagccagactgcctctctagattcttcctgtctgagcagggtatctctgaaagaaaggtagcagccccagtcaggggcttacagataaaactcccatctccctgggacagagcacctggggggaggggtggctttgggcacagcttcagcagacttaaatgttcctgcctgccagctctgaagagaacagcagatttcccagcacagcccttaagctctgctaaggaacagactccctcctcaagttggcccctgacccctgtgcctcccgatagggagatactcccagcaggggttgacagacacttcatacaggagagttctggctggcatctgttgggtgcccctcttggacgaagcttccagaggaaggagcagggagcaatttttgctgttctgcaggctctgctagtgatacccaggcaaacagggtgtggagtggacctccagcaaacctgcagaagaggggtctgactgctagaaggaaaactaacaaacaaaaagcaatagcatcaacatcaacaaaaaagatgaccacacaaaaactccatctaaaggtcaccaacagcaaagaacaaaggtagataaatccatgaagatgaggaaaaaccagtgcaaaaaggatggaaattccaaaaaacagaatgcctcttcttctccgaaggatcacaactcctcgccagcaagggaacaaaactggacagaaaatgagttagatcaattcacagaaataggcttcagaaggtgggtaataacaaactcctccaagctaaaaaagtatgttctaacctaatgcaaggaagctaagaacattgataaaaggttagtggaatagctaactagaataaccagtttagagaagaacataaataacctgatggagttgaaaaaacacagcacgagaacatcgtgaagcttaccacagtatcaatagccaaactgatcaagtggaagaaaggatatcagagattgaagatcaacttaatgaaataaagcatgaagacaagattagataaaaaaagaatgaaaaggaatgaaaaaagcttccaagaaatatgggactatgtaaaaagccaaacctacatgtgattagtgtacctgaaagagatgggaagaatgaaaccaagttggaaaacacttttcaggatattttccaggagaacttccccaacctagcaagacaggccaacattcaaattcagaaaatacagagaacctcacaaagatactccttgagaagagcaaccccaagacacataatcgtgagattcatcaaggttgaaatgaaggaaaacatgtgaagggcagccagagagaaaggttgggttacccacaaagggaagcccatcagactaacagctgatctctctgcagaaaccctacaagccagaagagagtgggggccaatattcaacattcttaaagagaagaatttgcaacccagaatttcatatccagccaaactaagcttcataattgaagaagaaacaaaatcctttacaaacaagcaaatcctgagggatttcgtccccaccaggcctgccttacaagagctcctggaggaagcactaaatatggaaaggaaaaactgataccagccactgcaaaaacatattaaattgtaaagaccgctgacactatgaagaaactacatcaactaatgggcaaaataaacagctagcatcataatgacaggatcaaattcatacataacaatattaaccttaaatgtaaatgagctaaatgccccaattaaatggcacaggctggcaaactagacagagtcaagacccatcaatgtgctgtatttagtagactcatctcatgtgcaaacacacacacaggctcaaaaataaagggatggaggaagatttaccaaacaaacagaaagaaaaaaaaaaggtgttgtaatcctagtctctgataaaacagactttaaaccaaaaaagacagaaaaagacaaagaagggcattacatattggtaaagggttcaatgcaacaagaagagctaactacctgaaatatatatgcacccaatacaagagcacccagattcataatgcaagttcctagagacctacaaagagacttagacttccacacaatactagtgggagactttaacaccccactgtcaatatcagacagatgaacgagacagaaaattaacaagaatattcaagacttgaactaagctctggaccaagtggacctaatagacatctacagaactctccaccacaaatcaacagaatatacattcttctcagcaccacattgcacttattctaaaattgaccacataattggaaataaaacactcctcagcaaatgcaaaaaaccagaaatcataacaaacagtctctcagaccacagtgcaatcaagttagaactcaggattaagaactaactcaaaacagcacaactacatggaaaatcaaaaaacctgctcctgaatgactactgggtgaataacgaaacaaaggcagaaataaataagttctttgaaactaataagaacaaacatacaatgtaccagaatctctgggacacagctaaagcagtgtttagagggaaatttatagcactaaatgcacacaagagaaagcaggaaagatctaaaattgacaccctaacatcacaattaaaagaactagagaagcaagggcaaacacattcaaaagccagcagaaggcaagaaataactaagatcagagcagaattgaaggagacagagacagaaaaaaccctttgaaaaaatcaatgaatccaggagctggttttttgaaacgattaacaaaacagaccactagccagatcaatgaagaagaaaagagagaagaatcaaatagacacaataaataaaaaatgataaaggggatatcatcattgatcccacagaaatacaaactaccaccagagaatactataaacacctctacacaaataaactagaaaatctagaagaaatggataaattcctggacacatacaccttcctaagactaaaccagaaagaagtggaatccctgaatagaccaataacaaattctgaaattgaggcagtaattaataacttaccaaccaaaaaaagcccaggaccagatgaattcacagccaaattctaccagaggtacaaagaggagctggtaccgttccttctgaaactattccaatcaatagaaaaagagggactcctccctaactcgttttatgaggccagcatcatcctgataccaaaagctggcagagacacaacaaaaaaagaaaatctcaggccaaatatccttgatgaacatcgatgtgaaaatcctcaataaaatactggtaaaccaaatccagcaacgcattaaaaagcttatccaccacgatcaagtcggcttcatccctgggatgcaaggctagttcaacatatgcaaatcaataaacataacccatcacataaatgaaaccaatgacaaaaaccacatgatcaactcaatagatgcagaaaaggccttcgataaaattcaacactccttcatgctaaaaacactcaataggtattgatgtaacatgtcttgaaataataagagctatttatgacaaacccacagccaacaacatactgaatgggcaaaagctggaagtattccctttgaaaactggcacaagacaaggatgccctctttcaccactcctgttcaacacagtattggaagttctggccagggcaatcaggcaagagaaagaaataaaatatattcaaataggaagagaggatgttaaattatctctctttgcggatgacatgactgtatatttagaaaaccccatcgtctcagcccaaaaactccttaagctgataagcaacttcagcaaagtctcaggataaaaactcaatgtacaaaaatcacaatcattcctatacacaaataatagacaaacagccaaatcatgagcaaactcccattcacaattgcaacaaaaagaagaaaatacctacgaatacaacttacaagggatgtgaaggacctcttcaagttgaactacaaaccactgcccaaggaaataagagaagacacaaacaaatggaaaaacattccatgctcatggataggaagaatcaatatagtgaaaatggccacactgtccaaagtaatttatagattcaatgctattcccatcaagctaccattgactttcttcacagaattagaaaaaactactttaaatttcatatggaaccaaaagagagcccgtattgccaagacaatcctaagcaaaagaaaaaacaaacaaacaaacaaaaaacaaagctggaagcatcaagctacctgacttcaaactatactataaggctacagtaaccacaacagcatgctactggtaccaaaacaggtatatagaccaatggaacagaacagaggcctcagaaacaacaccacacatctacaaccatctgatctttgacaaacctgacaaaaacaagcaatggggaatggattccctatttaataaatgctgttgggaaaactggctagccatatgcagaaaactgaaactggaccccttccttacaccttatacaaaaattaactcaagatggattaaagacttaaacttaagacctaaaaccataaaaaccctagaagaaaacctaggcaataccattcaggacataagcatgggcaaagagttcatgactaaaacaccaaaagcaatggcaacgaaagccaaaattgacaaatgggatctaactaaactaaagagcttctgcacagcaaaagaaactatcatcagagtgaacaggctagagaatgagagaaaagttttgcagtctccatctgacaaaggtctaatatccagaatctacaaggaacttaaacaaatttacaagaaacaaacaaccccatcaaaaagcagacgaaggatatggacagacaattctcaaaagaagacatttatgcatatgaacaagcatatgaaaaaagctcatcatcactggtcattagagaaatgcaaatcaaaactacaatgagataccatctcacaccagttagaatgacgatcattaaaaagtcaggaaaaaatagatgctggaaaggatgtggagaaataggaatgcttttacactgttggtgggagtgtaaattggttcaaccatcgtggaagacagtgtggcgatttctcaaggatctagaagtagaaataccatttgacccagcaatcccattactgggtatataatcccaaaggattataaatcattctactatagagacacatgcacgtgtatgtttattgcaggactattcacaatagcaaagacttggaaccaacaaaaatacccatcaatgatagactggatgaagaaaatgtggcacatatacaccatggaatactttgcagacataaaaaaaaaaaaatgagttcatgtcctttgcagggacttggatgaagcttgaaaccatcattcttagcaaactaacacaggaaccgaaaaccaaacaccgcatgttctcactcataagtgggagttgaacaatgagaacatatgggcaaagggaggggaacatcacacactggggcctgtcggggggttgggggcaagggaagggataacattcggagaaatacctaatgtagatgatgagttgatgggtgcagcaactgaatctggttttcaatacttctgttgaaagccataaatatgatttaatatggactataataaggtactattctgctcttcacttcaaagacacatcttttgaatatggcaagtagctagggaaatatcaaaagttccagtattatttcgttatattttccaaattctccactaatctttgagtgtagacatttaaccaaataaaatgattcatattacttaatgttgttactcatgccaaatatatttcataataaaacaaagacatctgagtgtagagagaggatggataggaaatgacaaagaaagtaaagtgatttgagaagggattaggtctaatcagttgggtttatttttttctgggaataattaagatatttactgaggcaatgggttatcataaagcaaaaaacaaagaaactcctaactcactccatgagatcgaatttcataaaagcatttctataaaaatgatgaatagaccaccagaatcgaaatgtatgcaaattgcaaagctagttggaggagtgtgtgtgtgctgccttggtctctcaagtctatcaaaaaaggggaaaaagaaaaggtgacttgctgcctgagcagttctatgcctaacatcagatactgtaataccaccattaaaaaaagggaattcatcataaatgctacttaaaagacagtaaagagccaacacacatgtttgagaacaagtaactcctatcagggaccttaaatgagagagatacggagcttaacctgagggcagcagggcttcctcagtgcccccaccctctacctcccaatccttatagtatcacttttctttagcctacaaagatacgtgtgaacacagttttttgttgttttttttttaaagaaatgtaaggacaaagcacatttgtaaatagagggaataggacatagtggattaaggacagtgtatagtgttttatataaaagattctacaacaaattttcttgaaaaaatgaggcaggtatgagatgtcctgaagcccccagttctcataacttttaggatatgagtaaatttgttatatggcatttcacaggtactgaattgcaggattttggtcagtcacagtttcttgccagaagcactatcttttgtaaagggctacatagcagaatttttgttctattttagttttattttgcttttgtttggtgggaagtaggaagagaaaaattcttactaaattccattacctagaaatatttttatagcataaaacattttccacaaatttttctatgcacattatttaataattttttataatatcatttccaaattattatacatctataataccaatgtaatgactattgtgtatagtctcgatattactgatccatttttgagatattaaggtttttttcctttttttactataataaacaatattgtgatgaacagcttcttcacatatattttggctaatttatctgactatgccctaaagttaaattcctacaaagaagagaaaatcttctgttttggaaagataattggtgctttagaaagatagttcttgctggtggcgatggctgggttgggggagagaaaagactaaaagactaagaagcccataaccaaaactcaggcagtggtaacagaagtgcagatgagggagagcagaaaggatactcagaaggtagaatcaacatggtacagagactgatccatgggaagctaaggagagactcaaggagagagaaaagtcacgggtggcctgaaggctcctagcgtgaacaactggggagtacataatgaatttcaaattgaacttgttgagtctgaggtgccttcaaggcatcctagtagaaatggtcaatgggcagtgcacagtggaaatatatagcattccaggacacagacccacacattcctgacaaacacaaatcaatttggttttacaggagttcataatatcacccctgccaattttaaatatagtgtctatagtgtgtgtgtgtgtgtgtgtgtgtgtgtgtgtgtgtgtgtgtgtgatgggatggggattacacaggaagtttctttggttgttgtccagtcactgcatttgatgtacatttgatgtaacagttctttttttttttttaacattaatgccccaaccttaaagaagagcttttgtcttattataaacaatactgaattaaaatttgcaaatttaaaactagagcaaatatggaaaaagttattgaaaagtaacaatcaatccatcaatgctcccagtgaagaataaacatcatcataagaatgcccaatatttgcagtgtctattgttttttgaaaaagatttacacaggcataagatatttgatttttaccataaccttggaaggcacattagtttttattgctaatttacagatctaaggaaactgaggttctgaaaaggtaaacagtgtttttctgttgttcaaagctgggaaatgcccaaattgaaacttgagccctggctttcagactctggagccggagttcttcctctcacccttcagctagctgcattaagtcaatcaatcaataaataactttttattgcctgttctttctcttcctcctccttattctaatcaagatattttaagttttgaattaaaaatttatctcattcttatggcaaagtaggtttcaagccatttcacggaaatttatacaagtgcctttgtgctacaatggctgaaccagagcacccagctctcaggcagtccccactgtggagacagagcctgctgtcccactggacagagcctcaaccctggctgactcacagccctgtgtatgtcacttggcagcttcttccagtagcatgtccttccactacattcttcagtcacctttctctactgcacaaatcctgcctgataatatgtgtgcaatgcaagcccacactactttttggaacctcattcaattgtcacctcttgcacagaaaacaaacaacaacaacaacaaacaaaaagctatttttgagtgtgcctgtttatcaagagtgttctctaaaaatttatcataatgccattatcattctgtaactccatggttcagatttaaggcaattctatatctctttgtctcttgtgtagtctccagtcaacttcattctcagagatttatagaaaatttttcccatatactgctactcagaagtcacatttatttttcaggttttttaggctgagtctgacctggaagcactttttttatgggttcagtttccctactcttgaaggttaaagtgactttctccggcttcctagtttattttagaaagccattataactgtgacagaagaaatctaaccaaaatagcacaaaaatattctgaccaaactcagtttttacttttggctgaaagctatttaatgtatgtttggtgccacttaaaaaaaaagtttcattgagatgtaactgagataaaataaactgcacatattttaaagtgtacaacttgacaattactgcaaatgtatacaccagtgagaccatcaccacaagcaagggaatgaacatatccatcactcccacactgccgacttcccgtgtgttccttcagaatcccttcttttccctcctttgccacatattctggaaagggagagcgaatatcgttaaaacttcaaattctttccagcttttctatagatctaactttgttttaataaaaatcacaataggagtcttaaaaaatgtaaaaacattgtccagaaataaaagcactttaaaatgatgttacaaatgaggaaataagaaaacaatgaacacatcaatacaaaaccaggcaaagtccataggcagagaatgctcatccctctgaaatggctaataaaaagactgaaatctaaatctaaatcttactaataatcaaataaataaatgacaattaaaatagcatattcatttacattaatttttgtcaaagatttagaagacaatatgatgctcagaatttaaagctttttgaaagtagacactaatatattactgaaaaaagtacagatttccttgtaactattgcaatattaaatgtacattatttttgatgtagcaacttatctaggaattaatactaaagaaataaataaatgaacaatggcaacaacttgggagcaatataaatgtctgtcattagtaaactggttaactatctaatggttcattcttataaaggaatcaccagaggccatttaaatggtaaagtttatctgtatgaattaagtggaaagaaaaagagtggaagtaaaggagatacatatagaatgatttcttttcttttgtacacaaaaataatccactgtgtttttcaggtgtaggaagaactctggaaaaaactatataaaatttaagtaaagttttctctgggaatggaagtaaaacagctttcactttttactatatatatatttaattttactaaaaaatatttactacttttataatttcaaatgttttcatttaataacaatatgtatatattcttattaaacttatatagttttctatgtccctctaaacatatacactgatacggtttgactctgtgtccccacccaaatctcatcttgaattatactcccataatttccatgtgttgtgggggacacccggtgggagataatttgaatcatgggggaagtttcccctatactattctcgtggtggtgaataagtctcacaagatctgatggttttatcaggggtttccacttttgcatcttcctcattttttcttgccgccaccatgtaagaagtgtctttcacctcccaccatgattctgaggcctccccggccatgtggaactgtaaatccaattaaacctctttttcttcccagtctcaggtatgtctttatcagcagcatgaaaacagactaacacatgcactaagaacaaaatcctaaaaaatacactacaaggtgttagagtcattctataaccacgagaagtcttataaaaaatttgttcatctgatttttctaatttttgtacaattatttgttataagctgtataacaaaatacttctaataaactcttgtttaggtaaaatcaatataacaaaaaattacttaaatagtataaaatagtcaatctctacatttttttttccaaatgctgacaataacaataaagtaaataaagtcactatagggacttctgcttcttgcccaaaggagtcaggtttatgcttgctcatgaaagaatggaaaaactggacaaaatgaatgaaacaacagttttcagaccttaggcaacagttagcttagcatggtgattagagaaaatgaatacaatgagatgacgcctatggttgccccagtgtacatgctggagagcttccaggtcccagcataaggaggagggatcactgcctgacctgaaagtctccctaagttgaggagatggagctgggaattcagggaggtcaaggtaactagaatttgctgaaaagagaggagacagtggcccagagagggaactcagggacatctgcacaggccccctcttgagtcttcagctgagtgttgatcagcctgaggaaggtgaaatttctgggaaaaagctggaggaaggaatgacaaagacacgaggaaacttttgggggtgatatatatttgtgtactatctcagttttggtaattttctcacagatgtgtatacctatatcaaaatttactaaattgtgtaatttacatgtagtttattatatatttttttccagtggagttttaaaaacaattttgtaaagaaaaaaatgtatggtgaaaatgaactgatgggataggatattactcaaattagctctttgtgtaagcacggtacaattagcatcgatttacatttacatctcttcaggttgacaagaaagcaagtatggataccaccaaaaacacctatataatttgcatccaaatgtagtaaattactttgaaaaatattggaagttttccctagtggattaaagttttcctaacatgtgactttaatcattggcctattactctaagaaattgtaattcactaataatacataaggccatagacctgggtctgccccctccctcaatatcaataataccaacatttgtagaaggtatataaatgttatgcacttcaagaagagaagtatgccaagagagatgtaataatgcatgagatagagtctagagaatttagaacaagccttggtttagatgaacattaagggattaagggctattcttccagtaggacatttgtaggagaacaggaaagccaggtgaccatattctacagggcaggcctgagctttatctatttcgtggctggatgttgcatgttctctgaatcagcaaattgtcagtgggaaaaatgtatctatattgactgctctcaaccagcttatttaagataaaatagtaccttggcagccagctgaagagattttttggtactgtgttggtctgagtaatggattattgatctacagttaaactgatctgaaggtcagacttctaggatttctctcagtctcacattctgaatccattgttgtcttttaggaatggttatatcagaggtacctgactcatctttggccagaacaacaggagcaaatctggtattacagtatgtgggctgcaaatataacaaaattagtgcctctatattttgctctgcagattgttcctgaattatggtcccacagtcatgctgcattgctcactggaagtttctataatgagaatttaacccacttgtttacactggaacttagttcataggttctcatcacatttatttcaggctttcaggtgaaataccctgcctatttgagcttacaacatttttatttctaatgtaaacgtgtgtatctgtacgtgtattttaatcaataaaatgacagattctcagcttctcgaggactatgccgaaaaacctaaaggataatccaggttacaaatagcacattctgttcagtgaattgggctttcatcccattatcagacaatgccattggttctttaaaattaatcgaggggaatatttcacatgaaagggattacttcttcctatgcaagtcaaaaaattggaaaacaaatgaacatttaaagcctactggagcccagctgtttgccccctgaaaagattatgctattcaatgactggagtgatttaaagaagtagcatgacatttgaattattggctatcaaaaagaacttgtggaggagacttcataaaatgaacttctaagaaataccccttgagaaatggtgctgaactctaggaaaaaaatagaactatttctgtttaactgtaaggacagcttctgtgtttccttaggcaaacagatttcctgtggtctagaaatgtttctgtctaccacagaggtggatttaccgtgaggctaggaagggtgaagcttcagggcccctcacttgcacaagctccttcctaaggcactggaaaaggctcgaggggtgggatggcatgctcctttgcttttagaattttgcatgagtgagacattttaactgcagaagtttaagatcaatgtctacgtactgattttgcctatatcacacttttcccttgggttagttagcactggggtgactgtgggccattttgggatctggctaattagaaactgagttaaagattcatttagtttcagtttggtgtgattatattcttgtggttctcagtctcttccctgtacccttaggttcttgctggctgtctgggtgtagcttccacgaacacacctgattaccatggtgctggtaacatgaaagtgcaagcccagagatcactccaaaatcaatgtgcccagagcttcaggcaccacaagtctgtgtggagtgaaggagacacaatgttcaaaacatataaagccaggaactgctctttgaaaattcttccaaatcttacagttcacaaatgaaagacatttgatagagatatttcccaagtttggtcacagtcctaagaatgtatatgaaatcacccccaaaaattgagaaacttgatgtaacttttctaaactatcggtaataaaatgacagattacaatcaattatactagagaaaagactgcattatcttgttattctcaacatagaaaacataatagaatcatgtaaaatgaagaggcaatcagagaataagcaaccaaaactacagagccaaaaaaatcatagaaatgtatcaagcaattaattttctgaaaatgaagttaattttataaattttgttatccttgtagaatttgtcagctttattaattttataatctggtgtgatttagttttacatcctaaataaatattcaatctccacattcaatacatattccaatgatgtatccatttctcttaaaagggactcctcgagttgtataagacatcagttggtataaagcctggacccactccttgtcaactaccatagtttccctgggatatgaagaggtaacttcctttatattacaactaagtaataaaatggatataaatgtattagccgaactgcaaattgtgatattcagcattttaagggactgattctgttggatactcagaaatataaataggccaaatcctatgaccaataaattaatcaattgataaaacaatgtatctttttcttgattacactaaaaatttaaaatattatattccttatacaacatttttaatttaatttgccttgtaagtgttggtagtatatgcatagttctccagaaatatgtttttaaatatctttatatataaaactgggttttaggtcctcgatttgtggcaaacgttttgaacgcttgtttggcttaaaattcacaaacatataaactagcaatgacatcatgataggctttgtgcatttcttaccaaaagtgataaaatttgtagacaataggccgggtgcggtagctcacacctgtaattccagcactttgggaggccaaggcaggcggatcatgaggtcaggagatcgagaccatcctggctaacatggtgaaaccctgtctctactaaaactacaaaaaattagctgatcatggtggcacgagcctgtagtcccagctactcgagaggctgaggcaggagaatcgcttgaacccgggaggtggaggttgcagtgagccgagatcacgccactgcactccagcctgggtgacagagagagactctatctcaaacaaaaacaaaaaaaaatttgtagacaacatatttaacaagtctgtcatacttgttcagctccataatccttactacaaaatgcacataatctggcatattcacagccttcaagttgaaatggaagctttcatcaagttcatcaaattacacaaatcacacatgacaaaggagagaccacaaagctggtgtacaattgtttaataatttatatgttaatattggtaaactaaagccaaatataaaaatgaaacatatcatcaatgacatcttcagataataaggataagattattattttaaaactgtaaatttagataaactgaggtctgtataattcatggtaatatttcctatctttctctatatattattcatatatgtacattttaaatatatttttgaaattagggatttttcaaagtttttttttttttaattaaaatagtgattttaaatatacctatacctgtttaaatatatctgtaaaatgttcaggttatgacacactttaaataactaaaattcatcttaaaccgtatcttctaccacatcatttacatgtgcaggagataactgcagataagactgaagaaggatggaagctgaaggtttacagagaacaaagtttttgatacttccaactgtgaaaacactttaagtattcagaagaaaaggttgtatcataaaattatatatatgtgttcacatttaaaacctcaatattctataaagatctgaattaaaattaacttagaaagtaattttgtcttatgagatgactgaatggaactattaaacacataacttattcatatgattttatttttatatatctttgcaggaaaaggtatatgtaaaatgaggtagaactaaatcagtgattcttaacccagaatcactacactgtaatagaaatatgaatgtgattccagtggtacatgtaactctaaaattaaatacaaattctctgtgtgattatgtatatatccagagtttccataagagctctgctacatctacttagactcttggatgattccagaactgctaatagagtgaaacacacaaaccttttagaaaataaatttcactaagaagaaaaagaaatgaagttctaattgtgttggtaatgtcccagtcccacccacacatcacgagagagagaaaaagaaattccaagaaggatttgataatttcaaggaacaaagtgctcaggagatatattcactgaccaattccccaagtgctcatgtgtgagcaattcaaaaattctaaaaatactattcagtgacatctcaatagttcttcaaaatatgagattgaaaaacaaggcctttttccaagtcactctcttaaatatggttaacattttcattacacaataattttgaagagtttttgagcctatggataccttagttaccaaaatactatgaatgtgagcttctgtagtcattaaagaataaagatgactaattattaatttaaaggttatgaaaacactcttaaatattaatgactaaacacactaactgataggttgtgtttggactaacactgacagcaagcttcttgtgaagtctgctggtcaagttaccaaatcagaggtgcagaaagacaagaaaattctcaaaaatgcttccacaagaagaatccttgaagtaatttaggcatctaacctcaaaaaaaaaaaaaaataaggtttaatggaggaaattattgctgtattctcttgcattatcaaggctaagaaagattattagaattattttgtatctttctggcaacatgcctcataccaaagggaggaagtggcagggaaacaattcattacaaagaatatttttctaaaaatgagtcctaggcaacaaggaaagagcttgtcttacgagttgatgttctctcccgaaaaggcaattttaagcattgagaatgttctgagatggatttctgcagagtaggaagttggattcttatatataggaaatccctgtcagtacttaaattctacgattctatgatttattaagaatagccacttgtgaccacatagggcacaacctgaaaacagggcagccgcctaagagaaggcccttaaatagttatgagtgaatgcccaatgtgaggtgaagaaagggagaggtcattagaaaggaagttgtgtacaaaacacaagattttactgccttggtgaattttgaaccacagccaaattactttcttctctgagaagatatgaggaagagaataaaactcttcaaggcaacagcatgatataaatccaaagcattttcatactttgggaacgtgcttgcatgcagaagtgtgagccgggggaggaatcttgggtgataagaaaaacacgtcagcagggcagagtggtgaatggccttcaagataaggataagtaattgaaattggttaggaaagcaacagggagccagaagaaggaattgaaatgagtaatgggaagccagaagattagaaaagctagacggattaccttgggaagcaggattttgagatggtaatggccaaaggggagattgtagaatcaagacaggaaacaaaaagacaaggatggatagacctattcccgaaacaggaatagtaccttcatgaggtcccagagaggcagtttgtaataacaaaaatgaggccttcactgaagcttgggagttatataacactgatctaggatggcatgcttacctgtcaccgttgcttggtatccatcaggaaatgtttgttgcatgaatgaagaaaaagacacagttccattctacataaaataatcattcaaaatcaccaatttgggaaacaacaatcaactattagattgttaaaatgttgatagtttgtgaacctttttttttttttttttttttttttttagcaatgacccaatgtcactgtagtgtttcttcagaactgcttagacttttgtgtagaagtaaaagaaaagaccatcagttcttaaggtctgagcctgaaaacaaacgttctttattttgaatttgttttcaatgtacaaaaggtttacatgaaaaatacaggcaggctaatattgcaaacaacatgtaatttcaaagaggaaaaatattcagtactttccctctcactttttaaattagattcagtaacatgattaactcttacctacatgttttcagaactaagatgaataaattagaggggtggttcaatttaaaacaccttttccttttagtaaatctaatgtttatggtagtcaataaaagaattgctcttttagtcatagaaaagcctcagaagctcttctaattcttctattctgttgattgatgcaaattatctctacagggaattaattttaatagttaatgaaatgaggaggctgaagatgcagaaatcagtgccttgagttatctttgtgtgtctgcaagggctaactctgcactctgctgtatagccagcaatgacaagtatcctgaattgactgaggaacaatctgaaaaaaattcacaggaatcttaaaagactcagcagcctttagccaatatccattcttaagtgtgatttaagtgacacttccaagtcttattaaaaaaaataagtaaacataactttaaatacctaagatttctggttagtaacatctaccatgtttaatgttatggtcgattttattgtagcagcttgataaaagatcactacttaataagtaaggtcattctattaccaatttgaaatgttgatttcatatatctatgcactcacttctccataatttgatgtttttgtggttgcctcagaagctgtgcaatagctaaataaagaagaaaaaatgtgactaaccaggcaacagcccagcccaaatgaatgtgttgtagtttttataaagtgctatttgtataaattcattaataaacttttattttataaaaataattgttggccgggcgcggtggctcacgcctgtaatctcagcactttgggaggccgaggtgggcggatcacgaggtcaggagatcgagaccatcctggccaacatagtgaaaccccatctctactaaaaatacaaaaaaattagcctggcgtggtggcaggagcctgtagtcccagctactcgggaggctgaggcaggagaatggcgtgaacccaggaggcggagcttgcagtgagccgagatcgcgccactgcactccagcctgggcaacagagtgagactctgtctcaacaataataataataataataataataataataataataataataataattgctaaatgagagcaaagcttttcaaatcaatagactgtttcattctttctcaacctctaatacagaaaacaaagatcttttatgtcatatttagtgcatgctcaataaatgttctttattttttcttttctttaacaccgagtgaaaaaataattttatctgaccttccttccaaaattttatttggctgacagaatgctaggcttacatagacagggaaggtcacatggagtacttgggtcattcaatatatgaaacttttccgtggaaaatattaataattataattgttgagtgtaataataatccatatcttgacattaaaagaattgctgagttttatgaaaatgattatttcccttccttccttataataactaatggcctaattctaattcttaaaagtatttttggagaagcactagattaggagacagaaagaaagaaaaaaagatagaataaaagaaggaaggattctatccacctggcatttctcagtgtctgctggttccaaaatatagcaccatttgtagtggatgatgtgaagattccccttcaagaatgaaagactcattttcctagattctacaagtgctctcagctgtcagccctctgtaaattgccttagctaaagagcaccattttgttccagcatctactatcaagtgaccaaggatataaaggcctaaccctctcacccgaatttaggacaactctcaagggcatgccagcttcggaactgtctattggctctgctgaggccttcctcaagactgcattgcagaccaacttcttctatctggtcccataattctgccttcttccctcccctccataggtgttggtcccaagaacggtctcatatatgcctcttgctaccccatctcttcttcctcagaggcaatcttcttctcttggaaacctaatctgtgaagcactcactgagaacactgaaagtacaccattagtctctgcctgtggccattcattccttaaaagagtttactattaaaattaagctactgaaaaaatgaaccttagacaaattttcacttctccataattccccttatgtacatctatctcctttgatagaatgccacataagcattcacacatatcagcctagattctttgcttgcccaatatgtttgcgttgtgtgctcaggatgtgtaacaataagcatttggagtacactaagagaatttgtccctgcaaaatatacgaaactttcacagctaatattgatatcaatttaaaatagatatcaatgttaacataattaagaggtgtgcatttcactgtggcttttaaactttccttatgactgtatatttgtttgagagatctcaagactttattgtttactcattctttttcccagaagggcaattataaaaccttgtctcctcaaccattcttcaaatctcaatactttcactaattggagctcaggaaacactcatttcaacactcaattcagatcttattgcatgttttttttttttaattccatcaaggaaactgtcagaaatataaatgcaattaacataggattgacaaacaaaatgctgaattcttttatttagtaagccagtgattctctccatgccaagtaaatatcttagtattgcacagcacataaactgaacttatccaactgtttggttatgcaaaacaaatccattgatatttaataatagtaattaaaatttaagtgtcacattccagaaacatttccatccaaaaaaagacactttatagaaatactaattttttaaactgaaagatatcatccaacatttcaaaactgaaacttgtaaaatacaactattggttaggtctacatagatgcatactgaactgactattcttcaaataatgttagcaaaaaaaaaaatttttttttttttttttagacagagtttcactctgttgccaaggctggagtgcagtggcacaatctctgctcactgcaagctgcacctcccaggttaaagcaattatgccttagcctccagagtagctgggactacaggcgcccgccaccacgcctggctaatttttgtatttttagtagagatggggtttcgccactccctgcccagcaaacaaatgtttttaagggcagtaattttatgtgagactgtaatgtaactaaattcctaagagatcatttgaatccaccgtagtgaaagtgatgtttatacgtagaagtggggtgtggtataaataaacaataagcaggacatagtactctgtaggactggagattcagtgacaagtcaaacaagaaaggaggagagaattcatacttcagaacacttcctattagcaattattgcacataggatttgtcccaattctgcatttgcccagtttattctcagaaaatacttcaaaattatgaaattggaacaattacttcaaatgtatgcttaactataattctaaattaattcattataatatctatttatgagtggggaaggagaaaagagtggaaagggaaagacaggagggaagaaggaagaggaaaagggggaaagaagaagaagggaagagagagaaggggagaggagaagggtgggaggggaggggaaaaagggaggggaggccaggtgtggtggctcacccctataatcctagcactttgggagggtgaggcctgcagatcccttaagcccaggagttcaagcccagcctgcacaacctggtggaacaccgtctctacaaaatatgtaaaaattagccaggcatggtgccatgcacttgtattcccagctactctggaggctgaggtgtgagaatggcttaagcccatgaggcggaggttgcagtgagctgagatactgctactgaactcagcttgggcaacagagccagaccaagtctcaaataaataaataaaatgggaagaggaaagggagcacaggggaggggaggaagggagagggaagaataaaataacaatgacttttatcatctagcgtttttcagtacttgctagttccagactatagtaccatatacaaaagagttgagagttgctcacctattacctgcccctggtcattcatccttgacaaaagcatcagtttactgacagactttgtggtttgaggtactttgttagcacaattgcctcccatcctatctgtaggtgttgatttgtatcaggaaggtcatgactggttcctcccaaactattggtccaataaatgaggaggggccactacttaggaaaattgttctatatttagttttaacacctttatagagatgcaactgaaataccacacaatctgcctgtttaaaatgtacaattcagtgacattagtgcattcacagagttgtgcctccattaacacaatttagaatattttcagtacaccccccaaaccctttgaccctcaatcttcaattccccataccccctccaaccctaggcaatcattaatccactatagacttgtctatagtggacatttcacttaaatggaatcatgaaattatgtcattccggcttctttcatttagcataatgttttcaaggtttatacatgtaatagcatgcattgatactgaattctttattgttgaataatattccattgtatgaatataccacatttgtttatccatcagctgatggctatttggattgtttccactttttggctattaagaataatgttgctgtgaacatttgtctatgtattttcaattcttttgggtatatacctagaagtagaattgctggatcatataactctgtgtttaacaatttgaggaactacaatattctatgttttttttcaaccattgccatatattaaaaaaaaaattctctgaaaaaaaaattaatgccaaattctgtcagtattggttcagtttgcggccacacatcttagaccaaagctcctacttaaaattgtcttagttgtttaatgaattaacactgtaagagcttgatgtgcaaaagagattcgttagctagtctttcttcttgatacaatgttccaaatattgccaataaaaattaacttaattccttgaaggtagaagcacttactgataagttcctcactgcaatacctttagtgtttttttgttgttctggaacttcaatataaaatgtaatgttggaaaagtaatgccactaataaaaatatgcaatattttacatccttgtaattgtttacaacttatcagtaactccaacctgaacatattcacttcacccttagagcagtcatttccaacctgctttattttgctgttattgttgatgagtttgttctgttttgttttattttaggctttagcagccagaagccatggtttttagcttctgtctctgttgataagtggaaaagagggatgaggaaggagcttttctggcccaaccagaaacagaaactaagaacccatgactgtattttctcccttggacacccccaccttagagcatttaagttaaaacttctctaatagaaatgataaaatcaagatttaagcaggctaagcgcttccaaatattaaatagatagttacacagctggctggaacttcatactccaaagttcaagtctagatcacttcaagttatgtctgttctaggagttaaaggaatagtgcccggctatgttcatttgtccagtctctactgtcaccttgcctttttacttcccccctcctcctacacacacaatactcaagtcacatactcaattcatgcatatgcagacacagcaagtgcatacaccacacacacgttttctatataccacagacacagatgtacattcctcatacacaatcacctcacagacacacacatcccacatacagacacctcacacacacttcagtcacaaaaaaactcatgcacaggacattcaaatatacacacatcacacacagacttcacatacacattcacaccttacacacacatacaataaactcacatatatacacactcacagaagggaagaaaagttgtgagtttgcaccaccagattacaacgtattggaccaagttttctagggaggggaagttatgtgacaaggacactcatccaaatctctcttaatcttcctttctccagtgctggccaggtaagtggagtcaagatatgctttcaatcttattagaaaccatctgttaagtccacgtgtcatgtggctgaccagaaagcagttatagccaatgacacagatctgctcttaggggaaagaaagtaggggtccctatctcaaatctaaaccacaggcaggatgcagcataggaggatgtgggcattcctaaccccttagccatattgtcaccactacgtgtgagaactgtaggaagtttcttaaactttgaaacgtcagcatatttattatggtaataatacttattggcaagttaggggaaaaaatcacaagtcttgtatggaattgggtgattctgcagagttgcaattgtgacaaataaattatactttctgagacactcttcagttttagcaattacaatagcaaataattattattcataacagtattaacatagcaaatggtcatattccttatagagatagcatttccaagaagtctttaactttttttctaatttgtcatttcagtctctcagaaaacattgtcttctacaatacctgccttttacagttgtcctaaggcctaagatcaaatacaccacataaaatatgaggcacgtggcaagaattcaataaatggtagctactactactattacagctattttcatcccaaccaaatatatacttggaaatgtaattgcaacacaagatattttgagatattgaaaggacaaatttgaaaaacaaaataaagactactcggaagtgctgtctctataaggaatatgaccatttgctatgttatgaatactgttataaataataattctttgctattttaattgctaaaattgaagattgtctcagaaagtgtaacttgtcacaattgttaacaccattgcaactctgcagaatcatacaattccatacaaggcttgtgattttttcccccatcttgccaataagtagatttttttcatcaccaataaattaaggctatgcctgtgccttactctccaaatcattagagctcaaatgaatctaaatcactgaacagattaaagttttagataaaaaataaatgtcatcatttactttctaaaaataacagcaactctgcatatttccctgtaagcttatagtaattatgccattcatatatactatctaaacatttatatatagtatatacatagaacatgtatacaatctatatactttaactcaatgaggagatattgctaacctattgatatttaattcttgcagaatattattcaataaaatcgcaattcttcttcaaactagttcacacttatgttattagttagctcacaacagcagcttaataaaataaattaaaagatagtaagtctccaaagagtgctaatacattccgcatgttataataaggctttttctgaatcacacttttattgtacaaacactgtttaacatttagcaatccaaatttaatcaatgttttgtgttattcctctgcaaattaacacaactcttatcacagatactgaaatatttgaatttccttattacataaaaattcctgttggctttaacctccctatgtaaacttataaactggtttaagggaaaactgaaataatcctttgctaaattatacttaaggtgaagcttaataaacgcatattaagtagaaagcaacgtaaaaaagaataattacaaatataccatttactgttcgcttactctatgccaggtataaggataacaaatttttaaatatatcttatttaatcctttaaaaaagcatgatagtgatattattttctgcaacttatagattaaaaaaaaaccatgaatctctgagtatattatttactaaagtctcacacctagaaagtgttgatcctgggttgctgaattaaaaccctcaagtctggaaactctattccatctacctaagaacccaaaatggagagccagattttttttttttttgagacggagtctcgctctgtcaccccagctggagtgcagtggcacgatgtcggctcactgcaagctctgccttctgggttcacgccattctcctgcctcagcctctggagtagctgggactgcaggcgcccgccactgcgcccagctaattttttgtatttttagtagagatggggtttcaccgtgtcagccaggatggtctcgatctcctgacctggtgatccgcctgcctcggcctcccaaagtgctggaattacaggcgtggaaagccagattttaaaatgagcaattgggtgtttgatgttgcccaaaggactccagcagtcaacaaatatacattgccaatgccaaagatattcctttattgcatggtttaaaaagttggttgagatctttataaataaaaaagtgtgtgtgagtgttcgtgtgtgtgtgtgtgtgtttcaagaaaagtttcagccaagcaggtggctcacatctgtaatgccaatgctttaggaggctgaggtgggagaatcacttgatcccaggggtttgagggtacggtgagctatgactgcaccactgcactccagtctgggcaacagagtgcctctgtctctctaaaacataaaagaaattttaatgcaacttaaatttttaaggtcaagccttctctgtacaatgaaaacctatgcaatccaaggagattttcaccgtcaaaggagatccttatactgggaagggatatgttgaatcagtaaataaaagcaacttttgcagatttgcaacaaatgcctaatgggagaatttgcttagaatgaatcacttgggtgggtgaacaaacttactggttctgcatcagcaaacatagagtaaatagtgtcttaattttctttccaaagaccagaagaattttgaaaagaaaaataaaaccctaaaatattgttatgtcacacaagaagtggaagtaaacaggcagaaaaaacttctaaagctaagcacttaggaactgagtgttagtaaagagaaacaaccaactgcattttggtttcctctgtaagctagctgagtggagaaaactgtgaagaaaatgaaaatcacaactgataagtgcttttcttctcaaggtgtggcctccaggcctttccgataattatgtcataagaagagattaggagtcttcgtaggtaagaagtcttaaggacagtctattcaaaaatgtttttcatttggtactctgttacagctatctcctttctctgacagtgtccagctacagtaacatctatatcaaactgcctaaagaattttagcaatattttgataactcatctatcataatgttcccttgcccagccatcaaagggcaatccttctgctacagtgtgcacgaaatggtctgaaccacaccacacatccttgagctctgaatgcatcaagataccagcagttagaagattcctattctctgacaactctctcataacaaacttgatttattaaaaaataaatattgaagtaggccgggcatggtagctcatgcctgcaatcttaccacttggggaggccgagatgggtggattgcttgaactcaggagtttgagactcacctgggcaacatggcgaggccccatctctactgaaaatgcaaaaattagtcaagtgtggtggcatacacctgtagactcagctactcacgaggctaaggtacaagaatcacttgaacccagaaggcagaggctggctgcattgagtcaagataatagcactgcactccagcctgggcaacagagtctcactctgtcgccaaaataaataaataaataaataaataaatattgaattagtaacttttgcatttcatcccttggtaatacatatttcttctgaaggtaatagtattttattctaatgaactctttctgccccatgtttagtaagcagagctcatttgtaaccatttgggcttcagacaaaaagcttttctaagttttgtttttatgaaaccaatatttaaaaccacttccttttatttattttttctctctcaaaaacaaatgtccatgaggcttcattatttttttcctcccttttctaatttcttctttttgaaagtaatttattttctaaaattgaagagccacctgactacagttactttagggtaactgaatgtggttgtgcttttgccttttaaagagttagttctgactacattcatataaggctttgttttcaaggatgtctggaattcaaacccctgggactgagaatatcacccaggaaaaaaagatgccaaattgaactaaaaggctactttacaattttgacctgtggattttatttaatgagggacaatcaacaaggctaagtaaaatagttcctggaatatgtctgacagtcatatgaataggataaaagctgctgaaacagtgctcaaagcaagttatcaccaattctgaattctgaatattgcacctaaattcacaacgataatagctatttttaaaaataccactcattatgtcttcaaactctaatctaccactcttagatcataatgccaagagtaacccctactggccagtctattttatggctaatgctgaaaggatacaggagaaagggtggttttactgatatatttataatcccaggagcagtttgccagcactgcattttcatgataatattatatatatatatatatatatattttgtcatctagctcctccagtgatactcctgaagatttaacatactttacttttacaaagttttaataactataaacatgttgaacattttaaatttctggcaatataaataatatttctaaatcaacagataaaaggaattctgctcactttaaatagcttttccttagtattactttctgaagagggcaaattatcaaatgatgtttaaaaactccattacctgctccaagttaaggggcgagacagggcacagaatgaatacagtgggggtgtgtcattaggatgctaatttacacaacaaaaattaatgacagataaagtcagcagcatgttgacatgtccagcccacatgccctacattttgtctacttacaaagtgacatatgactctagatgtttgcataagcaacatggagattcccttcattattgcatgtttaggttgctagtaattgagtcatactcctgagctaaattaggtaaataaacttgtgtataaggaagttaccatgcaatcctattaattttccatatcaagatatccaggaataaagcagaacttagacagattctagaaaaaatcacacatagggcaacattctcacttcttcctggcccactgcatctcttgcattctttatgggtttgtaaaaatcaggttaaaataaactaagtgtagttcatttcacacaggaaagaaagtataaatgagcattgtaggccaggataaagctgtggctggggataggcattctgtcctgtttgcctggggtgctaattttatgaacattatatgctattatagactatattattgttctcaacaattcactcttttgccacttgaatgttcaggcgttctgggaggggggatatattgctgagacccattgtctggttagccacaaacttgcttgggctaatggaatgtgagtggagatgacagtctgtcattttagatcaaaggctttaagaagcattacgtgcttcccccagcctcttgctctttaccctgggccacagttccgttgtcagagttccaaccagctgtactctgggcaaggttgagccatttcctctactttcttctaatggatggaatggtctaacccattgaattgacaggaaaacaagaaaatactttggctggaaagaaactcttacaagagctcaggctaaaccctaaggaattcagacttctctttgaaaatcttatttgtcaatggtcacaattcaggagaaaggacaaggtatactgcaacacctgggcctcatttttgctgacaatggagcagatggagtgattatctgtaaccttatttgcactgaccctgaatatctgttgtttgtcaaaaccatttgaatccttttagtttcagtttcccacacgtataatcttattactcataaagtttactctaaagcaaggtttaaaatgaaatctcatgagaattaaacatcatttgtacacttagattgccattcttaaaaaagttacataaattcagcagaaagaaagcactattttaagaaaaccaccttatcctctccttttaattgcttctaagaaactgggcaaaccaccctcaatgaaaataatttgaataataacatatccgttctcttatattttaattttataatattccatatgtgaaacaatggggtaaatattgaagatgagagtgggtgagagtcctagattccagaaagataacttttacttctgctatttattattaattttcttcctttcaaaatagagttttgtaaattgcagctatttctaattctactcaaacctttgacaaagaaggagatgtatacacaaacacattaaagaaaaaaataaatggttacattttaagttggaaaatattattccactttaaatatatcctaagtttaaagaaagtatttattgtgagccaaggcttcacattaaattttgcaatttgtctccttaatacttctagaacaaaagttaattatttcttaaccacttacataggaaataagatttagaaattactcaactcacttatttctgctgatatttttctttgttttttttttcctttgagatggagtctcactctgtctccaaggctggagtacattggcgtgatcttgcctcactgcgacctctgcctcctgggttcatgcaactctcctgcctcagcctccagagtagctgggattacaggtgcctgccaccacacctggctaatttttgtattttttttttcagtagagatggggtgtcactgtgttggccaggctggtctcaaactcctgacttcaggtgatccgcttgcctcagcctcccaaagttctgggataacaggcatgagccatcgtgcccagcctctgttgatatttttcaaatagaaaatcaattttaagtttttctttatcatatgaagcaaatattaaataatcattttatttagtctgatgcttgcttgattatattgtgatatttctaataatctattagattttataataacaattataataattgtttctaagcaaatgaactattttactgtatgttcaacctcctacagaacgctgtataattttctaaataatggaatctatgcagcagcgggatctatttataaattcactgcattttcagtgtcattattgggatatattcctgagtaactgctgtggagacagaaagtatcaaaatatacagcagaaatttgaaccatataaagcctgatgggcctgacaaaggttaacagaataacataacattcagctctactccttttctcaccctcgtctcatctcaaaatatatgcaggaaatgcctcctttttcaacctccttcgcattctgaagagaatgtagaactttgttttaaaattgaagccaatgtaaccaacatttgcctatttttaaaaagctcttccttcattctgattggctttagaaacaggcctaatattgacaagaaatttatagagttagtgagagttttcatgctaatatcaacattttattcttttttgctcactcagttcccaaagatggatgtatacaaatgctgtagaacttcatacatgctttcctacaccttcatttcctcctcctcaaaagattaataagctctgtttattgacgtttttgtggtaagagtgatgtaaatatctcaagccatataatcaagttgtcatgttggtctaggcacctacaatacaactagatctgtgatttaccaaggtgctatgtatgaatatatttattttgacaaacacaaatcagttaatattttgacaagtatattttgataagtataaatcactgaataacagctttcatatatattatttcattttaggtttcagaagtagtcaacagttgattcatgaactgcttgccttgcttgtagaaaatttagcagacaggagaaagaagaaagaaaaataaataggcaaatcccagactcattcctgccataatggtttcattttgcctgttttatatatcagagttttgtgaaaaatttcattcataaagagaggttttctgattttttaaaagataaaatttgaaaatgtctagcagagagctcagtgcctaaatctcagaaaatatttaaggacagagagaaaacatgaaaaacataaatagtatctgcaaataaggttgataagtctaacctttctatacttaaaagaaattcagcttcttaaatggcagagaaaattctgtatgccagattacaatgaatatattctcgtcattatcattatctttagatacttccagttttctgtggatagactttgtaaaatgccatctatctccaaaaagaatgttactaacacccaaggaaaaacaagtttgtagagtcatacatctaattaccaatataacgtaatgattcttttcattatcatgaccctctgcccctctgtagtgacatgtccccctgaaatttgacccaaatagttcatacaaataaagttgcaatgtctccagtcagacatgaactgattgtcttcctagggtctcctggggtagcaacagtcaatttgccacagcagaaacttgagtatgcacattgagttccctccaggtattttggcaagcaaagtttaaaagcaaccatgaccttgtcaccaatactaatggacagacttcagacttctctgctttatgttagcatagttgctggagtaaggttacaatgttctgaggactattattgatcctgacattccaaacaactgtgagttgatggagtaattatcttatattcctgtgaacagactttttctgcctcaggtcactgaaccatttttatttttcccaacataaaatttctatccaaaaagtgatctaatccacctgaggaaaaagactataacttcatcacattcagaataatctctcctcaggtcctctaccaaaatgttatgattgctttaatttccatattgcccatgtacagaagccaacaattattgcagcataacttagagagtacaaataagctgaaatgaccagctatgatctgaacattggcaccctcccaaaattcaaatgttgaaatctaatcaccaatgcaatagtgttaggaggtagggcctttgggaggtaattaggtcattaggcctccagccttgtgaacaggattaatgcacatattaaagaggccccttcttccaagttatagctcccttgccccttcttccaagtgaggacacagcaagaagacaccattaatgaaccagaaacctggccctcaccagacaccaaatctgtagcatgctgactttggactccccagcctccagcactatgagaaataaatttctattgtttataagctacccagttttttgtttgtttttgagacagagtctccctctgtcggccaggctggagtgcagtgggacaatctctgctcactgcaagctctgcctcctgggttcaagcgattctcctgcctcagactcccgagtagctgggactacaggcatgcgccaccatgcccggctaattattgtatttttagtagagatggggtttcgccatgttgcccaggctggtctcgaactcctgacctcaggtgatccaccggcctcggccttccaaagtgctgagattacagccgtgaaccactgtgcccagccatgctacagagtttatgatattttattgtaacagtccaaatggactaagacatgacctaccttactatcagtgccaaaaagactaattctaccattccctgggatctgaagataatttaattgtcctttctctaaaaataatagtaacaaccaacaaacaaaaaatctccaaaagtttattttagaaaaaaggtctaaggaattctatatagttcttgataatttattaaacatagtcacaaatcttttggaatttttcagcaagcaataaagtgtccctgcctaagcaggtttttaaaagctattccaaggagaagccatacagttccgtcactgcatttggatgctgttgctgtgcactttattcataggaatgcatagcgtggcttactggtactgaaaaagactgctgaatggcagattttaaaaagagtaagcaactgaattgtaaaaggtcctagcaatgatagattccacaacccgttagaaatttgcccctacaaccctcctgacttctgaattccaagaagaatgaaagtgatggcttataattagcatgattgtgttaggggcatgacagatgctgtcggccagccttgatgtcagagtaaaatctgtttcctcattcatagtccagctcttttttcacatgatggactgcagcaccctctttctgattacaggcactaggcttcattgcatgttgtaaacatatataaggcagagcctaggtgcatgcagatgataatgtgtcagtctgggtcaagtgacagcttaggaaatgtcaaaatgaacaacaaaaacagagtaattctatgaaatggacaatgtgggtggatattacatttcaatattattaatgtctaactcaaaaatttgatttgccaactgaagtccatttagcaaaacatacacattgtcagttagcctgagaattttcactaggcttaccccacttccctcctagaatttttttttgggggggaggttctgaaggcattatttttattgtgttgtgttgtgttttgctgtgttgcgttgcattgcattgcattgcattacattttttgagacagagtctcactctgtcgctcaggctagaatgcagtggtgggatcatggctcactgcagccttgacctcctgggctcaattgatcctcccacctcagcctccagaatatctgggactacaggtgcacaccattactttgcttccaagttagacataactacttgcatggtctgcttgtactcaaactcagcaaatcacacccagcatctcctcccaatttagcatcttctcatgatttccctatttctgttcctggatcattattctcccagtcattcagacccgaacctgagaatcatcttagatgtctcactctttttcaagcgccatattagtttgtgtaatatggtatcaaaactttgaaatttctgtagcatctgtccctgagtctttccatatctatagtcatcaaacttagctccacattaccccttgctgagtctaacccactagtcttatatttcttagatcacacatccagtctatgttcccacgaaaccattcaagatggatcttcctgcggcattccatcaacatctgcctgctaattctcttcatcctgtacctgagcttagcagctcactggcattttctccaagttgtaccatacttcctgtttttttgcccttgtccagtattctttcctctgtcttcaatttttctgtttatacttctgtggaaatcctatccatccttaaaccttaaaatgtggagagtgtgtccttaagactgcatataatgactatagcagttcaagtctctttgatgttgactaactgatattgaggaaatatgtcaattctgtgggattcaggtactcctctgtaattgggagtaaagggagaagaggataatactttccctgcctctgtcatatctatcatagaataattaaaatgagcaaaaactttaaatgagatgaatatgtaaaagcaagagtaaaagctaacatgctatgcacagtagaaagccttactatgatcatcctctttactgttacatattcaccacatgcagatgaggcttcctcctgggattccacttattttcatcactattatggtcaatactatgacttatctttcagaattagttagcaggtatggtggctcatgcctgtaactccagaactttgggaggccaaggctggaggattggttgagttcaaaagttcaagaccagcctgagcaacatagtgagatcttttctctacaaaatttaaaacaatagctagacatggtggcccatgcctgtagtcccagctactcagaggctgaggcaggaggatcacttcggtccaggagtttggggctgcagtgagccatgattgcaccactgcactccagcctggacagagtccagagtgagaccctgcctcaagaaaaaaaagaagaagaagaagaaagaagaagaagaagaagaaagaagaaagaagaagaagaaagaagaagaagaagaaagaagaagaagaaagaagaagaagaagaagaagaagaagaggaagaggaagaggaagaagaagaagaagaagaagaagaagaagaagaagaagaagaagaagaagaagaagaagaagaagaagaagaagaaagaaagaaagaattagttcactgacttaaaaacaggcctactgagggtcacagattcttttggaatatacatgcatatttggaggacagaatcacaaactgtttgacacattcagttaggttatgaagaaaataaaaggctttggttgtaatatgatcagatggctagttccctttattctttatttttgagatggagtttcgctcttgttgctcaggctggagtgcaatggcacgatcttggctcactgcaacctctgctcaccacaacctccacctcccaggttcaagcaattctcctgcctcagcctcccaaaagtagctgggattacaggcatctgccaccacacccggctaattttgtatttttggtagatacatggttctccatgttggtcatgctggtctcaaactcccgacctcaggttatctgtccgcctcggcctcccaaaatgctgggattacaggcatgagtcaccgtgcccggccttagttccctctattctaatgtaaataaatactctaaataaatgtataattcaaaataaatatttacataaatattgacagatgaagtgctttttgactcatgctgaagttaactagctgccccttgaaaaattagttttctccattaaattattaaaatttaactaattctggagtttttctatggcatgctggacataataggaaccatggacttgctgagagtcctagtctaggagatttccttccagcacctgaaatacttcatgggagaccacagttttcattccatattttgatgttacaatatgaaccataaaaactttcttctatttctattttttactttttgcaagactaaagacaccccccccaatagtccagaattttattcctactttcttcctttttcacttgagaatgtagaaacaataaataactcaaatctacattttatcagtcagtgccaccatttaaaacacagcattttgggcatgatttcatttaaccccttaattgtatagttatgattccataacactgcacactgtctattccttaaaattttcttaagttttactttcacattatgcaaaattaattaatgctccactctgtggactctatgccaccacaccactatcaatgaattcagaagaggcagtgggagtgttgatagaatgtaacatagcattatggtagagtacagactagattacttgtttctcagttttctcctctaaaatatggaaataataataatatatctaattcagagtttttgtgaagattaattggtttaatacatataaaatgtttagagtagagcctgacacacaagtactctgtaagtatcatctattattgttttgttattaataaaggactccattatttcacaaggtaggttaagcatcattaatctgaaaatccaaaatgcaaaatgttccacaatccaaaactttttgagtgctgacatgatgtcacaggtggaaaattccacacctgacctcatgtgacaagtcatagtcaaaacacagccaaaactttgtttcacgtacgaaagcattttaaaatattgtatacaattattttcagcctatgtttataaggtatatacgaaacataaataaattttgtgtttagatgaaggtcttatccccaagatatctcactatgtgtatgcatgtattccaaaatccaaaaaaaaaattcaaaggttgaaacacttctggtcccaggcatttacaataagagatattcaacctgtatatgttaaacatatactaattcttaaattttttgagagaaatgtaattataataaagtggaaaaaactatatcaggtatgagtattaatattttggtttaattactgcaatgatcaacatagctactttaattattattctcatgagagtttttactttttttttttaaatagatggcggtcttgctgtgttacccaggctggccttgaactctgggttcaaatgatcctcctgcctcagcatcccaagtagttgggataacaggtatgcactattacaaccagcccatgctaatgagaattttaatgcatatacacacaacatatacccacacactttcaacacacattttcattatacagagtgtttccataggtagagtagaatgagatatgagttctggttatttagcctggcaactgcagcagagtcaaatactgttagtgtatctatcctggttcatgtcctgttatcaatacaagaggcaaagtataaatggagatcaggtttccatctggttacaactaacagcatagccttgattgcctgctttgagttaggggatcaaaggaagaaatcatcagagatccaaatagcaactcaggcaggcagatcgccatttgaaaaaaaatagtaacttctctaccttaaggaaggataactcctgtttggctagcttgattcctttctaattataaaaataagcttggggtgagtagcaggggataaaaatacaaagtatcatataggagttaataaagaaaacaatcatgataattatctttctaaacagtaaagagaaaccaagtatttcttcatattagaaatataatacaattttacagccaggcatgacgactcacacctgtaatcccaacacttcgggagatggaggcagaaggactacttgagcccaagaattcaagaccagcctgggtaacatgtccaaaccccttctctacaaaaaatacaaaaatgagacaggtgtggtggtgtgagcccgtagtcccagctatttgagaggctgaggtgggaggatcactggagcccagcaagtagaggctgcaggagccatgatcataccactccactccagcctgggtgacaaagggagaccctgtctcaaggaaaaaaaaaaaaaaagtaaagaaataatttttttcaaagaaaccctttacattaaaagcactacttatgatggaatctttaggaaatgctagaattccttgtccctagatttttttctaaaggattaaaatcttcattttctaggagaactgacatttaaatgtatgattcctaaactcaagatttttaaaagatctgagttgctcgataactctatagcacactcttgaagatgagatattcatggaccctccctaaatcttggaaagtcttcaggctaacggcagggctggagctaaagttgaggcagaacctcatttctgccagtaacagcatgcctagccaggattaaaaaatttgccaagaccacacagaaagagactagatggtaagttggatttatacttctctttgcaactgaaggccattctgaactcctgcctaaagttggagaaagtgaagagaggccaaatccagaaaccattagggctcagagataattattatggaaaaccaacaagcatgtacctaatgattccccagagtcactcctagagcaaggaatgaaatgaaaaagtttatatcacccacaaaacaaagattcaatgcagtcaatgaaccaaagaagaaaaattcagctctgaaatgtgataataacctgatattcctcctcaaatctctggatatttggttacattataatttgcttgatgcacgtattcttaaaataccaacactcaattaaattcatcacctaagaaacatggtcattagtaattatttttgcataatctcttttcatttttattactgcaaattttttgtttctaagtccacaaaaggaaacttcaacttgatgtaatacaaaaagtccagagtgtatcacaaattaatttatctagaatgtaatcaccatatagaaaaaatgatgcatatgatcttaaaattgcatccaggtttaaagttctataaaaaagataaagggaaggatgttactattctgagctgatgatgtcttaccatcccaaactgtaaccattgaacatacacatttattgacaaactgctttgaaatcataacaagatgtctcacaaatgtattgtgttttgatgcactagtgtcttagctgtatgaaacagctacatccatgtttttccatctataaaaagggcaatgaaaagatatcctttgagtcacttttaactcaactttctaagtgtctccaattttataaacatgaatcatactcctataaagaagtcttccactccaccttcacgagtgtatatctttgatcaggaagtttaaatggacactctatatgcatccttgtgcttttggggatctgacaatcctttttttgatggaacagtaaatggcccaactgtttgcctaagactaggcagaatgcaatttatcttcttggtttgcagaaaatggctatgtaaactttaccacatttgccagtatttccattccttaagacatagctcattgactaggacccagttttccaagcaagtataagatgtttccttgttactagtatgtttttggaaagcaaaagagaccttccgaattacctcttagaggcatgcttcacttttgtcctcagtaatgattatttcaatatactgtttacaaacccaatcgttactccctttttgaatgcaaagtaacacgtgctaattgttgttttgatgatattagtgaatcaaaaccttatgggaaatacaattgtctcatcttccaggtttctatgtgaaatactcagaactgcacttgcaaattcctgagcagcttcattctaagggaagcatggcgccatctagtgatcatacagaaaattacatttatgcattttctctcaaagctctgtattaaaatgatgagttggcccatacattagaattgaaagaagagaaatagaataaaaattcctagaaactttacctagttatttgctatatgcaccatcctgcatggtcattattaaacatatatgggttataacaataataatatgacattgtccctctcttggggtcacttttttaacttcaacttaccattggtttagtcatgtagtttccgaaataaatatcttcacatggaacatttaattccaatgaactatatttttggttcattaaaagttaatgaagtttttgaaacaattccaaatgatctgtaaaatatatttacttaaaaatgcttcattttatttctctagtgatgccctgctaggatgctacctaaattgttaaatatttaaaaacacagaggaaaaagtaagataaaataaatagcatactatttagagattaacctattccttaatatggaaaattattcctcattgtcagaataaaacatattattgtatttctagtttaaggataatattgtacagatatcaataggataagatatgcttgcctaagccggaatagatgcccactctgtcccagcagggtttttccagttttaccctgtggaaagttctatgaagacaaggaccatgtctgatgcatcttttcatctccatacgccactactcacccaaccctcgcccccaccagcacaatgcctagcatgtcataggaactcaggatgtttcttcaatgaaccaataaattaatttattatgtctgtctctaaaatcattatttagagtctatctaccacaggaaacagcttttcacttttctattgtatgattctctgctccttttctgagatactctctctacaagtggcaccttatttgatattcacactgccacctcctaaattctttaaaatcttgagtatccatgtccaaatggctttctttccatgagttatccatcttacagaaagggcattattcatcaacacatcatttgatgaaataaatccaaaagggtggaaatgagaaactcttatttcttactcttttcaataggtagtattaatattctgtaacaaggagatttcaatagtgtaacacataagatattactcacaatttgaaacaggtgcttttggcattataggcacttggccacaatgcatagtttaatatttgtgtggctcaaaacagctaacttatcttgaaatgttgcagaggaaacttccttaatcacattcttactgtccagtgactgaggtaaatcatggcatacatgcgtcattatgaatcacatactatctatacctacacttcaactacctgtaactagattttcactatacggtgtaatgagtttcagtgagaacattcagataacccattcctcaagtaaatattccaaaagcattttatttcactgtagagaaaatttagaaaaagtagatttctccttctctagtattgctgaattgtgattcaaatctataatacacagtaaacgtctcagaatactactacttttgaagtacaaagattgccacgatgtagaatagaatggctttttgtttttaaccaacatccccatcagtacattcaactcagccttgcaactcccactcataatgtcacaactgtttgtccctaagctaattaagtgtgtctgcgagctgtagcgtgagttatgaagttatcatttctccacactttatagctgtttgaaggatatgaaatggcaatggacaaacagtcatgatatttttggcaaaatatcaaatgtttttgatggaaagtgaaagggctttggagccctctgacctgggttcaaatcctaactcttctactttatagcctgagcaagttactgaacttaagtttctttatgtgaatgtggagatgctcttggacccaaagttctaattttggcacatacctatctttaaaaacaataataattttaaaagtaattttgaaatgtgttggtgaaaaacgtaggcttttttgaaaaagggtctctcactctgtcacccaggctggagtgcagtggcgcaatcctggcttactgtagtctcgacctcccaggctcaagagatcctcccacctcagcctcccaagtagcagggactacaggcacgtgccacaacacctggataatttttttgtattttcagtagagacagggtctcactatgttgccctggctgatctcaaaatcctgggctccaattatccttccacctcagccgcccaaagtgctgggattacaggcatgagccaccacactcaaccaaaaaatatagtgttaagagatcacactgtgacctataacatttatatatttagaacacctttggagctaactgagattagggatcaagatatatgtatatgtatatacacacacacacacacacacatttaataacacaagcatgcacttttgtgaaatagaatacgtaagttctaagcaaggagagtgcaaactgcatttatttttcaaaaacaagaaaaatacagtcataagaggttttaagtaactagttttaatcaatccatatggttgcatacttagagttttcttagaaatacattttacatttagcattgaccttggtatgtctaatattttctaggtatttttcacatatttctaagggctaaaaatatttattcatttatactttcattcagtcaatagatatttattaacagctttctcttatccaagcacatgtttgggaacagtcaacttttgttttatgatacagattaaaccaaagggacatattaatttgtgatcaactaataaaccaacagagagcttctaaaagctgaaggattttctaattttacagagcataaagaaccattttattcattttaaatctcaaactatgctgtgtttcataaggaaatcaaaggatatataaggtgtatacacttaggtacacatatatttttagatattttttaaattgatacataataattgtacgtagggatgtttcaatacatacaatgcatagtgatcagatcagggtattagcatatgttccaacatttttcatttctttgggactattcaatatcctctaagtatttgaaaatatataatatatcgttgttaactatagtcatactatagtgctatagaacactaccacttaattcctcctatctagctgtcatttcgtattcttaacaaatatttctctatcctccccttctccctactgtttccagcctctagtaatctctgttctcctttttacttccatgagatcaactttttctagcttacattttttgagtgagaaagcagtagaaaagaaaatgtggatggctttaaaaggaaaaaaagagaaaaaacagccctatctccaaatactccaatcttgtgaattgaaaaaaaaaagttgagatctttttttttaatcagttgctatctatttgtatatatacccacagaaaaccatagttaaaatgtaggcattataattctaagacatatgtacagaaaggcaaatgctggggggaacatattaaaatgtttctctgacattttgcagtcttacacagtgatttaatttatacgccatccatatattagtgatctggactctcttgatccaccaaaaagcaccctacttagcatttatctagtgttttctaagtagacgtttaaggctctttttaattaatcattttattaactcttgtcacactaatagagacagcaaccaacctgaaccatctagggcagatgagcaatggagatacacagaaagctaagttgcactgaaaataattttttgagaaagaacaacgggagctgtggagttctccaaatcataagttataaagctcagttaaattacttttttgtacaatgtagacagaaatgacaaaatggcagttctatatgcctgtaaaactcaaactgaccaaacactgacacttggtaacagcaggatgtgtactgatgttactataatgatgtttagcagaagagttgaaaatagaaagggtttccgaatcagcccagcaccaaccaagtaatccagggatccagatcattccaatacccagtgagttgtcccctttggcccctcctaggtgtgacccatccaagagaagcattgtatttccctagtctacattgttcccactttgacacagcctatcatatacttctctgtaagtttatgattatctcctccattaaatttttaattcttggggaccaaaaatctcatttctctttgtatgttcaagtgctattaagcacataagtactgaacaaatgctaaatcaacaaataaataatcccatgattacttaaaactgaggtgcctgcacaaatcagcaaggcactaaaatgataaactcatcctctaacaattgatcaaataccttaaactcagtctcaaaaagagtaaaaaaaaatgtcttggcttgctttcaagaaatgagcaatgttaaatcaaattcttgctagattattttcatggtaatagtttttcacaacttcttattgtaaaagtaacaacattatttcaaaatttaattaaggtataaataaatataaatacaaggagataaagaatatttataatcctattactcagagttggtttcatactttagcccatatacttaaaaatgtgtaaagaattacattatgtgtagttttgtgacaaatttcaatgctaatatctctatcattaaaaaaaatatggaagtaccacaatttagtctgttttagttttttgtttgtttttgagatgtagtctggctctgtcacccaggctggagtgcagtggcaccatttcggctcactgcaacctctacctctggggttcaagcacttctcctgcctcaggcgcctgagtagctgggattataggcacctgccacagtgcctggatatttctgtatttttagtagagatggagtttcaccatgttggtcaggctggtcttaaatttctgacctcaagtgatccgccttggcctcccaaagtgctgggattacaggtgtgagccaccgcacctggcctgttttaaacaccaaccctccctagtcctttactattatcaactcattgacggtcaaaatacataaaataatctttgcctacttcttgttacttgaggataaatgtctacaagaggcattgttatatgcatattttgacatggagtgttaccattgtaactgtacaaaatttacaatctctcaagtaatatatgtgtgcctgtttctttacccctttcctagactgagcattaccaatctttctatttctagtaaattgtcaaattaatctcagagaagacttagagacagtcttattcacttagtttattttctctcatgtggcaaaaggcaattataataaaagtcaacgtttacttttaactcatgatatgtattacacaatcggcctctcataataactcaatccttatttttataactctgcaatcaggaaggaacaataaaatttaattccaatattgctaaacctaggataattttgtagactagagtgtctaagtgtcatagtaacaatggctgaaagaaaagatgtttttccataccaactgaaatatatggattatcttggtacaacaaaactcttctaaatttattttattttattagttttggccacatgagaaacagcaagaaattccactgctagtcctccaaataggtaatcagatatatctgtggttatcttccctccataaacatttcctagtgattttgttaactataattctgtaatacaaaccctttgggtaatactcctatagacatcccacaatatatgcactccacacaaagagataaatgacagttatcttctgtaatcaagctcctgccaacttaaggtaagtaatgtatgagaaagataacctaatggcaaggctggcaagtcattctactatgtgtactaagctctttctcaacatcaagtaaccagacttaacaatgatttaaattactatatgaagactttcatggaataatgatttaatattttgacttataacaagactaagtataagaacatcactatttattcatgattaataatgtacatgtatgtaactcacataaaaatactattaaacatattattgctttactttacacaaagaccctaatgaaaagtcttataattaattatagaaagataattttctctcaagacataaatattatcaggtttctctatttgctgtatctttgaggaagctattaatattttaagacctaaacttaactccaagtacgaaatacacttttacatttgtgtttctaacttagctttacataggcattttatccatttttaaagttaggattgcttaattccttttttgaaacaaaaagcataaaaaatacataattaatggcattgcttttatacccaacttttattatctacaataaagatgtgatcatgtacaaataaccagatatgaagagccacaaacccacatatgcatttggaatttactcagaactatgtttgaaaatactcatgcactaacatttgtcccgttgtttccagattatcctgaagtttggtccaagacaaacttgttcagattttctgatttagatcacagctctatactctaggaaaacatggatacctacacctcagttaactgagtcttaaatggtgctagagatttcttattattaaggaaaggaaattattagttgatattttaaacatagaaacagaaaatatcattccagattaatcgattcaactctagatgaaaacaaatttatatattaaaacaaattaactgatccatatttaaaataagtaacagaaccgtgaagtgagtggaagtggctgtgagaaaagaactaaccaagtgaattttgagtacagaattaggcatataaaacataaataatgctaaaagtctacttactgaaatacttttctttgccttacttctctttttccatagaggcgtgagtgggtaattctgaaagtaatttttgaaaccacattccacaggtaagaaaatcctatgcaatatataatatattgtgaataatgggagccaggcttctcaccgtaacttctcacagagttacagatacgaaaatggagaagaacagaatgagcactgcaatgatggattatcattgtgaaatcctaggtttaatgtatacaaatatctgaatatacccatggatataggtatgtgtgggtatgcatatatatgcacacatttatatatgagtatgtacatacatacactttccccctagatatgtctactaaaaggacctagaagcaaaagcacacctactctccaaattttgatttctaaaaaccattctttactgaaaggaaacagagagccctataaaagtagctgattccaaggcttggataaaagaacaagagtctcatatctaaaaccaaaaagtaaaaaagtactcaaagaatgatagtaacgtgttaaaatgacaagggagtcaactagaagtaccttgtactgtccaaatccaggacagtatgaggattaagataaataatgatattaaccaacaatattaaaggataacaacctgctaaataaagaattcatgactccacacagaaacaagcacgaagaaacatttttatgcataatagaaagccaactaataaaagaggaagaaatgatgaaattacaagatttccccttagcaaaccactatggtttgaatatgtctcccaaagttcacatcttggaagcttagaccaaaacgcaacagtgttaagagttgggacatttaagagatgattagatcatgagagcattcccttcatgaatggattactttatctgttatcataggagtaggttccttataaaagaatgagtttgggccaggtgcggtggctaaggcctgtaatcccagcactttgggaggctaaggtgggtggctcacgaggtcagcagatggagaccgtcctggctaacacggtgaaaccccgtctctactaaacaaaatacaaaaaattagccgggcgtggtggtgggtgcctgtagtcccagctactcgggaaactgaggcaggagaatggcgaacccgggaggtggaggttgcagtgagccgaggcggagtcactgcactccagcctgggtgacagagcgagactctgtctcaaaaaaaaaaaaaaaaaaaatgagtttggcccccttctccctatttcttgcccatgtgatacctttcatcatgtcatgatgcagcaggaaaaaggactgcaccagatgcagccccttgatcctgaacttctcagcctccagaaccatgagccaaataaattctattcattataaattacccagtttgtggtatctgttacagcagcattaaaccaatgaaaacagcaaccatcataataacacaagtaactgatttagacaggaatcaccaacggattccaaagctattgggtaagaaattgaggaataacagcatatttacatgctctcatattatcatggtacaaaatgctttttaattacaaaggaggaaaatagtaactttacagtggagaaatctggtaggcaccacttgaactaaatgatcaaagctaaatttgtcagtaatggtactaaacaacagcatctacctctggatataaggagttagcatccctactgtgatattcctgcccaagttgtatgacctgactatcatccccaggaaacacaaaataaactcaaattgaaagatagtctatgctttagactgaatgtttacgttgcctccaaattcatatgttgaaacttaatcagcaatatgatggtatttacaggtgtggccttttggaagtgatgagattatggggacagagccctcatgaatgggattaatgcccttataaaagagaccccagagaactctctcttcctttctgccatgtaaaaacacagcaaggagacagctatttatgagctagaaagctgatcctcaccagacagaaaatctgcttagcacagatcatgggatttctcagccttcagaaccatgagaaataaatttctgttgtttataaaccatgaagactatggtagtttgttatagcagcccaaataaatcaagagagtgtacaaaacaattggcatgtaattctccaaaaatataaatgtcatgaaatagtctttcacgaagactcagaaactgctccagtttaaaggatattaaagagacatgacaactgattgaaaagcatgattttgtaatttcattggctacacagaacattattgggacaattattgaaatttagaataaagtctgtagattagataacaacattttatccatgttaatttgctaattttaaccactgaactgtacctatgtatgataattccatgtttttaggaattatttaagtatttagaagcaaaggagtatcatgtctgcaacttgctcttaatgtgtatcaataaggaaacgtgtgtatgggtagacggatacatagatgattagatagacagaaaggtagatatgagagacagagattgaataaagtaaatgtagtaaaatgttaacatttgggggatattggtgaggggtatctgggaattccttgtgctattcttgccactttacagtaaatctgaaattacatcaaattaaaaatcaaaatcaatataatatattaactttatggcttatagatatttaaagttagaattgtcaagtgacattctggtgaatgcttcaactagttataactattttccaaatattataaagcacactcagcataaaatcctgctttttgataccttacatatttcgaggacaactagatttttcagttatgtctttataaccacactgtacagaaagtaaatatatatcgagcagaaaatagctattcgtgacaaatctcacacctgagattaagagtctgctaaatcgttccattacattttggccttatgccctatatttttatcttcttttatcaaaatgtgatttcttcattgtaatttattagtagtttttagatatagacaacatatttaaatatatagtatcaccatcttttttgtttggtagaatcataccattttagtatgccataacagaattatatacatcaatatttttgtcattcagcctggcccacatgactctgagatgttctgaattggattgggctcatagaataaagtccaaactacttgccaagacccgatgccccatataatctggctttaggccaattttgcagatttctctttgaccgtaatcccataaattccctatgacatgcaaggctctctgtactacaaaccttttctatgctccttcatataaccatgaacttgaaaatgatgcctattcaactgtcaactcctaacgagctagtcaccctccaagacaaaactcaatgtcaagtcctgctttaaatcctccatccctccctgagcactgccctcccttctttcccaaaaggttattcttccttcttctgtctcctcatatcttttgctcatacttcaaacatttctgtcatattttaatgtattctacagtattatcttttccattagactgtcatgttttatcatttttttctgatcctctcccccacagagcatagaaaagtggctagcacaaatgcagctctcgataccatttttttgaataaatggataacaaaaaacaataaatatcacagaaaaatacaagaatttttgaattacaaaagagaatggtaattattagccactaggttgtacagagtaaccttcatgaaggaagtggtaactgatttgggcatgaagaatgagtaagatgtggagatagaaggcattgtaatagaaaataagaaacagaaagaaccaagatctaacagtctctgtgtggggccgtgaggatatgctgcagacctccaactataggaactataaccagcaaagggccccaactgatgcctctgaaattcactgcaacattttagctaaggccatacctcccatgccctgcttcctggtatttactgagcacagagggcatgttgtggcagacacattcctgggaaacaggattcctctgatggctgattttggcttgaggactcccatatgcctttggctagcccaatcaaggatgctctcaccaattctctctcccttctttactcagagtcaaacttggatcatgctttgacgtttccctcagccttaactggctccctccttatattcctctacaagggcatttcctaaaattcttgcatttctaatcccattttggcatgggcttcttgcaagactcagactaacacatagagtatagagtatgtatggagtaaatagggaattaaagctgatgaagcaaattgggactttgttactgagaacaacatgccaattcaatacattgtgccaaggcaggataaatctttattttctaatacgaacataactgtctatgtagtttttagatttcacaagtggcaaggaatttataacttccttttgagaactatttcatagtttaatcatctttcacagctcacgtaggtctttactaaatcctttgtgatttaagatcatttcttccagctcttctgtggtgatagattacagccaactttagacatactaaattaactacatcaactcttagtcataacaggaattccttctacaatattatgcacacatggtcttgcagggccatttgtcactttttctatttgatacaaaattatttctcattaataatctaatcatgaaacacctgtttgttaggcactgaaaaaattttccctgtttgaaagcagaaaaacaaagatttgtatgtttacttcagagaggattttgtgatttctaataggaagcaaacaattgtttttcttttctcaagtcttttaaactactctgccttctattgacagagtaagaaattaaatcttcaattatttaacatagcattttatctaattaaaaataacagattttttttttctgccaaagatttgaaacagagatggaaagcatgtgtgggaaattctgttacctttccagatctctgcttgaataaaataaaggcattttctgaccacgataagcacactgtctgatccagatcctccaagtatgcaaatcaacaggaaaagttccagcagcaagacttacccatctgcacagagtttcaaaaatggtgatgtacttacctaaaatagaaagagagatgacattagtgacattcatcgcagcttagacacatagtgaaaaacacattctagaaggcagttagagcatctgttcccctcaccattgccaagacccagttttaaggcttttgtttatgacacaacaggccagatggtggtgtctctcactgtccaagtttactctgagtacacttcataggtatttgttcaataaatactgaaaaagattataacaatcaactaagcaagaactatgatttaataacagcagcaaatttaacatctattgagggattacttgcctgccaagcccagtgcaatatgctttgcatattttcccatttactctttagatagtggacatgaggtaagtactattattatacctattgtaaagatgaagtaaatgagcttagggaagttcattaacttgcctaaagtcgctcacacaactagaaagtgttggagctgaagttttcacaggctctcagattctagagcccactttcatgatctttatgctatattgccaaaacccactgggaaataaagatatatatcattaccagtactttgttaaataatacattttaaaaatagaaatgatcacaattttagaatttgggaaaatgaacaatgcctagtacacagcagctgttcaataatatctgttgagtgaatgaaagaataagcaaagaaatgtcactgatatttaataaatatacacaggttatatctcaacacaacaaatatttacccacagagcactctactgtacagcttatttctttcttcctacagatgactatgtaccactattttaatctgctgattatttgaaggtgagaactaaatgctcttaagtgagaaagatgatggatcaatctagaccaaatgactggggagttaccaaggagaggatggaattgtcaaatcttcaaatggcatgttactcaacatataaaatccttctgtaattgaagaagcaattaacaaacaccatttaacagttcaactttcttcagccctttggttactcattttggtagaggttctcattagcaacaaaatattaaagaaagaagcagctaagagagaaatagaaacatgagactggctatttgaaagaatgctgtaattgaaaaacaagaaatactcagcacctcaaattcataaagagataatcatcaagttatctcatgttttgacattgataacatattccaatgaatcaatttttaaaataattataacaccctaaaagaaaattaccctctagtagaatgccacaaagatactcctcgagaagagcaactccaagacacataattttcagattcactaaagttgaaatgaaggaaaaaatgttaagggcagccagagagaaaggtcgggttacccacaaagggaagcccatcagactaacagctgatccctcggcagaaactctacaaaccagaagagagtgggggccaatattcaacattcttaaagaattttcaacccagaatttcatatccagccaaactaagtttcataagtgaaggagaaataaaatcctttacagacaagcaaatgctgagagattttgtcaccaccaggcctagaagagctcctgaaggaagtgctaaacatggaaaggaacaaccagtaccaaccactgcaaaaacatgccaaattgtaaagaccatcgatgctaggaagagactgcatcaactaatgagcaaaataaccagctaacatcataatgacaggatcaaattcacacataacaatattaaccttaaatgtaaatgggctaaatgctccaattaaaagatgctaactggcaaattggataaagagtcaagacccaccactgtgctgtattcaggagacccatctcacgtgcagagacacacacaggctcaaaataaagggaggaaggaagatctaccaagcacatggaaaacaaaaaaaaggtggggttgcaatcctagtctctgataaaacagactttaaaccaacaaagatcaaaagagacaaagaaggccattacgtaatggtaaagggatcaattcaacaagaagagctaactatcctaaatatatatgcacccaatacaggagcacccagattcataaagcaagcccttagagacttacaaagagacttagactcccacacaataataaagagagactgtaacaccccactgtcaacatcggatagatcaacgagacagaaagttaacaaggttatccaggaattgaactcagctctgcaccaagtggacctaatagacatctacagaactctccaccacaaatcaacagaatatacattcttctcaacatcacattgcacttattccaaaattgaccatatagttggaagtaaagcactcctcagcaaatgttaaagaacagaaattacaacagtctgtctctcagaccacagtgcaatcaaactagaattcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacatatttaaagcagtgtgtagagggaaatttatagcactaaattcccacaagagaaagcaggaaagatctaaaattgacaccctaacagcacaattaaaagaactagagaagcaagagcaaacgcattcaaaagctaacagaaggcaagaaataactaagatcagagcagaactgaaggagatagagacacaaaaaaacccttcaaaaaatcaatgaatccaggagctggtattttgaaaagatcaacaaaattgacggaccactagcaagactaataaagaagaaagggagaagaatcaaatagacgcaataaaaaatgataaaggtgatatcaccactgatcccacagaaatacaaactactatcagagaatactataaacacctctatgcaaataaactagaaaatctagaagaaatggatgaattcctggacacatacaccctcccaagactaaaccaggaagaagttgaatccctcaatagaccaataacaggctctgaaattgaggcaataattaatagcctaccaaccaaaaaaagtccaggaccagagggattcacagccgaattctaccagagatacaaaaaggagctggtaacattccttctgaaactattccaatcgatagaaaaagagggaatcctccctaactcattttataaggccagcattatcctgataccaaagcctggcagagacacaacaaaaaaagagaattttagaccaatatccctgatgaacattgatgcaaatatccttaataaaatactggcaaaccgaagccagcagcacatcaaaaagcttatccaccatgatcaagtgggcttcatccctgggatgcaaggctggttcaacatatgcaaatcaataaatgtaatccagcatataaacagaaccaaagacaaaagccacatgattctctcaatagatgcagaaaaggcgtttgacaaaattcaacaacccttcatgctaaaaactctcaataaactaggcattgatgggatgtatctcaaaataataagagctatttatgacaaacccacagccaatatcatactgaatgggcaaaagctagaagcattccctttgaaacctggcacaagacagggatgccctttctcaccactcctattcaacatagtattggaagttctggccagggcaatcaggcaggagaaagaaataaagggtattcaattaggaaaagaggaagtcaaattctccctgtttgcagatgacatgattgtatatttagaaaaccccatcgtctcagcccaaaatctccttaatctgataagcaacttcagcaaagtctcaggatacaaaatcaatgtgcaaaaatcacaagcattcctatacaccaataacagacaaacagccaaatccgaagtgaactccaattcacaattgcttcaaagagaataaaacacctaggaatccaacttacaagggatgtgaaggacctcttcaaggagaattacaaaccactgctcaatgaaataaaagaggacacaaacaaatggaagaacattccatgctcatagataggaagaatcaatatcatgaaaatggccacactgcccaaggtaatttatagattcagtgccatccccatcaagctaccaatgactttcttcacagaattggaaaaaaactactttaaagtttatgtggaaccaaaaaagagcccgcattgccaagacaatcctaagccaaaagaacaaagctggaggcatcacgctgcctgacttcaaactatactacaaggctacagtaaccaaaacagcatggtactggtaccaaaacagagatatagactaatggaacagaatagagccctcagaaataatactacacatcttcaaccatctgatctttgacaaacctgacaacaataagaaatggggaaaggattccctatttaataaattgtgctggaaatactggctagccacatgtagaaagctgaaactggatctcttccgtacaccttatacaaaaattaattcaagatggattaaaaacttaaatgttagacctaaaaccataaaaaccctacaagaaaacctaggcaataccattcaggacataggcacaggcaaggacttcatgactaaaacaccaaaagcaatggcaacaaaagccaaaattgacaaatgagatctaattaaactaaagagcttctgcacagcagaagaaactaccattggagtgaacaggcaacctacagaatgggagaaaatttttataatctacccatctgagaaagagctaatacacagaatctacaaataacttaaacaaatttacaagaaaaaatcaaacaaccacatcaaaaagtgggcaaaggatatgaacagacacttctcaaaagaagacatttatgcagccaacagacacatgaaaaaatgctcatcatcacttggccatcagagaaatgcaaatcaaaaccacaatgagatatcatctcacaccagttaaaatggcaatcattaaaaagtaaggaaacaacaggtgctagagaggatgtggagaaataggaacagttttacactgttggtgggactgtaaactagttcaaccattgtggaagacagtgtggcgattcctcaaggatcttgaactagaaatactatttgacccagccatcccattactgggtatatacccaaaggattataaatcatgctgctataagacacatgcacatgtatgtttattgcagcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctgagcaaactattgcaaggacagaaaaccaaacactgcatgttctcaatcataggtgggaattgaacaatgagaacacttggacacagggtggggaacaccacacaccggggtctgtcatggagtggggggaggggggagggatagcattagtagatatacgtaatgtaaatgacaagttaacgggtgcagcacaccaacatggcacatgtatacatatgtaacgaaccttcacgttgtgctcacgtaccctagaacttaaagtataataaaaaaaaaaatgggaaaagagacagagccaaactattttaagatgatctagccatgatgtgcaaaaaataagcttaataatataataatgaaagttgtatgtaatactttcctttcattcaataaatattattttatataggaagttcattttataatacatgtcaagtcataggggtgagataggaaagaggcacatttatggccttcattattaagccatatgaggggtaagtttagaaacaaaacaacctgggcaaaatataaattggctataagtaggtcatagatatttacgtttcttgttaaaatatatgataggaagaattcataggtttcatcctctggctttagactgtgatattacctattcatgtgggaaaagttcttcttaatgtataggaaaaaaggttctgatacgtagaatatcctttgttccatttttgaattgatagtgcaattagttaagaaataagacataggaagacttgagaacctaggtattttacagagttttaaagagagagctcttggtcttcttgggagggtcttaaggatccgctttttattgttgtattctttgttcatgtaatttgtgctgcttgccttggtttgaccatggttctatagcaaagcagaattccaaggggattgggtgaaagaagaactcttaagttatggctggttttcccagaaccagtttcttaaatagcctctaaaatcttcatctttttccaaataaacattattagtaatctctttaagagtaaaccccatcacctcatattactctcacgtactgagcttttaatatacatcaagaagattaagcacacacctcaggtattaaaatgtgtttcctctgcaatctcattttatatcaaacatcagtatggttatctcatgttgtagagtattgctgaactagattctatgttggctgagctctaatttaagtttagatacagctcaagccctacatagaagcacatttaaatgcatcgctttagcttgtttctgtagcatttaaaggttctggcatcatggaaatgattttggaggtattctgagtgcctctgttgattttaccagacttgtgaccttaggcaaatggcttaatttctcttcctcacttttcattttgcaatgagaacatgaatattaaccatttacataattataaccaaagttatgaggctaaagtatgagaagagtgacagggacagacaagtattcaaataagaagttgtttgctaaggtctatttaatgtattatagtatgagcaagaaaagttttcagatttgtgcacattaattataatattaaagctgacagggttgagaatatttgctaatttaaaaattataaagttgttcatcagaatgatgtaaatatactctagaagaccctgaaattgtatatgttttcaagttttgaataaacaacataactgaaggaaaaaaatagtaaaaaatatataaataaaataaagaaagaaaattaccctctagtaattcaagtcccctttttcataagcggtgccagagtaaaataaaccaataaaacatgagagacttcactcaaatgtccagaatctttaccaaaaatagtcaacatgaaaagtctttatacctgcaatgttttccactgcttttctcagtattatttatagatctgagttatatattaaaagtggttattaaagctaagccaaaaagaaggaaggctgataaagttttaagcagttttgtttcaagatcaaactggacagatctgcaaagaaaatcacaactatttgcgaattttagtgaaacaaatggaacttttacagcaaattcaatgtttacccttaaagataactgaacttaatgactcaaaactttaattatgaggtagttacaaatgtatgtggttccattttgataaagacctgggagaggatccaaggagcaaagttatttgcaaaaaaagttaggcaagatttgatggagtgtacttgttgaatacgaatgactgaaaagtattttttaatctacttccttgtgatgataataaggttctgtttaacattagatctgtcagtgagcagataaaggaaagaatctaaataagattcactttcaataagctcggagtagtctatggattaggatttatacctccattctactgaatatgtggatcagttctaagagagaaaatattatgaaaataagacatcaaaggttgatgccttaagggctaaagaaatacaggcaactcagaaaatgaatagcatttgaatttatactcggggaggaaaaaaaggacttcaaagaacagtcatatttattcactagattaaggcagacatttttccagtacaaagtctgtgacacaattcttcacccctgtccaatcccagcctccattttcaaatatcttggccatgcagcagtttcttttcaaacgaaatgaaacaaaacaaaactttattattttattgaaattctagtcacttccttcacaaactcccaataactcagtgtatttattcctctataaagtaagtgcagatcagaagaatgagttatacaccaggttggccgtcttcgctgggaagatggttaggtcagcttgaagtgaagtcagtagttgtggtttactctatgtctatgtctggcactgcgcagtgagcctctgttcttaaaggaatcttattttaatcttcttgggaaggcaagacattcatacttgaaacaactattaaatgatgcaaaacaacttacaattaaatgtaaattacacggtggagacatcaaatgctacaggaattaaaagaaatgaagaaaagatgtttcagctgttgtgtgggattacagcaatatgttgtaactgggtgggagactattaagagactcctgatagggaatgtgcatccagtacatcttcttcttgaccacattcagagtcccgcatagagatttctggaagagcgtgggagctgcttcagaacaaagccaatgtcttgagaaggaccatggatctacggtgatgtttgaagagcaagattaaaatgtatactgtatccctatgaccatttgctcctacaaatcacaggttattaattgattataactagtaacacacataacagtctacttctaaaggacttttaccaaacattactattaataacttttgctgaaggatgttcattaattcacacagtaactactcataggtcagctctccaccaaggaggcacagagaggtgctcataatcatgaaactttcaaattgtattaaagtcgggaccccccaggaatacccatctgacttacacttatatctaatcaaggtcagccactttgaaatctccatggtctctaaccttttaggatcttttctttcaaaatttaatgagcagctcaaatccatatcttttatttatcatagaacccaaacatccgggcttcaataatgcttctgcatttttgaaaaaaaaaaaatatcgagtcaaggagcatttattccagtgtgagtcttctgccaactgctaccctactgacccacccctcatttacaagggccccttctttactcttagctcctcacagtatattacaattgcttccccaaggcaggaactgcaccttttattgccataatattataccaaatgtcatctctgtgcataacacgttatgtatgcaacatgtttgttgaaatagccgaattgtttcactagttatctgatagtttaactactcaggccaatggtcaagtcactcttgtctgggccctagcaactctctgcatgatgcatattggaccttgaagtcctttcaagatgaactacacagactggtgacatattcaaaaatggtgtgtatttgattttattctattttttttctttttgagacatggtctgtgtcgtccaggctgaagtgcagtggtacaaacacagttcgctgcagccttgacctcctgggctcaagtgatcctcctgcctcagccccccaagtagctgggactacagacatgagccaccacacctggctaattttttgttgttgtattttttgtagagatggggtttcaccacgttgctcaggctggtctcaaactcctgagctcaagtgatccacctgcctcagcctcccaaagtgctgagattacaggcatgagacactgctcttggctgatttaattattgttaaactgatttcaactcatattatctggctcaaagtcattcaactcgacatgtggaaatattatgttttgaatcattatgtgctaatacctttagttattgtcttctttttaaaatgagaaaataaaatatgatttacacatatataggaaagaagagtaagttaactttttaaaaagtcaacttttgttactatgaacttgctggtttacatgtattatgcattccatcctcccaacaaccctagaaggtaggggcatctgggaaatgaaaggctgaaagtaaataatatgagattatatagccaagaatggtaaagccaggattcaactcaggccatttttccagagtcttagtgtataactgccaatccctacttcattcataatttcatttaataaatgtccatcaaatgactactataattgggcacttattctagggatacatcaatgactacacatcctggcccacatggagcttacattctattgaagggagacagacaataagcaatatcttaatatacattatacagcatgaaaaaaagtgacaagtgctatgaaattcattgatgtggaaagagagggtaagaatggcgctagtggagaggaatgcatttgcaatggtaaataggatgttcagggaaggccttgttggaaaagtaagtacatctaagcaatgatctgagttatactttaacacatttatttgatgagaaaccagtaaaagttgagaatacaatagagcaaaaaactgcaggaaaatactgaagctcttggtttttataaggtatttattccagtctcatactttagtcaaacttgcacatgttttgtcacttgtattatttttttaagttccttgaccggaataactgtgcttcacacagctttaaatccttccatagtgcttagaagagtggctgtcacaacagaaagtatctgttgaaggaatgaaggactaatggaaagagatacacatatgagaagtaaaaaacagaaaaaagaccacatcaatagttacaatcactggtaagaaaaccccaaaatagatctagtctagaaaataaattcaaggaagagtactttctgatcatggtaatgaaactgagagaagatatttgggaatagaaagagagtagttttgctaatcttgaggatgagaaagttgaataagaaagccttcctgatggggagtaatttggggtgaatctaaattaaaggccacactgagcagactgaataaagttattcatccattgaatcagcatttactgtgagccacctaagtactaggcactagaggaaaattcattaatagatagtccctgaatttatgtgcttatattctacaagagacagctattaaataaaaaagttacataatcaattaattataattgtgttaaatgctataaaagaggcacatagagggccaaaggggcttaatctttctgggggtaccaggaaggagaacctgagacctgaagggcaagtgtgtgggggtgggagtggaataacaggaactttctatgttctatgtactacaggtattcaatgaatatctatcaagaattgttatgttcctgcactacatacaccaacacttaccatctcatttactcttcaaagcaaaccaatgaacaaagtttcactatgctcatttaacagaagagaaaattgaggctcagagagataaaatatcttgaccaaggtcacacaggttgtgagccaagattccagtccaaacctgttcaggattttcccatatcagtcaagtgtcaggcaacctgttaccaagatctctgctattctgatgagttgttattatgtacttgctaagaaacaacagcctaggtaggggctcagagttgattcaggtcagggcaggttgatatcagctagaataaccaatgaaaagccctgttgaattgtcccaatggatctagcccttggtcctacttgatgtaacaaactttcctgcctttatttactgattttatgcagtggacaaatactgaagctctatagacatcagtttcagcattgtgaacatgaaaatgaattatacatgctcctctctcaagcagtttagtctagtgaagattcagacccataaaataaatggagtttaatatggcaaatgttacaaaaatattacaaaaacagtatagaaagcattcatcccactataagaggctcctaattttgcctgaagtcttctaaaagaaactggactttggcttggaggttaaatggagccacaggatattaagcagagggatggagaaaagcattctctttagggacaagataaagtctgccatgtttttcaaacagcaaaatgttggttggctgagatgtatctgagtgtgttgaaggcgagggaaatggccctgttcccacttaagcagatcacatagtaatcatcttgaccccggactttctacattgcatggatatttgagaagttgactatgttgtggtttactttctggcatgagcgctttaaaactattacccaacatgaagggtcaagcagaaggaaagagatctgaagcaccaccacatacacccacattcaatcctattacagcaaactttacctgtaaactgacttgtttaaaaacattagaacactaaatgtaaaaagaatgacagcccacacatagtgcttagagatattttttctatttatttatttatttgaggttgaaagatagcaagaacatgaagaaatggaatttgcgtgacagtcccaaagcaaatctattcaaaagaaaaccataattacatatgcagctctcttgacagggatgacagcagtgaatcaacattctgcgctgaagacctaagtcaatatgcatttgattcaaaaaactaccttcattagcacagactatcattagtgatcacagatctatataaggctgaaaaacctaatctctgtgtctctgaaaactgcaaaaccaccttagcagttgcctaatttccctgagagtggaggtttcacttggccattgggctcaagaggccttaaagtgggcaattagcttgctggattatgcagtgtactttgtacctcttcattacattttccaccaggcttgagtcgaacagaagagcttacaatgtcaatgactttgaccatttgagattttgaagcagaatttcttaaccttttcatttctactgtttctcaattgatctacagctggggaaatgtaattctctcataattctgttaaaaaattatattaatagttccatggaacacacagaagcaggtatgttaaattatcaaattgaatttgagaggggagaaataagaatcagaaattatgtaaattaacaatttaacatactcaatgtggcaataaattatagcttcatagctggtggttataagtacgtcaacaattaaaagaaaaataataaaataaaaagagttagctctctggccacatcttccaaaattatataaaatagaatcatgacttattggatccccaaatcatttttaaattatagaatcagcttttcctgtgggggtcttctattaaaaagatggtattaagactgcaggaaattaagaatgcaggctttggagctagaaatgtctggttcaaacacaagcagacctgagtgtccaagaagtggtagctatatataattatgatggtggtggaggtaatggtgactgcagtgacctaaacaaaaaagaggaagatagaaatgatgatttggtgatcaaagatcaatggaacctttgtttatggacactgacttttgtcatttttctgataagtacttaagaaccaataatataaaatagggactattttacacctctttttcaacctgtagcaaaaaggtatttattttttcaaaatcttatcaaggtcagattgatgccaattaagtatcagtatatccctcatttcagtcaccatctactagttagatccaatttagatagtctacctcctaagagaatcttaatagcttcatttgcacaggaatgatagactattgatcagacagcctcaggcaggatccctttagtttgagtagatatatttaatctaatagtgcattgaaaatctaatagctggtctcctgggatccctggtcacaaattttaataccctgcacaatgaaattgcataaccattactgaactctatcctgttgccaactaggaatatctagaaaaccaataaaaggaagaacaaaacattcagaactgcagggctgtgtgattacagtctctattgtttctggtttaaagtgaaatcaattaattgcaaacacaattaaagtaactttgcagtagttggctaaatagaaaaacattttgtggtattattattttaccaacaacccaactttggcctatcatacctatgacacttttattttccttctataaatcatgccacaaaggttaaaaaattaaataacgacataggccttttattacaatcaaaatgggtaagaatgtgactttgcagagattaaataaaacagctatctcttcatgattcacatttattgaataccaaaaataatatgggagaaaaaaatcacgtagatttcacacctaataaatgaacaaagaaggagaataagtgtatagatatcttatataaatgtataggcatatttacttatctatttacatgtatttacatgctagatttccccaccaatgccatggacagaacctcaatccccttattacttccaaaatttacactgcctatccccaaacctcaccttctttggtcttatttatcaattaccaatatcaactcagtaaatgactggtccccttctccagttgcattcagatcacatgccaatcatatccactaaacatttatgaaattagcattctcctctcaatcccgtagaatcacaaagctagctcaagcctatgtgatgttttgcccaagccacagcaggagccaccttttacattcccagccttcaatcttgccacttacatatttattctccattcagcccctagaatctgatcttgtcacataattgcttggaatgcttcatggtttgaggatgaacccaaagtccttaacctggctcacaaggtccccagaacctaaaccttatttatctccaggctcatgtcttgtcactgaactactaaatcatcccttcatcacaaataccatgggattccttgcatcagtgtctctgttcctgctattcctctctccctgaaatgctcttcctattcctctctccaccctacattcattctttaagactcagtttaggtcacacttttcaccccagaaaaggttaggttctgctttttgccactcccataaaatcttctgcatagtgctaatcacggcactcactacacattttccctgataatctacgtaaatatttgcttcccctgctccaatttgaactactttaatctaaattccctgagaaaaggttattatttgtattatttatgttagtgtcttcagtatacctagaacatagtactgtagatacccatacaggttttgttaaatgagtgaatgagtgagtgagtgaatgaatgcttttctctagaacaattaatactgaaaagcaaatgtaagcacaatggagaaaatgccattccttagaattcaagaatgagtgtgagggataagcccaaggagtttcacaattatggaaagtcacactcagacagtgagaatagaagtgctggttgtggaaggtgaagactccaagaggagcaacacagaggtgaggagatggtaccagcaagacaagaaggctgtgtggtgcatagttgatgtgaatcttcttcacaacttctcaaagctttagtacagttcacacatgctatgtgttcttggatcccttgtgaaaaacagctcaattcctctacagctttgcatccagacctgaggcccagcagaaggtaaaaacatataagatggacacagagttctggaggcagagagtggcataaaggtgtcaggtgtggcactaacatagaggtcatggcaaaagttaatcacatttccaagggccaagaaagcactggtcaatagaaatatgacagaaaagaatgaagagggaagctaggtgaaagaggttttcatacatcaacagcaacatcacctggaaacaatttttgattagttaggcacttactaattattccctgcttttctttttttgagatgaagtctcactctgtcgcccaggctggagtgcaatggcacaatctgggctcactgcaagctccccctcccaggttcacgtcattctcctgcctcagcctctcaagcagctgggactacaggtgcccaccaccacacccggctaattttttgtattttttagtagagacggggtttcacaccatattagccaggatggtctcgatctcctgaccttgtgatctgcctgcctcggcctcccaaagtgctgggattacaggtgtgagccactgcgcctggccaattattccctacttttaaaataaattataatcgtgctgagagaataaaaaaattaaaggaaagagttcagtgagccgtgatcatgcaactgcactccagcctgctcaacagacaacaaacaaacaaagttatcattcaaaatgtttcccatggccagatgcagtagctcctacctctaatacctgtaatgcccgcactttgggaggccaaggcaggaagatggcttgagtccaggaatttgtgaccagcctgggcaacatggcgaaacctcatctctacaaaaaatacaaaaattagctgggtgttgtggcacatgcctgtaattccagctacttgagaggctgaggtgggaggatcacctgagccaggagaggtcaaggttgcagtgagccatgatggtgccactgcactccagcctgggcaacagagtgagaccctgtctcaaaaaaaaaaaaaaaaaaaaaaattagaccaaaaaacaaaaacccaaaaagccaaaatgcatccaagtatcataagtgaaaaagtgagcttcttagcagccaatatgcaaagggaacataatctcttacacagtttggaattactcagaaaacgtggaactgtcttcaatcctaaagcgtcacatagaaatgttccctgagtctcactgggacaacacactgagcaatagctttaccagaatgttttgtgaatatggtatgatatcaagagtaataaagttattttggaaaaaaataactttagaataatcacttaaaagtctgctgtttttgaccataattgcacatggatatattgccttatataaactacaaagaattgtctatttcacatcacattttacaacttacattgcaaacctcacttcagccttgaggtacaactatcaataaaagaaacaggtcttatttttaaaactttttattattcatatccttggtgactttcagacaataattaacatgtggttagtatcaccttaatggaggaagtaccttatacttcaaacaacccttaccaaaagaacagataatacatatgtattgatacagcattacaaattgatgataattcaaaaaggcaccatgtagcttgtacttgagaaggaattttccctttgcatattgaagggggttctggtggtgttttctttgtccccagccgacttcacaatgaaatgtttctactttgcaccctttgggttcagttgttcaaccagttacaattagttagattagtaactggttgaacaactgtaatcaaagagcacagattgacttgttgtggtctactagagagagatttgctagtggtgttcagcagggctctgtctgtcctcttcaatgtgtgcatgaatgacttgaagcaacatacatacattcaagaaaaattcattaaacattgaatcatcatctaatatttgcctgctattatgacaggtcctgagggaaccaagaaaatgtcagttacatggctctgatgcaaagctgggaagaaggagaaggagtcagaggtagaggcagagagagtaaaagaaagagggagaaagtgagaaagtgagacagagaaagagagggaggccatgttacacaacaggaaatgtaacacatgacctccagctcgaaaaatttgaataaaaagatatttcaaggagtgcgagggaggtaacccttacaattattagaatgaacatttactcattgtcaacactatggagcacatatttgggaattcacctttatttatgccacacaatattatgtaggtgacaagctaacccgtcgtatttaacaatataaacaaaaacacaaatatcctactttattaaactgaaagcagaggactctcatctccccaaagcccaggccattccctgatattagtaaggatactaggtgaaactccttctttcaacatttattgtaattagtgaaaacatgcttaatgggacaccatcatctacaatgatgacaccatatctcaaatcactaatctttctgccatggacagatttctgtatcaggggacacctttgtcattttgtcatccaaattttgaggattctttttcaattctccagcattgactgagaatttaaatggtgccagcattgtgctggaaactggataaaaactgagataacacacttgagttcctactctcagagaatccacttattggattgctttgctataattcctgaatccagtgagattaactggtattttctgttgttcaaaaaactacttttcccctttttgtacagatcagcaataaacatttacatcgagattgtgtggtgtccatgaacaaggcattcagtagggtccaagtctagacttgaatggcgtctctcacatttttgactaagagacaatgtagacataaaagtatcataatccaacttacatacaaaatggaaaaaatggaaccagaacaccttaaaatgtttcctttgaaatatgtgtgtgtttccatcaggtttattttagttctctaaaactctgtaatactgaatactccaactaccaatattagtcaaagctgtttaaaaccagccttcccttatttacaaaaggcagattttacaagacaactatcagggataaacacaaaaagaaatgaaaactgttccatgtctagcaattcgccagagtaaactggctgtatattgaacacagctgtttctgtgagggatttttctttttttggaatttaatattgactgtgctcttgtggcaagaatatagtaaatgaaagattgttccaggcctgagaagaagagaggccagaaacaattgttcccctaggtcctccccttccttaataaccaaactgttgtctggagcctccttgagttaaaagcctaccatttttcatgtcaattacacacaaacaggacttttcttgtcaccttccctaaactgaggaagacacaaacccagcaggaaggcaattgtaaagataaatttaaaagtaagaaggcaagcctgaaatgcaaacataggaaagagcctcttattccctacacttctcacttttcatggaccattgaaggctgtttcttaccaaattgaattctttgaaaagagaaaccatgacaattttccccaggctacggtaaatatattttcttgcacatttagtttttgtttcataacaatcctaataaaattagatgcttttagcaccttacttaaattaagaagacctttcctgctaatgtgcccagaacctatctgggttactaatattaatagttccattttatcatgtacttaactttgtgccaggaattgtacacagcaccctatacatgttatggtatttattcttcccaatagtttgagggaatcatgcttgacatagtaatccattgatcacttcttactttgatctctacttatcctcttgtaggatcaactatgcaaagtggtggattatagcacaatgttaaagggcagtgctctggagttagatggtctgtatttgaatcctagctgcaggaagttggggaaagtacaaaatgaagatagtagtgctaccaatctcaaaatataaattctggagattaaattaggtttaatatgattgtttggtccatctctagactagtaccttgaccactagtactctttcagagatttttttatgttttcaagaatgacaaaaacgaaattctatacacaccctgatatccccaaagacactagtgccctggggattggccatgtgggttactaggttccatttatttggttatggaggatgttcttcacccaagttaatcctttcacaaaagctcatttttgttctttttcctgcagcttccctcagaagaagctgtggccagtgaggatttcagggtcgcttgtccccaggtgatatgggagtttcagctcaggaagtgactaggttagatgtgggggcaaatcaagaccttttcagccactagcttaaggctaacccaccacagacctaccttcttgaacaacactgggaatttgggtaattaaatgctaggatatcagacatgatgtgattaaatcgaagggctgaaacaaatctgacattctgtgctcaaattataaggttagcaaataagaaaactagaaatatctctcttctaggcaagaatgagaacataagtctacccaaatgtgctctacagaggtttcaggtttagcatcttgcttaaggatgatgcttcatggtttagagagaaatgaattctagaatgtatcctttgcttataggacataacccatatttatagagatattttcaatatggtggagctagtggtagggtagaaagaacataaaattgactataaggaaatataaatccttttccgagctccttctccttatgcacacatatatacatatttgataaaataatggccctgaaaaaatattagagtggttttcttaaaacctaaagaaaatggtatccacatcagtgatgctcaattgctttttattatggacaatgaaaccaaattagattaatcataaggcaaaatttcaaatgaaaccagtaatacagacatagtgtctgtaaggttttatagcagaacatcagcaagatagcagaaacttaatgcatgaagtaacctctcaaccttgttaaagaatttcttttatatttcttgataaaatagtttttgttacagttagtaacattattttaaaaactgtacgtcttcttagctgtacacagaagtgagacatcactaaccagagatttcaatataaatatcttcaagtaaaaatgacatagtacatgttcagagatagcaaatggaaaaacagtggattgatttttataactcttcgtgaataaattctttaatgcaacaaacatttattgaattactgtttttcttggcactgaggggaataaaaaatgagaaaatacagtctctgcctttatggagctctcagtcttgtggaaactcatccacaagatggtcacatgcatatgttggtctagtcccaggccttaacaaactatggccctcaggccacatctagcccatagcctgtttttgaaataagattttttttaggtttttattttttttgtttttggttctggggtacatgcacgggatgcacaggtttgttacataggtagatgtgtgccacagtggttgctgaacctatcaacccatcacctaggtattaagaccagcatgcattagctacttttcctaatactttccctcactaaaccccactccctgacaggccccagtgtgtgttgttcccctccctgtgtccatgtgatctcattgttcagctcccatttataagtgagaacattcatccacgtccctgcaaaggacattatctcattcctttttatggctgcatggtatcccatggtgtgtatgtaccacattttcttcaaccagtctatcattgatgggcatttgggttgattccatgccttgctattgtgaatagtgctgtaatgaacatacctgtgtatgtatctttgtaacagaatgatttatattcctttgagtatatactcagtaatgtgattgttgggtcaaatcctatttctggttctagatctttgaggaatcgccatacagtcttccataatggttgaactaatttacattcccaccagcagtgtaaaagcgttcctacttctccacaacctcaccagcatctgttgtttcttgactatttaataatggccattctgactggtgtgagatggtatctcattgtggttttgatttgcatttctcaaatgatcagtgatgttgagcttttttttcatgtttgttggctgcatgaatgtcttcttttgagaagtgtctgttcatgtcctctcaaacaaaccccacagctagtagaagacaagatccagaacagaactgaaggagatagacatgaaaagccctttgaaaaatcaaggaatacaggagctgattttttgaaaaaattaatagatagactactagctagactaataaggaagaaagagagaagaatcaaacagacataataaaaaatgatcttccatgtaagacgcttatcacaatgtctaagggacagaaagctgggagtctatggagcttatgagaataggctttatgatagttgtggctccttggtaacaaaagcttgccagtcaacaaaattcagtccaaaatctgctttcattactacattagacatgatggcttagttgtgggagaggacacctatgtaccttatcctctttcaattaatgtagactatgatattcaccaaaaagactctgataaccatgaagggtcaaattagctatgtcaattcatgatgattaatttgaacataaattattaattttgataaagaggtattacctaagctttaattaatgaacgttccacttctacttaggacgtgaaagtcaccctgagtttatgtcaatagcattggctgaaaagtcttaatttctcatctggctttttttttttttttaatcgaggatatcccttcctccaacccaaatatattttcagcaacactcatgccaacccttatctgatgttgagaagctgtgaatttgatagcagaatcataacattttagacttaaaaagtgctttaaagatcatctacttcttctacccactcaactaatagttttatacttgaggaaacagagttgcatggaagtaaaggaactcgactaaaatgatcaagctagagactgaaccaggatcagagccctttcccctgcagccccgggaaaaagaattcatgttgaggaaataaggaaaagtgtttaatactttcagctaagcataaaattcctaagaactcttctctataaacagaaaatctaaactctccaaaagaatcgcacccccttagctgtaacaaagtctctgcagttatttcacagctgaaagccaactgacactgattcctgggtggtttcactaaaatagaattttctgaaatgcaaactcacctcccaaggaagaatatgaatttgaaagaggaaaggtgttagtggcgccaacaacttgctaccctgctgagaagcttccagatagccagaaacacagcagggagtagcaagaaacagaagttacagatgaagctgctctttagtcacaaacttgtttctgacagctcttgttgaaaaacctggggacagctgaacagaaacgttagtccagaggcagcctcagggctcaagtgctcaaggatctcatctcagtgtaaatattccaacttcctctcatccttctcctactgaggggaggaggagaccaaagggagtagacgatttgaaggcagttgctaaatgagaatcgctgggtggtatgcagaaaatagcatggttagcttagatcctacaaccagttttcaaaaataaaggaagtaataaccattagcataatgagaatacaaatcccaagtctccattactttagacagaactctgcaggagaccacctaaggaaaatctgggggaaaagaagtttccaatcaattgcagcagatttaactgattcccttctgtgggcacagcatggtattgagagctttggggattattagggaaagagaggacatgctttctttccttgagagattctgattctgggtgagacatggtgactatgtgcatctgaatatgctacaaggatataaacaattatacaacgaaccagaactatgctggctcagtgcccagggaagtcggaagaattcaagtcaggaccttgagtcagggatgaaacaggaatggttttatgaagaagtcaatttttcagctgagttttatacatgaaaggccatctcgtttagccgaaagtacaggaagggcctgtacttagcatgagaggcaggaaagcaagaaagcctttgtataaaatatggtgaaagaatcaacaaaagcttctgaagcctacatttatatacagaacttattctttatccaaaatgtaatgtggggattcatgaagatggcagaactccagtattctgcacattaataatgcaatgagcatgtctatggcactctaatcccttaaaatttcatttgtaaaataattatccttgttctcataacagggaaaataaaatcctaggctacagtaacaaaatatattatttaacttaatgtcaatgttaaaaataaaatagtaagaaacagtctgatattatatttcacagttatcaggattgtgattgtaaatcctataaatgtcatatcctgattaaccttttaggagaaaaatactccattggtgtagttctaacactgtttttgagatgaagcaaaatttctcatcaatatttctattctgactgtttggatatttaaaagtcatataacctaatttcaattatgttataaagaatagggttaaccaatagctaccacctgaggagcactgactgaaccaggcatacggtaggaattttacatggttttatatgtgatactaacaatagcctaataaggtaccataactccatgtacattttacagggaaaggaagatgtggaaagttgaatgaatgtgcccttgttcacaatgcaggcactccaaaccacagcatattaaccaatttgacaatcacctcttagagggttctctattgtcttctctaataggacctgcagaggaaaagatacaaattccattctgctttacctctgcagtaagtatggaaatgtatctcacattgtttcttattcatgtcttttcaatctgcctatgtcttcagagaattcttatcactacattgggaaaattttctgcaagctgacatatcacacttccagggaatttttgttgatataagaccattattttgtcccaagagttctcataattgcccttagtataatcccttaagtctctttccactgcagtatttatcttcttttaaaaataatagttaaataaaaattaacaatgtaaattagctaaaaaaattaaaaaaaataatatatccattcatttatctagccaggctgtaaatactcctctgttgcataatctttcaattctttcatcatactttcttctgctctcttcactcccttcaaattgtctgcatattttttatccactaggattgagtttctgtggttgaggctctgcctaaaagctagttgggaatcacaatcaaaatggattgttcatcatttactacaacctaactataacttcctagtttttgtctaatacaagatctgctctttatgccttcatcatttccaatgccaaattattccagcgatttttaattggtagcatattattaatacactatgcatcttcttttgtatattatgatatattacttcttgttgacatctcaaccagaaaaaaatggttgaggaaaatgcttataaaggttatataatgttcagatcttattcattagcaactctcatgaaattttctttggtaaggaaagggaaacagcccaatgacatttgtgcttatttgtggattttacttatccattcactctttcattagctctcatatttgactacaatttcctttgccaattacattataaaaatcaagtacatttccttcaggccttttcaaagttttccccagtgagttttaatttgacttctgatgcatggacctgctttgacaatatttaaatagaatatttatacaaactgatgcttcttttctactcgttttagagtatataaactgatatcagaaggctaaaataacatcaaacaaagttatcctagagcagtccataagtaaagaattataatcttcagctccatctctctctaccatattcattacctttccatagtctcataatatttttctaaccttatggtctaaatgatctcgttctgtctgtctatccatttgtctgtctctttctctccctctgcaaatcagataactacattatacaaatataagaataaaggttaatattattcatatatatatatatatatatatatatatatatatatttaagttgttttattctaagttctttatgttactcattaaaaccccaccattgttaccagggatttataacagatttattagtccactgaatttacccaacattgctaccagggatttataacagagttattagtctactgaatctattctgccaaaaaatgtgctgatacagattctgcccaatgagcataaagctatttttaaaaatataataattataataatatatctataatgtatatacgctatagggttaatagggtaagtttaatttgcaaaacaccaaacacaaaattaatttcataattactgaaactagaaggcaaaggttctgagcaggggcccaagatttatgtttcaggcataataacattggtggacaaggttgtcacatttcagagatgtggttatcatatctcacatttaaagttacaattattataatgaaataaataaggttgacaactgtttaaagaatttttgagtgaatagtccagtataaatgttttactataacactggaatatttaaagttacttatctaagaatttaaatttcaactgctttggcatggatatcatcattctgaggttagaacttctgtgacataagcaactattttaggaatttgacagcattaaaacaaagttaaatagtactgttcaaactggatgcaagaactcacaggaaaaaaaacaataagtgaacatttgagaagataggcaactttgctagcaattaggaaaaaataattaaaacaatagtgacagacatacctcatctgacaggcaaaaattttaaaaatctgatttaaggaaaatgtatgcgctgcagtcaataggctgaggcagacatcaggtccagcatgactcagcaagtttggagtgcaggtgcacaattctgcacattatgtaactacaccacgtaaggcgcattaggtgatcacccacatgagcttgtaactggctcagagccactattgtctgtaaaaggtataactaccggactgacactgtacctatggtttgcacctacggctcacactcagacagtaaaggcacgttgaaactgtgcatgattcctctagtgtttttccagctacccaccactcacccactgactcccctcagacctcagttagaacctgacaattggcatcacgaacaggatcccaaggtgggcgagcctttggtccctgctgattctgggttggcaatgtggccacgacatgggttgtggtacctggtcacagctgtgctgcaagggtgaactctgttggaaacctggccagcagtagatgggtaccccacgagcacggagaaagcactgaagcagctggaagtgcagagcaccgagaaggaatgagcctttgacagcagagttggatgggcattttttctgtgctacaagaagtacactcccaatccctgagggatgcagtgcaggaaagggccttttgggcacaggcagggtgcctggaggcccagctacacagcttagaaaaagagttagaggctgccatgaatggggatctccaggtgcaggtggggtgcctgaaggcctggcatagggttggaaagggagttagaggctgttgtgaatgcaggcctgggtccgtcatctcagccagagacccctgcttggtctgggtctgcactgtaaaaaaggggaagatgccccacctgcagagcctccccatcatggaagaaaagggggccccaacaagtgacccactcacagatgtggatagatttgactttggccagggttgactgagagaaaatcgataagcagcccaatgaagtactcttaactttgtggagataactgtctcaagagcagcaattccaggaaatgcagaaggggaaggaggacattgctgtatgacctggtcccactcaggtgcttcaactcaaagactacttgctgcagccaggtggaaatgttgagctttttctgtttgattagggaactggctgaggtgcctggcctggggggacaccagacaaatagaggccacatgtgaaattagcaatccactggtcctccaccaacatacagcaagtgctggcactggtaaacaccagcgctgatatattctgggggtggatgttttacatggcctgacagccatcccatctattacagatttgatggaccgcttgatgatggaatttggacagtgccactatgtggtggacttgattaatgcattttcaattaacattgctctagagagccaggaacagttcgccttcacgggaaggtgacagtggactttcatagtgttgctgcagggatatatgcatagccccatcatatgtcatggtcttattgataatattatgttaacctctgattctcttgcagatttagaagcggcaatgctcctcttgcctagaattaagatagtgtggctgagactgacttcctggcagctaaataggctattcagcaggcacaagccctatgggtagttgaccaagggtgctcatttgagttggatgtgcatgtgaccacagatggttttggctggggcctgtggcagagcatggagtgcttgagaacaccagtaggcttttggtcccaactatggaaagaagctgagctccagtattcactgatagagaagcagttagtaactgcatatgctgcccttcgggctcatgagagcatggcaggacaggctacagttgtcgtgtagacgagttacctgatagcaggatggatgtgttcattgataacaaccccccggactgggacagtgcagacatccactttagcaaagtggggcacctacttgaagcaacagagtacgctgagtacaagtcccttagcagcagagttgcaagaggtcttgagaccagcagtcctaatgcaagataaggccatggggcctaaggacatggggcctgaagcacccctacatgctgagccttcaccatttaaggaagggcatccccccctatgcccgatggggcacggtacacagatgggtctagctggggtgctgctactgcctggactgctcacagtccagcctagtactgactccatatggtttcataccgggtatggacaaagtagtcaatgggctgaagtcagagcaatatgaatggtgatcaccaaagaggtgacacatatgataatctgcaccaatagctgtgtggtctatcgaggcttaaccttgtggttaggcacctggaaaatacagaagtggctagttggccactggcccatgtggggctaggccatgtggcaagacctatgggaggaaggatgacctcctatgaccaggatggaaacggatggtaacctgttgttgcatgccccaatgcccctaaaggtagggaaataaaaacctggcttaatgcataaagtaaattcgggtaacatcatcatggggtgtttgcccgtcataacctggagttgttgctccttgtattactgctgtggcctctgggtctggggttccaccctgtgggcatgtttctccatttaaaagactccttcagcctagggagtagaatttaaggcctatgtgtcagacctgtgtgtccagggcctttgtccccagagtgtacgtataaggcctgtgtcttagacctgtgtgtccaaggcctgtgtctcctttggcattgagggtggagtgtaaggaaaatggatgtgctgctctcaaaaataggccgaagcagacatccggtccagcatgactcagtgagtttggagcacaggctcacaactctgcacattatgtaaccacgccacgtgaggcacattaggtgatcacccatgtaagcttgtgcttggcttggagccactattgtctgtaaaaggtacaactacgctgctgacgctgtacatacatcttgcgctcatggctcatggccagagagagagtaaatccatgttgaaactgtctacagttcctcacgtgtttttccagctacccgccacttgcccaccaactccccttggacctcagttagaacctgacatctgacaaaatcaaatgttacaacaatgtgataaacaggtaaccctcatacaccgattgccagacagtaaactagtatagccattgtggagaggaattgagcatcgtatagggaagttggtaatcctcttactttaagatccagcaattcaacctctggtcacggacctcaaagaaactctccaaatgagaacaagcaaacatgacaagaatattcacagtagtactcattcattcatttatttattcatttcacaaatatccattgagttcactgctgtatttgcttgggatatctctgggactgaaacaattctccgtcttcattggtatgttccaggacactgcttttgggtactgaaaagtttaaaatcaccttaaccaccaatgaggcaacaaagtagtgtgtaatcatataatgaagccatgtaactcaaactgtgtgcctactaagcacacaccagaaactccaggaaatcacgacagctgtacactctaattttggacttgtttttgcatcagttttctgaaagattgtcatggatgcaagcatgttattattagtcattgataaaagagcacagaaagaggatgtgaggagagcccttttttccttagggataaaaccctttcatcttggctttcatgaaacccattaccaggcaaaactgatgcgaattcctgactagaagaaaatgttctcctgcctttattctctctcagatgactcccattaattgatcccaggagattttctcattttgctgccttccctgcatccagccttcatttaccatgaccatcaggcatctgcagggccttgacctggaaaagctgccaccattcctagtagaggatgaacataaattctcactctcagaaatgcaaatatttcccttgctgtggggatgcataacttcagagaaaagctaagcatatggagcaccccatgtaaattaccatctcatacaacaactcactgtaaccttatctttatttcttataaatactgtttgtaaagaatataaaaaattgaattccacatgcaagataaaggcacagccacaatttcagaatgacatctaatatttctgaagtaataaaataaatgtaaccctgtggaaaaataaaacatttaaataaaatagttacaaatgcaataggaaactaagaaaaattattaggatagatccaatgttacattaaactgaggacagctcttcactgtgctggcttcattacgatatttaagaaatctgacagttgcaataattagaaacatttaagtttccattccagctagcacagacaagcccttgacaaaacaataatagtggcaagagccaacaatagagcacttactgtaaaacagcagacattgtcctaaacactatacatatatgtactcattcagtcctccaacaaccctacttttataatccccattttgcagatgagggaattgaggcaaattgtcagttacctttgctaaatcagcacgtctcaacttcagtgtacataaaaatcttctgaatatgctgtaaaattgcaaatgctctagccattcccataacccactctgattcagtactgttggtttggtatagactgcccacaatctagtgttacaatctccattttcgagaggtctgaggattgggcttggaaaacactgctccaattacactattcccagtgatattcccatttatcttcaatgcctctctgatgtttgggtcattgtttccatgtttctgaagattccattttgtttcatttcagagtaagaatacttatttcgatccaatgaatttgattacctattctatgtccatctaaagtttaatcaaaacaaactatactgatatgtttacaccttaattatgtcagcttgaaccaaagacataagactgttgaagaaaactcatttctcttttcacaaggaacctctagtaagctggtgaacaccttccttaatttttaaaacactctaaataggaaaatctctggaatctctcctaaacagacatttgcttaagtaaggattacaactcttgaaggcatacatgaaaaattcagaagtttctgaagaatgcttggccatatcatcattcaaacgcacataaagtaattttatcagcacaattttctttcttcagggccctcataaaaggaagattctttgactcctttgcagagctataaaccaagagtaacatccatactgtaagaacagaggctgttagaaagatctcgagattgtgctcaactaaaaaaaattcattttcttattttcacagtgatgaagaatgattttatacaatgaaagaaacaagtcattgttttcttcatccatggcaatattctccctgtctttcaagaaagattgaaaatgtctttcagattgtagtaatttgaaaagttgtaaaagattgtaaaatagaggcatatttatcagatttgggggaataaattttttttgaaaaagttctcagatccttttgaaaggagtttaaattgaagtacaataaaggtacctgctctcttctgttacaactaaagccagccactcttagaattaaaaaaaaaaaaagcctcttgtttctggtttcatataaggagacataagtggcttcaatgctgaacaggaggtaacactaaaggggtgaacttttgagtcaggccatgtaccaaaatgaatttctaccccaaaacaatgggactattctaaacatgagccattggtatgctggtaaatatttatcagttggctctccaggagaaaaaaaaaggcctgatttgtgcagtatgtccatttccatggtgtaactactatcagcatgtcttatttcaagctaccaatgtgatggccctgaatgtggagttgggaagagatttgtagctgcacctcattatatagtatttccacgacacagatacgatggactacataacctcaagagcatggataatagtaaaatataatgaagtacttgggaactaatgagttttgagtattgattacctttgcatttcatataatttatttaattacgggtttatataatttaataatgcctgtgctttccaaccaggtctcaaaatcattgaatacgtaacagttagtactcctgagctggtactactacctggctccaggctaccattgcatgtatctcaccttaagcaaaccttccacaatactgatccacttttatacacatgcattaatgaatgaaattacaatattatttaagtagaagttttatcccatgaatacaagctaaggctttattaatacaactcaatatctacatattttatagcataacactatacatttcagtgttaagagatattttagagatcatctgatccaacccttcctaagactagccatgacaactattggggatgccatctttattcattctcctattccaaaattccaaaattaccactttatgcaaaaagccacattcaattcaaactctgctatttctcaagaacatccataatttcactcaactggtatttttcccataaaattctcccaaccagcatccaacataccaaatcagtggtattctcactatcttctgtaaatgctatgtttattctcccttctgaagctgtttcttccactctgtcacacattcattcatttgcattttcaaggtgtgtatgtttgtgtgtgttttaagagaatggtagactatttacacacttgttaaaatgctcactttttttaagagatgggatcttgctctgttgcccaggctggagtgcagtggcatgattgtggcccgctgcagccttaaaatgctgggttcaagcaatcctcccacctcagtctcctgagtagccaggtatgtgctatcatgccaggctaattatgtagagagagggtcttgctatgctgcccaggcctgtcttgaactcctggactcaagtgatcttcctgccttagcttcccaaagtgttggtattataggtatgagccaaagtgtctggccctaaaatgcccatttcaactacagaataagagtacctgagcaagagcatctagaaatctgctttgtaaacaaggacccctcaggtaagggtaagatttctaaagtttcaagatcaactgatttagtgagtggtaactaaatgctaaggtgagaataagagagcatgaaacacaagatcaagtggtttaatggatataaacctgtaaacagttacaactctgtgttttaagtacaacaacatagtggtgttcaagaccatcattaaagacaaggaacactgaccagtgaagggaaactccttcacaaaagaggggagggctaagccaagtgctgaagaaagttctcttttgctggttctcaggggtcaaggcccagagtggctgaaaatgaaattacatagagtctaaacaagggccttagtatgtttagacttctctaagatagaatttccattatttgcttgataagaatcacttgggttctatacaaatgtagatttccaagcactgtcctcttgtattagaggttctcatttagtaggatggagaagagctcagaaacccagcagttttaaccttaaagaaactgttataggagcaagggccacagagaagtcttactaaaatataggggagtaacactttcagatttatgttttaaactaatatttataagtcttgtctatttttctcagtttagatcgagtttagcacctagtgaatcttatctgattgttatagcccaaactgacctcttcattttatacatcattaaacttggagtttgaattatacttttacttatttcctgtgtattattatttctcttctattgtcaaccctgaggaatagaaagtttgtctctctgtattcttcgtaatgcctgatgcaggcataagaacacagacacaaagtaaaattggttctatgaattctcagtacgtagccctagtttttaggcatgttaatctggaatacaattttaaaagctaacatttaatgagtgcttatgtgctagggactactggaagtaatttacttatattatctcatttcattcaatcaacaatattgtgaggtagatgctagtattgtctccattttacatataggaaaattggggcttaatcattttccaaggtaggctgggtccagatcatatgccctttattaccaagctacactgcttctccctaccctgccccctaaaaatgctgtttaaacaatgaatagataaaagaaagcaacaatgagattataatcagtagcaataatttttgaaataattaggtcagagtcctgcataaaagatgctactataaactataaagcaatccaaattattctaaatattcccaggctgaaatctgcatctgccagctatgcatcattgactcctacctatgctcttgattaaaaatctcctctgtgtcttcacattcccaatgggagtcgcatatcaggagaggcgcatccatgggtgcagcaagagtgacaatacatcacagcctcgacatctgtgacaagcccagccttttgacagtctagtgagggggtgtgcatcttgaatattaccagatgtgtcacaatctttgttccccaaatacttactcccttttggataacaaaacagcagaagacactactcagaacaattaaaaaggtttgaatattcccataccctataattaatcttcattcaatcacaagcatttctgttcaatctattgcttgaaatgaaatgctaataaggcaagaaagcacaactttaggacaatgccaaaaatggccttcgtttctcgtcttttgacataaataagatgcttttgatcatattaatgagtgagaaatgtgcaagtctctaatacaagattcagttaaattacattcatccttggagatgaacaacctgaatttaaaaggacaatttaggctgaataaaaagtcaaagcacagtgcaactaaaagtttattctaacttaatttaaagtattctagaacctttgcaaatcttcattgtcacacattttcacccttttcctccagtagtttttttcccaacttctgccatttctttaattctttccatgttcctatgatagttatatttattctggatttcctatgtctttaaaaattgttttaggtgctggttattatctataagaaatctaaagtgagtagaatgatctgtctcaagacattaaatagaccttgttggggtttattaattatttcttatagagttacaaacagtttagagggcttataggtgaaacctatcataagaaacaatgttatatgttgaacatttaagctccttgtataccaggacattactaggaatttcacttgaatctaactgggctcagtatactcctatataccaaaagcctttattgttgaaggtgcatagtaggaattcagtatatatacatggaataaacgtgtttgccctttttctgttgttgaatgcttttggaaattcaaggaatgaatgtgaatgctttctgatttttttacaattgcttcattattatatagtcatggttcagccttctttataaactaataatcttactaaatgctttcaacactgatcaggatgtgactcacctctgtgtcaaatacagaaggtactgaagtcacatcaaaaccaaagcaattttcatccctcatattcaggtctagtggaatagaacaggaaaagagaatctgcatataccttcaatgttcttgggtgacagaataccttaaaaaaacaagtatacaaggcgtttcctaggacagtcaaatgatgaaatatgggcttcaatctcctgggtcctctagttttctcatgaccagtatgtgaatataggcaaattacctgaataactcaacatgttttcttacccatataagaaaaggagagtaaatacctcatagaatgtggtaaaactaaatgagacattacatgcaaagcatttaacacagagcctagaacagagtaaatgctcaagaaatacggactattgttatatttctgggatttggataatttttactaatgtggataaatacagatgaggcgatcctacaatgagaaaaacagaagttgtgatgtgtgagacttttcatttacatacaaacggatatggaaaatggattatggatgcaatgtccctgataggaatggcaagggcctatttgggcattatactttattcctgaatcatagaagaaatcctatcaccaaaatacccatatgggttttcacattaaaaaatatttaaacactttctttagagatgcattctgagacccacgtaaggagttgtccaaactaatattgaatgcatttgacatgacagctgggtttgaaaaagtgctttcagcaaaagcagaagccactggttaacttttctccttgtagttaattacattaaacaattttatcccaaaaagggaaagagagattaaaatccaggttatggagcattcattgaggttttcttttcttttctttttccttctctccttccctcaggtagcagaaaatcatgagcttaaaaagaagctgacctggcaatgtttcccagacttcttttattcttgacttggaaaaaggaaaaattgagggattgagggatggtgattttacttggtccttctaggacctatttgaagactcttctagagtcaggtgttggttgaggttcacagctaattaatcactggaaacctggagagaatagcctgaggtattacaataacctaggtatgaaggtttctacaccccaaatggccaaattgctggctacttctgggattatctggacacctgaatcctaaagaatatgaagtcccaggatcacttcctcaagatgtcaaattactctgatagagaaagataatttttatcttatttattttttcctttccaacctttattttaggtttagagggaacataagcagctttattacatgactaagttgcattttgtaggggtgtacagatcattttgtcacccaggtaatgggcatagcacatgataggtagttttttgagaaagatgattttcaagcaagactggaaacagaacaggtagcagttagaaaatacatgtttttgtttatttatacttaattatgcataaataaaagtgtaaattatgaagtcacgatgccagtaaatgcttttattggcttgtccacagatgtcctcccttctctaaccccctttctcccaaagtgggtgtgagtgcaccaccaggtggtgacataatgaaatgacacatagggcatataatgtcaggctgaggagaattttggaggttccaaggattgctggaaataactgcacaaacatggctctattactagagcttttgtgtacttgaggttttatttttgtttttgctgaagcccaatacaaatatataacaacattaaattgccatttatgactagaattttaaaacctaagtcaaacatactttcattgaacctggctctgcttttcatttattttgtcacacagggcaagttatgtaatatttttgaacctcacttcttcatccataaaattcaggataataatggctgccatgaaatagtttaattggaccttaagactgactatctctccaagattctttcctcttctccctccattccccaccatctccattgtctactttgttccttggctttacctttccttctggtttgcccgggggggataaatacccacttgtacatcacctcctcaggcagcgctgctcagcccatacctccgtgctcatgccaggactcatatagcctttagcctttgcattctccacactgtttagtgtcacttgtttccctgagttttgctcactgctgggcctgtagcactgggtccatatttctatgcatcttattaacctaggcattacacccaagatataaacacattgtagatattcagtgactttttgttgaatatttttaaagtataacaaaaagcctttgaaataccaagcaaaaaagagtacgtaaaagagcaagaggactttctgaaggagtatattcattgcccaaaaaaggagatctatcccttgagagagaactgtaaatctcttctactcagcttgcaaatacaactattaagatcaatggaatgcactgcatataaagttgatttatagccctggttctttgtaaatgttaatagtaaacctaatttgaaatgttatttaaaaagaagctaccatttcagtctaaagcatttactttaaatcattaaaaattactttgtgttccttctcattgggatctcttggacttaggaaacaatttgaaatcctaagggctttatttaattaaacaaactccataaacattaaagttagttgttttttttcatataaataacagataaggtccctaaaagattgattggaataaagaagacattgatttgaatcagtctctaaacaattatgtgactttggccaaattagtaaacttctgagtctcaatttccccatgaaatggttaagaccaccctaaggactgctatgagggttgaattattaatgcccacaccactgtgtctggcactgagaagggttagctctcttctttcatttcatccacacctactcttcaacatatacatttctctaaagtcaatgtgtttaattttttttaagttcaatgctaacaaatattaaatgcttcttttcccaacactataattttaacaaatgagtttcaggcatatttaaaaatgagtttcaggcattagatcatgtgaacataactaattatgtgaaacatttttgtccaacttctacataaatcatagcttcaaattatatggtcataagcctacaagatactcattgctatgcactgaattatgtccccttcaaaattcacttgtggaagccctaaccctttatgtaatagtattcggagatgggtcttttgggaggtgatgagatcatgagggtggggcctgcaatgatgggattggtgctcttataagaaaagacaccagagagcttgctctttctccaccatgtcagaaggcactgactgcaagccaggaagagggcccccaatagaacctaaacatgctggcaccctaatttcagaactttcagcctccagaattgtgagaaaattaatctgttgttgtgtaagttatccagattatagtattttgttgtagcagctggagctgactaaaaccctcatgtgccaacgtaatatcgttttagttataaatttaatattgatacaactttagctaaaggaataaaatctgtatgagaaacaatataacttttcaacagtatgaagatatagttcttcttattcataaacacacatatacacttgcatacatatatgtaaactatattttgaatatagaagatcaactatatagaagatcaactatatagccatctagtttaactcattgatcatttaattcaacagagttgagcgcctgctatgtgccaggcaatgcactaagcaccgatatacaaagataagggagatacattcttatcttaattgagcccacagcccaatagaggagaaagtcaaaacatacgatatataataaggtatgataaatgctccagattataactaacataatattaaaagttgttctcatactgtagaacggttcttccctaaaactgtatcaactccacctaaattaatccaacaatagcctcctgacatttttacttagagagactaatttagcaggcatctaaggcagaataaagtgtttacctcaacttttctatcaacaatgttagaagtggaaaatacaacataatttttgagtctcagctcctgtcaatttaaatgaaaatagacagttggttcagcatatgttgatttcttaaaatcagaaatagattttcccagcaatacgcctcagggaaaataaaatgtgtgggctggtttatccacgcattaaaagcaagcttccagctgatgtttgattacattcatgaagaaaaaaatattgtaatgagaacatccaattactctttccacaggagtaaaaatttctggtctgagaatttgtttcaaatcagtggttagaacataaacaaacaaataaaaaaggggaaataagtgagaatgagatcctcagaacagctactaaatttgagtaggcagagcatggtttctggagtccaaaagcctgtttaaagtcctgactctaatgtctactggtaaggtgctggtgggcaggtttcttaccctctgtgagcatgttcttttactcagcagtaacatggaaccaaataagacccattgatagagttgctcaaaagttcaagagaataatttgaattctctttctctcaatgcatgccatgtgtctgacctatgacaggctctcaatacttggtagacaataggaattattattattggaaggaagagaaataagaaggaacagcaacttgaaagactactattggcttcattgaaataggatctttgcattttgccttctttatctttgcatcttgtcttctttttactttctcttcacacacgtgacctaataataatagcatctgtagtaactgttgtgttatcatacagtagcacccagttttgtaggtcttattttacttaatttgtagtcagtaaacatattatccccatttgatagatgaggaaattgaggcttagacacgttaaatgtctttcccaggtcacacagtttggaagagatgacattaagacttgagctctgatctatcccgactctaaagttcatggtaatatgaacataatataaaagggaacatagtataatacaaaagaacataaaaataatacaacttatacaatgttaactttcaattcagccctccaatgtaatctgaaagatctttggtttgatttaaaaatcaagtcaaatctttgtatggcatttctcctgggaggctcaaacaagtaaacattctaccctgacgttgttctttccttttctctcctttcaagttattcaaatgctcagtaataagcagctttcaactgaatatggtggggcaaagccagctgctctttctccatgtggtagctcagatggacacctcactcttggtgttactgtgtagctgtactcccttaatagcctggccagctgtcttacataaacaattattcatgattttaaattattaataatttagaaggaaaacagatttcctgtgactatatggcacaatatagtacataaaattgggtttgaatatttgttttctgcacatcctctatagttataaaatgtaactaatgatttgtgtttaatttgtctctcaatccaattttggtagagcaagatttaaaataaatggctgtagatttcctaatttgatcagggactctcagttgttacaagtacatatgttatttcatataaatgtgaaaaaaatattttatgtttttatatgagatccacttcttatgcttataatattatggctcccagatgttattaatgtgaaagtgtttagagaatttcctctgaaaatgtcatcctatccctacacaacccaagattattgcaatagtttcacaaatgtcatggtttataaccttacatttatgaagaaactgttgacatcctatctttagagaatgagaaagaaagaggaatcattctgaacagaataattccaggaagcatcttggcctgacacataggcctgcctagactcggtagattttactaatatgtctttccaattcatttgttgactatatttagctttataaagttaaaggtgagagagcctcaatgtttaatatagcatctactccaatggttctgaaacactaaatcttctccttgagaaagtttgcaccagaccaacagaaagtttcgtatatttgtgattaagctacatttatcaaattagaagcacgattcattattctgacatgatctttaccatttttaaaatttataatagccatgattttatcaaaggataaatgcagagtataggatattttcaaaaatgagctcacctggcaaactaaaagtaggcagtgtaagtcgccacattccaaaaatcaatatttaaaattgcaaattccagaaacagatgaggtctgtagttttactagtggaaccactaatacagtgacttgagtatttttttttcacttagtatattttaactatcttcatactaagaaaatacctacgaaagtaagtctagaaaacccaatatcagcctgtcaatatttatattattcagagggatgtatatacatcttaatcttttgttgtattcctatataattctagctatatttaattctagttacaaattaattaaaaataccactcttaacttttctgggcatggggttgtaaccatgaaaccaacttcttatgccttctgaaaccaagtcaaaagtcagacaccttaaaaatgcagtcttttgtacacaaatgtacaaaatagccccagaatagaaacctaattgtgagtccttagataactaggactagaaatccttcatcgctacactcctggtgcttaggacaacagtgacaggtaaaggcactcaacagactatggaatgagcagattctaagagtcaatacttagggtgaaccttgctctatcacaatacttctcaatctaaatgatactgcagacctagtaatataatttgttccaagccggaaaacttcaggaatgtgcaagctggaatggggaagaaagaagtcaaatcctttatcactgagaagagaaaccaagggagaagcaggtatggagttccgatacgtgcaaagcttcgtagatactaaactggggacaaccaggttaaagtgaaataacattacagctatgtacaaaacatgtttctgcttccaaaccagggtaattaaaaaattagaatgcagttatttattttattagtattagctattagttgagatcaatttttaaactttaaaatgcagtcactttaattacaaacttttactttcagactcacatatgcacggaatagtggagagtagagacatttattatttaaactagctctgacaatgagattcatttaacaagctatttcagatcaaaacagaattggggactatcaatcagtttcctcattctcccctttcatttttggatcagctataaatagtcacaaaatgtgtccatttggcatcttctgtggcttccagggtttaatttcaacactccttgatatcacagaatcactttaaagaacagagaggttgcagatcaattattgtagtcatgtgccatatagactttgtgtgactaaccccagactatttgtctattttaataaaaggaggtcatgattgtgcagaaagtgaaaaactttttattaatctgaatttagcatatttatggtattatacccctaacataatagtatacaggtaatatcatctgatattttgtttgaaaacccttatgttatattgctttttatatctcaccaactaattgcttttctaatcccaccaaatttagtggtgtccacttaactataagactgtggctgacactgctgattgtatatacgatatccattctccctttcattcttatttatataagcctaatgttaatcacccaataatatgtctagttaaaaaaaacaagctcctcagcttccctggaaggtaggggcaagtatatgaaattgttcttgccaaagaacaggttgtcagagaggggcaaggtagctgggtttatataagctgaggattcctaagaaatccttgtttccctgatacagacaccatcccttcctacttcctttccatttctcttctttaccctggaatgaggagatagtgccgtgggagcagtatcgccaatggtcgtgagatgacaagcacaggacaggcccatatgctgaggatggctggcacagaagaaagaataaaaggaaatcacatatttgagggtatcatagaatcactgtactagccctagtttgctacctcctgatatccttttccacaagaccaacaaacccttagatgattcaaccattgttagttttctattgcttatagctgaatgcattttaaactgacaaaaaaagactttctaatgattttgcaataaagactttttagcacacctgccatacttttaaaacatggccattttgaaggagctggtgccagactacaatatttcaagcaaccgccttcttcctaagtttattacattgacacacattaatttaggttttgttggagttaatgtttccttcagtcatttctttgcttacaaaatactttttaaagtaaatatacacaaattatctaccttagaaaatgcaaaaaagcagatatttgtaagtcatctaagtcagctcttgcttcccttcctaaactattcattaatttggtgtaaagtgcattataactgaatgttgttcttgtatttcatggacaccagttgtcatgctaatgtgcacaaaaggttttttccagagtgaatgcatcaagtaaatcccaatcattgccactgcaaatgctgacagactaaacaaaattgctgacatcttccaaaatctgtctagatagatcactgctgcgcaaacatcattgcagttcctaatgaaaaagcaaataattcccatttgacatttatcttaatttcaaaataattattatttaatcatatctaaccatttcctatagttctcttgtaattcattgtacatagtgtgaatttcaataaaattcactttcctcttcctctgttttacctaaggattaaaaatgaagcaagctaacctgtccttctctgaaaacctgtacattaatctatgcttacaccttttgtaaaaagctatattttattattttattgttaaattgcactgtgaatttcaaatgtcaggagacattcacacacacacacacacacacacacacacacactcactcacgcacagagagaaaggaagagaaaacaaagagacagaatttcctccctaccaaaggggctttgttttgatcagcaagtttttttttggctcattgaactaaattcacaaattaacaaaactccactatgaagatctgatggaagaaggaatggaaaactcttgaccttttggatcccagtcccctgaccggcccttttcatcttcccttattaaatggaaatgatcagtatgagctttcagatttaggcaagacagctaaaagcaaaatcttgccttctgaaaaagatggtaaaggaaaaattggagctaattaaataatgaaatctgtttaaatgaacctatttatgccaatgaaataggcagaatcattcattatgtaaatatgacctttaaggacatatcacaagtaagttgtgaataataaccccatgaataattgagaattgatggtatttaatatttattaagtgactttcacatggatttgagttaagtaagtcaattccatgggcccagtgatggtatccatttaatgatttattcagcctctaaatatgatagtaatgttctgtatgacagtgagctagaaattgcacaatggagaattcaaaatgaataagacactgtccttgtttgcaaagttttcatgtggcaaatcccttaaggagaaaataacacttatttacaggatgaaaaggtcagctccacatagttgatcagcatttagagtttgaaataataattgggtgaggtcttgagggatggatttttattggtggtgatattaaaaagagagaatttcaagtatatggaaggtcaaaatccaagggcaatgaaagttcagaaaagtaatccttttgagctgggatacatgcaaaacgtgagataaaatcctggacagatataggataaaaccatgactttaaagggctcactgaagagtttagattattttgagaagtcagtcatggagacagaacaaatggatgagatgtagtataataagttccagtgtctcccataccccaataaggatgtacatgaattataatctaacaaaagagaaggaagcttggaaagtgttaggattctatttctttctgctttttctacttatgattacatggattagaatgttatctgctgtgctgaaacagagttgaaatgttactttaagtaatctggtaagtatgttattaaaatgactattttaccaagattcaaaaaattgaaatgtcaacatatgcctaatcatcaatgttgtttttgtgaatggtaatagcatccatattaccatcttttccttcctctttcttcccttcttcttcacagtctttaatttcttaattatttaacctttgtggatgagtattaagcatataagttagaaaataccaattttattactttttaaatgctgaaataattatttttaatgagagtattattgacaaccacttcttgttattactgaaagagtaaacttgagttttgaaccaatgggttaaggattaaatctgcattaatctaaatagggaattttaaggaattttttattccagagtctatggtatcataaacttctatttaatgaaatagattatcagaatcacctttcaatttcatggtctgatgtaaaaaaaattctccctgaaacagatacagggctataatcctcagattacacgcacacccaaacacacatacacaggtttgtatatatttgccacctccaacccaggtactggttttatttaaagcattcattttttttttcttaaactatgctcaaaccatggttgacagtttaagaaaagaaccaataggataaaatagtgtattctattcacagcaacagactgaaatagactcaatatctgatgttgaactttccaaatatatacagaaaattacatataagttataactcacacaactcttctatctccttattctatttgtcctaagaatttacaatagaatgaagttccttcaagtaagagacattacagtgctgcattgctgagacaagcctataaagaaaaggaagacggtttgattttgtctactgtggtctccttgtagccctggaatgtgaaaatgtacaaaataatctaatatctcataaacaaagtaaagtgggtttttttggccagatattttctagatagatatgagagaactgtcaagaagcaaaagatattaagataactccatgtattaaatcatttcgatttcattggatatgtcatggacttaaaaaaaattctcttttccttttgtaaagaaaagtcacagttaaaaaacacagaaagaaaagagtttggaaatgtgtgagggagagatgaaaaaagctctctacaactggttcagagattaacctgagtgagtccagtcacgtgcaaaggcttgcggaggtctagactgcaatgtctgtaattgaattttaaactggctttacatattcccagagagagcatataccatgatgtgctcatgaatgcaagccttaataggaattacatactttcacaagcactgtgcttataaaaccccttgaaccctattaatcctatattgaggttttatgtttcttctactcagaaaaatatcagatttatctattgcccataggatatttgttttaaagtgatacacttcagttgggcctgtctcctgaagaagttttgtataaaaattattcacttgaatgccaatggaatagttgagtacagaatcccattaatgtatcatagagtgatattgcagttatgaaacataaatcttaaagctgtgaatctctgcatataaacagattgggagtttagacttgagatgtatataaaggaatgattactaatgtcaaagaatgtaatttgaggaaatattttgttttctattaattgtattcaggcaatctgcagcccaaagtttgagttctaaattattcaccaactgccttgaagtaccatcaaacaaattctaagatgtgacacttgagggggatccttctgcctcaattttttaagtcagtggaataggactcttcaatatatcaaactctgaaattaaacaagctttacaaaataagaaagtgagaatggtacattttataaataacactgagattacatatcttgcgttattcaccaaaatatattttagatggaatagatttagtttttctaaatataaaaagcaagcatgctaagcaaaatatctatcacagaaacaaaacttttttttttcgagacagaatctcgcttcatggcccaggctggagtgcagtggcccgatctcagctcactgaaacctccacctccctggttcaagtgattctcctgcctcagcctcctgagtaactgagattacaggcatgtaccaccacacccagataatttttaaatatttttagtacagacgggatttcaccatgttggtcaggctgatcttgaactcctcgtctcaaatgatccatctgcctcggcctcccaaagttctaggattacaggtgtgagccaccccatgcctggccaaaacaaaacttctttacaataaaaatttaaaaaacaaaaaacaaaagactagaaatagttgcttaaaataaagagtcaaatttatgtgacaaaaagaaataaaatacatgtataacattgtgcacatgtaccctaaaacttaaagtataataataataaattaattaattaaaaaaaaagaaaacaaaccaacagataaacattgattcatcaggtagatattgaaagattccagcagagagttcaagcaaatggaaatataaagggtaaacaaacaaatggaaaataatattgagatagtattttataccatctaaagacaaaacatgttaagaaaattatgatattcaatacagctaaaataacagaatattctggggcactgtaacttgatataaattcctttgaaaataattcttacaattggccgggtgcagtggcacactcttataatcccagcactttgggaggctgaggcgggtggatcacctgaggtcaggagtttgagaccagcctgaccaacatggcgaaacactgtctctactaaaaattcaaaaactagccgggcatggtggtgcacacctgtaatcctaggtactcggaaggctgaggcacgagaattgcttgaacccgggaggcagaggttgcagtgagccgagatcatgccactgcactccagcctgggtgataaagtgagattttgtctcaaaaaaaaaagaaaaagaaaaaaaggaaatgattgacaaaatataggagaaatcatgaaagaagcaatcagttccacagaggttaaaaggtatgtgcaataaagatgttcacagcagcattaactataccagtaaacacctggaaacattccaaatatctaacatttgaagaataattatttcaaaggtaggattataacggttttaaaattttcttctttgcaatttttggaggcagtcttcaaacatttaatacaaaagtattactttggtaatcagaaaattacctgttaacaaatatttaaaaataatatgtgcataatataatatgaaaaatgaatataaatgtattaggttacagatgtttttcacagcaatgagaaattactaaggaaacgacttaatactgttatactctttgaaattctctttggtaattctgcatttacataataacatttaattaattatagcactattgtctaattgagtacaatgactttgatgacataacataaagcctaggcttttaaagtcgcattcctggaagtgagggcatttggaataatctttttttaaaaatgttaaaatgttattttatgactattcttggttttgtatagtttctgatatattacaaaatgcctttcggtatgtattaaattccctagctttgtttatagtagggtaattcatgcgtattggacaggcccctgaaatttttgcctagaaatcagccatgaaatttgaaagaaaaaaattgtgacctgggcaagttccttaatcttactatcattttcaatatttgtataaagaaagagttgacatacataatttcttagcaatctaataggccacggtattgtgaaaaacaactttacaaatgtaagaaattaataacataatatttcattaatcttaaattctcacagtacagtaaaacatattgttagtcttatctataaaatttcaaatgtccacatgaaaattaaaaacaagcccatttagattttgcaaagatctgaatgtttaatattatttttatatattgctattgacccaatgtttaaatcattagctggatttttaccattttcatgagtataaatgaatgtgtatatatgtgcatatatgaatccatatagttatgcacattcacatacatactatatataatcaacataacatatagaatcaaaatattatttgtcttttgacttcccggttttacaaaggcagcattagacaaagctatatttctcaaaacacatttgtttttcaagaaaaaatatgcagagccctatttttctatcagttcgtattatacattaaagatttattatgcacttgctactgatgttaaaatactttaaaattcagtgagcaagagatactgtttctatggcatattttgcttcaaatatccacatgcataaacatgaatagattgtgggacaattattatttaaataaatgtctcaattttttatagacaggctaagtgatacatgcaatgctcagtaatacacgcaatgctgagcaacacatgcaacagcatacataagctgacatatttgtaccaaacatcacatttgtcatacaatgtattctgttgtcagatttgcagaatatggggcagtacaatataagaatgacaaattttgaacaaaaagagttcctttccccatgaataggacagagaaaagtggtgtaatatttattataataaatatcttagtaaaacatataaaatgcaatcatgggggggaaggcagaattatttgttttccaaagtgcaaaaaggaactgtctcttttgaatacacacctattcaagaacatactcaagaaaagtaaacacataatagtagttacctctgggtgggaaggaaaggtgatagaattggggaagggtacactaggggccccagttttacctttagtgttgtatggtttgaactctttgatgcataaatggctacactatcatctatttttacatgcctgaaatatttaatattttaacataataatataaaatatatttctatactctagagtatatttatctttaatattctataatttgtaaaataatacctattagtttatcattcatgttcattctaaacactacgcatacttcttactcatttctttttatccttttcaatctgtatcaaaatagtagagctttacacaaatttttatctaaatatcatctttcaattattttcacagtgattaaaaacaaagtttaaaaaaaactagaaaaaaataaaggtgaacattgacctgagggtgaggaaagcttttatatgaatgaaagtcatagatcaaattttccaaaagaaaagtgattcttttgtctatagttgtatattaaaaagcaatgtaataaattagatggcaagcaacaaactgagaaaaatattttttccaaaagtgtgagggagaaagggctgggtgcagtggctcacacctgtaatcccagcactttgggaggccaagacaggtagatctcttgaagtgaggagttcgagactgacctacgcaatatggtgaaaccccatttttactaaaaatacaaaaattagctgggtgtggtggtgcacacctgtagtcccagctattcgggaggctgagatgagaggatcgcttgaacccaaaaggcagaggttgcaatgagccaagattgtgccactgcacttcaccctgggtgacagaatgagactctgtgtcaaaacaacaacaacaacagcaacaacaacaaagacaggaaatgttaatgtctcaataagacactaatgtacaattcacaatagaaaattcttttacactataaaaatatttgcagcctcaatgttaatcaattgagataaattagattttatccaacatattaattttataaatacttaactataaaaaaactcaatatttgagatggtgcagtgatacagcgatacagcagtgtaatacgctacaagcacactgctaacagtctctgaaaagcagaacacgatgtcacctttaaaatgttctttaactctatacatcatatttctgagaatgcatcttaatgcaccaatccaggattgaccttcaagtatgcttatcttaaaacaattaaaaacagccaatgtccaatatgaagagaatggttgaataaaaggtaggaatataaaatcatgttatagaagattatggaatataggatggtatgaaataacataaatataaatctcagtttactatttttaaagactaagtattaaaattctcattggaagttgaaggtttgaatcctaatcactccaacactgtacaattgcattataaaatattttctttacacattctaacacaagagttagtgtatcactagataaaagttccatatgagttatttataaaagtagaaaatactttattgctgctggtgtcctgaaactgaataataaattcatctataaatcatttagtaccttaatgtctgtgggcccacttactgtgttaagtgcagaaaattattaacagtctggactttctaagtacataattttctattgtttattctttgttttataaagtgcccacatgttcaaaatatttttgataatgaccaagtagtctactttcttgatgacctggaacagtcatccttttttttcttgctggtatttttgttctaaaagggaaaagagtgtggaaaaggataatggattactttataagcattgtcttgacgacttggcaacaataatcaatactcaaaaacttttaagttcttaacacatttataccttgtaaataggggcacaatcacgtggaattcataggcagtttgcttttcttgtaccatcactcaattttttgaattaaagattttatatgagacttcggaattaatgatacaaagatgcatgaatgaaaatagagataaacccaattgtggaattaaatatacaatcagtagctaagaacaaggagataatgatgcttcagcaatcttaggaattattcaggtaaagaggggcaagcacagcactttgcactgaagaggactttagagatcaactacccaacactctccttttaaattagaggaaactgagcctatgaggatttaagtaatttgcctgtgatcactcagctaactagtagcataggaggaacaacaataaaggtctagatttacagtaaatttatctattaattcatttctacataactgcttcttgcattcaatgcacctagtgtaagtcaaagtcaggtatgcaatatggaaaatggtttagtctctttgtactccaaatccaggatcaaaacaacagaaaaataccagaaagacaaaaacaaaacaaacaaacaaaaacctcaagagggcactgagcagagatactgaatcaatgacaagctcttcccaatctccttccgtccccatccccaaaggctctgggtcagactaaaaagactactgaactacatcaaacaatttgtgtctatgtcccacattttcctaaatgtgtgaccttggacacttttctgtgccatcctgaacctcagttttatcatctagtcaaaactcaagatgatctctgaaaggtcccttcttcctatatgtcactacgcaggtgaaatacaccaggatttgccctgccttgtctttctgttctttttaaaacccttcgtccagtcaataagcccagtttttaaaaattcttgcagtttctattcaaaagaaaaaaatctaaagggtgtgtctaataacaagtgctctcaatatgaccataattgtactattgacattttggtgtttcagggtaatacaatttactgaaaaagaagaattaactctggctatataaagttgccgtatatttatttaaaatttcacgtattttcttccacaaaacttgattttcctctttcaaatcataggatatgaagaacttttcattagtaacatgaaagctactgactacatgtctaaaagattcatctttatttacatatctaggttcttctcttttaatcaacctgaaattacgtttttctagtagttaaaactaaacattctcttagtaaaatacagaagataacaggagaagaaaaagctgactatggaaaatttttctaactgtatgtcatctaagtttaacggtaaacttctagtagtctctcgggtcctaaaatgcttcaaatgaattcataatctgaatgggcttttaaacaacattgggattaggagtctggccctaccttctctggagcaaacatattgttgagaatggtttgcaccagaaggatcttctatcaccagtattactgttgttgttactgatatcaattatcatcatcatcatcatcatcatcttcttttggggggagggtagggtgtggatggagttttgctcttgtcgcccaggctggagtgcaatggcgcagtctcggctcactgcaacctccacctcccaggttcaagcaattttcctgcctcagcctcctgagtagctgggattacaggcatgcactaccatatttggtgaatttttatacttttagtagagacggggtttcaccatgttggtcaggctggtctcaaactcctgacctcaggtgatccacctgccttggcctcccaaagtgctgggattacaggcgtgagccactgcgtctggccatcctttttgcatataatcatttataaagtacataccccacaaattatcatgtttagacacatggacaaccattctatactattcatgcatgttatttattcctatttagcaagtgagaaaaccaatgttcagaaggattatgagatttactccattttatatccaaaatatagtaaaccaggctttgaacaaccctaattctagaacttcttttatctgtacctcaatgtggtaagcattatgtgatgtaggcacaagggttttctattttcataccaggtgtgcagtaatcaggcattctaaatttagcccaagaaacacacttaggtaatgccctgaaacagtcattgctattccttatctgggaattctgttatcattttgcatttgcaaaaatagtcattctataatatagaagtattctttcacattggcctcccacattgctggaaacatttctttatatttactcttcccccaaaaaagaatgagtgggaaacatagttaatatttattttgaaagaaaatagggcttaataaagggaacaattacatatttagtcaaggtagattaatagctgaggtttaccacttagcacactgcaaacaaaatctaacacgatactattgcactaatactagagcaatcattacaccagtaggtgtgccaaatgtggaactcaataacaaagcctacttaaaatgatcaagtattataagttagtacatgatcagtgattattctataaagtggggtttgggaagctaaacaaaccctaaattttttccttattcttcataatcaaaacacattacagatagacaaaagttaaatataaaaaaagagagcccccaaaaaatggtaaagtaaaaaaagatttaagaagcttaaaatggagtcacatttctaaacatgacataaaagcacacagaggaatgactgttaaaccttgatctattcaaaacattttagaaacaaaagattaaataactccaccaaaaaatgagtacataacttgaacagacatttcttcaaagatgatatacagatggccaacaagtacatgaaaagctgctcaacattactaatagagagatacaaatcaaaacctcaataagatataatttcatgcccattaggatagctactgtaaacacacacacacacgtaagtgttgacaagaatatggagaaattgaaccctcgtgcactgttgataggattgtaaaatggtgcaaccactatggaaaacagtatgaaaaaatatattaaaaatagaactatcttaagacacacttagatatatatcccaaaagaattaaaagcaggctcttaaagagacatttgtgcaagtttcttctctcaaaagcagactcatattgtacaagcccatatgactgctgaacagagtccaaatattctttatttcctttcattgagcactacaatcatcactcaaatcattacacttcaatcagcctgacacagaactgtgttctttaggactcagtagagagtactatgtaacaatgaagatcagaaaatgtctttggaagcatggaaccagacaaaacaaaagatgacagacagatcgatagatagatacagatcgataatagatccatagatagaatgcagttaataaggtgatttatataatctaaatgcttaatgtcagcttgttaaccaatagttcctcactctcataaacagtgtttgaatacatactgccaattgtttatgcctgctcaaattcttaccagtcctaccatctgattgacctgtcaactcaatctctttaaaacattgcatcttagttctgatgcattaagtgtagattttgtatgttaattcataatggaggaatcttatttctctgattttgacatctcttctttcccactgtactgtatgcaagcagtatagaacactttggagttaattgtgactgtaatattaattctagacaaactacaacagaagacacatcatggcagaatatactttaatattcctatattgtaacccacaacttttgatcactttacaaggtcaaactttgttattgctgagcatcacagtaatccaatgactataacaaaaagctgatgaccttaactttccaggtggccctagtataaagcctgactttgatgtatctaaacaagcacaaatatagaactcatcatgaggtctattagaatcataaaatcttctgagaggaagctatctagagccaccctgcttaagagatttaaaagcagacagatcaaagcatgtgtcattgagaatcctgctggttgtcatgagagaaggggtaaaattacaaacccattcagttgtatccattactgtaatgacctgaaatagactagaatgatgaaaatgaagggtgagtagcattgggtcataataatagtaatcacatatcatgtgacagtagtattgaatttttcttttgtacagcaaagacagtgttgtatttttttcctggatagctatggtaacaagctttatttctgaatgcctgatttcctgtctatagacccacacatctgagtaatatgcctatcccaaacattcattgtgatatcaaggatgagtcaaaaaacaagatggacatatgccaaacaattttatgtgaagggtaaaatctgtatttccattgattaccaaactgaattttgcacaggtaaaaagcaatggtgtcacataatcctgcatcttatcagctttcacatctcatgctttcttcaatgaatatggtgttcagattatatggttagggaaagaagaggctaaaaatgcctacatatctagcatgctgaaagaaaaagtctagaacagaaaggttctcttttcaggataagccagtctctagaagttagagcttaggacaatctccaggggaaaaattctcgggtgatgctagttataattctatgctccatggagccttcaattgactgtgtatttcttagagttctccctttaaaatatatttctcttcaaattgacgctatgcctcttttaaatgggccaccctgtatattctgaatgagctttttccagtaaagaactgtgttgatgtaaatctacgttggcaagagcgtcatcagagtcagctgggagtgacaggcatgttctagccaattctggacagtgtgttgaaatatgcttcccaggctgcaagagcaaatgcacaaaagcaagcccacgtcttgacaggggtgacgtgctgatcagcaaagccctggctctgtgagaacataaaatacgcaccaggagcatttcttgaggagaagccaaccaatcaatcacagcaagagccacataatccttacaggttaaaaggtgccagagcttacccttttccttagggcaaaaaaaaagaaagaaagaaaaaaatgtttgcacatgttgcttgcagggcgcactcctaagacacagaagatcgtatttcctaataactgccagccagtacaactaatataaatatgcaagcaggcagtaagaaccaacaattcaaactccaaagagaaagctatacatttcatatttgttttattaacaattatgataatgaaaatattcctgtataaatgttaaaacctggcatcatcttgtaaaagtatttcatgccaacacataaaacctatttatttaagaaaagcaatatcattgtgataattatgtgtataaactgttgtgacaaatgcaatatatatattttttcaaaaatatttttcagttcttcaatatctaggctgaacatcatattcaagaacaggattttgtgtccaaatcatggaaaaaatggcaatttcatattagaaaatctgtgccagggctatacatctgcaaactagcaatttcccaattgtttttctgtatcttctgtcatctgtctcattcttggagcatacacacacggccaagatgtgagaataatatgactttaccagacaggaatgttgaagtgaagatgactgggcagacctggccagtctggtacccaccacctctcccctcaatttctataaatgcagtgaggatgaattactgtttctggaactaattaaatagaccaaagaaaccggccatcccagcagaggagtttgtgcttgtctgactacatggtcttaaaaccaaggtccttgtcttgaatacacaaccgtcaccacacaaagtccaagactgccaggtcattgctcatcaccagatggctctgtaaatcccctactttgaaatccccagccttccccaattcctgcaaactcgccagcgtgactcctagcgttcagtctgtcatcagcaaaatctccttatgctcctgtatcttcagcatgttctctgactttcctgcaccatcttgctctgacactactggctgcccaccgagaatacggatttacttcagccctctgatgcagtggctatttttccttccacatgtttgtacctctgcccctagtgaagtaggagtctttctcattcttctctgctgcttccagaccatgatctcttccttgccctaaaatgtctttgtaactcacatcattaatctgctcccctcctaatccagttttctactgacctaaaggtctctcctctcagtctttaaacattttagccctgtctctctccagcgcaaactcttacataactcataattatcttttcctcccacggtctcccagtttctggatctcccttcagataatcttacctgaaacctcctttccttaccataagcaaggccttgccatgacagataacggtgccccataaccactgttaagcgtctctccctaccttctctctttctagctcatcccctccagtattctgactccaaaaatcttccaaacccaatgagtcctccagtgcattgaccttagaagttgttctgaccctcaccaaacttatgtccccttttccttagtgagcttagagtaaatatggcagcataatcacttctttgcatatccttttaaaactcagacttcactgaaatatctcatctctgttaaaccaacctttttcaaaccgtgcttgttgtggcctaagcagtcaatgatagttgaggaaaaacacaaccatgatgactttgaatttgtaactactggcctgaggtggctccttagtgccgtctgggaatttcacatttctctagacaaagcactctctcctcccagagatgatggatcatttctcaccttctctctcctcaaacctccaacatctgttctctgtctttacattgatgagcttattattttatcacaaaatagaaggaattaagagacacttttcatacactctgaaaccagatctatcaagatactgacctcctatactctcagactgtcctactcttctttctcatttattgtgaggactgaacaatcagcactcccattaagggcaactccttggcttgtgcactatctgaacttctccttacccctattcccccaaagcctcctcaagaatattgctcctgcaattgtccccagtttctcatgatcaaatgtcccctttctgctgcttctttctcaaaaccacacaaacataatacaattgacaacacaccctttgcccatatctcatttttcttcctatcccctccaactgactttacaacaaaactccaagagttaacaattgccaccacttcttttcccatcatctcttgaatccacttgacttagtccttttataaggaggccttcacctccagatactcacaactttgagtagtcctctctcacactgtaccagggttggcacatgtgagcagaagaatatggcagagtaatagtgtgttgctgccaagtctgggtcataaaagtcgttgtggcttctactttgcactctcttgaatcactgactcctgtgcctgaggtaggaacacccagccatcccattactgggtacatacccaaaggattataaatcatgctgctataaagacacatgcacatgtatgtttattgcagcactattcacaatagcaaagacttggaaccaacccaaatgtccaacaatgatagactggattaagaaaatgtggcacatatacaccatgaaatactatgcagccataaaaaaggatgagttcacgtgctttgtagggacatggatgaagctggaaaccatcattctcagcaaactatcgcaaggacaaaaaaccaaatatcacatgttctcacttgtaggtgggaattgaacaatgagaacacttggacacaggaagggggacatcacacaccggggcctattgtggggtggggggaggggagagggatagcattaggagatatacctaatgtaaatgacgagttaataatgggtgcagcacaccaacatggcacatgtatacatatgtaacaaacctgcacgctgtgcacatgttccctagaacttaaagtattaaaacaacaacaaaaaaaagaacacccagccctttggagaagcacaaacagtgaggaactgaagtcttctgccaacagccagtgtaaagcaaggctgcctgcggacagcaccatcttagaaaactgatcttccagtcccagatacagcttcagatgactatagccttcactgacaacttgagtgcaatttcttctaggaactttagtcagaaccagccagctaagctgctccctgatttctcagaaactgtatgcaataataaatgcttgttggtttaagcattggggaaatttgttatattccactctagtcagtcctgtatcatcactactctactgatcgacttgtgttgtatgccaccaattggctgcatgttgccaatgcaatgatcaattctcagttcttattttagttgacctatgagcagcatctgccacagtttatcacttttctgttgttgttgtttctttgtttttgagacagagtcttgctctgtcacccaggctggagtgcagtggcatgatctcagttcattgcaacctctgcctcctgggttcaagtgatgattctcctgcctcagactccccagtagctgggatcacaggtgcctgccaccacgcctggctgatttttgtaattttatttgagatgaggttttgccatgttggccaggctggtctcaaactcctgacctcaggggatccgcccaaagtgctgggattacagccgtgagccaccatgcccagccacttatttctcctgaaacagtttgttcatttggcctccagatatcactctcaatttttcttcaacctcactggcctctctgctgagttttcctcattttcctgatttctagattttaaagtgccccaactgtctcaggtcttttctctatatatacttgctccctgggtgattcattcagacttatcacttttaataccacctacattttaataactctcaagtgttcatctcaagtgctaatctgtgctccaaacttcagactcatacattcagttatctaagtgaaacctccatgcagaaatctaagaggcatccccaaaataaattttttaaaactaaactcctgatccacctcccctaaaaatgctccttccacaatcttcctcagcttgacaaatgacaactacattctacctgttgctaagtccacaaacttaagagttattcttgattcttctttctcactcttcacatccaatgcatccacaaattctgttggctgtgtcttcaaatggtagacagaattatgaccttttttttttttttttttttaactacttttacctctatttctctagtccacactgccaatacatgttacctgggttacttcaatagtttaactggtctctgcttccattttccccacatctttactttctacacaggagccgggatgattcttccaaaacttatgatagactgtgtcccttcctaacacagacattcctactactaacactttttgcttcaatacatcacagtcatcaccaaggaatgacccaagtctttactacaggctcaaagcactatgtgatctgatgcctttctgtggctcctacctcattttctataacttcccccctccctcaaatacgccaaccacatttggcgtacttgaaatcacaatgaaatgtacttctgctggataatcatatagctcgttcagtcatctctttcagatctctgctgaaatgtcttacatacaactctgtaactccttaccctgacttattcttctatactgtacttgtctttctctgacccactggaatatttatttgtgtgttgtcttctcctttattagaatatgtgctctttagcctgatgcagtggctcatgcctataatcccagcactttggaaggccgaggctggagaatggcttgagcccagaagtttgagaccagcctgggcaacatagtgagacccccatccctacaaaaaataaaaagttatctaggcctggtagcatgtgcctgtagtcccagctacctgagaggttgaggtgggaggcctcttgaacccagagcccaagaggtcaaggcttaggtgagcagtgatcatgccactttactctaggcggcctggacaaaagagtaagaccctgtctcaaaaaaaaaaaaaaaaaaaaaaagtatgccccaatgtatggaagactgtctatttcattcagttctctatctccagaagaacaataggtacacaggaaacactcaaactattttttgaatggatgaaaagaaaataggatatttcactcctgactctcaccttggtgagctagtgataaaatagagaaaattaccttcagagtaagatggttttctgtgtccagcccctcagaactgctagatgtgttctaagaattgtatacttttgcaattcagtaagaaggaaggcacagtcctcacgtaaataatgcctctgttctatgcatcagaacacaagtgccactagtagaattaacacatctgatttgaatgaaaacagcattgtgtatctatttcagaaggattatcttgggaaaagtagaagagcagtagctagctgaaagatggtatagattggtctaattgaactgagtctcaaagtccaactattgaaagtgttcagtgcacatacttgtggcttagcaagcttagcatggggtaagaactcaaaatgtcacttcctgttatgtggagtgaagctgttaggaaagataacatcatcatgtttcttttatacatataaatccctggtgtgtgtgtgtgtgtgtgtgtgtgtgtgtgtgtgtgatgtgagagcgagcgagcgagcaagcgagagcaagagagagagagatgttagcaatccttcaaaatctgattccaacctaccttccctagaggcactcaaactcacctaaaccccatgtaatccccatatttgttcacactattcccttggtgagaaaacacctcctgtcacttcccctccttccacacttcactgcagttctctccctgctgaaatctcccatgcttcacattcatatcaaattccttcctaggcccctctctctttgtgaaatgtgataataaaacctaaacctaatcaagttgcagtgaatattcaatgagatcatctaagacaatgctcagtagggtgcctgggacttctctgtgactatttcatctcactcatgaggtcttaagtgattcctagtaccagatacaatgtctccctcccataaattccaaccactctttatgcttagttatggcaactattgttttatggttgagtaatcatattctaacacctgttaggtcataatccttgagaacaaagacaatgccccaataacatcccatatagtaatttgtacagtgtagacagagtatgtgagtcaaattaagcttctagatttcaataggctcagatcaccttcagtgttctatcaattgtatgtttaccttttatttgaaagtactactgtctttcaagaggtctttttgttaaatatatcatttgaacttctaaataattttatgaaacatgtatgaattagtaatagttccacttacagatgaacttaattgtgatttgtggaatttaaataaccctaggatcccacagtgagtagcagagttggactatgcaatagattcctgaacctctttgtatatcacaagactgtgctaggtgctagggatacacctgtgaatgaggtagaactggttctccccttcacaaaatttactccctagggcagtagttcttaactgaaaacaatccctcgtcccctacaagggaaaactggcagtgcttggagacattttgaattttcacctcatggtggaaattaatgtcatctagtgggcagtggccagggatgttcttaacctcctacaatgcacaggagagcccccaccacaaagcatcattctggcccagtcatcagttctgctgaggttgagcaaccctgctctagattcggcttcaaaacgaaggatgtgaagtatccataggacacaataacacatagggttgcagagataggtgcagaactgatgacagatgcttagatgccatgttaaaggtgtgaactttatcctacagggcagggatcggcaaattacggccagtgggcgaaattcagcctatttgtttttgcaaatacagttttattggaacatgctaatgtccatttgtatatctgggcttcttttgcactaccgtggtagggttgaatagttgccccagagaccatagggtccgcaaagcctaaaatatttattttctggtccttttgttcacctctgctatagatagtggacaatcaaagcagaactgtagggtaattaatgagacagtataagtaggacatccttagtgggaaggagctagtggcacaaagacaagttagaatgttattgaaatagatcaaacacaaatctaagtattaaaatacctggtggtattgggagggaacagaacagcaagagataataggtgaaataatccataggcctaggcagaaggagggcaaggcagaagtcaaatatgattttttctggttttttgggaagataatggccagataaacagaagtagaaaaatcaaaaaggggggcacagtaagcttggttttgtgcgtgttaaatataaattaagagtggatcttccacgtggaaatgtccagaggaggcatatggaacttgagcctgggaaatgaggtttaagagtagggtttattaaaagagctgacagttggaattgaacagaggagagacacttgtggtgcagggaacatactgaataaggtcaaaggaataattatgtaaccgggggtactttcaattaaggtgctggaaacagagacaatgaaaagaaaagggagatctcatatgaataaagttaatccagtaaatgagacagtatcaacaaagagggatgagcatcaatttcaaatgctaataatattttgccatgactaatactgtgcatatcagtaagtgactttaaatgcaaaggcaatgctgctttaagtttgtttgtgtatgtacgtgttcatttgcaaagaaaactctcaagatgaatgtaagataatgtttctctttaatttatagctggtccaactctgacttttcttggaacttctgtttttttacttcaacgcatatcattgtcttctgaagtttctatcaacagtgtaaaatgaggagcttatgaataaagatgttcttttaaggccaggtacagtggctcatgcctgtaatcccagtactttgggaggctgagacaggcagatctcttgaggtcaggagttcgagaccagcctggcaaacatggtgaaaccccctctctaccaaaaatataaaaattaggcgggtatggtgttgcatgcctgtaatcctagctactcaggaggctgaggcaggagaattgcttgaacccaggaggcagaggttgcagtgagctgagatcgtgccactgcactccagcctgggcaacagagtgagactgtctaaaaagatgtccctttaagacagtttctcaacgtatggcttccacatcacctgtagggcttacaaagtcgactttctgggcatcacatcagacctattgtgggtgcagggctggcttcacaggtgtgacctatgaagttatacaggatcctactctcagaagggccttgtgctggattgaatgcagtgctgttgccatcatgaaatttgtaatatttatttgcgtaacgggccctgtattttcactttacctgggccctacaaattacgtagccagtgctgtgtgagcattctagcatggaaagtaattagtttacagagtaaaaaagattacagggtagaaaaatgtggttccttacttagctctcatttatttgcattgagacatactttttaaaacacccatgtttacactctttggaagtaaaacttggaatctaccattggcaggtacagaattttccacagaacattttttttttttttttttttttttttttgcatctgtgcagctaccaggtaagaacttaataattacagtgtgggaaaacagagtaccaacatactttctgcttagggattagcatcacccaatccaagttcagtgtgtttacctgcaactaagggattgagaacagaagaacttctgcaagaacaaatgtccctcttcctatggtggaagtatcagtggttcaggttggtatattagatggtttgaggttgtacaaagatggtgtttggcatagctgatgtggcttattgaattttaaaatgttgaattaaataaggagaagcttatttcctttccaaatccctttcagtaattcttattaccttaagaagaaagacttaattgtggtctttcatatgtctatattatttgctaaatgccattttaaacagagaacagacctcaggctcagagtctttggaaggtcatggttatctagctaaacttgaatctattttgccttgtttattgtatattttttcaattatcttctatgcataataaatgacgctagttccaaattacagtaatatacaaagctttatttttaaacatatggccttttaaataaaaatgtaagtctactagaaatattaaatgtaaacagtataaatggcccacagttgcacctaaaattgtgaaggtgattcaagaatgatcaatgtgttagtgaaactgctattcttattagtaagaaggctttattaaaggaagcctggttctattcagaggagaactgtagaaatcagccttgtgcattatcagcctgcaattcatatatattttagttattagtatccataaatcatacgctgttctatttggcaatcactcaatagaaggtcataaaaaaaatcacactgcacaaaataaagcaaagtaaaacaaatactattaacctaaagaaggcaaacaagcaggaatgataatccaagtaatcttaagtcagaaagttgcttgcttcaaaaggtcaacaatacacacttcaccatttataaatgtgaaattagccatgtatgaaaaaaaaaaaccaaaaaactggtaccctactaataacatgaagaggaagccactttattttaataatagctaatttaatcagagggttatctcaaaagggtaatggggaaaaattggtctcaaattactgcaatttaaaaatgatatatataatatttaactgtataaaaatatttatattaaaataatatttctatgctaaaccccttcaaaaaggttttctattattttagttcttctgaagatctactttggaaaaatggtacttaatttctgccagttaaaatttctccaaattaaaacactgaaaatgaaactatgaagggtttttttttgcaaatttctcaaaatcttgacatttcttttgtaagcttaggtcttgatatataatttaactgttatgaattctaaaagataaggattagtcatcagaatttaacaagctagttattcagtaatttcccaagaatcatagatacatttacacagatttttttcagaaatataacaggcataaataattttcaaagtataagctaaatattaaaatgcatgtatttgacaaattattgtgacagaataataagatacagaatcattcatatacaccaaagccaactataccaatctatgtgcatgtaaacccaaaacatacacacacacacacacacacacacacagagacacacactgagtcatggtgacaaagtccacacaaatggttaatcattgagttcaaagtttttttccactatggcaatcaaaaccaacatcaccaggacttctagtctggaagggtatggatccccctgggtgttcagcataaaagacacagcaacagaaggtatgtttctcaatcgatcaaaaaacaactatttattgaatgtatattatacaggtggcacttgtaccttcacagtggatacaatgattgatgaatgtggaggttcttacttttttttttttttttttgaaatggtatctcctctgttgtgcaatggtgcaatctcggctcaaagcaacctccgcctcctaggttccagcgattctcctgcctcagcctcccgagtagctcggattacaggcatgcaccaccatgcccagctaatttttatatttttagtagagacgaggtttcaccatgttgaacaggctggtctaaaactcctgacctcaagtgatccacgtgcctcagcctcccaaagtgctgggattacaggcatgaactaccgcacccggccggttcttactttttaggaacttacagtccagctacatacttgaaatacaaacatgaactagaagacagcataacatagaaaatgacaaataaatgtcaacacattcagtctgagagcccaaggaaagaaagattgcacccaatgaaggtaggtagttttggccctgtatacatttgcttacgaaaaccaaaagtcagaccaccaactcaaatgtttccactttgtttgctcttattaaagcttacactttttaaataatatattgaatcacagaaaacaatctctgaaacactatttctgagaagaaagacaacaatattagcttctagtcccagagatatttccattctaaaaggaaatatctcaagtcaaagagactattctataatgtggaatttggcatgaaggctggcaaagtggaaatggaaggatattgttttgaggtaagatgggtcttggtcctcctctatctggccacctaggtcactcaaagagagcctgtgagtcaggccagatcttgttaccaagcagtttgctgttctgttgcttagtgacttgaactagccggccatcattcccagctggctcttccagagtcaaaccttaacagatttctgacttgatctttctccttagagctcaagacttttttctttccctgaatgattgactataaaattattctctggctggctttgtttttacacctcttatgtaaaaacaaccctgaatcaaatgttctccattgaccccttttcaccaaggacatatatttctcctacacacacatatttttataagaatattttataaggatgtcaacttctatacaagccacatgtgtaaactaataaactgagattccacaccaaaaaagggctctgtctctacctttctgttaactactattttgtaaaatctttgaatattcattgttataacttcaatacacatgcagggtagggtaacaaatgtgaatgtgattcttagcccaaaggaaggtaatgctgaaagaaagaacacacgatggagagttaggaagacttgggttcaagttttaatgctattggtttcatagctgtttagctgaaagatcttggttatgtaagaactttttctgggcctcagcagctgcatatgtaaagtacggttaacaatacttacatccaaccttggttgttttaaggggttaatgtacacaaagtacctgacacatggcaggagctaaatcattgacgtctatgttataattaatctaaggttataaagctatattattatgaacctaagtgtttttattccaaaatgaaatcatgtaatttcttctcagatcaacttttcaagatctccttttgagaataagtgcctcatctgaaatacttggagagtatttatgtccttaaaactgcacataaaatgatttttctgttttgcttatttacagtagaagagactgatgtgttaagatggtataaaattgaagtctagtaaaagagaattttaaattagaatctttacagtgatctatacatttccctatctgttacctaaaattatgcctttcagatggtggcctaacgtgaataccaccaataccttcattctgaaggccctgaatcctatttatgagtcacagaattattaaataattctgtttcctgtttttacccatgtagcatctaccttactttcttacagcagcaagttggaacttgtttctaattgctaatcttaaatagactgtagtttgttatcactttgtaaatttaattagtcattactttttacttgtaaatgccaaatgcctttataaccatatgacttattaatagagtctccaagtcaaaaaggttgaataactaaggtcaagtatcaaatgaccagaagacctggaaatatgtgatttcaatatactgaatgaatcgcagctttaaaaacatgattttttaaaaagcaaaaccattaaaaaaaagacattattttgctacattagagatagtaaagcttcttcctgaaagtgctacttgaagaacaaatttggtagctttctatctaagaaaaaaaaagtgctgaaactcctttagttatctgaatacataggagcttttcaattataaagaaatttacacaaagaatattttttaaaaaatcaaagccatgattttcattattttaatgaactttaagattcaagtttttattttcttcttatcaacatttctgccaagtttgcaagaaagaccatgtcttcttaagaagagattttaccatcagtagcaacggcttcagctcgtacgaacaggcttcacatcttttctctttaagataaatgtcaatggtcatgggaagcacacgtgaataataagctgcaaggttatccaaggttttcttcacttttttctcaatgccaattgtcataatgtaatccctgtaattccttaaacatgacaagccaatcggcatgttctttaaaaggaaaatcttcctcaggtcttttgatttcgtggaaagccaactatgcctttcaaatggtacagacaccctcaacttgcagcgcctccacctcccatgatttccacagagggcaacagccagttatgccacagacatggctgaaggttagggctgactggtcttccccaaacattccagcagcacttcctggtgtgcttctcagatgatttcccccagaaacttgctccccaccttctggtattacactttgcctacagccctcctctgggttcctagttcccaggagactggcagcaatgctcttctccgggtattattaccataagagacagagaaaagataaccttaaagctaagcagggcagaagtaagagagatggaacgagggagaaagagacctcaaagagaaatcactaaataatggctttgaaaatctactcagttgtttgtgtgtgtatatgtgtatttttactctacaaactctaagtggctgtatttctcttttataggtgacaaatggtttctttccccttctatgacttgcaaatttatatttctcttaacaaccataaaaacaactacagttgctgaagaaataatgactcagaaagcaaatgtttacttttaaatatgagcaactttacatctaatgccaatgcctgataaagagaaatttatagtaaacaaaaaatatggccaaaatcacttatttagcttcctaaacacatttaagatttattaaaagtctcctaaaaggccttttgaaagtccacctaaagaaattattttgttgttaagattgttactaagtacttcttctactgttggatatgttttaattaaaaatacatatgtgtatacaagaattataaaaattatacagttgagtattacctagtcaccatgattcctaaagatatcctactacctaatttcgcttatatacacgctggaacattttcctccattcagtgcatcgagcacagtataaattgacaatgttttcatctagtccttaatcaggaatataatccccatgaaattacttatattagaaaactgtatttggttttaattatatttggaattaaaaatgtttttgagagatatatcataaataacaaacctgatgcatcttagtgaatgctacccatgaatattagtttttaatggttaatgttttcaaagtagcttgaaaatatttcactatgtagcctaaattgactgttaaattcaggaaattacatcttcatttccgttatagtaaaatgactcaatgtttttcattgtgacattcacttagattggagtgtgatactgacagctatagtaacaatattttaagagtataaacagctgggtttttagaggcaaattgacacagagttgtgcattgcttattctaagttctgagaaatgtgtcattaggcaatttcatcattgtgcagacatgttagagtgtacttacacaaacctagatggtatagcctattgctcctagcctacaaacctgtacagcatgttattctactgactattgtgggcaatcataacacaatggttaagtatttgtatatctaaacatagaaaaggtacagttaaaaatacagtataaaagataaaaaatgatatacctgtatggggcactgaccacgaatgcagcttacaggactgaaagttgctctgggtgactcagtgagtgagtggtgagtcaatgtgaaggcctgggacatttccacacactactatagactttataaacactgtacacttaggctacacttaatttataaatatttttatttctttgatataagttaattttggttactgtaactttttactttatacaactcttaattttcttttaattttttggctcttttgtaataacacttaacttgaaacactaacattatacagctgcacaaaaatattttctctatatctttattctataagcttttatttttaatttttttttactttctaaatatttttgttagaaactaagacacaaacacacattagcctaggcttacacaaggacaggatcatcagtatcattatcttcctcctccatatcttgtcccactggaagctcttctggggcaataacatgcatggagctgtcatctcctatgagaacaatgccctcttctagatacctcctgagggacctacctgaggctgttttatagttaacttttgtatataagtaggaggagtactctttaaaacaatggtaaaatacataaatacataaaccagcaacatagttattattaagtataatatataactatatatgctatatgtttatgggactgacagcatggtaggtttgtttacaccagcatgcccacaaacacaagagtaattaatgcattgtgctatgacttcactaggtgattggaatttttctggtccgttataatattatgggaccaccatcaaatatgcagtccaccattgactgaaatgctgttacatgtgtgtactgttgagcattttaaaaaatgatccaggtatatatatatgtgtgtatatatatgtaggtatatagatatatatatgtgtgtgtgtgtatatataggtacacaggtatatatatgtatatgggtacacatatgcgtatatgtgtatatgggtacacatatgcgtatatgtgtatatgggtacacatatgcgtatatgtgtatatgggtacacatatgcgtatatgggtacacatatgcgtatatgggtacacatatgcgtatatgggtacacatatgcatatatgtgtatatgggtacacatgtgtatatgtgtatatgggtacacatgtgtatatgtgtatatgggtacacatgtgtatatgtgtatatgggtacacatatgtgtatatgtgtatatgggtacacatatgtgtatatgtgtatatgggtacacatatgtgtatatgtgtatatgggtacacatgtgtatatgtgtatatgggtacacatatgtgtatatgtgtatatgggtacacatatgtgtatatgtgtatataggtacatatgtgtatatgtgtatatgggtacacatatgtgtatatgtgtatataggtacgtatgtgtatatgtgtatataggttcatatatgtgtatatatgtatataggttcatataggtatatataatatatgtatataggtacatatatgcatatatatgtatatatacacacacatattttatatatatattcacaactctattcctatactacgtactaaaaaagagcaaactgcttaaggatatatatatatatatatatatatatatatatatatatagcttgctctttctcattttatagtatggcatattatggagatatatatacatgtaccatctctatatataaaatggtaaacacacaaacaggacacatacatatgaagttaaaagacaatgacattcaaggaagaacacactgatttcaggatcctctgcgaaggaagaagaataggatgggtgacagctttagacattatctgtaacattttattcttaaaaaaataaaagaactgatgcaaacaatgacaaaattttggcattttaaaaatctgagtctggggtcaggggagcgggtagggatagctttaggagatatacctaatgctaaatgacgagttaatgggtgcagcacaccagcatggcacatgtatacatatgtaactaacctgcacattgtgcacatgtaccctaaaacttaaagtataataataataaaataaaaaataaaaaaaaatctgagtcgtggatatatagatgtgtattataaaaatatgaaaaaattataacttaagtgattataatgctaaattactttttaaaagaatatgtgaagataacaggttttatgacttaaatatgactaaacagcaacttttaagttcccaaagactgaaaaccagcatttctaccttgttcttctaaaacttatttaggccttacaccccaaaactgtgcttaaaattcaatgacgagaaaagcctgaagaatgtgaagaacttcctgatttcaattttcctgaaataaactagtactggaagttaagttttcttcaccagagattccattgactttgtagttcctgctgatgatagagggaatcccctaccagatgaaatctgaatcatgtctataatcactagaactacaaggcattgcatgtttagtaaaagcagtcaaacagattagtgaaaagcagagacacaagagaattctaatcctaacagatggtgccagaccaaaaccagtgctcaacacatactagctagtgataaaactattactaataagcattgagagtatcagagacaagaggcgcaatagaaatctgttccttgaaggaaggaacggattacttccagttgggagaactggaggaaccttttaggaaaaccaggaatttgaaagatgtatttttgcagtgggcagagaagagacaccaaaccccacagttctgcctcagtagtatctctcatttctgccttctcctttcctacagtaataaaactgacatacactcgtttctttcaactcttgtctcttcactctaattcatccacaaatgactgacagagtaatcatctagaaatttaaacatgatcctaaaggttcatgcagaccaaggctggaataatgggcacagagtacataataaaaaaaatactagcttataatgacacccactaagggtccagccctgtgaaaccacttaatttatacataattgtacttaattaaaccacaacccccaatagatactattcccagaaaactgactaacggggaaactgaagcacacgttaagtaacttgaccaaagtcacacaattactaaatgcaaagtaagaatttaagtttagtctcttttctaactgctttggtgctgagtgacatagcacctagagtatgctgtcaattcagtagctattctttaaatggatcatgaaaacccaagagaagtctagataaaaactacctggtaaatatagcatatagaaatgaaataacaggatgtttacttaagaaaagagaagtccctttttttttttttttttttttggtgacagagtcttgctctgtcacccaggctggagtgcagtggcacaatcatggctcactgcaacctccgcctcctgagttcaagtgattctcgtgcctcagcctcctgtggagctgggattacaggcacacatcaccatgcctggctaattttttgtatttttagtagagacggtgtttcgccatgttgcccaggctggtctcaaactcctgagctcagggactccgccctcctcagcctcccaaagtgctaggattataggcatgagccaccatgcttagcccaagagaagtcttttttaagagcatgagaacactaaaatattgattaatgaatttgtttagcagacatttattaagcttccaccattgaccagccatcatgccaagcatgggtataccaaaatgaatgaatagggccctggttctctggtgggttactccaagccacttgccttagggcttcataatggaagggagcaaaaattcaagttgtaggattcccaaagcagatcttggatccatggatgatagttgcagggaaggagacttctactgtttagaagcaaggtctttccaatcaacagccctatcaaacaacagaagtgcttctgtataatcttcatcaaggaggtttgacgagaggttcaaggacttgttattacagatgttattctaagaattcaacaatggcatatgttattacagatgttattctaagaattcaaccatggcatagagggtaaatcagatagcccttaacatactatataaccaagatagattagccaccagcactttaccttatgccttggaacagagctatgtttcccagcctcctttgcagttagatgtggccatagaactgagttccagccagaagaaaacgagtataagtgacatgtgcacttcccggcctgtctcataaaagttcacacataccatcctctttcatggtctttctcctgattcatctgagcctggcaaccttgggaatcacatgttgcaaataatggaaccacaggatggtagaattccaggtccctgaggcacccagtggctagggcaggctgcctccccacaaaaagcagaagcaagaaataaaaattcactgtgtcaatccaatgagatttggagactattttgtagaacagcaagattatcttagctaaaacagatgtcttccaatattattgatttattctaccatggtataaattattggaaaccaacaaatggttcttgctcaactttgtaataattaggtacagaataaacatgttagactcagtaggtattaagtgtatgcatagcgaatggaggggaataccaggagcaggaaactgtgaggcagaacactgtactagcaacaaattagatacaaatatatttatatttatgtcagaacaatttgaaacatattttcaaaattctccatagtgcttagcacaaactgtgaaagcacaaatgagatttttgtcaaaagatgcctgtggatattatgaacgtcttggggctcattcaaccaatatggaaaacttgagatactctttccaactcccttgcctgatagttttagtccataggggaaactgcttccttctgagttactgaaaatcgataccatgatttttatttctggtttccattgctctctttatgcttttcttactgggctgtgacctgatacactaaaatgaaatattgatagaaattgtgctcatgaagtttttccaaacagcaccagaaaaggaagtgccagaaatgtcagaagaaagcctattttcatgggatttcctgccttccttacatcccgacatgtctaaatagttcagataacctccagctgaactctaggttgctccactcagactgaaatcaaacagctgagttgagggccactcattcagcaatgggtgcaatttaggaactgcagtgataaagcagcgcaaccaaaagggacactggacacggaaattctggtcctggctccgtaggaactcatgccagctctcctgctctggcacccgatgcctggccttgagccaaccttctccttcagtgcatctcccagtgtttattcatgcctttcttttattcactgtttgttgctcacaattttttccaaaaagaaaatcttcctcaaagagaagccatcatttcccaataactgctttaagacagaaaaagtcaatgtttgtctc

SEQ ID NO: 57 - DNA, 74576 bp, Homo sapiens
aaggttaaggcaccttttcaattacaaacctctgattatcttcggtagtctctatcttcagtgcctgcctgcaatttgcctttctgccacttccagcagaacacagctctattactaaagtgttttaaaaacatgttgtatcaatattcacagaaattagagtcctatgaggcactagaatccaaattcaacttttgtcttcctttaattagcattttcctgcagtgtcaaatgttttttaaagaagccaagaggatttcagggcaatatatagacacttttttccctgtaccttttttatttgaccatattacttaaagatgaaatgcaatttgcttactgttaaaataattctagaatttttctttgtggaagttaccacgtaccatccattatttgaacgataatatatttaggactcacaacaacttgttggctgtgtaattattctattcttcccacacactcagtcttaacatattttcatatgtacatttcaagcatatcatgtaatggatgctagagtaccagaatcaggaaccatgtctcaaactctctagactgctgaaaattcaacactctccacacagtctagatgccactgggaaaataatgccaatgaaaataagtgctcactttgtttatcagcaagaacagtccacgaaatgtgcaagtggcaggagaaggccttcatcatctcttcatgctatttatttatttatggttggaaatatacctttcctccatcagtttaatatgagccctctgctcatatgtggactatacacaaaatctgagaaaggttgtgtcttaagagaaacaaggcaatctcctaagcaccactctccactgtgtaggattaaaccatactttacaaaggcactctttttgccccttttgcagacacaagtgtgactggtggcagtggtcaaagtatttaccatgcctaggagggcactaagccagtattttcccaaacacaaaaggagagaaatggaagtgttctgcagtatagactgcctttttcttttaattcattgcattattaacatccaaaaccattttaaagaagtacacaaatttcttctttcccctgaaatgcttgccacctttcgcctcaatataactgtggcaaaatacctctatccgaaactcttattctaatttctcatacactaacagtacaagtgacttataatttttttccagattaaattggaataattcaaatccaacctgattttcaccaccaatttgctccttcctttttactcatgaaaactttatcttttatatatttcccactgatttttaaaaattctttgttttgtttttactatgtaattgcaagtcaggaacattttaaaatgtaagaaaatcatttaatatgtttccaacttgtagagtttttaatttaacttataattccaaaatgttattgatagtaatagtttcttgtgtgatctttgaggttacagcttgagttccaatctaccacttcctacccatgttactttagctaaattatttaccatccctgtctcccatatgcaaagtagtactaatattacctacttcacagaattttgcaattatttaatgaaataatacttagcacaatgccttatatgcaatgaatgtttaataaaggtagcaatttttattattcctgccaggctgggaagtatcctaaatatcatgttaatcagcagttcccagtcttggctgtacctagggaatatcacctgggggagcttgaaaaaaaatgtctgatgttgaacctagagcagtgattccaaactttgatgttatcagaatcaccaggagagctaatccagcacacaaagacccaggctccatgaagcaggatagggcttgaggctttatacttttaccaaatttgtgagaagatgctgcttcagtgtaaagtttgatcatcactaccctgcctagacaaataaaatcagtatttctaggggaggatcaaggcatcggcattttaaaaaactcttcatgtgatttcatacatcagcaactactgatccagacttactctctcattaaatggttgcaaaaacactgtagatactattagttgactcgcccttgtgtctcaaatacttctagggaagtccagcttataagcaaagttctcatgaaaatatgcactttatgtattactctagttgcctctatgctaaaagaaaatcttatactgctgaatattgagcactcccagccttccatttaaaaactcttctcattaatctaggtatttcctacttttaattaaaacaacaaaaatgtaaaatattccatctacccattggttttccctgcttatatgttaaataaattatccattctttttcccactagttgaccatagattttggagttttatgggcacagtctgagagagatttttgtgaagcattgggttaatgtgggacatcctggaaagctatcactacttaccattagcacatctatataaaaagtaaaaatcaggtaaatgatcagtatctttttcctgaacaaacttaaataagcagttagttggtgtcattaccatgcattatgtcattaccacccccacccttttctgcaaatgcatttcaaatctgtccaaaagatacaatcaatcactcaatgtgctgctgggcaattaacaagggagaacattcttgtcaataatgatggagagttctggcagaagtgatgtcaattaacagctagcagagagcaagcaccatttctatccagaacacagagtgagatggcaagtggcagtaactaagggtccatttctatcttggcaatgggaggaggatttttttttttactttttttattatactttaagttatggggtccatgtgctcaatgtgcaggtttgttacataggtatacatgtaccatgttggtttgctgcacccattaacttgtcatttacattaggtatttctcctaatgctatccctcctccagcatcccaccccccgacaggccccagtgtgtaatgttcccctccctgtgtccacgtgttctcgttgctcaagtcaatgggaggaagatttaaaggagactttcactttgcatacattctatgtatacttgagcacatgagtgctacttcatttgtaaagatggtcatcttgatgcccaacagtcagcttaaaatcggaaattttcatcatcatatgtgttacaaaaggctaaactcctgtctaattacatatccaaaggcattgaaagtctcagatttcacttaggtctttaatgttgagtagaaacaggttcttaggatatttccttgagatatatgaaaggcttttaaatttgtaaaaacctatacatatacaagataatattgtcagtattgccagtacaagtactagtattaaagtctctatcatattgtttccaacgcagtatattaggctgcttttcagtaatttttgtctaatatgaaataaacagaaatatgcaattaatatgaaactaagaaatgctgtacttgaatatccttgtctttgactagcacactaatgcaaatttagcagcacactaatttccaactagttggaggctcagtatcacaaaatcaattttgtaactttctaatgataccattccacttgtcagctcaaggtaaaaatattgcttatctactgtgtgctaattctcaggacgactgtgatactgcattgacaaacatgcacaaaaaattactatcctcaaggagttttgtgtcttgcagaggaaataaataaataagcaactataatttgggaagatggggggaagagatatactgatgcggatatgtagtgtctgctggaagaacattcaacccttacagctcagtgagtcctcaccaaagggagagtggcatctaatctgaggccaagacctcaagtacacattgaaattagctattttcagtatgtgtgaatacatatgtgtgaccatgaatgtgtgtacgtcttggggagatgaaggagtaaaggcattttgggcagagactggcgcagacaataacttagagatgagagatattgtggggcattggacattcagaaaatggcaaataagtctataaacctgcaaggacagctgagcaataagcagaagcctgataaagaattacttcttattcagtgtcccctaaaggcaatgtagtgactttgtatacattatcaaaaggacccccttctgagtggagcaggttttaaagttgatgagtaggatgcaaagagagggagaaataacagatatgacagaaggaaggaaaataacaatatgttgtccctgagaagatggggttgaggggcgttgaactgcagggcacagatggaagcatttgcccaaactagaaaaaagccaacatttccactgttacaggaaaggaaggggtaaggattgattcagatggaattaattttattgcatttattgaacaattaacatttgatattctgattctggcaaacattttccatacattattttatttaattcttgcaacagtatgcttttttcatcacattttaacattataatgatcaggatgagtctttcagtggggactaaagaactgtgctagtcctctgccaatgttgagaatagcccgttggactcttaactctacatagaaaacacctgttcacctgattgtctcaacattaattcagccatttaaccaatatttattgagcacttaatatgtgccaaccctaagttctggagataaaaaagtcaataaagaaaagttctggccctcctcttctaattaaaaaagacagaataaacacctaagcacatatatatatatgtatttatatatacatatgcatgcttaagtggtaaatatatatatatatgcttaagtggtaaatatatatatatagatgcttaagtgtttattccatttcttttaattagagaaatataaataataatatcagatacaggagctcagtgttatgaagcaaactgaagcaaattaagaagttggagtgtgatgtttgggagtgctattttgcattggctggcaagttaggcttatccaaaagagtaatggtagagtggcctgaaggaagcaagggagtaagccagcactccaggctgtgggaaaatcaagtgcaaagacatggcagccagcttgttatggctgaggaatagtaaatcaaccagtggcctgggatgaagtcaggtgaaagctgtttggaaatgacagatcaaggaagtccatgctggtcatggtaaggactttggatttctgacttgcattcatatagctacagattgatgaactttgcacttaactaaattaagactatttggctgggtgcagtggctcatgcctgtaatcccagcactttgtaggccaaggtgggcggatcacttgatgtcaggagttcaagaccagcctggccaacatggtgaaaccctgtctctactaaaaatacaaaaactagccaggtgtggtaatgcacaactgtaaccccagcctctctggagcctgaggcaggaaaattgcttgaacccgggaggtgaatgttgcagtgagccatgatcacaccactgcactctaacccaggcaatagagcaagactccatatcaaaaaaaaatatatatatatatatacacacacacacacacacacacacatatatatatacactatttacttaaaatgtcttcaaaagttcatactataattattaatacctcattgaagagctaagttattttgtatataggaagaaaattaaaacatgggtaggagacaaagatttactataagtgaaaaaatatttcttcctgggagaaaaactgcacttccatatcttattgaaaagcaacaagatattcataagaatgatattggaagctgcatattgctttagcattgaaatgtctataaaatcatggccagtcacacagcagcaatacagttaaaatgagtagatattaccaaatccctcagaagatgtcatagaactttcaaagtgacagatttgtgagacctgaagaatgattactcagttgctaaatgtccatctgtcacaagctcttagctaactttttagagatgtttaactttttgtggttgataattatattttttataaaaatgaatcaatatgccttgaaatgtcactcttgatctcaaaaatgtaaaagagatcatgaaagagcttgtcactttgaaattaggcccaactaccaaaggctaaaactgtataaagatctttagattcttaatgtagaaaagatttaatcttatagtttgagatgatgaaaagtaatgtggtaggtaggcattggtaaggcaaaatgtatgcatttttaaatcacttaagaaaatgtaaatttaaactaatagttctcattttaaaaagctcccattaaattgactcaactattgtaattaacggatttcttaaaatagaagaattgtagcagcaactattttacatatgaggaaactgaagcttatggggacaattacttaactaaggtcagatacttgctgtttcaaagcctggatttgagcctcgtcaagctaagtccaaaacttgtgatcttgcctggatgacaaatgggagaaattaaacataggccttttgaaagtaaaatgccaattgatgagttatttaagaataccagttgaagactggtttaatatttcagttaatatcatcctagagctctaattatgtattaaaccacccatccactgaaattattagaatagtattatagtattcatgcaaggaaggatttttttaaaagatacaaaagcagttacagcgaaagactgataaactatactaacatttggaacttctattcaagagtgatcaagaaagtgagaggataagtcataaattggaagaaaacatagcaacccatgtaactctcaaaggactatttcaaaataagtactcctatgaatcaatgagagaaaaatggaaaaatagtcaaaatacatgaaaaggcacgtcacagaaaaggaaaacagaatggtaattaaatagatgaaaaaattgaccaatctcattagttatcagggagatgcaaataaagaccacagtgagaggacattttatgtccactaggtcagcaaaaagtaaaaagcctgatgacaccatgtatttgaaaagatgtagatcaatgaaaactcatatactgctggtggtaaaacaatttaccattatctggtaaaggtaaacattcacatacactacaattcataattctactcctgggtacacagcacagaaaatgtcttacatgcaaacacacacacacacacacacacacacacacacacacacacacacacacacacacggagacatgcaccagactgttcatagcaggattatacactataacacaagctagaaacaaactaagtgtttagcaggaaggactattagcacaaatgttacatcaggaagccatgaacaactacagaaagcaacctggatgaatcttaaaatgccctgttgagcaaacaaagcaagtagcagaagacaacaaacagaatgtcattcttataacactcaaaaacaagaaacaaataagaaaacaagcaaacaaaacaacccctaggaagacaaaataatatattttggtgtagtgcttcttaaactaatgtgcctgtaaatcaacagcaattcttgttaaaatacttattttggttcagtaggtctggggcaatgctgaaattcagtatttctaataagctcccaggcaatgttcatgcatagatctgtggaccatacttacatagcaagattttagaggatacatacatatatgattttttaaaagtattaaaaatggaaaggttatgcaattcatgaaatttcagatggttgttacccagtgagtggtgaaggaaaatatggtaactgagagaaggaaggagcccacaggtagatacaacatattgataatattgcagttcatatattatatgctctataacctacatatgttataatgctgaatattgtataagaaaaaccataagggcaattgtaaccccacagggtagggaactcacatcatcaccagcagaagagatggaaactaagtgggataggaagaggcagtaagccatgtggagttgaatatctcatttcagaagagagagctgcaggccagtcgtcaacactgtatttgtaatctccccagattaaataactgggcagacttttaaaactgttgtagcacaaaatttggggaacctaaatagaactctgagctaaaaataactacaaacatctttaaaacaaaattcatcctcctctcaaagtttagttttaaagttttatagttaaataaagttaataccaaattaagataaaaatttttgtgaagtggtgtgtgtagctctcaaatccaaggtaaacctgttccattctttggctgcgagttgcccaatcctggcacacatatattcctaaatatctatcccccacatcctttggatatgcagaaacttttcttggagtgagaatgcaattttatttctcaaatatctgactttaaaatataatattccttatcatctaacattgtagctatcaacgaacatcacagcaggaattagtaataactaacaagaactcaggacagttgcctaaggattaggaagcggggtttgcaggcaagagaggagaattactagtttaaaatagaagatggggagtgacagagaaaaattctctatcttctcaatattatctcaggttcttcaaactgttctgatgtataaaatattgcaataaatctctggatgaggcactcgtctaatgtttagctgctctaaagggtgaaagggataagacagagcaggcaggatacctattagcttgttgtaaaggtaattgcgatttttgtgattgaaagtaatagaaaaaaaactgcaattacttttgcaccaacctaataaattgacaactactacttattgggtttactatgaaccaggcattattttagctggttttcaaaaattagtttattactatcccgattgtacagataaagaaactgaagcacacagaagatggtaactcatccaaggacacacagacagcaagggcaaagccaggattacaatgaagactgccagtttcaaagctcatacttcaggccagtgttccctgcctgcctctctgcagtgtcccaatacctagttctctgcaagcgtgtcttatgtctgtggacattgtcaatttcctcatgattgttctatttaagaagatgggtataagcaccagacagagcaaatcagaatcctcaaaaattgcatgactttttggccaagttttacagctttgctgagccttagtttcctcatctgtaaaataaactagtgacaaaatatacatgataggactttgcagaaattacataaagtaatccatttcatgcactcaagaatttgctgctgctgttattggtattagtattactaaatcctattataaatctaaacccaagtctgtctttacttaagattttgtgcaaaatactatgctttaccatgtgcattttacatatgtatagatatgtatgtatatatgtaaataaaataaacaaggcattttctttttgtttctttctttctccccgactcctctgaatcaggctattatggaaacacattgaaaggaactccaggactccaaactagaaccaggaccccaaactagaaaccttaaataaacagaagaaggggagtttctctcccactttgctggaataaagccattttaggattagccatccaagtttaaattcattagcctccaaggggtttgtgaatatttttagataattatccaagacctccaaaatgcaatttctaatgtagctatagctgtcatgaattgaaagatgaaaaagtctagctcattagatcaaatggtgtttcctcaagtgataacaaatgtgatacttttcagcgtaccacaattctcccttaagatctgaagtaaataagacttcaaagaggctcccagcattaagggaagactagtttcttaatctgtcctcaaggaatacatgttctctccaaaagagagaggataggtacctggggaacactcataaactaactcagattggagcccaattattcacttttttgtgaatgcaaaatttttaatgaataatacatttttttaaatattgggaaaagatgctgtttatttttattaaattgttaaatttccaagtaacttggtaagtaaaagaaaagaaaataagaacttcaggaaaggaaaaaatatacagaattcacaagtcacggcagactctccaacaccttagtttttaatgtgtttgcttgcttgctctgtcttcttacagagttggcacagtgatacaagattttatttattttaatcaaagtagttttgacatagtatttggaggaaggagaagaaggatatgaaccattattttcctcagcatgacactatcatttaaaataaatggaagatccatggtctaatattaccaaggctgagtagttttccccctggctcagtgcatggaaaacagcatattttcttcatgcataaataatagaaatctcatttttgaacacagtgaattgttcagaatgctttgtggagcgtggcaaatgtagatctagatttatgtgcaagtggtccctgtgcagattcaaagatgtggactaattggccaattataaaccacagattggactaattgacccagttcttctttgatgttggtcaagtaacttagaaatgatgaatctaaaccaaatcagtagtctcatcacagttaaatattattcattcttaaaagtatgtcatttatcatggttattaagagaatgggcattacagccagaacgccctgagtttccgtttcagctccaagactttctagatgtgtaaccacagatgggttacattaacctctctgtcagttttttcatcgatgaaaataacagaatcaactttgcaatgttactgtaaagattatatgagataatagatgtaaaatgctcagcacaatatctgttacataaataatgcatgtatacctaagtatacacgcatatatacattattatattccatatatgatgttatacatataatttaggaaattaggggagtaaaaaaccaagaactcccacagtaccatgacaggggtagtgcttttgaaaattatgaactgtgttgaactagtaatagggctttgcctttaagccggcaatgaatattttagtgagataaagagcttctgtattttaaaactgaaactagttctgccttcttctctcctttgtttctacttttatttctattccatatgtgtttcctggcaatggagaagggagaaaacagatgtttactggagggcctactatgtcagatgctgctgcagtgggcacttcacttatgcgatggcatttgatagccatggcctttttatgaagaaggtattgttattcctaatttacagatgaggaaaatgtgtcctcatctcataattagaaaacactggaactcaatttttagccactatttaggtacctccaaagcgttttacatttctttagttaaagaatttgccagatacagtgtgggtcaggttcctatctatttttaatcgagaacctatttctctaggaaactatgctagagaaagtagttagcttcctaagccagaaaaagtagttagccttctaagctagccttttcattcacaatagaaatagcacatactgcaatgaaacagggtcaggcaaactgtggctattagacaaattcagctcgctatctgtttttgtaaataaagttttattggaacatagccaaacccatgtaattacatgagtaaatgtcaatgattgctctcatacttcagtggcagagttgagtatgacagagactgtatatctcacaaagtctaaaatatttactaaacgaatctttataaaaacagtttgctgaccactaatgaataagaaaatattagaataaaaaagctcaatatcactgatcattagagaaatgcaaatcaaaatcacaatgagataccatcttattccagtcagaatggaggagaaaagggaccatttatacactgttgatgggagtgtaaattagttcaaccattgtaggaagcagtgtgatggtttctcaaagagctaaaaacagaactaccattcaacctagcaaacccacaactgggtatatacccaaaggaatataaattgttctaccataaaaacacatgcacgtgaatgttccttgcagcactgttcacaatagcaaagagatggaattaacctaaatgcctgtcaatgacagatttggtaaagaaaatgtggtacatatactccacagaatactacacagccataaaaagaatgagataatgtcactggcgggaacacggatggagttggaggacattatccttagcaaactaacgcaggaacagaaaaccgaatactggtcccttttctcctaaatcttgccagcagctgttatttttttgactttttaatcacagccattctgactggagtaagatggtatctcattgtggttttgatttgcatttctctaatgatcagtgacattgagcttttttattctaatattttcttattcattagtggtcggcaaactgtttttataaagatccatttagtaaatgttctcatttataagtgggagctaaattaagagaactcgtggacacaaagaaagaaacaatagacactagggtctatctacttgatggtggaagatgggaggagggggaggaaaagaaaaaataattatcgggtactaggcgtagtacctgggtgatgaaataaaataacctgttacaacaaacctccatcacactagcttacctatataacaaacctgcacatgtacccctgaacctaaaataaaagttaaaaaagagaaaatactatgtggcaagttctatcacgaacaaatcatcatttataaataacattctctctgcgtttaaatactccttgtcatctttgagcgaaaaatgagtattaatgtagcaaaagatgatttcagcagcctccatcagccctagagtggaccaaggagatgagagctggtctgaattcaaggacctagttctgactgaggaagtttactccaaagcaagagctattctctttacagctcccaaacatgcccaccacaaattgctgtttgttctcagccttcttttgcttgtcctcttagctgaaacttcccccaagtcctcattcttttgtcactatttgacctccctcttccctttcagaaggtgaaagcattccctctcaaaccaaacatccctttaaaacataaaggaatattacagttatttgcactgaactgaacctgacctatacataacgttttaactcttcaatttgcctgaatttctttgcctattttcttctgttgatgaaattaaagacttggtaatttcagcaattttaggcaatattcatgtttaaaaagaaacatttccagttcctaatttgaggcattatgcctcaaatgaactatgaaggcaatctacacaagtactcagatgtcattaatgaaaaaggcaaacaatttgttcacatgtctaaatgaagatattaaataaactcaaacttttttttaaaaaacaagatggaattacttttggaaaagttgcttgcttttgattattggttacggcttccgaaaacaagtggaagcagcatccactgtacccaaatttgcatcaacctgagactgaaataattcctctgacaattattataatttctactgaaaacttttccttataccttttgtctcccattcttgatgacttagtgatgcaagctagaacctagccataataacctcctcaagatgttcgcatatgtttgttctggaagctattcaaaataaggtccatgattgtatattttattcactatggactataattcccatagctatagtgccttaactaagaattggggttcatagtctgatggaactatgaaaatactctaatatattccctagagttggtctctcagctaaatgtggaagatttagataattgagaattctacatctactttcaaaaggtaatgattaaagaaatccagaaatcttgactaagaattaattaaatccatgatggggaaaactaattattagaatacacttggaaataacacaaagtggtagcttaattttttatgaatttctttcctatttacagatattcccatacccatcatttgatcttatattttcaacttggtttacatttgtacattatttttatttgcactggctttttaaagtaagttaagtgacttgcaaatccagttacattaacaaaaatatcaaatatgataaatacattaatatcatttaaaactatttcttccctttgatttcttatacccaaacatttctaggtcttatcaattcttccttcactatatctctaccaaccatcactttcttttcatccctgcttccaaaattataatacaaaccttcaccatttcactcctagattattgtgacagccttctaatttagtattattcaaaatgtggcctgaagaccacttatttagaatctaacccttaacagggagattatgcgtcctctccagacttgctgaaccagaatctctggagtaaggttcaggaatcggcaattttaacaagctccttaggtggattttttttttcttttgagacaaaggggtcttgctctgttacccaggctggagtgccctggcgcaatcatggctcactgcagcttcaatgttgtggcctcaatcgatcctcccacttcagcatcccgagcagcgggattacaggcacacaccaccacttttgtatttttttgtagacatggagttttaccatgttgctcagccttgtctcaaacacctggactcaagcaatccacccacctcggcctcccaaagtgctgggattacgggtgtgacccactgcacctggcccttaggtggcacattaaagtcaagaaccactgttctgctttcttcctttctcgttctccctattttcaagaaattgtgcatatttctatctggttagtcattccaacatgctatccttgtcccctgtagaaaaccttcaatggttccccattattctcaggataaaatcccaatgtctaaacttgaaaataaaggacccacataaaatggtcagaaactacttctgaaatttcctaaagatgacaaacgaattcctagtttcatgcattttgaatgccccatatataccccccaccatcgtacttctctgcaacgtggaaaaacctctacttattcacttccaactcgttcaactccaaacacaaggcaatgtcaaatttttccatgctgccttcctcgatctttcctttttgggagctcatctactttattgttgctattattcatatggcagtttatcctagactgcctgtgccgcctcttgaattgtcatttaatttttaatgtgagtatgcctgtctcatttttgcacctgattgtgaagttcctgagtgtaagaacattttttgtattcaactattctcctagcatacctatagacaatgaataaataattttgaaatgattaaatcaatacaagattgacaaagtctctactgatttaacccattatttagttgatatggttcattgtttctgaattgcacatcgtctactttaacaaaaacagattttcttattttatgagcttacacctctctcatgttcacataccaaagagctataactacatccatgactacaaaattgatcccaaaccagacaaaatgcaagaaacagaagcatcagctactctggtctaaatgttgtatgaaaatcttgttggctgattcaagtgggagaaaagcttgaagttataagcatcattttgactgttttatacccagttgcacaatcaaaaagtgcctcatttatcagtccctgctctcaacacaacaaacagatgcttgtaatttgaattgtatgactctggtatcaccaccagacactagatccttgaaagcactttaacccttgatagttaaaataggatatttatctccctgcccccaaagaactccatgtcttaaatgtaaagtcagaatttacaatgcagtagaatccttggggtagggttaggatccacaaaacagactcccaggaactagacagtgaactaactgaaggattatcataggagtaaaactgtctttgtaaaagttataacagtgaaaaaattatgacagagaaagagatatgacctaacagattccatcttgcttttaacctccaagctgtccttattcattcctgggcataggccaaactaactttgggaagaatttagtttatagtttaactttgaaacaaagatgataatagccctttcccaaaacaaactcttttcttgcctggggaccagactggctgttgtaggactaacaaatttgccacaagattagaaattgcgatttaggaatcatgcatctagaggtcacaagattctaaaaatccccagttgctcctagggataacatcactattgtaaaacctaagattggtgcttgagatattttttggaccctgaactcgaaggatcagctggcaccacccagattgataaactggctcatctggtcttgtgtccctcacccaggaaccaactcagctcaagtggacagcttcaactccctatgatttcatctcccaccgaaccaatcagcactccctggcatcctatctaccaaattatccttaaaaaaccccagtctctgaattttcagagagactgatttgagtaataataagactctggtctcctgttcagcaggctctgcgtgaattaaactttttctattgcaattcgtttgttttgataaattggctctgtctgggcaggaggcaaaatgaacccactgggcagttacaggagcatcggttgacttaaagattggcttatccacctaccagaatctaatgtctgccatattaaacactttaaagcaattagagctgtcttactgagaacactttggacaataactgataaactatgtaactgaatgatcttttgatgaggtctaatttatactataattcattttttagatgtttaaagtaatgtattatggtaatgtataatgcacttagtttctatgaccaaaacataggaataatttctctgtttaaatggataatttattttttgtataaattataatgattttaaagccctataagactcacagttttgttattattatttaaattttcatagaatattctttttccaaacaataaagtacaaagggaggaggctttaaactaatagaaatttatgttcaaatcccaactctgcagctggcagtgtgagtctgaatgataattcctacatcaaaggactgtggtaaggatataataacacgtgaatgttgccgtctagttatttgtttgttatctgctccttccattagaaaccaatcccaatgacagaagagcctgatatatagtaggtgctcagaaatcatttgttgaatgaatatgatcagcttatttttctgataagaaaagatttaagctaatttttctatattttaatgtaactcaccttaaatacttgaggaaaatatttcccgggaaggaaaatgtcaagaggaagcagaaagcattcttgtctttcttctttcagatgcaggaaagtaagactgcacttggtgatgagatatgcatattatcaacaaattaattgtattgacaggtttatcaaagagtagtctggcaatgtcaaaaacaactgggcatataactctgaagacttacgacaattagatcagttaattttgtgtttttttaaatggcccatgatgtggctggtggaaagtctgtatttgttgggttgtacattcttaggccccctcatggtttttagtcactaatacaaatatgaaaagtaacaaggattacatcatgcatttattaaatacataattattgagcaccaactaattgccaggaaatgttccactcattggggatactgtggtgaacaaaacaatcaaggctgctaccctctgtatttaatgtaccatgatgaacaataacacataataaatctaaaaacaaacacttcagaaaggaaatagtgaggcatgttattctgaaaaataaaataagagatatgctagtaggtgactgaaggctgctttagattgggtgccagagaagacctccctgacaagtgttcttcaagctgagaactgaatgacatggaggaaccagaaatacaaacattggggaaaacatcatggaaggagcaataggctagtgtggcagccttgagaagtggctggcccagtttgaatgaccagatggtaagccattacagggaaaagaaaactaagccagcaattttccaagggcatgaggaatatttcattttttcttatttttatatggaaggtattggacaagataattgccaatgattattatatactaaaaaaattcagaaatctgtggtcaagatggttccttaatcccaacttaactatgaaacattgactctttcaagtcctttagtagaaaattcccaaagcttggggagttgcacttctggctgaatggggttgtaggtgtggcagttgttacaatgttctgtttagaaaagctaacagtaacacctttcatatatgtgagagctagacaaacatgtctaaattacacattcataagacttccattggagagagaaaaaggaagatatacaaaatttaatacatataaattaaagcttattttctttcactgtggtccaaaactttaattagaagagctttggtggaaataagtcaggtaattaatttttatgggattaaagatactaaatagtcatggtatagtaaatatagtatatttgtatttgtctacctcaggcataatatgtatatttctacttagaaattctgagttagaattgacatattaacttccacttaatgcaaatcaactgtgaaaatagcttatatatgctttaaatatttaatattttaaaatagtataaaatgtaatgaaataaacatgaaatatcaatgctagaatcaagaacaacagccttgaaggatgatcagagtaaaatcagggtttttttggcatgaaattgtagtttttaattgtagttttaatataatttgtgcactgctgtatccaatactgaaaaccatataataataaaaaccatcaaatcatatctctatttcaccttcttaaatatggtttaagaatagtctgggccaccttgagtagaatatgtacatttctctacagaaattctaagttgaaattgacatattgactcccacttgtgcaaacagctgttaaatgatatatttcatataacttatttatttaatacatatgaataactactacatgtcctaggtgctagactatggcacaaatattacaaaatccctgtcatccttaaagtagacaatagacaacaaattaatatacatattttatcaggtgataataagttctgtggagaaaaacaaagatggggggtggttaaggagcctgggaaaggtaaggagcctgggagagggaggtatgcaattttacaagatgtggtcaggaaagtcctctctgttgaggtgatttttgagcagagacctgagggaagctaggtaaatgcattacaggcagacaggattgtcaggacaaagtctgtggggcagggcaagacaactaggaggcctgtgtggctggagcaagttgagggagagatcagaaaagacaaagccaggaagatgtatgtgtgtgtgtgtgtgtgtgtgtgtgtgcatgtgcgtgtgtgtgtgtgtgtgtgtgtttgggggaagaggttttaactttgattcagaatgagatggaagcctttgacaggttttgagaagtgtgacatggtctgagttttattttaagaagatcatactctggctgccatgttgaaaacagacggtagaatggcaagtgtggagatacatatagcagattggaagctatttcaacaattaagaaagataactggcttggcccggcgtggaagaagtaggtaggagaaggggaagtatagttaaggcttggttataatttactgataggggtgtgtgtgtgtgtgtgtgtgtgtgtgtgtgtgtgtgtgtgtgtgtatgtgtgtaaaaggaaagaaaggaaaagaaattgaagatgtttggtcttagcaacccaaattatagtgcttctattgagtgaagtggggtttctggggaaggagcaggtttgaaggttgtaaatccagagtttgttttaagacagattaagttggagagaatctattaaagcttcaagtggagtacaaaaacatagtgtacttgtgtttgtctaccttgagtataatttgtacatttctctatagagattctgagttagagtggacatattaactctcttttgtggctgaagctggagaaatagatttgtgaattgtcagtcaatggatgaccagctagggcagaatggaacagtctgaggattgaattggacaaattagaaggaatcagaaaaggacactgaagaaaggtgagtccataggaagaagaatagaaatggtcccagaaaccaaggaaagagatggtgcaatcacaattaagagtactctaaagtttatattaataactgacattagttatttaagaggactcaacaacttgttgtggctacatattggagaacactgggaataagctttgtggcagctgtcagcttcagcagaccttggaaaggaaaatggtttgccttagttttacagtttgttttgagaaagaaaaccattcatttgtatcctttctaagttgcaatataaataactgtcattgttcttgtattcttcacaataatgtccattaaacatatatgtatcacatattttacctcactagggactaaggcattgcattatgtcaggattgtattacttttccctctcatattcgtgtcttactcttaataggaagtatgagtaaatcaggtatttttctaaaggtaattttcatttatttagaacacatttctttttggtgacataaattatcaggaacatcatcactccggaaaaaatacagtgggggttctcttgtacataatcctttgaaaataacattgaactaaacatgaaacatacatttatttctctgaaataatttctcttgaatatttctacaaaagtaatttttccccacatctgttattgtctttaatctcctagtccccagaactatctataaccaagttagttccattatttaatctctactcatcacaccacacaaaccccaaaatacgggtagtcagtcacaaaatataatctatgagaatgctttttttcctgaacttttatataatatttgaaggagaaaaggacaatggtggccctcccctgcaagctgtgcttcgcagcctgcctaatacaccaagacctaaggtaagtggaaaataatctatgcaacaagctcacatgtcatcaggaaatactaattagcattttctataacaacaaaacaaaggtgtgtgtatatacaaccgtattacaagaatgagctactctgcccttgacatattttaaccagtagctttattaatgtgagaaaagttttgaatttgctgccaagttcatgcaaaacaaaaaaaagtcccagacatacagtgaacaataagacatataataactctggtcaaaacatgtgccaactgcacttattaaaaggtaaactgtagggaaataagagtgttcccagggtaaaatcgatgcatttaataactagagtctgacaagccaatgcaatgtacatataatttggttttaaaacctacttaaaacaccatttaatcacattgttgtttcaccattaattgttaacactgatatgtttgaaatattttttaagagatggttctagatattggcaacatttagtaaatacttttaagagtcacagcatacattgggaatatagtattttttgcaaatctataaaactacatagattccttttttttttctttttgagacagagtctcactctaccatccaggctggagtgcaatggtgcaatctcacctcactgcaacctccacctcctgggttcaagcaattttcctgcctcagcctcccaagtagctgggaccacaggggtgcaccaccatgcccggctaatttttttttttttttttttttttttttttagtagagagggggtttcatcattttggccaggctggtcttgaactattggtctcaagtgatccatctgcctcgggctcccaaagtgctgggattacaggtgtgagccaccatgcccggccatccttcttgaagaagtctttcattacacggctggaggtcaaaggaggaagagaaaaactaatgtatagattgaattctactttgacatctacgactggctagcaaatttatgtagagcatgatactaatgaaaacaaagtcacaggcttgattctgatctgtgtcattaacctcattctgtttcatgtttccaagctgaactctaaccatcagcttgtgactcatggcttagctggtctcaatggggaacaaaccagagagtctatggatcaacacaaagctataactgcttcatgaaaagaactttgcagggcactgatcaccctctctgacaaatgaaggcaacttattacttaagagctacaagaggtagtgaaaggccagtaaactgtgatacagaagacctggactccaatcccaattttaggatccctaaatttataacctataatatatcaattaaactctctgacttttaatgtccttattcattatttcatattaatactcttctaacatagccctgaatatttagggcttcaaataatatgtgacttggttgctcttgtgttgtaagcttttagtacatacttgacacttgcttaataaaatatttgctgaacaaattgttaaaatgaatttgaaagactgaagcacattatttcaatgcaacttatttaatctaaaagaccatttgtaaacatttaatataacctaatattcttgtcaatatctttatagattttgttatataaaaatagattgtttattaaaataatatagaataaaatgttacgattgcatctctttttacaaactgctataaacatttaatgtaattaaaattagcttatatagaaaatccaaacacataatcagtttaaattcaatcagttgctaaaactagtgacctatagttttatactatacacaatcaattacacaaaaaagagaaaatttgtgggataaatttggagaaaaatagtattatatttaataatgataaaaatatataaccatcatttgaaataaaattattttctgttatggtttgaaagataaataacattaaaaaaataagctttatactcaagtcagttactggcacacttggactctgctttaaaaaagtgtatgtgtatatgtgtgtgtattttttttttaaagaggcacctgtttgtgcaatagttaaatgtcattcaaacaattatttaatgttgactacctgattatctggaaacctttcaaatgataccaaagcctgaaatagattttctttttgggatgtggcagacagatatcagggtaaccctcatgattctttcctcctggtattcacaactgtttatattttcctcatcttgaatatgggcaggaactttaagttgcttctaacaaataagatgtggcaaaagtgatgccctgtcactcttatgcttatgctatataaaatccagtcatactagcaaactcactctcttcctctcttgctggatttgaagaagcaggctgcttgttgtaaagggtctatggcgagggcaaggtagtagcgaactgaggatggcttctaagagctaatgtaacctctgatacgtaacctctgatataagtaacagccaccaagaagttgcgaccgtcagtcttgcggctgcaaggaaattaattctctcattatcatgagtgacctcaggagttgatccatcaccagtggtgcctccagatgaaaactgaaccctagtgaccttagattgcagccttgcagaggaccagctaggccatgcctagactcctgacccttggaaactgtgagatagtaagtgtgtgttgttttaacccagtaaatttttgaatagttgaaatattcaaggaagcaaaattattctgacaagaatattgcagactcaaaaatatatacatgtatacatagagatatgtaagtacaaacaaactggctttttgtggggagaacagatgaatttagttaaaacaaaaccttttttaaaaaaacaggttgattcaaattaaaaagtattgttctcgaattgataacagttggatagactcagcaaaatactccccaagcaggttggtaacgtcaagtctccttagtttatatccatgaaatagctaattgccaatgccagtctaagagttttagcctggatttaagatgtgtgcttaaagtaaggctatagaaatattctcagctcaagaatattattcagttttcaccttcctttctccaactacagtcattcttaggcaccaattaaaatgtgtaccatacaatctgcatggactttctaggaggtttattctttcattagatatgaaagaattccaggccctcattatcaaaaagtgggattaactgtatctgtactttatgcataaatggtcatccctatgtaggtaactactacccattctcaaattgaggtcagattcacatcctctaaaagccatatctgacattgttccatctaatctgatttagacactttttatcagtgcttgaagagcactccatgcaaaccactgaacctggtaatcatgcaccatctgttccttttcttccttcttgtgggaaagaccctccctatttttcttcggccctcaggtcagtgcctgccacaaagtagacactgaataaacatttgggaacttttatttttcaaattggttttacatgtatatgcgcatatattttaacctctcaaatgtccaaggaataatgtggcaaagattaatttggtctgttgagagaaagacagagcagatgctttgttataataacatagccctattattaaatgaggcatattatatatctatttcttctatgtacatggtaaattttaattaatattctctgataacaaaagatataagtatgaaatcttgaattgagattatgtaaaataaaatttattgtttaaatattttaaaatacactaaaaccataagtaaaatttagacaaaaccctaatgttgtgctagcaataacaatatatgctggggcattgatgaggctcatgaagaggcatatcttttttgtcttgtttctgatccagatgtaaccctgtcagctttaatgtcctatcccagttcacaactcacataactctgtatggctgcagataagaataccgaaattattaagctaattataaataacttataattcttatctctgccatttccaagcccattctccaaagtaaaataactgtatttctattacaaacactatttttgttctaatatattattctacaatcctgtggaaatgctgatgtgttgaatgtacaattctcctttaatgtaaattggctttgtggtattttatatttgcagctaaaaatatattggaaaaccttcttcagctgaaacagggagtattttttcgtctacctggctttgaactagcagtatgtaacatacagagttagttggaagatagtccttattatgaaatagtggttaggggaacagaccctggagccacattatccaggcttgaatcctggtcgtgtgacttttggtaagccacttaacttctctgaacttcagtttcttcatctggaaaggataataactttgtagggacacggatgaaactggaaaccatcattctgagcaaagtatagcaaggacagaaaaccaaacactgcatgttctcactcataggtgggaactgaacaatgagaacacttggacacaggaaggggaacatcacacactggggcctgtcatgtggtggggggaggggggagggggagggaaagcattaggagatatacctaatgtaaatgacgagttaatgggtgcagtaaaccaacatggcaatgtatacctatgtaacaaacctgcacgttgtgcacatgtaccctagaacttaaagtatattaaaaaaagtgtctacctcatagtgttggtgtgaacattaagtacggtaatgggtgtataatgctaagaatagtacctgccacataaaacatccttactaaatgttaactacttaattacctgtctcatacataagctctatgatgtcaatatttcaaagtgggcaggatattaagtgtaataattaaaaattattattattagggttgctaaaatataacatgtctaatgttcaaaataatttaggcaaaaaattaatgttttttgcaaactttttttaaaacacgaaaacagcataatggccattcatataatatgaacattattaagtagtgttaattctcattaaatataataaggcctaacatttgaaatcaaaagttgaggttattgagaatttcaacaaaagaaatgggatagatatgagtactacagtgccagatacgcaatattgatttatagaaaaaaaacatggactattaaatatatcactgatttttgttgtaaccatatcattgatttttgttgtttgaaatgtgatgttgatgatagtctcttgggtagattaattgctggttgctggttaaatactgtactcagacagtattgattaatagcttgagattaacctggaaacatgattcaaaggacatccagaattctaattttgcattttaaccaacaacctgggtgaagataaggaagtctggtttatcaattttgtgggtaacagggcaacatgttacagaataaaaattattttggaaaggcagagcaagatgaccaaatagaagcctccaccaatcatcctccttgtaggaatacaaaatttaacaatgatccacacaaaaaggtaccatctaagaaccaaaaatcaggtgagcaatctctgtacctggtttaagctatatatcagtgaaaaaggcactgaagagggtaggaaagaaagtcttgaatggccgatgccacccctcccccatgcgtcagcagtggccacgtggcacagagagtgaatctttgtgctcgggggagggagagtgcagcgactgggggactttgctttggaactcagtgctgccctgtcacagtggaaagcaacactgggcagaactcagctagcgccagtggagggagaatatagaccagccctagccagagtgaaattgcccattccagcagtcagaatctgaaatccagcaagcctcactgccataagttaaagtgttctggggtactaaataaacttgaacgacagtctaagccacaaagactgaaattcctgggcaagtactgatgctgggatgggtttagaattagtgtttatgggggacatgtgacctagtgagacactagcaggggcagccaaaggagtgcttgtgccaccccacccccaaccctaggcagagcagcttgcagctgcaggtgagactccttccctccacctaaggagaggagagggaagagtagaggcctttgtcttgcaatttggataccagcttatccatggtaggatagggcaaaaggcagagtcatgagcccaccattacaggccttacctcctggatgacatttttagaaataccctggaccaaaagggaacctgctgccttgaagggaaggaagcagtcctggcagcattcatcatctgctgactaaagagcccttggcccctgaataatcagcagcaatagccaggtggtactcactgtgggcctggggtgagactgagaaatgctggcttcaggtgtgacccagaacattcccagctgtagtagttatgggaaaagactgcttctgcttgagaaaaggagaaagaagggtaaagaggactttgtcttttagcttaggctccagctcagccacagtagggtagagtaccaagcaggcccttgggatctcccattccaggccctggctctcggacagcagttatgaacctgccctcagcaaaagggtagcccactgctctgaagggagaatctcaggcctggtttcacttaccacaagctgactgaagagctactggatcttgagtaaacactggcagtagccaggcagcacttgccataggtctagggtggtggtagcctcagggaaagtctcctctgcttttagaaaagggagggaagaacggggaggtctttgtcttatagctttggtgccaggtcagtcacgtaaaatagaacaccaggtagcttcttaagatttctcacttcaggtcctggctcccatatggcatctctggattctcctagggcaaaggggaacttgatgtcctgaagggacagatacaagccttgttggctatgctacctgctgattgtagagccttaggaccttgagcaaacatatgcagtagccaggtactggtcattgcaggccttgagagagatccaatgctgtgttggcttcaggtctgacccagcgccatcccagtggtggtggccacaagggtgctagtgtcacccctccccaagctccaggtagctcaagacagagagagagacagaccccatttgtttggtagaaagtaaaagaagaggacaagaatctctgcctagtaatccagagaattcttctggatcttattcaagaacaccaagcggggacacctccatgggtcagcaagagccatggcattactggtcttggggtgccccctaatgcagacatagctgcagtgaacaaaaacttagatcacaatatccaagtctctttgaaaacctggaaaaccatcccaagaaaggcaggtacaaacaagcccaggctgcaaagactacactaaatacttaactcttcaacgcccagacactgatgaacacgcacaagcatcaagaccaccaaggaaaacgtgatctcaccaaacaaattaaataaggctccagtgaccaatcctggaaagacagagatgtgtcctctcaaacagaaaattcaaaatagctgttttgagaaaactcagtgaaactcaagataatacagagaaagaagtcagaatgctatcagataaatttaacaaatagattgaaataaaaagaatcaggcagaaattctgtagttgaaaagtgtaatttacatgcatcagagtctcttaatggcagaattatcaaggagaaaacagaattagtgagcttaaagacaggttatttgaaagtacacagtcagaagagacaaaagaaagaaaaacaaacaaacaaaaatgaaacacaagctcaagatctagaaaatagcctctgaagggcaaatctaagagttattggccctaaagagaaggtggagagagacatagggataaaaagtgtattcaaagggataataacagagaacttcccaaagctagggaattatatcaatattcaagtacaagaaggttatagaacaccaagcagatttaacccaaagaagactacctcaaggcatttaataatcaaactcccaaaggtcaaagataaagaaaggactctaaaagcaacaggagaaaataaacaaataatatatagtggcgctccaaaatgtctgacagcagagagtggtatgacatacacaaagtgtggaaaaaaaaaaaaaaaagatctcacctcttattctagaatagtatatccagcaaaaatatccttcatgcatggagatataaagactttctgagacaagcaaaagttgatatgtcatcaacaacagacctgtcctataagaaatgctaaagggatttcttaagaaaaggacattaatgagcaataagaatcaattaaaaatacaaaactcactgatgatagtaaatatgcagagaaacgcaggatagtataacattataattgcgatgtttaaactactaatatcttgagtagaaagactaaaagacaaaccaatcaaaaataataactacagccaggcatagtggctcatgtctctaatcccagcactttgggaggctgaagcgggcagatcacgaggtcaggagattgagaccatcctggctaacatggtgaaaccccgtctctactaaaaatacaaaaaattagctgggtgtggtggtgggcgcctgtagtcccagctactcaggaggctgaggcaggagaatggcgtgaacccaggaggcagagcttgcagtgagccaagatcacgccactgcactccagcctgggcaacagagcgagactgcatctcaaaaaaaaaagaaacaatgaaagttaaaaagtagaaagtaggaggacaaagtaaaagtgtaaaattattacttttctctttccttgtctgtttgtttatgcaatcagttttaatttgtcgtcagcttaaaataatcagttatgatatgatatttctaaaccttgtagtaacctcaaatcaaaaaacatacaactgatacacaaaaaataaaattcaagaaattaaaaacatactagcagagaaaatcacctttactaaaatgaagacaggaaggaaggaaagaagaaagaagaaaacaaagcaaccagaaaacaacaaaatggcagagtaagttctttcttaccaatgctaatattgaatatcaatggactaaactccccagtaaatacacagagtagttgaatggataaaacaacaggacccaacaatctgttgcctacaagaaatgcacttcgctgataaagacacacatgtactgaaaataaagggatagataaatatattccacgtaaatggaaaccaaaaaagaacaggaatagttacagttatatcagacaaaataaatttcaggacaaaaactataaaaagagactacatggtcactatataaggataaaagggtcaattcagcaagaagatataagaattgtaaatatatatgcactcaacactagagcatccacatatataaagcaaatattattagagctagagagagaggtagaccccaatacaataatagctggagagttcaacactccactttcagcattggacacatcatttagacaggagttcaacaaagaaacatcggacttgatcagcatgatagaccaaatggaactaatagatatttacagaagatttcatcaatggctgcagaatacatatttttttcctcagcacatgaatcagtcttaaggatagaccacatgttaggccacaaaataagtcttaaaacattaaaaaaaattgaaataatagaaagtatcttctctgaccacaatagaacaaaactagaaatcaataagaggaattttggaaactaaacaaacacatagaaattaaacaatatgctcctgaatgagcagtgagtcaatgaggaaattaaggaaattgaaacatttcttgaaacaaatggttatggaaacagaaacataccaaaacctaacgggtacagttgcaagcagtaataagagggcagtttataccctatatcaaaaaaagaagaaaaacttcaaaaacaaaaaaccctaatgatgcacctgaaagaactagaaaagcaagatcaaaccaaaccaaaaacgagcagaagaaaaggaatgatcaagatcagtgcagaagtaaatgaaattgaaatgaagaaaacaatacaaaggatcagtgaaataaaaagttgattttttgaaaagataaacaaaattgacaaacctttagccagactctgacaggatttttctaacatagcatcttaataagaagacacaaataaataaaatcagagatgaagaagggtacattacaactgatactgctgaaattagaagtatcattagaggctactataagcaactacatggcagtaaattggaaaagctagaagaaatgaataaattcctagacacatacaacctaccaagattgaaccatgaagtccaaaatccaaatagaccaatagtaagtaatgagatcaaagtaataataaacagtctcccagcaaagaaaagcccaggatctgatggcctcactgctgcattttaccaaacatttaaagaagtaataccaattttcccaatttattctgaaaaatagaagaggagagaatacttccaaacacattctatgaggtatgggagcatggaaaaaggagagtttgtcttcagcttacatagaccaaaacacatgaactaaaggaagagtggaatttagcttgtttatgatgcttctgcatttgagtgtttgagctgcagtttctcttgactaatagtattctctccatgctcttctttactccatgacacacttttacctcaacttctaacatttcctctattttctttctctcttttgtttcttaagacatctttcaagacccagttcactttttctctcaaatgcaaagcttgggcctcctttaattttcctcctctctcctcccagacctaggaggttaaattaatatagtgtgaatgtgacgaataacatcctgcattcttgtactagaataaaaactggtaaccagacaaagcacactgcagcatagtttgaaaatacccatgtggatatatttgcatatactgaaagaacatatactaaattctcatactttaagaagacacatgtgaataagaacatcaacaaagtgtactgttcatctccattaacaagaaatcttggaacttggtatttttttccttcacagacagcttgacttggtttgattcaagtgctgctttctgaattcagtgcaggtgctaattagtacgaaggcacataaatctagagaggaaggtaaatgggaaacatatggaaacagaaatgtaaccaaaagttctttttgatgatatacatggttcaacaagttttaaaacaaaactgcaagctgatggatggtaatattctacatcacttatactgaaacaaagctgccaatgtgattgtctagttgttcactacttgaatatttataaagtttacagttcacatgtggcatttccataagctgccttgattaatgaatttaattgtaaatgttatgagctgatttcttaaactgtatttcattttgtttatatgcttggtgtaaaagtaaattttcagactgaataatacccagcagatttgaatcagggacaaagctctcaagctgcgtggtgtgagcagtgcatagtgaatgtggctgcacagcaagtattgtgtttggccaaagtaaatatggggctcagtgccagatttcctgagccagtctaggccccgagttcacccaaaaattcattcaggggacttcttaaacaatcaccaaggccagacattaaaatgaaagacatttgaaactctcctccaaggacagttctttgggcacacagaatctgatggagagggagtttcaacaagttttgagcttttaaacagtagaaaaggataaaggaagaaagtaataggggaggctgaggtgggcagatgacctgaggtcaggagtttgagaccagcctggccaacatcctgagacaccgtctctaccgaaaatacaaaaattagccaggtgtggtggtgcgcgcctataatcccagctagtcggggggctgagacaggagaatcacttgaacccaggcggtggaggtcgcagtgagccgagattgtgcctctgcactccagcctgggcaacacagtgagactccatctcaaaaaaaagaaaaagaaaaagaaaataatggaagtaacttactggtcaccttccccagccccctgggtatctattttgtcttgcaaaaagatgaaatagaacaaatatggtattgattctgggccactaatctcctgtcctactcctgggactacctgttattactctctctgtatatatctctctttatattttcttataactgttgacagccccaaagttccagaccttaaaatgctccatttctatatattagaaatttctatatattagaaatttctatatattctatatacatatatattctatatatccatttctatatattagatcatatatatatccctactcatttctgcaattatcatccccaaatcagagcaaagtccattaatttaatggacattaacattttttgctgtagtaaaaagggcttaaataaggattcttttctgagtcataaaaaattagatgtacttaaagattttcaatatatgtgtgtgtgtgttatgtgtgtgtgtgtctctctctatatataattttgacttaatctgcaaatgcagcagttttgcatgtacacaggtgaagatgaatttccttttataacttttactacatgtcatccatactagtttagcttagtataagcaagaaaagtataatattgtagacatttacacaattcacttcattctccctgtccttaggtaatttatgatatcagctttagcaatctctgaggaacccaatctacacccttttcaattttaaaaaatactcacttattcccacttttttaaaaaaaccaatttctctgcctctcaaaacataggtgttcacacctatttcattttgattcaactttaaaaagtagcctttggtacaaaacttttgagttatttaaggatgtggtatctacagtctttttttttttaattcaaaattggtttgctctttatcccaaagaatccaaaaagctaaacatcatgttctctttggatgttattttctataatatgttaagtgtctgaaaatgtgaaaaatttaagcaagcacacaggcacttggttaataaagtgggaatgtgttcatctgtgaaatacttcttatacatacttatttccatcatatttggagaggatttttctaacacagcatcttaatggattattagtagacctgactctaggcttagttactgcctaagacaagcccaccttacaaaagaggcttgggcacctcttcccagggaaaatgcttcctttcaaagttaatgaacaaggaagctctagctgtctctggaaaccataatgtaagtttgagcagtgcaatcacgtagtcttgaaaaaatgttagcttcatgcaaatataatcttcatgcctagagcatctctgaccaaagtatagtgagccctagtctcaaggtacctgttagtggattaaaaatcggccccatcgcctgtagtcccagctactcgggaggctgaggcaggagaatggcgtgaacccgggaggcggagcttgcagtgagccgagatcgtgccactgcacttccagtctgggcaacagagcgagactccgtctccaaaaaaaaaaaaaaaaaaaaaaaccggccccataacatatatgtccatctggaacctgtaaatgtgaacttatttggaaaaaggatctttgcagatgtaattcaattaaggatctcaaggtgaaatcatcctggattagggtggagtttaaatccaatgataagtgcccttagaagagaacagaagaagtgaagagaatcagagagagaaaaagaccatgtactgatggagatctctacttccatcaactcagattggagttatgatgccacaagttaaggaatgcctggaatcaacagaagcaaggagagaggcaaggaaaggactctttcctaaagtctccagaaccaacaagtcctgctaacaccttgattttaggcttctgacctccagagctgtgagagaataaatttctgttgttttaaaccacccagcttacagtcatttgttaaagaatccttaggaaactaatatagaatcaatcttaaatgagggctcagctcttccagtggtgtctgtgctaagaaaggggaagaaaaccaggcagagtaggggccccattgctcaaggagagaaacttattcccactgtctttttaaagagaagcaggaattttttatttagagtcattgaaagaaatgattgtttgaaacaataatacgcagaggtatgactattgccagaaatgattgtttcaaacaataatatgcagtggtatgagtaaacaaactttcatcttgtatattaaagtactggtaattttaggcttcaagctagaaaaaaatattcaggattacagtgattgtaataaaaatatgaaagatttctaatattctggggattcttgtctctcccttttgaaagctttcaaggaaaacaaatactgcattgaaaaaaatgttccatatttattttactatttatgaattaaacaatgttgggacaatatgaattttaatcaaagcaatacttttcaagaagagagaactgtacaaactatttatcttttccattttgtctatcaacatgtttggacaatgaaaactttacatatgtaattttaaagtttaaattatgcttatgaccatttcatgtaagtttctttcaaaatagtatttgttttaaggctttatttgttatataaaagagtaaaatagtgctacaaaaatttgtgtatgttgattaatttggtttacatgctgcctagtccattttctgttgcttataacagaatacctgaaactttcttacagttacggaggctaagaaatctaaggtcaaggggctgcatctggtgagcaccttcttgctggtggggaccctccacagagtccaaagttggcacaaggtttcacatggcaaggggactgagcatgccagctcaggtctctcttcctctccttccagtcccaatcccatgaaaacctattaatccagaaatcaattaatctattcttgagagcagaaccctcatgacccaatcacctcttaaaggtctcacttctctatactgacacttttcttcttcttcttttttttttttttttttcttttttgagacggagtctcactctgtcgcccaggctggagtgcagtggtgcaatctcagctcactgcaagctccgcctcccaggttcacaccattctcctgcctcagcctcctgagtagctaggactacaggcacctgccaccatacccggctaattttttgtgattttagcagagatggggtttcaccgtgttagccaggatggtcttgatctcctgacctcgtaatctgcccgccttggcctcccaaagtgctgggattacaggcctgagccactgtggggcgcggccatggattaaatcttaacatgagttttagagaagacaaatattcaagccatggcacatatgcctttctgatcctgccatacactctaaacagcattaaaaggtattttacttttagaaaccatccacattcaggtaggtcaagtgttaaaagcatagccatcacgacttttatgatagtataaatagaaaataggatttttataacttaagttgtctcctgtcaaaaatgcagttcaactcaacagataatgtattgagcactgactataccaacaaagaaataaacatgttatggtcacaattattaaggagctttctacctaaagtggcaggaggagtctctgagggataatagagagagctgacattcactgacagttttctactttgcaactcttgtttactaatttcatatgcaccattacatttaatcctaataaaaatcataaagtagctactattagtaagttcatttgcttagctactattattaagtcctcaggtgaggaaactgaggcagagtggggttaagtaacctgcctaaggtccaaagtaagtggtaatctgactttcaagtttgtactttgtacttcaagccatcacactgtaaagacctccccaccatcatcagtaaccaaagattgtgataaatgattttatttctatgcactaggaacacagaggaggaaatgatgatttatcccaacttggaggaatctggaaagtcggtagataccaaatcgattctacactggacttagaaagacagagagaaaattcatacatggagggaaacatttcagatgaagagattagtcaacaaaattgggaaatctataaagaatatttccctagaaaatttctgtgcaattttagaacataaggaaaatttctacattccaatttttgccacctatctgtcatccccagggagcagctaaccctttagaaatggtgaaatctcccttttctggggcagcaacaggcttctggagccataccaaaacactatgggactcagaagttttgaggtggctatctggtctcctgcaccattgctttgaaataggattcagaaaatttgtagctggaacaccttgtactgcacacttaatgcctcaaattcaagtgattttcctcaggttcaaagtcctgaccctgctcagattaattcagtggatttgattgctagcactaaggcagaggaaaacattacagtttgagaagatacttccataattattgatatgtctctaaactaatgtgtcatttactcttaacgctgaaagttttaaagtcgtgatttcctatctctgttcaattaagggtagaacactatggaaatgtcttcagagtaaacatgatgttgagaaagaaatcatagcatcaaacagcttttggaatcctacagtgaaacactatactcactttaaagtttgaaaaagctcaatggagtaatcttttagcattcaacagacattttaaacttgtactgagagcagggctcctactatgtgccaagactctaactaaatgattttatagaaattatctatgtcctcacacttatgtgaggtagctattcttacattcatttgataggtcaggaaacaggattcctaagaaaataacttgcttaaagtcccctaactcacacatgatagattaaggaattgaactctcttttcttccatattgtaattaacaaaaatgtttgaagctatatgattcttcccttaaaacgttttctagatagatgtaaaaggagatatatatatatatatatattaataagcattcatataaaagataataattttgcgcattttatggggctgccattatgcaaattagttaacttttggctggttgacccaagacaactgcaggactgcagaattcctctgagagactgaagtgctatcaagcttaggaaaacacttaaaaacctatttgattatagaaggtgagggttttctttttctttttattttttttgagacagagtctcaatctatcctccaggctggagtgcagtggtaccatctcagctcactgcaacttccgcctcccaggctcaaacgattctcctgccccagcctccaggcactggccaccatacctggctaatttttgtatttttagtagagacagggttttaccatgttggccaggctggtctcaaactcttgacttcaggtgatccgcccaccttggcctctcaaagcgctggaaagtttaaacagtaacaaaagaggggaaattactgcataacgaagtaaaaggcattgagttttgtcatttttgtgagggttatgatactggtagaagagatgcaagaggaagtatctggaggtgaggagttctgtgtccatggacagacttggtcagggagtgtctgatacatgtctaagggctgtggttctatcactctaattccagttgattcctgcttctgctataattgccctgcataatccccaaaactttcaataaaattttattactgacaacaacctgctgtgagtggtgtttggaggaataatggagaagagatggagccttgaagtttcagatagtggcagatatttgcatagatctataatatatagtgcagcatgggctgtcttctaaatagcaaagaatatgcattatagcagtgcagaggagggaccaatcactttcaggtaagggattagagaatataccacaaaagttgtagcatttcgtgtaggccttaaaagatatgcaacatttgaataagcaaagattggtacgagatctttagattcagagtgaaatggcatggaggttgggagtttccaggcacattctggaaacaggattcaggcaaacttaagtcaaccacatatttaaaagcaatggaagatataggtacaaaaaaatattgaagttggagagacgacaattttcaatgtcagaataaagagttaaaaatttattccaccgtaaatataatcactgaaaattttgataaagggaacaatataacctggtggttgtgggcagatggcttggggcctaacagtaagaagtatatgaattctggtttttgacatgttgagtttaaagggctgtgaggtcataagtatccaatccattgggcatagaagaataaaacttagaaaagactttggaatgaaagacactgatgcagaagtgtatagagagctgaatttaatgtttgaatatgtggcagtggatgggagttcccaaggagaagaaagtaagagagatgagaaaatgtcagagaacaggatttgggcatgacttaggggttgagaaatggagactcaagacagtaaaagtcagaaaacaaggagagctttttaggaaggttgaggtgatttaatgtgttatggaagataaaaactgaaaaaagtcagaggagtactacttcctcatttgataaaaaaggggtaaaaaataaagacattgtgaatgatttaggaatacacaacatacagagaaatgaaccgaagcattttaagtttaaaatgtgtgtaattcaattcttgcaaagttggcttttaatttattttccctttgtattaaagaagtttgcatccagaacacattttagtgaatacaaaaatgggtagataaaaacaaaaatagcaaaaaatctttaagtcactattgctaaaaccaactatatccttgttacttaaagagtagtctgaggaccagcagatttagcatcgtttaggagcttgttagaaatgcagcacttcatccatgtccctacaaaggacatgaactcatcattttttatggctgcatagtattccatggtgtatatgtgccacattttcttaatccagtctatcattggtggacatttgggttggttccaagtctttgctattgtgaatagtgccacaataaacatacctgtgcatgtgtctttatagcagcatgttttataatcctttgggtatatacccagtaacagaatggctgggtcaaatggtatttctagttctagatccctgaggaattgccacactgacttccatgatggttgaactagtttacagtcccaccaacggtgtaaaccatcattctcagcaaactatcgcaaggacaaaaaaccaaacaccgcatgttctcactcataggtgggaattgaacaatgagaacacatggacacgggaaggggaacattacacaccggggcctgttgtggggtagggggaagggggagggatagcattaggagatatacctaatgttaaatgacgagttaatgggtgcagcacaccaacgtggcacgtgtatacatatgtaactaacctgcatgttgtgcacatgtaccctaaaacttaaagtctaaaaaaaaagaaaagaaatgcagcacttcagtcccattctagactccctgatcagcatctgaattttaatgtgatcctcaggtgattcatttattaatgtttgagaagcactgctgcacaaaatactattttgtcatacatataagcttaatgatatacatgatatgatacatgagatgttcaataatctgtctatagattcctgccttcacattgtgagataataactgggttctgagactggattttagtgctcaggtctgccactccatagctgtgagaaaaatctcactctcccatctttcagtttcattgcaaaagcagtagtcacatccaatcctatattgttattttaaataaatcatgtttaagggatatggcccctgctccttagaatctgtaatgtaacattgacatcatgatagggagaaagacactcatggcatatattaaataaaagcaaaatgcacaatgcatgtatcttttaatgacaaaataaagataagaatggcttagaaaaaacatttttagagttccaaggttgaggagaaactgctattatttgttcctccatcatgtagttcaaagttttctggagagaatagtctcttacttaatgcaaaagaggaagctcagcaaacctctaatgatggcagtaaatagcatatttggaatgcttactacctggcagatgaattgtcatgcatatctcctttaatcctcacaacaacctgaagagacaagcagcactagttatcatccccatttacagataggaaaatggaggcttagatacattagtcactggctcaaggtaatagagtttacaagaggtggaactgaaatccaaaccaggtctgtcaaacatggaaagtagaattcttaagtatcctcaatgaggaattagagatagacataaaataatatatacgctaacatatatggacataaaataatataaactaacatatattaaatccttgtaaacacactatcatataggcactgttattatccctgctttataggtgagtgtattagtcagcttaggttgtcataacaaaataccatagaatgggtagttaaacaacatttattttctcacagttctagaggctgcaagtctgagatctgtgtgtcagcatggtcaggttctggtgaagactcttttccagtttgcagatagctaccttctcactgtgtcctcacaaggactttccctggtgcaggcaagtagagaaagaaaaagagaaaactcttccccttcttataaggccactaatcctattgaattaagaccctacatttatgacttcatttaactttacctcctaaaggccctctctcctcacacagttgcctcaacatttgaatttggggggaacacaaatctgtccatagcagtaagaatcactatccaagaatgattacataactttctcaaggtcacacagtggtgaatgatggagtttcaatttgaatcatggcaggctggctcaagagaccatacttagctgcgatcttatgcttcctctaaggatcaatgaaaagagggcatattaggtatgacatagctgtctccattaacggtttctctctactcaatactttattgtgatttcttgtttaacaacgtgcttttattccaatctaatttcctcccaaattatctgttttctattagtggaactgtaacagcatgacttttccttttccaaaaccagtacaactaacaaatgtaacatgggagaaaataggctaaattgtattgactacgtgctattagcttctagggacagatttattaaatagcacccttcaattgcattcaggttttcagaaaacctattattctataccatccttcactttgtatcattgctaagggtctcttcactcagttaagtcactagaagtgccaattaaaggtgaaattaaggaagctcagttcacacacttgcagggacactggtgtttacctgctaatggatagacaatgggctgaaaagagggattaaagcagtttttattttcttaagtcagatccagctctttctggactgcatatcaaccaatacagcctggaattttaaaaatgaagaatatgcaatccagccaagatgacctatatgtctaaaaccatatgctgaactgcttactccaaggatatttctacattataggccaaaaaggcttcagacagaagcatggatatgctaataatcaggtctgccactctaatcatctcctctggttccttgacacacatcctccacttcaaggaggctgatcactcctcactgccctgggcacacgttcatacatacttcttgattatgtttattttgtctttcctgctagcaaggcctacccattcaatctgtccaaatttcatctttcagcctcgttcaattattaaatatcatatcctcttgaatttttctgtcagcccttcagattcaattttaactttaatcacatacagctctacattaaaatgtcagtaaggagacttctactggtcacatgtatctaattcttctttcctcctcaatgcatgagatgattacctatttcccctttacaaatgggcaggaccatgagactagttatggccaatggattgtatatgaagataaagtatgtcatttcctagctggaatatttaattgccagagtgaaacccttcttaacttctcttctgctggactttgaaaatagacaatattccaagtggtagcctccgtcagccaaggtctgtaataaagatgaggtagggcggagtatcctgttaaagcacaagaatgcagtgtgcacaagaaataagcctttttggtgtaagccaccaaaattgatgagtgtagctatgtgtgtgtgtagtaaggagtgttaatatagttgaacctaacttattctaactaaagtatcttctgctttgagattatatattttatgcttctaagggtcttcatttattctacactcaacaaatatttatcagagcacctactgtgggtcagtgaatggcctaggcactgaggacacaatggcaagcaaaacatataaagcccttgagctaatggtgattatatctagtgaggaagataaatgcactccaaataattacatgaataaatacaaattttaaaccaaagtcagtgccttgaagaaaaaatacatctgacctcgtgaggaggactgtgctgaggtgtcagagaaggcctttctgaggaagagatttctgagcggtgttacaaagacaaacgaagggcaaattaggtaaagtctggcaggggtgaggagaagagtatttcaggtagaggatgcagcaggtctgcatgttttcaggcagtggggagcataactaatgtgaaggaaggaaggaaagcagacgggggtacctaactgtagaggaccttgtaggccaacctaaggattgtgaactttatcctaagagaaaatggaatggaagcgacggaagaatttaaagatggtagaaagagggtatcatcacaccttcactgtgacatggggaagttccctctcaagtttagcttctaatataaaaactcatgacaccaattctttggtatgatcagagaaggatttttattactcatacaagtggacagtcccatatcaaggaatggggaccagctctctggaaggaagtccataacagagagagaaagagcatagggtgcacaggccttttatgagagaagtccctctggtggcacctggaagagacaactagagaacccccgcacttggagggtgaggaggctgtgctttatcatggagcttcaggaagtgacagatccaggcatgaaatgaggtttagaggttactagcatcaactcaagcaccacaggagtttcggtttctttcctatggtctccatagaagaagggggaggcacataccatgattagatttgaatttcaaaggattttttctggctacagtgtagagattagattggataccagttaggagggtgctcctaatttgggcaccagataggagacttgtgcagtaatccatgtgagagatgatggcagattacactacagtactggtggtggaggtagagagaggaggacacaaacgaaaggtatttaaatgggtttggttttcaatatgatggggtggggtgataagcagggagctgttagagatttatctcagagttttgattttgaaagtagatgtttgatggtatcattcactgaaatagagaacactgggagatagagggagttaatttttggtagtatttaatcaaaagtgcctttgagacatatggatagagatttcaaaaaggctgaatgatacacaggtccggagctcagagggaaggcctaagttgaagataaaatgtgtgagtcctgtatacatgacagggaattaaaactaggtgtagagatattaacttgagaaaaaataggtggatctatgacttgagggacttgaacatttagaggacatgacacattgcacactggctgcattcattctcctctccatctctctattaaatccaacatctgggtccctctcacccatagtttctgccatctggttcttttatcctgtgtatgggttatattttttgtttctttccatgctttgtgatctttggttggaaagtggatattgcagataatatactgtagcaactcttcttactccccctaccaccacccagggcttgctattattctttggttgtttagtgaggggctggattattttaataagtatatttccttcacagtcaggtgagttaatttccctcagttaagtcactgagtttgctatcagggaggtacatctttgggtatgtccacagacagcccagccggcatgagagtgatgttcgtgtgattgtccttcactctttccttaaccacattcagctgttcaactccactaattggtgaacaattgctgtgttattttcaacagtgctttacaaccttatattgttcaacacactaatacaatcgaattgtgtctcctttgaagaaatagttcgaagtcagggctcctcccagctgtgttatttctctggttctctcctgcaaactagtctgcaatttagcctgtatcttgactctcctcccaattgcctttcaccatagcttccactgttcttgagcgcactctaaggcttgaacttttccatactttgttgcaaatgaagccatgccctttgggaagagattaagaatatttattttatgatggattattgcccccgccaccaccaggcaaaatctctaagccatgtttctcaagatggaggtggagaaaatggagaggttcttcctgcatgactgcatgaaactcccactctaggagcttagcttagttgggaggtggcagcactctaatatcttctatatttatctctcctggtgtggaacccccacctcaggaggccaggcaaggatgatgaggcctctgtattcttagcatgcagtgcctaaggtatcccctccattcaatgatgggggatttggcaggggaggaagcccctacctctctactgtattcaccagagcttagccttagcaatgggtaactatggccaggatgagaaacactgaagttctgttccttccaggaagaaaccttccagctggaggggagagagctctgtgttcttgattgcaccagcctggaatggaagctccatctccctgaacttggaagggggtgagagggagcagtcttggtttaaataccacaggcttgcctttcttattgaattttcataaatgttcttgaatagatgtttcttcatttgctatttgtccttaggatcatttccagaggatttaagtgcttggagtttttatttgtttgatcatagttttcactagttttactggggagtgggttaaaggaagccctcaagatgttatgccaaaagtcttctctctctgtatttctgccttcagtaggctcttcccatgtgactctgggcattggccaagagagtgctagcaaatgtgatataagcaaaagcttaagaaaagcttgctctgtgaggtttgccctctgtcagcatggaagccctttaatcagcatttgaaaaagtctgagctagtgtcctggacacagtgagagaatatggtaagaaagtggagagaaaggctgcagctattccaggagacccaggcttcacagatcaagccgagagagaatagtgtcagaggagccaggagaagaacacacttcaaattgtgagaaatcaaggaagagaagaattgcaatattcattacatttagaactatccaggttattgttcttcttactaaaaatgattttattggtaaaatgggaacaagagacagactagaataggatcggctgtgatagggaagtgaggaatatagctagagagaataggcaaaactgggcaagtgtggctttgcaagggagacaagagatgaggcagtcattagaatagtggttcctaactggggtggggggtgggcatctttccaggagatatttggcaatgtctagagacaactttgattgccacaacttgtggggcgagggacacaatattttcatgggtaaagaatgctgctaaatatcccaaaacgcacagaacagccccaaagtaaagaattatctagccccaaacgtcaagagaaaccctaacatagggaaataagtggttgaaggtgaggtttttgttttgtttgtttttaatgcagaagacacttgaatgtattttgagtctcatggaaagtatctagttgagagaaaggttaaaggtacagaagagaaaggtgtaattttccaaaggtaacaattattattattattatccttttttttttacagatgaggagactgagagggtaagtgattagtcccaggtgaagaaggcagtggagctcagattccaatgttggcctatttgactgcaggccaagttgctaaaggagttctttgtccttctgctgtactcccaacacaatggcatcaataccaaaaacacacccaagctaatatcatagatatctcttactcaccttctaaactctctactcttccatcagacccacattttctttattgaaccaccttattagcttattgttaagtctgagtgtatcatttagggaagagaccttcacttatagtttaggtttcaatcctcagtaccatttgtagccatttggcttctgcataatttcctctttgagactcatctgtctaaagatttcacctctgcttagccgcgcctttccttgaaatactctgcagttccagcaactgacagctcgtgcgggcagcactgaaaaatggaccaacccaattgaaagctgaactctctcctgaatctggttctggactctgacccttttttaggtgttccaattgttccctgcccctaaggaatgagattgcagaattccaaacactaccatttttcaatatctaagtcctttaattgtgcagtaacaataaccgtgcagttagaggagtgccctagaagcacttatactataccccagggactattatggcagacgaagggaagcaagaagatgaatggcaaatgaggaaatgcagggaggaaaggtcacttggagccaaacaatgcactaaaatgctgacatatctatgcaaagaacttttacaacctatacccatgaggcacaaacagatccttaaagtgtccagggaatgtcaaccttcctttcaggaaatttgtctcaactcagaggagactaaggaagtgttaacttaatgccgtggagtcaagtgtggaagattaagaagagtcatgtgtctgctttgttgctttaacagattctgtacctgagctatttttaaaatttctttgaatacatttcatgaactcctttttctatttattccagcttttgatacttttccatctgataaaattttgcattaggattgtatctgggcatactttaggattgtatctgggcatgctttttttttgtttttgttcgtttgtttgtttgttgttttgagacggagtctcgctctgtcgcccagtctgtagtgcagtggcgccatctcggctaactgcaagctccgcctccggggttgacgccattctcctgcctcacctcccgagtagctgggattacacgcccccaccaccacgcccggctaattttttgtatttttagtagagacagggtttcaccgtgttagccacaatggtctcgatctcctgacctcatgatctgcccaccttggcctcccaaagtgctgggattacaggcgtgagccaccgcacccagcagtatctgggcatgcttttaaacaacccagtgcaattcaccctttacttaatgatgaaggtatccttcagcactaacccctcatggacttgaggtatttctccttcctccctgccatcttcctttcccctttctactatctccttttctcttcttcctctatacctactttccctcttcctgctcttcctccttccctccatcttaatcttctttactctgcagtcttcgcagaatttaaactctgatgtgtttaaacccaaatctcacaaagaatatagactatataaagtataaataaccaccctggactatacagttatttttaatttaagatatacactgttacatgttaaaatttcaaagtgcagcattttctaggatattattaagtatattaatctattgagaagcaataaaatttcactattattactttgccaagtttttctgttgcttcttttgaaagtgcataaaagtagtttagttaatttttccgtgcttcagtgtattcaatactgcattattggagcagaataaatggttgaaatggcaatttgccacaaactcttctaccactttgagaggagtatatcagaagagagtatcatttactgttgactaaaacattaaaagatggaagaataatatttgaattaagtgcttttcatgaaaaaccagtaaaaatctaccagaaaaatattgaaaacactttggatccagcccagccttttattttagagcttgaattacagtttggagtttgtgctgttttccaaaagggctgaggttaagagaggtaggattcaatgaagatctaggatcttttaatctgaaaatattttatttctatacagtgactgagacaaagatattaacaatttatattaaactaaaacatggcaacatcatcttcctgtctctcttcccactgtactattgctttactcaattgttgctttattctcctttctaacatttgcgtgtcataggacctgttagagaccttgataagacataaaaataaccatcttgctggtgagaaccatgtctcaaagcctaatgccaacaaagtgatggtgaggaaaggtgacattggaaaatgccatgataaataattttgagtctctggacagactgattattgaatttctttcttaaaaatagctgaccctcctaatcaccctcacttaaaggaatgactcaaggctggtttggtgaggctatttgctcctgttgattttagggcaattgtgtagctctaacagcccctgagcagtctgcagagagcagccatttcaccacctaatcactatagaattcaaatctgaggctgacagcctaaaaacagccacccctcattttcaagtgaaaatgatgaacagctcaacagatcataatgtgtggtctcctgaacaaactgacctatgtctgagctgccttccatactgtagatggtcccatactgggcttgggggcagtattctggtttaaaatactcactctggccaatttatctatctctgtcacatctgccacccaagtgctgagactcagacaagctgtccttaccatttgcctcaagtcacagataatgatactggcaaagtggtgggcaagcaacctaccacagacaatgacagacataatgaattacttggaattaaaactcagaccccaaaacttcccatgttcagcaattattacagggaggtcgggaattagtttgtcttcaggaagctaaaagagtttaatacccactgtaccttaggttgacaagaaataagagatcagccaaagcattgtatgacaatatttgtctttcacaagtcggagtgctggaccaagagactttctaaagtatcctgggttcccaacatgctatgcattgaagaaggacacccatttttctaactttattgaaagattattcaactatagaagccatttgctctagctgtggagtccttagcatttgccaggttttaacagtgaggggcttattttgcagaatatgttttcagacccaggccttcacttgccctaagttatctattgtgaaaagcaacccatgtaaagcactctctaactgataaactgctacacgcatattaggagttatttaaattaatgagctatcatgatacccatcctgaagggccagtaactcatttttaccttgtataaccgagttgtgtattacattctagtatttattctggtccatcgagaagtctccctcttcaaactattatgttctgcacacatataacataatagctttccttgtttgctctttctcttacatccctgtttttatataactgagtttggctctagttttcaaacagaaaagttttgattctcaaacaaaatgtcaggctcctaataaggcttaggaaattctatttgttgccaatgagaccaagctggaaaccaagaattcctaaaggagtgttgcatgccagcaaacttcaaaattggttgttatgtgattacatttggctatttccaaatcatcttaaagtttcctttcctaaagggaatataactgcagttcttccagcacttttgtgtagagagcactttgccgtcttttgagtaacttcctgatatcccttggaaggcaaggctcagcaggttctttccttctctcttaacttgccatatccttcctgattcacggaaacaggagaattcctgggtatgcagctcaggactaaaaatctagtgtgggcggcccgggggaggtagctctcaggagctaggtaacagcctacagattgtaagtcttacattttgtgaggacaaaccagtccaagtagtccagttagtcagacttcccagatgctcccttgtctagatgtttagttcatcctgagcatcaagagaaaactgaaacttgtaggatatgcacacctgctgctgaaagccgataagatcttcaaagtgaaatgtagatactgatagagaggaatttatatttttcaaaggcatatttaagaggaagcttgtttaggcaactgatttacaaggatatgctaggttggctcttaagggccaggcacggtggcccatgcctgtaatcccagcactttgggaggccgaggcaggtggatcacaaggtcagaagttcaagaacagcctgaccaacatagtgacaccctgtctctactaaaaatacaaaaattagctgagcatggtggtgcacgcctataatcccagctactcaggaggctgaggcaggagaatcacttgaacccaagaggtggaggttgcagtgagctgagatggtgccactgcactccagcctgggtgacagagcaagactctgtctcaaaaaaagagtagctccaaaggcaatcaaggtagtaatttgtaatgcttgatatactgatatactctcaaagagatgtaaaaaatggacctcaaatattagcttactagcgagtgtagttaatagtgccactaatgtattgtgagtggagctcctttatataaaagtcatccaaagctaaaaataattcccactcttgagttattctaccaggttttccctatggatacttgttatattcttgggatcatattgtggcctgggttatgcctgaatttacataacaataagctaaattataatggaattctttggtgattgagtaatgccatatataagttctgtatatggagaaaccaaagcataggtatattaaattattttcttcatactgcagaaatatagtagaaaattgtatgattttctctgaggacttacagagggagaggatggtagttgtgcagagtgcaattctaattttatgctgagaatgataatggcttgctgttcttatatacagaactactgaagacagaatgagaaaaatgggatgaataaaacaatttcaggttaactattgtgaagttgaaagctcataattaacaaataaatgctgaacccctacaaatagcaagaagtctctattagaacctatggttgatgaagatatcactcacaatgcttttaacctttgagatgcttacaacttacttgggaaggcaaacccttcatgtacagaaagttaacacaggaaagagctgccaattagtgagataacttagtataaaggaggttgaattgagaatcattatgtagattctaattctgacttagccacgaactaccttaatgaccttaagcaagttacaatctccttgggccccaactggtcacctacttatagttaacatttattgaatgctcactatgtgtgccagatgtcttacacatattctctcatttcatcctcaaactgaagcaaagtaagtttaagtaactcatccaggattatactgctagtatgtggcagaggactcaaccttgtattctgaaagttaaggcagtgtcagaatgatgtatatgtgtgcatgtgtgtgtgtgcgcatgcacatttgtgtgagagagaatgtaagaatatatgataggctgggcgcggtggctcatgcctgtaatcccagcactttgggaggccaaggcgggtggatcacgaggtcaggaaatcgagaccatcctggctatcacggtgaaaccccgtcgctactaaaaatacaaaaataattagccgggcatggtggcggaagcctgtattcccagctactcaggaggctgagacaggagaatggcgtgaacctgggaggcggagcttgcagtaagccgagatcgtgccaccgcactccagcctgggcgacaaagcaagactccgtctcacaaaaaaaaaaaaaaaaaaaaagaatatacgataggttttcctggttgtattagaaacacacgtgataaagaatctaccaaactatctggtttaactatgagacatgataagtagacaattcacatcaaattgtagtggagagcccattccttgactgcctctatgaccaagtgggcctgattctctggttcaaatctttacgatatggattaattaatgtcaagtacagatatgttactatcaacattaagaaaaaacttccccataaaaagtcacctgctatattttatatttgagattacatgcattatctactctctaaatccagcaaatctgtttctgtatagacctgatttagggagatttttatgttatctttccggttttccttatataactgtagacctagcagaggacacctccatttttgtttcatttatttgctttatattattttaagaagaaacatgaaacaaagcaaatccactttatgattataacacaaaagttatgtgtttaatttacatgtgattaataagcatttaaacctattttcattgtatgagccacttcaaacatcagagttaaagcttctttaaggaagattttcaaaatagtataggcagagtacagaactggtctgatggtatctatcctaaatgttatttttattaagagatctttacatttttggtacttcatgattcatttaaaagattatagttttctgatttttgttctgcgtatctcacagtgtctttggaaaaaagccatatacctctgatctaagaccaccagcttactatgcacaaaggctaataactcagtattttcagcccagtagctaggtagttagctctatcttttgagggaaggccagataaaagtaaaagagggaactcatacttgttatcattataggtggtcatataaactcatattaatagaatttatatttgataaatgatttaatttattttataattagatcttcagtaatattcataagtattataaaatagatgctacattttcctggagggatgtggatatcttatttatctttgtgtctctcaaacacagatactcaatttttgtcaaatgaataaatggatgaatagacagatatacagataaaagaatatataattataataatgtgaacactacttgaatcaagaaaacaaagcccaggatatcacttaagatattcttggctgccctttcccttgactgagtctaggctatgaggtggataagaatatttcttctctaaaaagacttttgtagttaaagtttattttgttgttatcttttggctttctgagaaattggttttattactgtttttaatttcttcttttttcctcgttttatttctggataatttaaagcttaaataggttaaaaaagtaccagttatgattaaagaaacaagttattccagggcaactctgaatagagcaatatcttgtctagctcaaaacatttatgccaatggcataaattgagtgttacagaagaagagcaatttcaaaaaaaattgtcaatattattagcaatatttgagtccatactacatgctaggcatgattcaaagttcttcataaatattaatttatttaatcctcacaacaaacctgcgtaagaaagataatgttgtaacatttatattaatattttcatgtaatatcagcttttgtgatagatattgatagtaaatagaagaaaaaagaactaaggaatatttctttgggattataaagagtaaagattatttttctgtgtatttaggtaaatttatactattctcttatatctaatgtcaataaaaatacctaatgcaaagggattgaatttttttccccaaacacattgcaatttagagattgcactccagtgttttagaaactaaagtatggtggtcagtaactttttacttttccaaatatggacagttaaaaatccaaaacacaagtactatctactgtcaccatcatttcctcttaaaaaagatcattttaaaactaaaaagtttggaaggatataaactcacaataaagatcatttcatttaattgaacaaatttagctttgtgaaagattcatgatgtctaatttctgatttcagagcttgccaatgaaaattttaccatggactggcttcagtctttgcaatgacatttaggaaccaccaaacgttaacatgacagccacatttattactaagtttttctgaaagcagatgtaacagatgtaacctagatttagtaggcctctactttttccctccctctacatagaagccatattcagcaacttaatgtattttgtccaaaaatagatccaactctacaacccagtgggatgtttcctctaaagattataaaaatatagagaaacaattttacctcacattccacacagcaaagctccataaatatccccgttaaacatctctgttattccctcaaaatccatctcataatgtcagcctcctcacttctcctttctctgtccctgatatgattaggctttgtgcccctacccaaatctcatcttaaattataatccccataaccccttcatgtcaagggaaagaccaggtagaagtaactggatcatgggggcagtttcccccatccggctcttgtgatagtgagtgaattctaaagagatctgatagttttctaaggggctcttcccccttcactcttcactctttttcctctcacctgccaccatgtaagacatgcctcttccccttcctccatgattgtaagtttcctgaggcctcccaaggtctgtggaactgtgtcaattaaccctcttttctttataaattacccagtctcaggtatgtctttatagcagtgtgaaaactgactaatgcagcccctttatatccacagtccgtaaaattctcaccccatccaaccctgctccctctttctcgtcacttcaagctctaagctttcatgtcccacttaataaaaccctaacctggcattagctaaacctgtgtccactcctcccatagcatattatattttccaaagattaatatacagatcttcttatgttactttacgttgtgactggtagaatctatgagttggatttacgttcttttcctttgaatattgaaggatacttgttgttgatccaacccatgaagtgtggttgaagtgatgctctgtggtttccaagccaaagcataaaaaggacacagattctaacaggttcttactctctctggggatgcttgcccttggatatcagctattatgctatgaggaagttcaaactaaccctcaaggagagaactcatggagatgaactgaagtctctagcccacagccagcatcaaccaccagacatgaacaacttttcagatgatttcagccctcaacctttagagtcttccagctaaggccttagacattacataacaagagaccagctatctctaccctaccttgttcaatttcttgactcacagaaaccatgagagaataaaatattattgttttaagccacaaagctttggggtgactttatatgcagaaatagaaaactaatacatccccttaaaaaggaactccatgaccgtatattactcttatcttctacttggaggaagggagccattaatgtttcatcatcttttttctttaactgcttttcaaaatactcactaaataagttcgggtctcatgcaattaaacataaggcagtatatgttctagccacttatgtagaaatgtttacagactataagaaatggtttcatgtttatgtgagaaaagtgaaaatgggaattgggttctagttatttggaagagagatgcagcaattataaaagatattttgcgatttaatgcatcaaaatatttactggttaaatatttacattgtctagaattttttttttgtctagaatttcgaagccataaaaatgaaacaattagactattattttaggtttcatatgtttcataggaaaaaaataatgattttactggagccaactaaatttctcattaacactcacttgataaaattgaaaataaaactgaacattaatccgatcagaaaagcactcctaatgcctcagttatattcttcagtaagcttgtaaatctccatttcctaacatcatgtcacagttctcaatctactcttgacaagacattacaaaggctgggcaggcccagcgcttatcaaattatttatactgctcacagtgctataaattacaaggaatattatgaacaattaatattatataattcatttgtataaatatgactaaaaagtagcaatactctcccatttgctttacccatccaatttaaactgtacatatttgagagaaagggagaaactagtaaaaagacttagtaaagaggagttactctacagtcatattaaatgttagaccccacttaacgctcaattccttggaagctttaatgtttcctagtttttttgttttgttttgtttttgagacagagttttgctcttgttgcccaggctggagtgcgatggcacgatctcagctcactgcaacctctgcctcccaggttcaaacaactctcctgcctcagcctcccaagtagctgggactacaggcatgcgccaccatgcccggctaatttttgtattttaggagagacgggtttcaccatgttggccaggctggtcttgaactcctgacctcaggtgatccaccggcctcggtctcccaaaatgctgggattacaggcatgagccaccacacctggcctgtttcttagttttaaaagggatgaatagcaagaaatgatatggtgacaattattcttggcatgggtttgagaagaaatgatattataagaattcttcttggcatgggtttgagaagaaccaggtatttattaaaagaagagattctcccaataattatcttagcatagaagccaatcttctatttcaggattactaaacaaacatcttggcagttatttgagcaggattcagcatgaaagagtgtgtttacatggaagatttagacctaaaattgtagggaaaaaagccgggaagattaacaagtcagaaatggccgttattattagagatggcaggtctaaagatactttagccctaactgtggcaccagcatattgaataagaattcattcttattctcaaagacctagctgcaaatggcactgccctgaaggtttcccttcttacctttcaggatatccctaccatgtcaggtaagagagcactttcagaaagattcacaagaatgccatgtatgtgccccagacctttttctccttggtttctacagtgaaattaagtggacttacattaaataagttcacgtattgagtgaggcacaggacagtgctgacgatgtaataagtgcacaaacatatttgtttaatctaaatctttgatcagaaattatgtaacataccctatataattttttaattataaatctgagattccaacagaaatatttacagattaattttcctagactagtataaggttcataattgctaaagtttaaaacaaagcaaatattcaggaataagaaaatgtattagagtgattacaattattacaattaaactagtttttacttgcccattctaaagtaatcaatgcaagtatttaataagtaaaagaagaggttatataagcttttatatatatactttatataagaaattggtaaccatggttgtgcctctggagagggactgggagtttcatcttaatacttattcttctcatgtgcatgcacattttcagaaaaactaaaacactatgtataatactagttgatactggtaaatgtttaacccatccaagtagtgatcatttcaactttagcaggtatttccctcaggcaatatctgcttggcaattcagctggtatctgcagtctgggtaccaaatcagttattctgttcagtgggtgcctgccaactcacaggaacatgctgccccatccaaatccattcctctgcccaaaatagggagggaatccctgggaatatcacacaaattggcctgaatctactcaggattccagctttcgggacactgcagggattactcagctcctcctactccaagcctgaggattccaaccagtatagcgaggagcattttcttttttaatatttttgtcccaatcattttaaccatggcaagagccagctataaggattgcctcttgtagcaggagggtgctggggtatttctcacaacatctccctaaggcagggtgcttttatcccggttacacagagccacatccttgctttacaaccctccctccctcctgcccttcggtcttctttcaatcagatctcccttctccatagggaaatgtatcaccaagtaagatcgacatgttctttggtggggatgctgcttcttattaaagggaataattaaacggccctgtattttactcctctctaaattccttttgtgtttcaaacaggaggttgtgtttcacttcctcactgacacagttataggatactctttctggaagaaagaataaaagctcacctataagacctctgtacttctggtccccacagacaaagatggaaaggcaattgatcggattctgaatcaggtatcagtgcaaaagcaagagttcaaaaatccaggtgagtggcccaggtcttagatggcagaaaaccccgaataataaagcaggtggtcacatcaacaggacactgacttctaatgggagaaggtggagttttgtgtgggcccagaaaccacacaactaataacaaccttcagcctgcaggacagcccctgaacacagccccttcccccttgcagttcctcacaggaactcagactctctggctgcccctaccttgtctatcagtccaatgctagcaacttgatggggtttgcactgtaactgcaaccatagcagagtgctcattttagattcatgtcttgcaaaatatttcgataacattctagcacccacatactcattgtggaaaaaaaaagcaagaaatagtatgggctttacacagaaccaaaagcagcaggcccctgtgtgcttgtgaaccaaacgcaaccaaatgtttctatttgtgagccaagatgactggggaatttcaaatatttctgtatttcataattacaaaagaggcatgctttcagaattaaatgaacacagtttttaaaaaatttataaagcttgtgataaaaatgcttcattttatatgcttattcagagtctgcttttaattatttcttacaaatgttttcagtagatatcttatagtttggctttgttccctggaatctgagaggtgaaactggctaacaaaaataaattagactgactagtccaattccattgcctaaattgaaacaaattttgagatttagagaaaagccaaaaagagtttgaaaaaaattgcattataaaagtcaatttctaatgttctaaattcttattctgaaaaacaaggcaataacatttacataacataaatatatatgtggccagatatttaggcattaaaaacaagactggcactgacttatggaattctttgtgttttgatgtgacaaggacaaaaggcttcttttgctaaaaataacaacatccctacttaagaaaccatctgaatgacattcttgaaactatgtctttactgaaaatcagggctgtggccatggtatccaatcagctagtccacaataggtacatttctttttttaattattattattttttttggttggggaaagtaactttcttagttgttgtgctttgcttttgaatactgagtgttgtcatatgaaggagccatttcatatgagatattttccagtatagaattagacagacatttttacataattctacttccatataaagttgcactttttttttttgctatcaactcagtaacttaatatgtgtgtgtcagtgcacgtatgtgtatgtttagtcaccagcaaaagagttagcttttctggacctaagttcttttatctgaaaatgttatatatgatattcaaagctcttcccttctaatatgagtacatgaatgggagtggctgttggtagtatagagaaaaggaatataacatgtatatttttacacatatttttcataataattataattatgtaaaggttaaggaaagtcatattttaattgcatatttatttctaataaattagaaagcagataaaaggacatgaggtagcagacttcaaatgctataacgtattttctctatctttttttctagtgagattttgctcaagagagtgtgatgctaaattttgttctgaaaatgagtgaattttcattcatattttgagacttagaatttgtcattctaagtttattgtctaagtaactaaatggtgaatgagtacaacataaaaaagaaattgttctatcaattccatacaacattcacagtggaaagcctggagagtttcctgatttatagagataacagagtaaataggcaacttggggaatgcttttttgaagtacatttaaatagacaaattagagcctttggcatttctagcaaacatttatggaggtaaaggataaattattggtaataggctctgatctatcttcttttctcccgatttttgattttgtacattcaaatcattataagtttttagcatacaaatggcaagaaacatgaatataatatacagtttaactgtgatattttataatcatcttgacaaatttcatcattaaactttgatattattagattttacatataggattttatttacatatttctttcatacatttttacactcttgggcaaataatatttcccttggatgtaataatgccattctcttttggcaagagtgtttcttccaaaaggatatattaccaagcatgggaaagaggaacagaatgctttcatggcaagataagttaaatcagcagtgatcccaaatgactctcttactcatttgcatatctatttatgtgttgtcagctacatacacagtattaagaaattcaaaatgtacaaacaccataaaagacagagttttcatcttcaaagaacttatagtgaattgataagcagaattataaacaaaaaccatattatcatcttaatagatacagaaaaagcattggacaaaatccaacatcccttcatgataaaaaccctcagcaaactaggcatcaaaggaatatatcccaaaataataagagtcatctatgaaaaaccccaagccaacatcatgctgaacaggcaaacgctggaaacattccccttaagaatgggaacaagacaaggatgcccattcctaccattcctattcaacatagtaacggaagtcctagtcagagcgatcaggcaaaagaaagaaatgaaggcacccaaataggaaaagaggaagtaaaattatttctctttgctgacgatgtgatcctttacctagacaaacctaatgtctccaccaaaaggctcctagacctgataatgacttcagtaaagtttcaggatacaaaatgaatgtacgaaaatcagtagcatttctatataccagtgacattcaaactgagacctacatcaagaacacaatctcacttaacaatagacacacacacacgcaggtgcacacacacacacacacaaatacctaggactatcaagaaggtgaaagatctctacaaggagaactacaaaacactactgaaataaatgacacatgatagacaacataaacaaatggaaaaacatttcatgctcatagctttgaatgactaatatcactaaaatgtccatactgcccaaagcaatgtacagattcaacagtatttctatgaagttatcaatgttatttttcacagaattagaaaaacctattctaaaatgtaaaatggagccaaaaatagagcagaatagccaaagcaatcctaaagaaaaagaacaaagccagaggcatcacctgacttcaaattatactgcaaaactacagtaaccaaaacagaatgatactggtacaaaaatagacacatagaccaatgaaacagaatagagaaccccaaaataaagctgcacgcctacagccatctgatctttgacaatgtcaacaaaaataagcaggggggaagggactccttattcaataaacagtgctgagaaaactggctaaccacatgcagaagaatgaaactggacccctacctcttaactcaggatggattaaagacttaaatgggagacctcaaactataaaaatcctagaataaaacctagaaaatactcttctggacactggcctaggcaaagattttatgactaagtccccaaaagcaattgcatacaaaaacaaaaattgaaaattaggatctaattaaactgaagagcttctgaacagcaaaagaaactatcaaccaagtaaacagacaacctacagaatgggagaaaatatttgcaaactatgcattcaacaaaagcctaatatccagaatccataagaaacttatacaaatcaataagaaaaaaaccaaataaccccattaaaatgtgggaaaaggtcatgaacagacacttttcaaaagaagacatacaagcaaccaataaacatgaaaatatactcaatatcactaatcatcagagaaatgcaaatcaaaaccacaaggagataccatctcacaccagtcagaatggctactatattgaaaagtaaaaaaataacggatgttggcgagacggtagagaaaagggaatggttgtacactgtttgcagaaatgaaaattagttcagaccctgtggaaaacagtttggagatttccaaaagaactaaaattagacctaccattttgacccagcaatcccattactgggtataataccaaaggaaaataaaccatcctaccaaagagatgcctgcacttgtatgtatgtttatcacagcactatttacaatagcaaagacatggaagcaacctaggtgcccatcaacggtggattggataaagaaaatatggtacatatacactgtggaatactacacagccacaagaaaaaacaaaatcacatcctttgaagcaacatggatgcagccataagccattgaatgaatgaatgaatgaatgcagaaacagcaaaccaaatgttgcatgttttcacttataagtggaagctaaaatttgcatacacacatacataacgatgggaacagtgacacaaggaactcaaaaagaggggagggagagaggaggcaagggctgaaaaacttccaattgggtactatgttcattatcttagtgacaagatcaatagaaactcgaacctcagcatcatgcaatatatccatgtaacaaacctgcacatgtaccacctgaatctaaaataaaaaatttaaaaaattaaaaaaatatttatatgtgaattgaaaagagaagataaattatagttagggaatatttaaattgcagtgctctaagtacctacctcagcatctggcactataggctctcaatgcattccttcaacaaatatttatttagcacttactacattccaggctctggtctatgtgctggagacacatcagtgagcataacagaaaaattgtaacttctgtagtgagttgaactgtggtccacaaaagataagttcacccggaataagaatgtaaacttacttgtaaaaaggatctttgcagatgtaattaaggtaaagattttgagataagatcaccatgtattagggtgagctacaagtccaatgatttatgatttcctcaagaaattatgtttaagatcagaaaaagagaagacacagagacccagattaaaaaaaaaaaaaaggccacgagaggacacaggcagagattgaacctcatgaagccccatgccaaggagtgccaagggttggaagcagccactggcggctatgaaaggcatgcaagcaatcatcccccagagcctccagagggaaccagccctacagcaccttgattttgaactgtattctgagatgcagaattctctctgcaactcagagagaataaatttctgctgtttcgagccacccatttgtggtcatttatatggcagcctcaggaaaggaacacatctgcctttacaaagcttaaattctagtgtggagagataaacaataaataaataaataagcaaaatatgtagtgtgttagatggtgataattgctatggatataaatactacagaaaaggggcataaagaaaaataaatagtataggtgtgatatgggtgtgtatgtgtattgttagtggaaagtgctgtagggaaaggggagaatcagagatgggtttatggtgaagatgataaaagccaaagctgcagggctctctgcttgcataagtacctgccgaggctctggggcggtgccctggcaagtgtgtttatttagccagatgctttggcaaaatttgcaaaagtaaaattaaaattatcccaatatcaagaagtgagttagaaagatgttttgaatgtttaaacaagtgaaaaattactgactcctgatttcaatatacgtgaaggatgcttttttatccttaatttttttagattaaaggactaaaaatataaatgaataagaaaatttcaaatacaattattggagtatgaagaaaatgcagtaaagccaagtggttaaatcaatagaaattattcagatatcagacagtacattgtaacaatttttttccagatcatctcaaaagtggtaattcaataagagaaagagataaatttcaaatagatatgatgaattggcccttgggttgcttgacaagtaaattaatgaaaaggagttaatcaaactaacacacattgaaacaatttttaatttttttctgatttgatataaaatgttgacattgacagagaggatctaaatctcatgacaaatgcagtgacacttcgatgacaaactggtaaaagaatacaagtatgtaagattagtcaacatacacacccacaaacacacacaccacatcgaatgccctgaaatcttacgctcctacatgaaaaaaaaatttaaatatttctcaaaatttgataacaatgttaagaatgtatatgacattacaaaacttttctaactattaataattttttaaaaatcaacaatcctgaagaaaagtttaaagtatcttcccaatctctacatagaaaatattacaatttcagtgtcatttaaagagacaatcaaagaatatttagccaagcataggggaaaatgtattataaaattgggttgggcagttaataaaatgttatgatttataatattttgtggtagttgggatatatgttaacttaaaatttgaattcatagtgatatcttttctccttttaactattcactttgtattgggcttgtattatattagtaattgttatttttgctcttaaagggaattccatatctgaaccagcttcgggcccaggttccagctgctctgtccccacagaaatgcaccagctctgtaagagaaactaaaagactggagaggagaacgtgaacacagtcaggctgtggagatccaaagaagtcacagtgttatagaaagggacacaatcccaatgacagagcaaaagcatctagggatgatggagagggtcttgacttacaggttgctgaggctcaacgtttcctctctaccttgcttttgttgatagcatattgtcagtggaagatctctctatattccactctggacctgaaggttatgctctcattctgtgtcctcaacaaaaatctcagaggggtggaagtcagatttgatttcccttttctttcagtaacattttgattaattcccccaaagcttcattccacagacttggagattttgacctgaactgttctccaggtctgaaagcatgactgaataaccactgtcacctaacatctgtatgtgctcgcccatgcacaaaacactcacactccctggtctgctctcctggcagtctattgaagggaatttttactagaacacagtggcatcaagacacaccaaaatcaggaaaacagcagaacataaaaacgggctggcttctgaagcactaagttaaccttagtaatcaagaagacaagcctcccccaagtacagcaagatctattgtgaaaatacgtgcctaaaattttcctatttagcttttcacattactctttccattagtaaagtctattccatagttatacagagtttttgtctaacttaatgtgggattttattagaaaatataacaccctcttctcactgttcaggtgagaaacacagccctattcagagtgggatggcttgtttcctgccttgagttttcagctcaaaaatgcctctaagatcccaaccctcctagactgatgaagggatggaactcctaagaccagctcttgttcttttacttctacagtcatttcttaacttcatctaatagtaattcttttgacaggatctgcaagttctatgatttttgcaagcagatttttataagcagagttatctagcaatatgtggaagggaaacacattgcaggctactcacagagtctgtgttatacccatatttggaacagatgcagatataaaatgcacttggttccatgagagaagcttcaaaagaggaaaggccaatgtaatgggcctagaacatgacaactgaagtgtccattgacatcatgtcaaacaacaatctgcctgctatgttctgacccattctcttcttaagattttgacctttactttggtctcattatgagaatgaaaagttcaatttttttaaataaaattaaccaatatatttataggatttaaaaaaatcagaagcaaccagcgtttggcttcagctggactaatctaatggcaagtatcccttccgcaccatatgatttttgttgatctgcttcttcactgctaggcagttgtgaagtttggctctcttctttaacaatacccagcttcttcactcagtgttctaaaccaggatctcaatccttctcctgagtgtccacatctactcctaggctctcttctctactcagtctttacataggcaatgtcttctatacccaaacataagtgaggtaagtctatctactctgcctctaaatatctctcaaaatctgatcatttctcttctccccactccctctactctagaccatgatgccttcatttcccacctgaattactgcagtagcttcctgattggtctctccacagaaactcttgttgcactctcctatccaatctctatcagtagccacagtcatctttttttaaaaaggcaaatttgatttaaccccattcttaattggtttagcattaccatattcttagtcttgctgacgtctgtatcctgtgtacctcgtcagcctcatctggctccatggtattgcttaatttacagttagattatgtttttcttctctcaattctttgattataccatgctctattttgcttcaaggcctttgcacatactaagaaaaattaaagttttaaaaaaagaacttctacaattttcaaccaccacgactacccaatgacctgcatctgtgcccatatactctacgttctcttattttactatggataaactgtccttgatccaaaaccaagactagtcccttctgttgtacactggatcaatccctttttatctgctcaaagacattatcccagcaatttcctgcaacatcaatttttccctctccactgaattgtccccctcagcatacaaccatgctgttaattcctcaacttaaaaaaaacaatcttggctcacattgtccttcacctatatctcatcactcccctttcctctgcagagaaactctagcagcatggttggcttcctcaagtcctctaatcctttattcaaagttacattctcagtgagatcttccatggttaccctaaaactctaacctcttgatccatgagagcagggatatttgtcaacattatatgctatgtgactccaatgcatatctccattaaggaaggcactatgcctctttttgctcactgctgtatcttgagtacctggcattatccctgtttcagagagggcgcacaatcactctggtgaatgaaggaaccaatgcacgagcattataaccacttcacctctccttggccccctccctgccacaagaagcagatagttatggtattttaatactttacaagcttaaatatcctggtaatttgtgcagtcagtaacttcttactaaagttactaagtctaaatcaaggcttggcaaagtttttctgtaaagcaccagatattaaacattgttgactctgcaggccgaatggtctccatctccactactctactctgcagtagtagtgcaagctccaagaaaccttcatttataaaacaagtggcaggcagcatttggcccacaggctgtagtgtgacaacccttagtctaacttgtttttatggatgttaactcatcttctaaacaggagcacatgaaaatgataacagcattgttcccatccaggtagcaaggtcagccctttccattgcctcacaggcccttggagccctcacaagtgaggatctcatctgttacccccacctctcaactcaatctctggttcgctactagtttacaacataaagttagtttacaaaggcaattatcgccaacagtaaagattaaagaacagtaaaataacatctctctacttgaggatatcacatgaattttatatccaatatacttcaaatcctattatgcttcattgtctcatgacccctccaaggaaagtatattagagcttttcttcgtctagagccttaatagaaagacaaactccaggagggaggggaaaatgtagattcttataatcctttcagaggcatttacaaaaacctatatttttacattttgtagatgacatatttctctctcaggtgtataggcctatgtcattcaaaacaatcttccatttgcttgtgcatacaaaatgctgcaacataataatttaaatgcaaataagaagccacccatagacaactttattttgtggttgtgatctgaggctaatcgaagtagtcattttccagatgaaaaatgtcttttaaataagagaaatggtacagatgtttcaactgatgccaattttatttttgcaaatgtcatctgagtttggttttctcatcaattaacagactctaatatagcattgtacaaagtcaattttctaaaaatcattttcaaactgttaaagcaataatctgtggcagtttaataacagagcttagtgttatgtgacaatacatattattttgaatggacaagggttttagttaatggtgccaatttacaacaatgaaatctaacttactgtccactgtcaaggcagattttcactgtatttaagatattcctagcagagaacttttatagttgttaaaagtacattatttctttcaggccaacaaatcagaaaccatttagccccaaatatataatttcctaattggtaaattaaactacaggtgtggggaatttttatggcgagctgacctggagttttctcagaatctcaaatgccccaggaatcatagtcaccttcattttcttttcataccacgtaagggttactttggcataatcggagtcagcttatgtcactctcagataattattgatgtcagcagggccttcttcagaaagagggaagtaacttcagtcagaaattgcaaaacattcaaatattttagaaagaaaattaaagattagatgccaagatggccaactagatagcttctgcacagcaaagaaactaacagagtaaacagaagacctgcaaaatggaagaatatatttgcaaactatgcatatgacaatggcctaattttcactatctacagggaacttaaacaaatcaataagcaaaaaacacataaccccattaaaaagtgggcaaagggcttcatgaacagaagacatacaagtggccaagaaatatatgaaaaatgcttacgtcactaatcatcagagaaatgcaaatcaaaaccacaataagataccatctcacaccagtcaggatggctattataaaaaagtcaaaaaatgacagatactggcgaggctgaaaagggaatgcttatacaccattggtgggaatgtaaattagtccagttattttggaaagcagtctggagatttctcaaagaacttaaaacagaattaccatttgacccagcaatcccattaccaggtatatacttccacaaaaataaataattctactaaaaagacacatgcactcatatgctcatcactgcactattcacaatagcaaagatgtggaatcaacccaggtgcccatcaatagtagattgcataaagaaaatgtggtacatatatactatagaatactatgcaaccccaaaacagaataaaatcatgtcttttgcagcaacatgaatggagctgggagccatatgcttttttttttttttttttttttttttgagagtgagtttcactcttattgcccaggctggagtgcaatgacccgatctcagctcaccacaacctccacctcctgggttcaagcaattctcctactttagcctcccgagtagctgggattacaggcatgcgccaccacgcctggctaattttgtagttttagtagagacggggtttctccatgttggtcaggctggtttagaactcctgacctcaggtgatccacctgtctcgacctcccaaagtgctgggattacaggtgtgagccactgcgcccggcccactgggtgccatattcttaagcaaattaacacaggaatggaaaaccaaatattgcacattctcacttataagtgagagctaagcattcagcacacgtggacatatgtataaatatgggaacaatagacaccatggactactagagggtagagggagggtgggatgcattaaaaaattacctatcttgtactatgctcactatcagggtaatgggatataccatacctaagcatcatgcaataatcccatgtaacaaatctgtacaaatacccatatatctaaaataaaagttgaaataaaaaaatatataaagctagaaccatataacagccctccatcattagcagttttagaaatttggatagaatacaaaataatagtgaaacctagatttgatattctggcatatctaggttaagataaaataccttaacctagatatttgatcttggttctttctgatactgaggaaattgtttaacttctccaggcttctgttttcttataagtaaaataagataataatggtacctaccgtagcatcatcctgagtatgaaacacaatataacatatccagtgtttagcataaggtctggcacgtgataatgtattattctccattcttcaaatttattattgacaatttgagatggaagataaaagacaaagaagaaagagtactgtgttcatcaaggaagaaaaggcaccccccccccgaaaaaaagagaagcatcttgatataatatgtagtttctttaatatttctattattgatgccagaacctatttgtaaactattttaattgcattttctgttaagccaaccaatttcttctaagctacaggaaatattactgcatgtgcaactaatattctaaagcattcagaaattcaaatatcta

SEQ ID NO: 58 - DNA, 1601 bp, Homo sapiens
cttcccccatcacattatattcatcaccctgttttatctccctgacattatcaatatctgaaatttctatgtagttgttgataagtcccccttcctgctgcccggaattcagtcacaatggatggagctagagcagccatcttggatcatgaggcacccttaagaatgaaagccacacatgaagaagggcggagcagaataggagataggagaaaggattcctgtgacttcctggagccacccaccagccctgggtggcttagtcatcagagaaatgtccactggactcacagtgagatcccatgccatacaccagaatggctacaatgaaaaagactgacaataacaagtgctggtgaggatgtggagcagccagagtgctcacacattgctggtggaagtgcattagtgcagtcactgtggaatatactttttctaccaaagctggacgttcaccctacaatatagcaatcccacccccagtatttgtcccagaaaaatgaaagcatgcacccacacaaagattatccacaaatgctcatagcagccgtacccataacagcccaaaactggaaacaacacaaatgtctacaagcaagtgaatgcatgacaaatggggacacactcataccatggaatgctacccagagacaaaagggaatgaccaattgagacacacaatgacagggtaaatcacacacagggaccacgtgcatgagtccatataagtgacgtcccggggaatggcaaaaccaatccatggggatagaggtgggggcagcaggacctcaggggtggatactgacagggaggggtgcgggggaggcgtttacacttggtatagggggtcattacaagcgtgcatacctaggtgaaaatccatcaacctctaaccgaaattgtgcacttttcttaatgcatttgatacttcaatttttaaaaagaaaaaaattaaagcaaaaaaaattttttcttttttcagacagagtctcactctgtcgcccaggctggagtgcagtggtgtgatctcagctcactgcaacctccacctcccaggttcaagcaattctcctgcctcagcctccagaatagctgggactacaggcatacgccaccatgcccagctgatttttttttttttttagacggagttttgctctgtcacccaggctggagtgcagtggcgcgatctcggctcactgcaacctctgcctcccgggttcaagcaattctcctgcctcagccccccaagtagctgggattacagatgcccgccaccacacctggctaatttttgtatttttttaagtagagacggggttttgccaaattggccaggctggtctcaaactcctgacctcaggtgatctgcctgcctcggcctcccaaagtgctaggattacaggcatgagccaccgcgcctggactgatttttgtatttttgacagaaatggggttttaccatgtcggccaggctgaggtctccaactcctgacctcaggtgatcggcccaccttggcctcccaaagtgctgggattacagacgtgagccactgcgcctggcctaaagcaaaaaattattgatccagggttgggtactc

SEQ ID NO: 59 - DNA, 5903 bp, Homo sapiens
tcacaccctacccaagtgttatttaatcccatgaatataaggatattacaatgtcagcaaatcttataattttctatattaacaaatgagggagttgaccttgctatatgttttaaaaatctcaaattcgtccaggcacggtagctcacacctgtaatcccagcactttgggaggccaaggtgggcagatctcctgaggtcaggagtttcagaccagtctgaccaacatggagaaattctgtctctactaataatacaaaattagcccagcgtggtggctcatgcctgtaatcccagctactcgggaggctaaggcaggataatcagctgaacccaggaggtggaggttgcagtgagcctagatcgcaccattgcacttcagcctgggcaacaagagcaaaactctatctcaaaaaaaacaaaaaacaaaaaaaaagctgctcaaattcaactctattcaattatttctgattaacattaaaaaaattctcctactaaaatagtaaagggagaaaaccatcttaacttgatacagactgtctgccataactccagcataagaaatgaaacttcaaagggaacattagaaacattttcactgacatcaggacaagggaagggtatctgtatcatcttagctattcaacattgtcctggatcttcaagccaatacaggttttattattttaattgctgggtcatagggtatgtgcatttttgataggtattccattttcttcccaacatagtaatatgataaatctgttttcagtattatgaatatataaatattgttcactgctgagccaaccaatgtgccataattatatttattttcttgcacaaatttttgttttgcctagagttaaaaatatgcttatattttcatttacttaatagtctttgaacctacagttaagctatcccatacaattacagagacgtaaaaatgctactgcaaagaattttctacatagtcaaacttgtcaggaaattgattcattctaatattcatttcctggaaatattcctcttagagcctccaccttcctgttccaatctggaccctctctggttcagtttctccagaaaataaatctctcatctcctgcatgaatgggtgtgagtaacttttccatcttcacatagtgttgcttggggttatacacaaccaggtagagtttgtatttttgttcatttgttgtcattattgttctgggatgattctcaagaggagaaaggggtgtatttttcatggtcccaagaggaaacacatgacatgctaaatttagaataatttgagaaaccttcagttaatggaatgtttataaatgtatgagctggatacaggggaactacagggatactgtagtgccagggcctgtagcagaactcttacctctagcccaacagggagaaaagggataagtgggacccagaagagagaattaatcagaggaagccattttgaaagagtcgagtaacctttgactccaaagggaggaagacctcgtcatgcttcctccatttcatctcctgtgagtgaagtgggggggcaggggtaggatggtgcccagactgcaactcaatctggagccagagggcaaaggggcccattgacagctctgcacatacacatcaatctccttgaagaagaaaacagagtagaaggaggaagaaaataggtctggagggttacacagaagatatctggcacaggggtagaaatctcttcgcaactattttaaaactggaagtctgatatcctggcttaaatgttatctcttatttgacacctaaattgatgttattaaggtctcaatttacatctcaaaccagacttctcttttaaaatctagatttatagctccagctgcctcttgaatgtataactgacatcttgaacagaacatgttcaaaacagaattcttgatttttacccccagatctgtgcctccccagcctttccagaattagcaatagcactgccacttttccaattgttccagtcaaaaacctaagaatcaccattgatttttcactgattctaccctcaaaatacatcttgaatcatgccacttctttcaatctgtgcagccacgacccagtcctgatctcccctcatctcttgccccaattaggaaattaaatatcttctaattagtttctctgtttgatggccaaattctaaaagctacagctatgattcacagtttctttaagcccacctaattttttgattcaagaactgattggtctttgttactggaccagttgcattcagttggttcccaaattctgcaactaaattgatcaacccatttgtatagtccattttcatactgctatgaagaaatacccgagactaggtaatttataaagaaaaagagctttaatggactcaaagttccacatgactaaggaggcctcacaatcatgacagaaggcgaagtaggagcaaaggcacctcttacatggtggcaggcaagaaagcatatgcaggggaactgccctttgtaaaaccatcagatctcatgagacttattcactatcacgagaacagcactggaaaaacctgtccccatgattcaattacctcccaccaggtcccacatggggattatgggagctacagttcaagatgagatttgggtggggacacagccaaaccatatcatcattctttcactgatctttacattttcagttttatcagcagttgtaccatgtaggtcaaagccttgtttctatttgagtttaaaatattttaatccatcttggactcactaacactagttaatggtttgatgacttcatatttaatgcctaatgtcctggctctgaaggaattaacaaatagaaaaagaaagcaatccaaaatatgaagtttcaacatctcttcagcaggaggtattacttaatgggtgcagaggttctgtttgggatgagaaaaagttctgaaaatggatagtggtgatggttatacaacattgtgaatatcttaatgccactgaattgtacacttaaaaatggtggagatggtaagttttatgttatatatagtttatcacaataaaaaaatgttaagtttcaacatctttgttatcagaaaaaaaaactaggaagtttcctaaaatgttgtaaactaggcctgaaagtctgtaatatcatctagagtagagactgtttaatatagctctcttaccctacaccccacccctactccagcctgcattcccaggagcccagcccagtttgtggaagatggtgggccctgaataagcacttattaattgaattttgagtgtcatattgatgattgaacaagtctacattcatcagttagtactaaaaacagattgaaatggatattacctcataaaaggatcccaattcttatctttacagtcactatcctgcttacttttctgtgcatgagccttttgttacctagaaatccatttctatcacctcttattcctctacaatacttatcttcttgtttctttaaccatgcttcaaagtttggttttcccaatcttttttgtttgtttgtttgtttgagacagagtcttgctctgtcgcccaggctggagtgcagtggcgcgaccttggctcactgcaactttcgcctcccgggttcaagtgattctcctgcctcagcctcccaagtaactgggactatggccaagccaccacacccagctaatttttgtatttttagtagacatggggtttcaccatattggccaggctggtcttgaactcctgaccttgtgatctgcccccctcggcctcccaaagtgttgggattacaggcatgagccaccgtgcccggccactttcccaatcttaaatcactcctgtcagtctcagattagtgcactagtatgagctcaaggtcaaaattcagatacaatttgttagctccctatagggtgggtgcacaccatgtcctacgtggttaagtgtctgtccagtctggcctcatcctagactttcatgatgagcatggggcaatctgcagtcttccctgccctctttcagaagcactggggaaccagtcccacacttaatcacacccttaccacctcaattttggtttgctgcttctgtgttggacctttaactcccccatccaaactaactctcagctcattctgtctaccacacagtcacctatgggtatccccatccctcaccttaccaaatgcagcatggtggtgcactctaatcagtgaggtgctgctaagtgtttcaaaagcagctccccaggcaaaaaacaagcacatgaataatgcacaaagaaacgacaaaaaccacttgatttgtagcattttctgatttttgtggtgtaaatacttgtaccatggccaagttcaggcaatcaatgtgatgtcactgaatatggagttggaaagatacatatagtagcacatcattttattgtatgtttccctatgttagttaacctctaagatgtgagccctggtattcagtatttatttccctctcatgttgttccagggttgtttcgtataaccagtaggaaatagtggaagtggttgtatgttacttccgaggttaggctataaaaggcactgcagcttctatcttggtctctctctctcagatcactcactttgagggaggttagctgccatgctctgagaaacctgatggagaagctcatgtagtaaggaactgtggcctccagccacagtcatatgagttaatattcgtggaagtcatatctttagctccagtcaagccttgagatggctgcatcccccactgacaacttgactgtagtttcatgagaaatcctgagctaaaaccacttagtgaagctactctcagattcctgacttagaaactgtgtaagttaattaatgtttgcgattttgaactgctaagttttgggatgatttgttatacagcaatagataactaatacaccatcataaagataagatagatataaataccctaaagagcatagaattagtaaaataagaagagtaattaggaaatgccaagttttgaatatttactgcctttgtttttgttttgttttgtttttttcttgagatggagtcttgctctgtcacccaggctggagtgcagtggcgtgatctatgctcactgcaagctccgcttcccgggttcacgccattctcctgcctcagcctcccaagtagctgggactaccggcgcccgccactacgcctggctattttttttttttttttgtatttttagtagagacggggtttccccatgttggccaggctggtctcgatctcctgacctcgtgatccacccgcctcagcctcccaaagtgctgggattacaggcatgagccaccacgccctgccctgcctttgtttttttaacataatatatgtaattataagtttatgtaattaaaaatttaataatagttgttgtattagcctgttctcatgctggtaataaagtcataccttagactgggtaatttataaaggaaaagaagtttaatggactcacagttccacgtggctggggaggcctcacaatcatgctggagggtgaaggaggagcaaagtcaagtcttacatggaggcaggcaagggatgtgtacaggggaactgccctttataaaactatcagatcttgtgagacttattctctatcacaagatcatcacaggaaagacccgcccccatgattcaattacctcccactgggtcccttccaccacacgtgggaattatgggagctacaattcaagatgagatttgagtggggacacagccaaaccatatcagttgtgtttaataggtagattttaaaaattcctgaaaatttaatagtcagtgctcataagcctgtaggggcacgttctagcacagcactga

SEQ ID NO: 60 - DNA, 171509 bp, Homo sapiens
ggtgctttaaaactgcttgtcttattttcctctgatttatatgtttgactaatcaatgcaaagaaaaaataataatcgttgttgaagatgggggaatgaaacataaaaatgatataaaataaattacatagattttgggtagagggtgatgcagtcctgaatcaggaagagagactaaaggacattttgtagctatttttacttattgagttatttagaaaataacttctttattttatctggagaatcaaatgagtggtatgtttactatgactaccttttgtggttttatgaaattaggaagtcaacatgattaacagcaaaatattcatttccagcaagcaagatggttgatcttaagttattatttggcacgagtcatatattaaatgttcagtgaaaaaggaataaaagcagaaagcaggtttgcacttttacttttcttctgtggaatcctcttagtatgctaagaggtcctcgtaccataggtcctcagtaaacgttgaatgaatgagaaggatcagcccctcctcaaatgaaagaaataaaatgtaaaaaaaaaaaaaaatggggaggcctcagccttcagtgaactctctgaaagttacatgcatagtaagaaattccctttggaaagccactggcctacattctggtcctcagcaccatcattaactagtttgttttgtttttgtccttagtaggtctttatacctcttcaattttttcatccaattcagattaaacaattctaagagatgcagaaatctagcagagccaggaatgtgtttagatgtggaaattagatgaataaagtagagcataaatgattttcagaaaagttcctgttgggaatttgaaaggttctcaacgtaatataagcaacagctgttaaaagtttccagctaactatagctattgaagaatcttcagataagtttgaaggagtaaatgaaaggggcgaagcaggaaaaaaagactttagctatcttgaacaaagtgttcatatttatgttcataaattggagacatttatttcattatctctggatgcttaatataacttttaaaatataattataaaaggaaagataaatcagaaaacatgaatatattaaataagtgcaagagtaaaaaatgctttactaaaatattttctttgctgcagttaaatgagatgaaggtcatagatggatatagaacgctgccaggcaagtctggatgagaagctgacttaaatctcaaaactaaacagaaaagacaggtcattaactggagactcagctgcaaacatatcaattaatgttcaagatgattgaattaggcattttgttattatatgaaaatgataccattcttgttagcataagagtggcagtaaatggaagaaaacaaaatttaaaatctcccctacacatcacattaatgctagtgtatttggacaattatttgagaattataattatctgttagtatcattaaagtgtcactaatttgttttctaaatttcatttttatttaattttagatataattatttaatttttttccattaaggtggacatttaataccattcctctttcatttgaggcttaatgaaagaaaaaaatgcaattcttccaaggtagtcccacttagcccttgagaaagtcaggctggcagtggtcacctgtgccattgtggtggtgggcaggatgcctgtgatcaagcctgggtaggttgcaggcagaagtgttcctgagacaagggcaagcggtgagacgctctagtagcactgccgaaagcccgtgcctgctgtaatcttggccccactctgtctctgctgatgcctgttctctgctgcaagctgaaattccctgccagcgggtgaaggaccatttgcctcctcacatctgtctttctctccctgttgaattgtttccacttcctagtccaccatcctctttcatactcacctttgccatcaagattcagcttaggtatcaactcctccagcatctcctcccagaaaccctcctcccgctccacgctgcaccctcctcccctcactcacagtctgtgggtgagtcaaaccagtaagcagacccttaatagtgtggtgagtgctactgctggagggaaaaatatggataaacctacacagaagaggccagagaactaaaaagcattagaaagaggaaggggatggagttggagctcagaggagggggtcctcacccatccatcaagcaagaggtcagaagacagtgtctaaaattaacatcaacaagtagccgtttcaacagattctttagagagatggtgaaaaactactggaagaatttagaaacagtagtaccttttttttttttttttttttttttttttgagacggagtctccatctgtcgcccaggctggagtgcagtggcaccatctcggctcactgcaacctccgcctcccgggttcaagcgattcttctgcctcagtctcccaagtagctgggactacaggcacgcaccgccacacccggctattttttgtatttttagtagagatggggtttcaccgtattggccaggctggtcttgaactcctgacttcgtgatctattcgccttggcctcccaacgtgctggtattataggcatgagccaccacgcccggttacagtagtacctttttagacagttatatatggttgtttctggggcacaagactgagactggggagtggtaggacagtggggtcactactgattagtgtaggttatttaaccatgggtaattattcctttggtttagaattgttatttgttttaaaaacaattctccacacatcctcaaaccctgtgactgctctgatagttacctactgctcccaaatacactgtcattctaacacttctatcccagaaaaaaaaaatggatcatcttaagccattttcacttttttgccaattttacacaaagcatttactcttctttatagtatctctgtttttttactttccagcttttattttagattcaggggtgtgtatgcaggtttgttacatgggtaaattgcatgtcatggggatttagcctacagaatattttgtcacccagttaagaaacatagtacccgatgggtagtattttgattctaaccctcctcctacccttcaccctcaagtagtcccatgtctactgctcccttctttgcgtcaatgtgtatctcattttgcccctgccaaggttcacatctctctcttccttcctcctaaaaccccctcccctgctcattcctcatcccttctcttctctattccaagagaagagaaaccttacctgacacctccttgcttttgcctgaggtcaattgtttaatgtctctgctctgaacagatttcaattcttcaagaggaaatcatatggcaatttgagaaataaccaggataatcaataagctggtatactcaggggaaggagttcaatgctatataaagtatggcttttaaacctatactcagtagtggaaaaatcagagtataatgtgttcaacttataataagtgattattggttattttactcctatcacctggtaatctattttgaagttcaggaattctttttggaaagttactgttataattatgcactgtatcatgcatgttatacagtgactcctggcagaaaaactgcatacctacagaagtcctagcgcctaaagaaaaaacatgaacctaattgtttatacctagtgttgcttgacaatatctatgaagcaaagttagtggccaagcttatttgagtgtcttagctaaagaaagatgcattctttttccaaactcatagagcatttccatgcaattgtgttccaagtctacatatcataactctgagctggtgctgtcagcatcaaagtaacatgctgctttgcagttagctttttgcttagtttctagtatcagttttcatggaattttttcattgtctttacccactgatacatcagtgtactcttctgcttggtaccaaaaacggggatacaaaacgtggagaaaccctgggactgagccttgggttcctgccctctgtgccactaactccccgtgtatcccctcctcctctgcacctccagctcttcctctgtaaacgacaacctgtgagtctccaacttattggctatttttttcttaagtgatgtttgtgtgtgtgtgtatgtgtttatgtgtatttatttgttttaactagcctgttaggtcttatttaacatccagtaaagctctgtttttaagccagatatttatgcttcagagtaggttggaaccccttgtgtaatcacctagtatatttctacccattttgtggaactttgaatataattgtactatttttagttactacttcaggttctagtttacatttatggcattttttttttcaagcattcgtcatttatttgatgtctcagaaacacaaccttcaattgtaaagctgttttaaaagaaaatttggtcaattatttgataattaactattttccagtgaggtttccagaaaaacattgtcatacaaccaaaagctgcctgtaattgcttttgaaaggatcaagttcttagataaactcaggattcaacactgatatcaaaggcataaggttaatgaccagggtgcctagccggttttattgttctagaatttaagtgtttaatgacagacatcatatgagtcacccaatagtggctcaataaatacttgttgaatgaatgtatgtctgtattcatgtgctacttgatatataagtaatggattcaaataagagaaaggatagtgtaggaggaatctcagaatatggagtacaaagacttaattgtttgcccaaattctgagctgcagttttatattggcaattgaaaattactcagaaataaaaaagttaactatttaaaatatagaatatattgttaataatataggcaaaagaacaaaagttatgctgctaggaaagaaaaactgtaacttaaactaaaagtataatgatagagaaattttaaagaatttcttctcatacacgttatatagagctgagtcaaataggaacaggtgttttcaaaacataataaatctctcatactaatgcatttgaacttatcacacaccttgacctgtgattaacatcttggcctctaattggagaagctgttcgaatcctggtgttctgctaccaacccagcctccataagggtgatgtgtttgtgtctttcttttagaccaggagcctgcatggtggcaaagctgccttagcagaatggtgtctgcaatttactctctagacctttgcctctgccatagccttggtaactctaaccttgcttcttctagaagaggctaaattatgcataatagtttttctgtgctcagccttaagaacacagcacataaaccactccaaaatacttacacaaggacagaaagatagactgacagaagaaactatgcatttatgcgttcctggattgaacatgtcaaaacgtaactgactgtcattctaaattttctctctccagttctgaaattaaaatggcagagacagtttgcggggattctgattgctttcgtaatattgcttaagtttgtaattggtgcattaacttcttatcgtacatgttatattttgtgtaaaaccttcatttccagaaacagcacgctgggaagaaacttaaagagcactgtcaaggggtctatgtggaagtgattcccaggagctcaccatcttaggaactattttggacaggagtaggagagatactgattttgaaaaacccaacaaaaaattctttttctcacttcttatttgttccctgagcttaattaactctttgttgttattttagaaatttgaaaaatagtaaacccacagaaaagttaacagtgcagtgaatgcatatgtaccatatactgactgagatttcctgaccactgacatcttgctatactcactctatactatctccaaatatatacacacatttccttgccaaaccattcaaaagtaggccacagacataatggcctctattcttaaactctttagcatgcatttcccaagaagaaagacattctcttatgtacccatatcattaccatatgtattagttttatgttgcggccttgtaaccaattaccactgttgtcaatagtcttggccatttgagtctgtcctgacctttcccctgctctgttctttattacaggggaactgactttgcaggcagcatttcctaggctcttagggcagttatctcaggtctgggctcagcaataggaagtggtgatgaaagatttggggaataggaccaggagagagagagagagagagagagggagagaaaataaataaaatgtgatcagatacagcacaggtctgcagaccaatccctgaaaccttttgtaatgtttcgttcataattgcatcaggtctgctgaaagcgcagatttttttttttttcttttttgctttcctttcagtagctaacagaattctttaaagactaaatggagacaattttgagcatctttggcaaaatttccttaaatgaattcttgtcagatagacctttttaaagattgtaattgtgtggtaaaattaagttaaataggtttaacactcctggcaaaattaccttaaatgaattcttgtcagatagagctctttaaagattatcaataattatgtggtaaaaattaggcttaacaggtttaacattcttctttagtttcataggcttctatgtgagcctgttggccaactgatttggaaggcaagtcctcagatgggatccagtacccaaaacattcatgttttgagttctgatttctgctcctggctgtgtcagatcatctttgagcaattgctgagtgcctgttacctctgagtttctgttacttcaccttctgaagacaatgttaatttgctgcctgtttcactcaaaaatacatagtgtcttcattaaataatgtgttatcataataagcagaagatgaagggtacataaaaattcaggcctagaaagtggaaataatactgtccagttgccaggcagcagccattctggctgcgaggtcttctgcaggggacaagtgactgtgtcttccgcaagcctggagccaccagtccagaccagcttcaggccagtgcgcccattgcctcccaccttggcacaagtaactaatacccaatgtcctccagttttatgtgctgggattcctggcgtgcccatttgaaagttctctcatatgtggtgagacgttccgtttttctcttcactaaaacgtgaagttgttttttggagaacatatggacagtatagaaaagcacaaagcatgatacatttctgcagttgacattttggcatatagatatccaaccttttttctgctcatatatttatttattttcttaatatcatacagtacctatagttgtataagtttattttacacaactgcatatcataatgaaaaataagctacaccaaacatttttctgtgttaccaagttttttatatacataattcctaatgacttcatggttttccatagtatagatagatcataatttaataaatcagagggattggaaaaaaatctgtagtcaaacagctaaagccatccctttaaagttattctaacacataaaaaccttccaccaagctctttgacacacacaaatcctcgaaggaatgattttttgtgtgaaatggttatagctgtcaatcacttattctctgtgtcatggtttctgtgctcttttcaggttgttagggggtgattatggattcctgtcaaatgagatgtctgctgtgtattcaacatgaagcagtttgtatttttctcagtctattgctctcctgtctgaggaggttaagcaaatcccagtgagccagagggaaacgggataggcatcaagcgctggcagcacacggcagacatgcccagggcccaagatccccactcaagcagattagacttcttacataaatacatttgtcttaattgtcgcattccacctagggctacacctaatatgcataaaaatggctccaagcctggttttcaaagccatttgccccccgctgttgctttttcaccacccagctcagaggcattttttgtgttatatctatcacagatgattaaggggctcgaagagttgatatataagggcagattaagaaaactaaatatttacaacctgactgagtgacagccaagggaaatactgtaaatgtcttctgggctcaaatcacggaggagacattgttttgcttttcctagtaagtggattttagagctatccaaattcagagaaagttttcttgggatgacatctcgtatgctaattagataaatgagtcagctagaaattgcatttagcagctactaacagaaacttgaaatagcagtggcttaaagaagtagggtttcatttttctctgctatgacatgaagctcaaaagcatttttattgtctgggactgcactattgctccatgatggcatcagtgcaccattgccccaccatctttgggctccattatgctcagcactggcttccatactcaaggtcacccgatgtttgagaagagctactgcagccccagttgccgtggcttcattccatgaagagagaaggcaaaagagtctctgccaactaagattgcttaagagagcttccttgatgcccatctactgatttcagtttacatctcactggccaccacatctgcaagaagggcaggaaaacttggtggggttttttgttttgtttcatcttaagttgggcacattgctgaccccaacaacatcagggtacttttaccaagaacgcatgggataatggatactgggtaggcagctaatggtttctgtcacaataattaacatcttgaaaattctgatgaaagtctgggctgtaagacgctgtggttggtatttgtaaaactagcccttgatatgtaacatacttcctcctgctcactcttacctaaattcattcatcatcccactaaataaactagccatctcaacagacctaagaataataacaacaatagtttttaccaagtaaaaactgtttgcactgtgttatgcacttaaaagcatcccctgaatgatttgccttaaaatattctaaagtggtgatggggaggcataaataaggataaatggaataagacttccatgagttgctaatagttgaagctggaagacagttacatgggggtttgttatactcttctttctactttcataattattgaaattttcccaatgaaaagctttaaaaatcacacttaatccttacattacttcatatcaggtcagttcttttacctccagataataatgcttggagttaagcagtgtcacacaacaagcaagtggcagattcagtattcaaacctgggtttatctcactttgaagtctgtgtcccacccttgccactcaaggaaaacacttttcagacaagcagcctgggcatcacctggaaatcagttagaaatgcagaattcagggccccaccccaagaccttttccaagcccctcagatcagattggtgcacacccacattccatgcgctcggttcactgctcttcattgcctcaacatcaactgtgacgtttcctttaaaaaagataaccctcggctaaaataaggaggctagtcgtgactcattacttggtaggataaacattttagataacgatttgattcacagcagttgtttctttcaacattgggcatctgctgtagtgctgggcactaaacacctatgtgtcaattaagcatctttctatgtgtcaacaatttttattaatcactgcatgctcgaaacttaatttggcttgttctagttaaattaagcccttgcttcttctcaggtaaggtgtgtgagattttaaaagccttgggtcttacagaaaactctccaggtgcctatttcaacctcctccagcatcagctctgcttacccacctgtgtgtaactttcttgatttttttcccctaacattctcagtcatcttttttgttttgttttgtttttgttttgtttttttggagacagagtctcatgctctgttgcccaggctagagtgcagtggcacgatctcggctcactgcaacctccgcctcccgggttcaagcgattctcctgcctcagcctccctagtagctgtggctgtaggtgcatgccggcacgcctggctaattttttgtattttagtagagacggggtttcactgttgttgcccaggctggtctcgaactcctgagctcaggcaatccacctgcctcagcctcccaaagtgctaagattacaggcttgagccactgcgcccggccttcagtcatcttttctaattttagccctcttcctttttaaaaggaaagagagctgtggaaattaggaagcctgagtcctagctttgccactcatgtgtcatgtaggcagaacagttaactgttggagcctccagttcttcatctctgcagtggctgagctatatgatctcaggtcccttccagcttcatcctttgtaaccccctgtaacttgatttttcaaccccgccctgccccctgcaaaacattttgaagatattgggctctgcgtgaaacccactagattatatttttccagtcagtaaaaggatcccagcattgattttttttaattggtttctttttccaaatgctaaatgccttaatacttatactttatgtgtgttggatcctttttagaacaactaagtaaatgaataaatgaagcctgtcatccatctcagttgtaacctcctcttttaaagaggctggatcgtctttgcttttgaacattattcaatattttctaggtgccagattaacttggttattttattttcactacaataaactttaaaccatgtacatatttaacaccctaagctgtttatcaacttctatagcataagaagaggcaaggaaaacacctacaggagagcagtatagacgccatccccaggaaccgtcactgtataaatcaggcccatactggtccctgttgaaggcacaatcattggagtcacttatttcttcttccaagaactttttcccttatcagaatcatgttaagcaggcatgtgatagttgtctcacaaagttaaacctaggaaaaagagcacgctgtaaaatagtgctcatgtcagtccttgtgctaggtgtgcctaaaacagtgttgcccggtcctaccttttccatgctgtatatatgaagtgtgtttctgatttgcttttcagggcagcttttggcaaggagtctgaagttcttattgggaacctgggtgataaattaatccctccacaagacatccttcgtgacgtcagtgacctcaaagccttggccaacatgcatgaaagcctggaatggttggcaagtcgaacaaagtcagctttctccaatctttctacatcccagagtaagtatctagtaggaagctgttgtggggacagttgaggaactagactgaatgcattcattgaaagatgagagtgtacactggtcaccgtatgggggcgtgtcccaagctgtcagaagatcctggttagaattctgcttgtgttgcacctcttgtactttgtgattctgggaaaggaactaatcttggtttccctgtgtggaatgtgggaatccaggaaaggcccatgttaatgtggcttgatattaacatggccttagaaacataaattcatctaggattgagccattaagtctcaagaacagaaagcaataccttttttcctccttacaacaacttctcaagggcagaaactgtctcggagctcagggctgtatgcacagctgacattctcattttacttgacataaagctaatctttttattagtcatagaagtgattaaggtgctagaaaatagagtcaatgaagacaacaattattctggaaaaaagatggctaagagatagcaattacagatttcaaagaaattaaggaacagaacatgaaattagggggaacctctttttctatgaaggaccagtgacttagagaaaaataatttgaaaactttagggcacataaactttaataactataaaattatatttaaagcattacttcaggagtatgtataacacagttaaaatagagacaaagaaaacatgatatgaagaaggcataaaggaaaaggcagatttattctttatttgttgagacagtctcactctgttgcccaggctggagtgcagtggcacaatctcagctcacagcaacctctgcctcctgggttaaagcgattctcatgcttcagcctcccgagtagctgggattacaagtgtgcaccaccacacctggtctcaaactcctgggctcaagcgatccacctgcctcggcctcccaaagtgctgggattacaggcgtgagcaagcacgtccagaccaaaagacagatttagatgtgtgaatggagagatagaaacaggatagaaaaagcaaaagaaacagcaggaaggataaggaagcaaaatcacctctgaatttaatattagggctattagacagttattagaaagaaaacacattatttggactgtacatgtcagagtgagctttttttaatcaccgtcatttgagaaggtattattacttgattaaccatgtttccagcctagagatggaaaggtgtggattaaattcacagagtaaattattcgcttatcctctaagagtctaaggaaccccttgagtgctcactacttgcatggcctcatgctgattctctgcctatcccaagggccaatgcagggtgggaagaagggactgaagcagtgggcttcagagggagatcatagaatctgcaccagaaatctccttaaaatattactgcatatttatacttttattcttacgtcttttattgaaaatactacttatttttgagacagtcttgctgtattacccaggctagtcttgaacttctggctttaggtggtcctcccatttcagcctcccaagtagctgggactacaagcatgcaccaccatgcccaactctaaaagactgctttttatctgatgatgaaattatacaagtttattctcagaaatctataagaatagaaaatgtgtctaccaattaaggatagtttgggcacagtattacttttgagcagattttacataaggaggtatccgtaaaggcccctttaactttataatcccataatatcaggcagttctattacaagcagcagtttaaattatccattttgtctcccaaacccactctgctcccttctcccctctagaaaaagtcagaaagaactaattttttctttgctaattgcaaaatgagcagctctaaaaaaggggccacttgcctcttttcctagttttctttgacttgcaaatgcagagctgcttaggtagtttatttagtaatgtttggaaggggtgctctcatttagtatgtcattagcatctaatatttaatgctacaatctcttatttctaatgacataccattctagatttctattctgcccattctaaaagggcttcacaaagcaagatagtacataacctgtgtagcaagccactgagtgatttacacaggctaacctggcatcaactgttttcaaaaggagaaagatgcattctgagttatgcttaactttgtaattgcacgatttagctgttgtgttcatgtcactgaaagtacccagtaaagttgatgtctaattcatgcctataatcatctctgttattctgacaaagatctcatctaccacgcctgttaatcctttgcctcatgtgctcagttccattttataatataagttgtaccctctcagttccttgcagggtgattattccacccagtgagtgatttaagtaactgtcagcattttgaggatcagtgcaaaacccaagtgaactgtaatcactacttatggtgtctgctaaaacaaagcatcaagcaagcctggtttatcctactaacagcaagcctggctcacccccacttatgtgctctttgaattcccaggagagatgcccattgatgtttataatttgaacaaagcaggggattctctgataatggcttactttgattgccctatgtcaatgtgactctagaaagggaacaaggggacagctttttattatttttttttttttgaaaagtgaaccaaatgattactgcaacaaaagtgtttccaagtctggagactagagaacatgaggaaaatgctcagcaggatgggaagaactcaagaagatcttcagtttatttcttgttccacattctgttaactatttggtatggtaaaggccatgttttattaagcttaagaagctattgctgtgatagggtggaaaaagtttgcagaaaattattttctttctttttttcttttttttttttgagatggattcatgcagtggcgcgatctcggctcactgcagcctctgcttcccaggttcaagcgattctcctgcctcagcctccctagtaactaggattacaggtgcccaccaccacgcctggctaatttttagtatttttagtagaggcagggtttcactacattgcccaggctggtctcgaactcctgatctcgtgatccgcccgcctcggcctcccaaagtgctgggattacaggcatgagccactgcgcctggccgaaaattattttcatagtagaatatctcttcagataggacagtaggagtctcatccacctgaacatttcatgtcaggtattacatttagaagaaagtagagaaaaaagttctacattttagttgcagagcatggctggctatacattgttcaggaggttaaaactaattatttttttcctaaggtaattttttcatctcttttagtgtttgcctaaatgtttctctatctcctttacacataaaagggtctcctggttgtatctagctcctgaccacaccaaaggtaccactcttgcatttcccctaccacacagtacacagttccctgttccttctcctctggtattctcccctcagtctttctgacactgtttctgcttaagattctttcagttgaaagtcacagacttaattgaaggaaaaagaatgcattgactcatacagcagataaatcaaaggacttcaagagtggctggatccagaggttcccaaaatatcgtcaggtcccaggcatgcttacagattctctctctctctctctctctctctctctcggatctaagtttctacatgttttcctgcattcatcacaatttcaaccttgtaataaaggcacaaataatgctggctctttgtaatgcctgctgtttgtaagatccctaaataaagactccaaaattgttatcattaagaaaattctcagaacaatatatgacctacataaaaattgttagactatttttcagtttaacagtagtgattttcttttgcatcttatcctcttgttttaaagatggattgtttttaaaaatagactacacagaatttgaaggaggctcaagggcttattttgtcaccatggcttccttagggaggcccttctctctatcttggattctgtaaaaatctctgggattagagattctacaacctccttgattatatattctactccataccatctaggaagtcttttttttttttaagtgaagcccctgtgcttcagtctaaacctcattcttcttttgtactctcttcagaaattaaataattactattaatgactattttctctataaaatattgtaatgcatccaaaaatatttctgtagcctcttctaattttttgggcaaataaatctcatagttttggttgccagaattggtttgtgaattgcagtattagttatacaattatttatatacttatttcttacaggtaaattattgttaggtatcttagaaatcatctggtctaactcagtcattttgcatatgaggaaattaaggtctcagggtggttatatcacctgtctgtgccaaactgagatggagcaggtcttcagaatcccagtttaattttctttctactacgtcagttagagccactaattggaccgttcatgccgtattcctattaaaccattccagcagggttggcatattttgttttaatggaagcactttaatgcttacaagcaagttgtggtcatttctgatcattttcttgtgcctaaacagaatttctacacctaaatatatggaattattgtacaaacccctcttgaatttcatcttagttgcaataaaacatttctgtaatttgccactctctatttttgttttgcaagtattttctaagttagaaactccatctgtcttgttatcatgccgtgtaatatattctagatattgcattgccctatatattagccactagccttgtgtggctatttaaatttaaattaattaaagttaaaaatgtagttcctctgtcatactagccatgtctcaaatgctcagtggctgttatattggacagtataggtatagaacactttcgtcatcacagaaagttctgttggccagtgctgtagatcatcactgaggtcattgataaaggttaaaaataatgccagtccatattcttagcctttgaaagatacttgaaatgcctacctagttctatcaaaacatggtgaactactttaattgtccagcctcagatcacatgtaccctcctgatgaaggttgatgtttttggctctgcattatcaaaatttctcctattgatgttaactaatgctaaagggaaaaggttttgtgatcaaatagacttggaaaatattaaagcacattaaatataattcaataccagaaaacctctaaaatctttactatattaaccagataattacagcagtggaatgtttcttaaacttacttttcagtgaaattctgttgtcccagcgtatctcacggggctttttatccatgaaacaacttctgggtgacactgcccaatgctatatttatgtaatttgtttagaatattttatttctcccggcaccatcaggctcagggcagatgttccactattgcgggaacttaatttcatattattggcaaatttgcataccatcagatgacttattttgcaatttggttatttgattatttgattcatttagtgatttttagaaatgttcaagtcagccaatataaaataaccatggtttccctttccgcctgtttcaggcttggctactgctatagtgacccttttccagtcattgtgcttttctcacaattctcaaagattctagctgcaattttataacacaccccaattcatgcaataatgtcaatgtatccatggtgggggtcctgggattgatttatgataaaaattttgttgtataatatttttagatttagtgtaaagttgcaaagatattacagataatctccttatctctctcatccagttcccctattgttaatatattagtatgatacatatgttacaagtaatgaatcaatattgatacattattattaatgaaagtctatacttagttcagattttcttagtttttccctgatcttctttttctgttctaggatctcatccaggatatatcacatttataccacagttttcccatatcacagttatcacatatatcacatagtgatgtctccttaggctcatttagactgtgacagtttcctagactttccttgttttttgtgaccttgagagttataggaattctggttgggtatttgtagaatcttcttcaatctgggtttatctggtgtcttttcctgattagactgggcttgtgggttttcaaaaggaaaactacagaggggaggtaccattctcatgaaatcacatcaagggtacatatcatcagtgtaactgattactgatgatgtctgggattgactttgtgcctccaatttgtgtagtcctctctaggcagttccttccaaattttggattgactctccactttctgactacaaattgcttatctttctagtggctatttttttaacatgatagaagcatcttattataagcccaatgtttggatgagttgaatacttgctaagaaaaatggttgtctaccttaaacaattatgcagttgataatggattataatcttgtgggtctgaaagactctgtgggaggagctgttttttaataccttgagccacttgactaaggcctgtagctacttttgggttgctacatgtgctaaacatcccttaataaatgtatacaaccatattaatttcaaacaaaaccatgctgacattaaaagagtttaactaaatttcttcactaaaaataaagtcttattttaacccattttaattaaactgtaatgtgcattgttgactcaaaacccattcacaagtggaactcgcttcctgagataagtccttttagagtagaatacctcataataccgagctgcacatcagttataatcagttagagagctgtaaaaatactgatgtagagattttgatgtaattgttcctaggtatgacatgggcaacaggctacaccccagaccaatcaaatcagaggcagagaaacctatgttgtaaaggagtggttttcagcctcatcgcattagaaatgcctgtgctttttaacatatccccaggcaattttaacaaacaaccaaggttgagaaccactgatttagagcccctaaaaatttcttctttaatttctgtcactctctatatttgggaaatgctttgtaattattttgccagttcttctatcctctggagcttgagattaacgtgatttcccattttacagagaagaactgtaggcatggagatacggtacttcgtgtccatgccagagtcgggaccacagccttgcttagcagttgttagctaaactgtcacccaaatctgattaacaacaaaaatgttcctcttacacttttcaagccagctaaatgagaagggcacaaggaatctgtgtctctcaacacaaaaggctgcaattgccaaaccaatggaatgaatgtagatatgtcattgaaaataaatggaaaaggccgaggtgtcggtccacccccatcccccaaccgcacagttgcgcaatattccagcatgttttttatgcattcccgatggtgacttaatattttctatgagatggaatgtgaatattctcatgctagagctcactatcatggactctttgtgccttaatagtaaatgaaaaataaaatgcaaatcctccagctgtttgtttttctgccttggcacaaatgaaaataaaaatttccctacccaagatctcttgggaatctgtcgtgtttcaggtttgcttttgtcagaccattaagccggagttttccttgtcataatttcatctgattctttttaattagaactctatgcgtggtaattcctctctcgcttcagtatttacaagtttcaaatatttgttgactgttatcagacagttcctcctcagcctaccttacatgtttagtttctctaatcacctttctatggttagactttccgtgcccttcatcgtttttcattcttagtagttgtcattttcctaagctgactttcatattgtggcttcatttctgtcattcttcttttattgacgataccttccaaactcattgccattggttgatttcatgatcatgctgttgactaagaaaattaatttaccattggtattgtattttgttcatgagcttcccaccccctgcctgactctaaatatattttggccttatctcattaacattacttgtacttctgttgagcctttctctcttttaaaaataatgtccaaatatatttccatgttgtgctcaatgtctcaactaatgttttgtaggaacaaaagcaccaactgataattgtatgatgatccagttttgttcattttcagtcttaaatgtactctgcttatatttacaaactcgttgaaacttatcataatgaagaaagaattgtgtggaaagccgctgtgcttagcgtgttcacctgattattcttagctgtcttctgaaatctacgttattactaggaatggagatgctgcttgttcttttattttctaaggaataccatctagacctctctgtctccttctgtttatcgtgcaagcttcagactgaccccagtggggttccccgtgttccttggttttgagcatatttgaaattgctgataacacaagagttaccccttttttaaaacacatctactctggttttccctttcctgtcattgagtgtcctcccttggctccccaatcatggttacttttgactctcctcacatagccttgtcttcctattaattcatagagtctttgtcattcttattccttagtctaggagacatatagcacatatttgactttgaagtctgacgaacttaaggacaaatcaggcaagttagggtataaccagggggaaactatttggcctgtccgagctaaataggtcttctcacctgttaaatacaaataatgatgcatactcattgggttgctctaactattaaatgatctgatgaacttgaagttcttagcagtgtgtgatacacagtggggctcactatggggtttctgggcttcctaccatgaatcttatccctggagctctcattcattgtactgggtcttccccttcctcctgccccttcaggcttctcttttatctcaagttgtgtggttgctttcaaaactgttaatatgtgtgttcctaaatcatttccagtaaatcatggctctcactcaccagagctcccaaaatgtttctgaggtcatggaagtgtgtctgagaatgggcctgcactggagggcctacaggtgctcatctgagaagccagggttgaatttgaaaaaggcaccttttgttcttcaaaactacaaaaacaaggctcagctattgttgaaaaacatgccaaacccaaccacaattccctctgtcaatcagctggtcgttagtagagttcattgtcctgtgctgattagaaagcagtaccccacccccctccgtaaggaggtgattatcaactgtggagctacagaaggctagtgctgtgggcatttcaatgtaattatggagttctaagtacttgcccataaaaaattatgtggctgtttctttggaaatgccaacatttgtacccataagggaaatattttattaaaatatgataatatcatggatgcttaagtgtggtggctggaagctgccagctgaatgattttatcttcaagcaaaactataaaatggaaacaacaagatatgaaagaatctctgggaaagaggagagacagaaggagttagaaagcaagagaaggctctaaaatggcatgctgaaattgcaaagccagacagagaagatggtggaaatgcagaatcaccagagcctgagccgacacccagcacagcagagaggaggagcggctgctgcagcagagtgacttgaacaagacatctgagtggattgatttggttgccacacagaaccacgagttccaatgaggagcagtggaagattgtacctgaaggcgctgattgtgctattcaatctggcctcttatctagaaaaacccttagacacttgggtgctttaaaacctgggataagcccaggaaccagtgtgaaatcatgacttaatgaactcctcaccagagaaagagtgtgtctttccattcttcacccttgaaactaagtttagatctacaaaatgcagtgggtgagggagacagatcctgacagggaaatccaaaagaagatggagggctggctgaagtgacatggaaggactctccattacttggtgggattgattttagaaaaatgttctaaatataaactggatgtgctttttttcaaacagcttccttattaatcaatagtgcataaagactttttccagacagcccaggaaaatgtagcaaaggggcgagatgtgcgaattgtatgtgtgtaacagccccaaaggatactacggtaatgataatagactcaacattcagattacatttcagactttcaagaacctttgtaaccactcattcttaatctcttatccctgcctcaagccgtagttgacagaccagcctttatattctcagttttacaaggcatgagcatgaaatgcaaaagtttggcagtttcccaaggtcaaaatcagtcaatgacaaaaatccagaccacatctgtctgttctcagagtgcagaccagagtgtctggaaaaacaacataatcacctattacgagttacgagtgacagagttacaagcacaccaaaccagcgtgcctttgtttccccacggaggcaatgctgttgttcagctatctcccaaagctacagcagcaaggcgaatgcaatgctgtgtgcctaatataaatggtatttaataatacactttaaaaggaggagtggagaaaagtgagcttaacattatttgactctctttcagaagctgagatgtaaaagctgcacctcttacccccaaaggacctattttggacccaaatttggtagtcatgcattcagggagaggttctcttattatcttaaattcaatactgtgatttatattaaatattgtaaattatacaataaaagatttccttcatatgggtacagagatagatcaggtataggtctctaaggcacagtgttccttattaatagcagttaattctgtgtactaacatctttgagctctggtcgttgaatcctaggtggatttgactagagttcttaaccaacattttaatccaatttttatgaaaggaagagtaatgaggacttttctctaagactgatgaaaaacctaagtgtctttatagaagccaagaatatctgatcagattcttcaaggaagcaaaaatcctgtaaatgtcagaaagatgatgctggaaaacccctttggtcaaattcatctaaagaaggtactatttgtaggtgacttttcagcaagtctgtcaaaagcttcttgctacagataaaaattcaataacctttcactgtggatgtgccacaattatcactaatttaaaaacagtccctctaatagagtattttatcatgccggacagtctctgcattgttcattatttagtgtttgctaagctgatggcacttccaccaacttttcttatctctacttcttcagaattggattttatatttccaaaccagccagatatgacaagtcattttcttctctcttgtcttttaagaaacgcaaacttgatttttttttaacaatcaccacttaaaagattaaagttattggcaatgtctgtattaactagcattgggatgtgcagtaaggcctattgcattttaattgcaactggggtcttcccttcttcttttttattctttctcttttccaatacatgtgtatgtattctctatctctttggaactccccattctgctaaaacacacagtgtatggcaaagatgaggtattatgaagcctgatgtagttagaagacaaggcaaggagagtattatcagaactattatattatagaacctccaaaaggtggtgataaatggtataagtagatctttcagtaaatatagactgtctttatatgagaaacttcctgaaaggaaaatgataaagtcattatcctgacacccgagggatacatgccacttcaaacaacatctctttctatccatagctcattattgaaatttttaactattttaagcctgaaaaaattctactagctgtgattctgaaagattttaaaagatctgtatactttacccaagctttggaccacgataagacagccacacatcttctgtcattgggaactctctccttaggcctcagggcatcttctgtcattgggaactctctccttaggcctcagggtctgctcctctgtccaagagagtctctcccaattttcagggaagtatagaacttcgttcaagaagtttgatgataagattttgaccttttaggggtacagtctttcaatagtgatatcagaatgctgaaaaagattgtgttagaaaatctcaccaaaatattcattttaagatttgtggattattgttgtaagcatcaaacagaaatagcattgtagtcagtcttcatacattaataataagggctgccctttaggattggctttacaaagaaaaatatttgctcaaactttacccagagacaggagatgcctgtcacgtctgcttctaaaagagggagtgtgactaaaaatccaccatcttattacttgtttaatggtaccacaagtccaattaacgcatttgttcaagccaacagccttttagcttttcacagaaatcttggaagtgtgctagagaaacacccccacaaaaaggttttgcatatgctgctgtatctgcctctctccaggaagcggagcatgggtcactgacagacagatggctgccacaagcgccaccagcggccagaaactcctcccaccagctcccattcctgcaaaacaaatgaggaggggtgcttttcttgaatgctgtgcctggactttctctcccttgacccagccctacccatggaataccaaggcaacctcaacatctgttacactcctgccttaattctattcctcagcaccagcataactcaatagaggagtatgggcttgtccttggacaaggtacttgacattgctgatgatgtcgtctgtattataaatccctcataggttatttggaggctaaggtcaactaacgtatacacaacacctggtacaatgcctgcaaacagtgatcacgtgataaatagtagtttcttctgctccttcttttttaagctcttttcctcattcttagtcttcctgagactattttatttcttgctttctcatttagctaccaatatttgcccatagtggtactcaacatgaaatgcccaaatctgccctctgtttatttccccctactcctgtccttcctgttgatagctgggtcattctgcccattctgcctgatactttaacttcatctcaaaagatctttgctgtattgcatttgaaattagattttgagctcttaaatttaacagccttccaaaatccacatggcttgggaacacaggcatagggtaaggtcgtatttattcagggccacaatgagtgaaacttaaggttaacctccagatctcattaaatgacttcctctgtgaacttgtatgtcagcatatcgagaaatatggcaatgaagaagctgctgaattggccaggtgcagtggctcacgcctgaatcctaccactctggggggccaaggcaggtggatcacctgatgtcaggagttactagcctggccaacatggtgaaaccccatctctactaaaaatacaaaaattagccaagcgtggtggcaggcacctgtaatctcaactactcaggaggctgaggcaggagaattgctggaacccaggaggtggaggttgcagtgagccaagattgtgccattgcactccagcccgagctgacaacagtgagactgtgtctcagaaaaaaaaaaagaaaaaaaaagaagctgttgaattgtggcttcagtaaaaactataacaaaaatggcagaccagctaatttcagagcccacagtagctctgggactcagaccttttaacatcaagggaatgattctgtctgtattgaagtgggctttggaatagctgtagttaagatctacccaagcttcagctgggcatcctccacaggggtgacaatgatctggttagctgcttaccccttctctgctgcctaataacacacttacaggaattctgggagtctcagttctgctaggatcttaggagtgttagctaggaatggaaatttgtgttcttttttgttatcatttcagccatttttaaatgtccagtttggtggcattcagtacattcacattattgagtagccatcaccatcatccatctgcagaacttttttcatcttctcaaactaaaactccatattccttaaacaataatccctcatttctccttccctccagcccttggcaacctccattctacttcctatctctatgaatttgactactctaggtggcccatataagtggaatcatgtagtatttgttgttttgtgactgacttgttttgtttagcatgatgtcttcaaggtccatccgtgttgaagcatgtgttagcactcccttcttttttgaaagctgcatgatattctattgaatggctgtaccacactttatttctccattcatccatcagtggatgcttagggtgcttccatcttttgcctattgtgagtaatgctgctgtaacatgggtggacaaatatctgttcaagtcctggttttcagatcatttgggtatatacccagaagtgaaattgtggaaattagtcatttgagattagatgtactgcacgtctttctacttcttctcaactctctgattgcttatataagtgacgtcttctgaaggaaagttcagcattttttctcagatatgataataatatatgctaagatcttggccaggcacggtggctcacacctgtaatcccagcactttgggaagccaaggtgggcggatcacttgaggtcaagagtttgctgccttcaaatcaatcattacttcttagcacctcttgaaatagaaaataaaaaatttggccaggcggtggccaggcgcagtggctcatgcctgtaatctcagcactttgggaggctgaggtgggaagatctcttgagcccaggagtttgagaccagactgggcaacacagggagacctcatctctacaaaaaagaaaaaaaaaattaattagccaggtgtggccccatttgtacaaaaaaaaatttttttttaattagctgggcatggtcatgtacacatgtggtcccagctactagggaggctaaggtgggaggaacgcttgagcctgggatgtcaaggctgcggtgaggtgtgattgcaccactgcactccagcccagcaacagagaaagaccctgtctcaaaaaggaaaagaaaagaaaaaaatgtaaaagccctagatagtaccctcctttcactcctagagaattcaaaatttacaatggaaatttaagcttactgtcttgttctctagatcagctgtttacaatgttggctatatgccccccaataattgtgtaaaacaatacattgaagcatgggaaggaaacatgagaccatttatgtatgctttttaaaagtaaaacaatcagaaacattgcaagttttactaatatttaacataagagatgacatgatagccctcatttgagccatatgtgaagtactatatgggaggaatcctgcaggaaccccaaggattcctcagcagagagaggctcaatcttctgccatttttaaaaattttcaacattttgtaatatgttccaggtgaagtagatttatggattacattttctagtttttactaaacttaccttccccaaatggataagtgacttaaaagggaaactgtggattgacactataagcaaaaatgaacatgagaaaatggcagaactggcattgtcactgttcctggtggggatcttcatcagtcacattataattatctaagcagtaataatctatcagatgactggaaactggcaaaagaacttgtcaaggatattatttggaatacggatttacatctacaattattaacatgaaccttgctctaagtgtatgtgtgccttgaaatattagctaatacatgttgaagctgtaatcattaggaagacatttaagaatatcacttgtttcatctttagcttactttttattgatttcttttctggttatatttttaaacttatataatgtattagtaccagtatatataaataactaaatgtacatttactattaatctggacacaaatatttttcgctgttggaatatataatcaaagaggtttggaaattgttgtgttactggatccttggggtgtcccttcaccagcaggaagcctctgtggccactggtgcctttgcccgagttttgctcaggaccactgggctcacttgacctggcaggctgtgcttggcttggcttggcttgtgctaccggcctggatcccatgcctgtcaagggcaagtggagcagcaagaggggtgtgagcaagtgagcatgggctccagccactgctcacagccagatacactggctgcagtgggatggacaactccagggaccagcataggcaccagctgtctgtgaggctgcagctaaaccaggcataccacaagcagcttccacacctggcaccagggaacacggtggtacacggaagtttggagacaccaggaactgcggagccccaaaggggatgtcacagccctggctcggggagctcctacatctgggcttcccaaggggccgcagctcttctctcctctcttctgtccttgttgcttgcaacttggtgagcaaggggagtgtctcagccctgtttatgttatacctcttttagccctgccattcggcaggtcctgatttcttgtcctgcatccaggaagaatgagttacatgttcaagtgttgtgtgagcagagtgaagaggagctttattgagcaacaaaacagctcagtggagacctgcagtgggtaactcctttctgtagcaaaggcatcccaatgagtattcagctctcagcatagaggagaccctgtggtgggtagctcctctctgcagctggttgtcccgtcaagtgttcagctctcagcagagaggagaccctggagtgggtagctcctctctgcaggcaggtcatcctgtcgagtgcttaagtctggctgagtctggggcttttctgggcttcagaggggaggaagtgtgtgttgattggtccatgggtgagcctggaaaaagtaacataagttcccactctggtccatgggactggcagcctggcccccaggcttcagacctttctttacttaaaggtggggcttcaccggggacctggccctgtctgccctggagcttgtctgcctcctgctgctgttcatggtgcccaggctgtttgtgccaaggggcacctacaggcctgcaccatgctgccctcagcaccccatctgcctccctcctgacaagccagcacccaaaggccagaaggggctggcgtgtcagcacttccctgagtgcgtgcatacgtgaccaggttgcaacagtgcccaggcttagcctcaactttgctctgagatcagagtgggcactgggagcagggagaagccaggcagtgagagtaggcacttctgagccttcaggggcagttggggggcttcccaggcccctgagagtccagagatgcccaggtccacagctccagtttgggtggcagcagctgcacctgggagggcagggctcctgcctgctcctggcccccaagagcacagggaggcctgggtccgcagctgcaactgggggccatcaattgctttagacactattgtctccaaatgaagttgtaatgggaccacagggacagtagtaccattgctttttatgttcttttttttttctttgttttgtttttagatgaacactgtgaattgtagctgataatatgacataattaggagtttagcagtctccagattctttccataaaacttaaagtaagtgttaaaagatagaggcggctcaaataggatgggattttctgacagacaagcagactaacaacagttcttcctccctggaagctcttttgtctgttttaatcattgcaaagtgaagcatataatggccaatgctggagtgtacagaaacttggcctttcagttatctgtacctagtattagaacaaaccagcccagatacttctcgcaattcagtgagttgactgagcagcttttctagccagagctcctcaagtagctgtgctcagctggcagctcagtgggggctgcatcatgtgggggaactgggggcctctctccatgtggtcctttcatctgggctgcttcagtgcacacaggtctcagggcagctccaagaaggcaaagactgaagctagaatagctaaggcccagattctgaaactcacataacagaacttcagccatatcctatcagtcagtgtaagctataaagccaatcaagatttaagaggtgaggaaaagactctatttcttaatggggaaaagctgcaaagaattgtgatcatacttattccaccacactggtaaattaggaagaaacaataccaaaaaagatatttataattaatcactttggcctgtacagagagcatgttttctatgcatttccttataaaaagtgtattttccacgtgataataccattgatttttttttttgtcaatgtgagaactatatagagaggctaaaatgtgcaactgaaatgatgcatcttttcagtgttcctcagtggcattctcaaaatgatcgttatattcatggcttaaaattaactaaattaagttttcaatgcaagtgttccctaaagtcaaagcttttcttcatttcttcattagagattaatttgtagcatgtctcattgaatggattgttcacagtgattgtttttcagttagacctcttagaaatagttttattttagaaaggcagaataattatagactgttaaatgtctaagtgaccctgaatagttctaggaaggtgtacagaatactgatacttccttaatgccatatatgctggaaattttagagtaaatatacattaattaaaatatctaccataactttcaagcacttacttttgaataactgtagtctttagtcttcagtaaaatcctgatgcaaagtacaacttagtctaaattaggattttcctgatagagtctaaggagtacaagccactctggtctttggaaagtcaagattcttaaatgttaatgtggcatttcctgtgttgaccatttggataatggattactccatcatttcttttgtatacccaccctttataaggattatttcttaatccttatatgtttcacatacatcatgaaacaacaaaaggcttcattatcaggagcttctattcgcttcagcagaaccatttgaaacatctaaacagttgagaaatgcatcccagtaatatactcagaaggcctaggaaacaagaatagtgaaaatagctattaactcaaattcattaggggttaattagccatgttgcaatctccttaattttctactttccacactgaattagtcatgtgtattacttaacccagccactattgccagatcagttagcactacgattccttttcctcagcaatgcttcatattatgacttagatcataaaccagagcaccaggtagaaatcacagccaatctgagtgtgctgcatggggcctcgtgatacttcctgttaatttagatgttgacagggccagtatcagtaatgaaattagttcagggcataactccttgaacatagcaggcacttagtaaatgttttatcaaattgaattaaattaacaaaatgcttccagtgagggcctgaaatcttctaccttgcttttatttgccaaattggctacttaatcaaatgaatcaaccatttttcttatttttgcaagtactatcatttcttttcctttttttttctccctcacatttcaaaaactgatagtaacaattactaatgtcttatagtactgggacgttcctctctagtcatccatttatctctgctaagaatttctcttaggattaaatagtatgattactatttccacatatttccacagtattttggtcattaacatacatatttaaagcaatatatttaattatatgcctattttatcccttgctaaatgtggattttatttactgaaactgttctctctgactttctactttgacttctctttctttttcttaaacaatctttcctatagtacctactctggcacaaaaaacactgttatattccagaagttcttttttaacccaaaagttagagaattggcatagctactgacattgaaagaggaaatgaagataaggctaaaaacaggaggacttgttaaaagtctgtttaggatatatttaccctcagatttttctctcttacttcatatacctgtgccactgcttctatcagaattgcagctgagcactggagttttagtttctgaaaatggtaaaatagagattccttggactgagggacataagtcatagctgagtgtgagggctgttattctgaaatcaggcaaagtttacattaatgactgctgacacttctgttctttttcctattggctggcatccaggaatataacttcagacaaaagactagaaagtcttttctgaaaaatctgataagcaccaggatggtgcaggtgtaggcgggagatagacactaacatcagtggttctccaataaaagagaccagccagatcacctacaaagacaactacaatgcatcagccttacctccagacacaaaactccagtcagccccacttaaatatgagcagacagccaagaagagtaatgtttgaggaaaccttataataggaaacagagaccaaaacaaacaggaaaagcaacttagaggaaacagggattatccagaaattaagaaaaacttaaaaaatgaaaattaatatccctagaagaaataagagaagatattgtattcatgaaacaagagtagtatagtatatgaaaggaactttcagaaaacaagaactcttagaaataaaaaataaagtgaaataaaaatctcagaagatagaactgaagaaatatccatgaaggtggaaaaaaaagacaaaaaagaaaaaggaccctaggaagcagcaggatattccataactgaattttaggtctacagagaaaaaaaggagagaaaatagagagggccataaaaaaaattaagaaaaattcccaaaatggaaaacaggaattctcaaaatgaaaggacccagtggatgaaaacagacctacatcctcaccaaggcagtcatctcaaaattgcagaaccctcaagttagaaagaaaaccctacaactgtcagaagaaaaaaaaaataaaagtttttctagaaagtacatctagaaaagaagcagaaaagcaatgatttgtcaaaagtggcagaggaagttaggtgacaaaaagaaaaaaaactatcagattctaagaaaattgattttcaacctagaattgtttatctaaccacactaccagttccatgtaagggaagaatacggacgttttcagacatacaagttctcagaaaacttatcttccatgcagtcttccatagaatctaccaaaccgaaggagtttacataaaaataggaaaacatgggctacaagaaatggggattctagagtagttacggaaagagaaagatctccagagtgatcatgacaggatatgccaagataacagctctgccacaggcctaggaagcagctagcccagagaggaatagctgatctctcaggagagctttgtggaggagcaggatgttgattagaatacctaatgtgttaggatttattgaaaaaaaaaattgtccatcataagagagtttggagttgagtactttaaacaacgaataaaactgttataaggaatttagcatctatgttcatcaaggatattggtctgtagttttcttttttggttatgtcctttcctggttttggtattagggtgatagatactggcttcatagaatgatttagggagggttccctctttctctatcttgtggaatagtgtcaataggattagtaccaattctttgaatgtctggcagaattctgtgaatccatctggtcttggacttttttttgttggtaatttttaaattaccatttcaatctcactgcttgttatttaacatacacaagtcaataaatgtgatacaccacataaacagaattaaaaaccaaaatcacatgatcgtctcaataaatgcagaaaaagcatttgacaaaatccagcatccctttatgcatccctggtgtgaaacccacttgatcatggcgggttatctttctgatatgttattggattcggttagctagtattttgttaagtattttagcatctatgttcatcagggatattgctgtacgattgattataagatcacagaacttgcaagtttgacagaacctcagccagtagtcagctgcaatgacaagcactgccatttattgagaatttatgatacacaagatgctatactgcagattttaggatatcgtctctaatcttcacaatcctgtgtaagtttggtaggcagaacaaatggctccccaacgatgtccacgtcctaatccccagaacctacaaaaatgtgaggcaaatgacaattaaggttctcggctcacctgagaatagggaggttatcttgggttatgcaggtgagcccagtgtaatttaagggctcttaaaagtggaatagggagacagaaaagtagattagagtaatgcaatgtgagaaagactcaaccctcattgctggctttgaagatgaggaaggagccaggcagcctcccaaagctggaaaaggcaagtaaatggattcacccctagagcctctgacacttatttaaaccaatgagactcatgtcaaacttttttttttttttttttttttttgagatggagtgttgctctgttgcccaggctggagcgcagtggcatgatttcggctcactgcaacctctgcctcccaggttcaagcaattctcatgcctcagcctcccgagaagctgggactacaggcgcacgccactgcacctggctaattttttttatttttagtaaagacgcggttttgccatgttggccaggctggtcttgaactcctgacctcaggtgatccaccgcctgccttggtctcccaaagtgctgggataacaggcatgagcccccgtgcccagcctcatatccaacttctaatctccagaattgtaagataataaatggatgttgttttaagccataaggtacatggtaatgtcacagcagcactgggaagctaacacagtaagtattaatgcctccatttttctgatgacaaaactaagtttcaaagattgagtaactttacaaaaaccatgactaagtaactggcacaggcaggactggaacctaggccagtgtaactcttagaccagactctttcaacagcagtaatagttggcatttgtagaacaccaaccaggtaggaagcaggctgtggtctatgcactctaatgtggtacctcatctagtccttacagcagcctatgggggaaggtggtggccgccctcatttctcagaggaggaaattgaggccaagcttggtggaaacaggatttaaagctgtacagtcaaactccagtgcccacgcacttaatctcaacacctctttgctatctcctagcagtttatgaatgagaaaaccgagccaggatgtctgactctctcctgaggtcacacatcaaggtgctgccacagccagatctagaacccaggttaactcttgtctcatctagggccttgtcttcttgaagaacatacttactgtggaaatacaggtgaaaattccgcatcaaacagagataccaaataacagctctaaatagacagtgatgcatttgctctctccttcttgttagtgtagtttaatttcctgagaagctttacacatacccctgagcttttctgtcacagctaattgtgcaacttccaagtagttgtcctgcctatgtttgttacttgggctcattaacataccctttaccgtagatgacactctcattaggttaaattaattaaaagatgatcattggggctacatagcttcagcccgggcagagatgtgccaccttcgaccctctggttcccttcgacagcctctgtggagatgtacccccaagacatttaaaaggctgtgctcttattttctgtcactctttatatactatctaaatcttaccacacaaacaacatttagcatgcaagttaaacagatttaaatttaagcaaaattgagtgtcaccacatgtgcttatgccagatctgtataattcttttgaggtttttggaaacgtgaaccaagccatttacgcttcataggaacagattatatcatttgaaatcctcaataaaaatgcagtctcatattctacagatgggtgtcatttaattaaaatatgtatttaaaatgcaaagggctacgttaattccacactgtggctgagattttaattgcactcaagttaggaaattcggagttaatgttcccctggcatctctcattcagcctcttagaacagatgtattgtgatccaaagaggatttcaatatgttttcacatgctgcacatgtaggaagggctttgagatacagggtggcagcatgataaaaacaggagttgatcccgagcaaaggaagggagtaccgcagcctgtggctgccttccctgtccccgcacttcaccaggtagcccttgctaatcactcacggcagttgtgcctcgtcccacttccctagatcaggtatcacagaaaggttgttggggtgctcccatttttgttttggtggggcagaggggaggcatctgtagtactcagaactgtaaaaatgctcataaattaaaaactcagtgaatgctttttagttgtagagtacattttagggtatacattaagggtttagggtacacatcagcctcgcataagtactgttgtaatacactagaaaatctattccacagtgcaacacacacattttgaaccctcaggaatttctctttagaccaaaggcagcccggaggcaaaagaaacgccaacacctgagggtgtttctgacaaggcaaggagtgaaaggaaagtgacaaatagatgttgtgggcctcagaaccccatgaaataactgcagtgtgaaggatttgggggaaacactggttttacgcttaaattattagagagttatccatgatattaaagtgtcaaaaaggaaagaattgagaattcccatgaaagcagagaagaacgtgaaattggcactgagtaagaaagtatattgtcttttcattcattctgttacttcaatcctttaagcctgctctgtgcccaggactgtgttaggcatggggcattcatcactgaccattagatatggtgtcactttggggattacaacctaatggggccattatctacataagacatgagttaaattaatgcagaggcttctgttttatttttaacgtggttacctaggaaatacagacaattatggagaaaagaagaaaggagtagttcatcttgaaaggatgactgttaagaatgttaagtacagaaatagggacttgtcttatatattttatgagaatgtttttattatgtatgtatgcccctgtgaaatctttttaattaaaatctgcaaagctagtatgaggtaatatatgagaaagaactttaagttcttagaaaaataggcagtgtgtaagtctttggggaagaaagtaaaccccaaacctccttagaaaaatcagcaaaagaaccagtcatagaattcagacctcctggctccttgtccagttcgttatgtcagagtcacaattttttatattgcaaaacaaagccagctaagttgaagaaccaaccatatttttctcttgagttttttttttcttcttctttctatatactttaagttctgggatacatgtgcagaatgtgcaggtttgttacctaggtatacacgggccatggtggtttgctgcacccatcaaccggtcatctacattaggtatttctcctaatgctctccctcccctagcccccgacctcccgacaggccccagtgtgtgatgatcccctccctgtgtccatgtgttctcattgttcaactcccgcttatgagtgagaacatgcggtgtttggttttctgttcctgtgttagtttgctgagagtgatggtttccagcttcatccatgtccctgcaaaggacatgaactcatccttttttatgtctgtgtagtattccatggtgtatatgtgccacgtttttctttatctagtctatcattgatgggcatttgggttggttccaagcctttgctattgtgaacagtgctgtcataaacatacatgtgcatgtatctttatagtagaatgagttataatcctttggatatctacccagtaatggaattgctgggtcaaatggtatttctggttctagatctgtgaggaatcgccacactgtcttccacaatggttgaactaatttacactcccaccaacagtgtaaaagcattcctatttctccacatcccctccagcatctgttgtttcctgactttttaatgattgccattgtaactggcgtgagatggtatctcattgtgattttgatttgcttttctctaatgaccagtgatgatgagctttttttcatctgtttgttggctgcatgaatgtcttcttttgagaagtgtctattcatatccttcacccacattttgttgggattgtttgttttttcttgtaaatttgtttaagttctttgtagattctggatattaacccattgtcagatggatagattgcaaaaattgtctcccattctgtaggttgcctgttcactctgatgatagtttctttagctgtgcagaagctctttagtttaattagatcccatttgtcaatttggctgttgttgccattgcttttggtgttttagtcatgaagtctttgccaatgcctatgtcctgaatggtattgcctaggttttcttctagggtttttatgcttttagggcttacatttaagtctttaatccatcttgacttaatttttgtataaggtgtaaggaagaggtccagtttcagttttctgcatatggctgccagttttcccaacatttattaaatagggaatcctttccccattgcttgtttttgtcaggttggtcaaagatcagatggttgtagatgtgtggtgttatttctgagtcctctgttctgttccattggtctatatctctgttttggtatcggtaccatgctgttttggttactgtagccttgtagtatagtttgaagtcaggtagcatgatgcctccagctttgttctttttgcttaggattgtcttggctatacgggctcttttttggttgcatatgaaatttaaagtagttttttctaattccatgaagaaagccaatggtattttgatgaggatagcattgaatctatgaattactttgggcagtatggccattttcacagtactgattcttcctatccataagcacggaatgtttttccatttgtttgtgtcctctcttatttccttgagcagtggtttgtagttctctttgaagagttccttcacatcccttgtaagtttgattcctaggtattttattctctttgcagcaattgtgaatggaagttgactcatgatttggctctctgtttgtcattaatggtgtataggaatgcttgtgatttttgcacattgatttttgtatcctgagactttgctgaagttgcttatcagcttaaggaaattctgggcttgagatgatggggttttctaaatatacaatcatgtcatctgcagacagagataatttaacttcctctcttcctatttgaatatgctttatttctttcttttgcctgattgccctggccagaacttccaatactatgttgaataggagtggtgagagagggcatccttgtcttgtgccattttcagagggaatgcttccagcttttgcctattcaatatgatactggctgtgagtttatcataaatagctcttactattttgaggtacgttccatcagtacctagtttattgagagtttttagcatgaagaggtgttgaattttatcgaaggctttcctgcatctattgagataatcatgtggttttggtcattggttctgtttatgtgatggattatgtttattgatttgcgtatgttgaaccagccttgcatcccagggatgaagccaactcgatcatggtggataagccttttgatgtgctgctggattcagtttgccagtattttattgaggattttcacatcagtgttcatcagggatattgccctgaaattttgttgttgttgttatgtttctgtcaggtttgtgtatcaggatgatgctggcctcataaaatgggttagggaggagtccctctttttctattgtttggaatagtttcataaggaatggcaccagctcctttttgtacctctggtggaattcagctgtgaattcgtctggtccttgcttttttttggtggtaggctattaattactgcctcaatttcagaacttgttataggtctattcagggctttgacttcttcctggtttagtcttgggagggtgtatgtgtccaggaatttattcatttcttctggattttctagtttattcacatagaggtgtttatagtattctttgatggtaatttgtatttctgtgggatcagtggtaatctcccctttataattttttattgcatctatttgattcttctcttcttcattagtctggctagcggtctatctattttgttaatcttcttaaaaaaccagctcctggattcactgattttttttttgaagtgtttttcgtctctctgtctctttcaattctgctctactctgatctgagttatttattctcttctgctagcttttgaatttgcttactcttgcttctctagttcttttaattgtgatgttagggtctcaattttagatctttcccgctttctcctgtggacatgtagtgctacaaatttccctctaaacactgctttagctgtgtctgagagattctggtatgttgtgtctttgttctcattggtttcaaagaacgtatttatttctgccttcattttgttatttacccagttgtcattcaggagcaggttgtttagtttccatgaagttgtgtggttttgagtgtgtttcttaatcctgagttctaatttgattgcactgtggtcccagagacggtttgttatgatttccgttcttttgcatttgctgaggcatgttttacttccaattatgtggtcagtttttagaataagtgcagtgtggtactgagaataatgtatattctgttgacttgggatggagagttctgtagatgtctattaggtccacttggtccagagctgagttcaagtcctggatatccttgttaatattctgtctcgttgatctgtctgatactgatagtggggtgttaaagtctcccactattattgtgtgggagtctaagtccctttgtaggtctctaagaacttgctttatgaaatctgggtgctcctgtattgggtgcatatatatttaggatagttagctcttcttgttgcattaatccctttaaccattatgtaatgtccttctttgtctttcttgaattttgttggtttaaagtctgttttatctgagactatgattgcaaccactgcttttttttctctttttttgctttccatttgcttggtaaatattcctccatccctctattttgagcctatgtgtgtctttgcatgtgagatgggtctcctgaatacagcacaccaatgggtcttgactctatccaatttgccagtctgtgtcttttaaatggggcatttagcccagttacatttaaagttaacattgttatgtgtgaatttgatcctgtcattatgatgctagctggttattttgcccattagttgatgcagtttcttcatagtgtcaatggtctttacaatttggtatgtttttgcagtggctggtaccagcttttcttttccatatttagtacttccttcaggaactcttgtaaggcaggcctggtggtgacaaaatctctcaacatttgcttgtctgtaaaggattttatttctccttcacttatgaagcttagtttggctggatatgaaattctgggttgaattttttttttctttaagaatgttgaatattggcccccactctcttctggcttgttgggttgctgcggagagatccactgttaatctgatgggcttccctttgtgggtaacccgacctttctttctggctacccttaacatttttccttcatttcaaccttggtgaatctaacaattatgtgtcttggggttgctcttctcgaggagtatctttgtggtgttctctgtatttcctgaatttgaatgttggcctctcttgctaggctggggaagttctcctgaataatatcctgaagagtgttttccaacttggttccattctccttgtcactttcaggtacaccagtcaaacttaggttaggagttttcacgtagtgccatatttcttagaggctttgatcgttccttttcattttttttctctaatcttggcttcacgctttatttcattaagttgatcttcagtctctgatatcctttcttccacttgattgatttggctattgctacttgtgtattattcacgaagctgtcatgctgtgtttttcagctccatcaggtcgtttctgttcttctctaaactggttattctagttagcaattcctctaacctttttcaaggttcttagcttccttgcattgggttagaacatgctactttaccttggaggagtttgttattacacaccttctgaagcctacttctgtcaattcgccaaactcattctccatccagttttgttcccttgctgatgatgagttgtgatcctttggaagagaagaggcattcttatttttggaatttttagcctttgtgtgctggtttttcctcatcttcgtggatttatctaccttgttcttggatattggtgaccttctggtggggtttctgtgtggacgtcctttttattgatgttgatgctattcttttctgtttgttagtttcccttctaacaggccgctctgctgtaggtctgctggagtttgctggaagtccactccagaccctgtttgcctgggtatcaccagcggaggctgcagaacagcaaagattgctgcctgttccttcctctggaagttttgtcccagaggggcacctgccagatgccagctggagctctcctgtatgaggtgtctgtcgacccctgctgggaggtatctcccagtcaggagacacgggggtcagggactcacttgaggaggtagtctgacccttagcagagcttgagtgctgtgctgggagatctgctgctctcttcagagctggcaggcaggaacatttaagtctgctgaacttacaattttcccacagctgccccttcccccaggtgccctgtcccagggagatgggagttttatccataagcccctgactggggctgctgcctttctttcagagatgccctgcccagggaggaggaatctagagaggcagtctagctatagaggctttggggcactgtggtggtctccgtccagttcaaacttcccagtggctttgtttacactgtgaggggaaaactgcctactcaagcctcagaaatggcagacacccctccccccaccaagctcaagtgtcccaggtcgacttcagactgctatgctggcagcgagaatttcaagctagtggatcttagcttgctgggctccgtgggggtgggatccgctgagctagaccacttggctccctggcttcagccccctttccaggggggtgaatggttctgtctcgctggcattccaggcaccactgtggtatgaaaaaaaaaatcctgtagctagctcagtgtctgcccaaatggctgcccagttttgtgcttgaaacccagggcctggtggtgtaggcaccagagggaatctcctggtctgcaggttgcaaagactgtggaaaaagcatagtatctgggccggaattcactatacctcacagcacagtccctcacggcttcccttggctaggggagggagttccccgactccttgcgcttcctggttgagatgatgtcccaccctgcttctgctcaccctccgtgggctgcatccagtgtctaaccggtcccaatgagatgagctggttacctcagttggaaatgcagaaatcacccaccttctgcgttgatctcgctgggagctaccaacccgagctgttcctattcagccatcttgccagccacccttctcttgggtttttaaacttcactgcttcaagatggtgagctatagagtcaccaggaaactgcaggttccaaatggtttcccctgacctgccttccttttcttcatctactgacttctcagccctgaaaaatgattcccaaattgcttctaagtctttgagaaatgtcttctcagttaaaaacccccagagaagctggttaaagactgaagagagaacctcagccctaactgtagtgccttcatgagatatagaggttataaactccagagaaatgaaataccattatgtgcatcagaggcccgggcttgactttctgattctgcaagggtacagaaggtttagagaaccttggcaaatggaggaaaacctaatcatcagggttaatgtgcaggacttgacgagtaagagattgatttctctttgttacgaagaccagtagggcttcagagttgttggttttttaaaaaaaatattcccagctccttgaaccttggctcttataagaaatgtggggaaaatgtgtatatatatatatatatatatatatatagagagagagagagagagagagagagagagagagagagagaaagagagagagaatatgtattctatgtaagaatatgtattgtgtattcttatgagaatatgtgaatatatatacacatatatacataaatatattttttcttatagaagattgtcttacctcttattttttattaaatagatttttctatcaagaggtgaattttcttaaggcaggatgtttgcagaaactaatggaaaacaaaccttttttaaaggagtaattgcctccttaaaagtgctgatttccatgtgaaatttatgccttcttccagaggcagtgaggagtaccccaggcagttcgaaggagacaattcattactggttagtgtacacacaccaagaaggacattaattcacaaaatgaaaaactaatagagtgtttagctgactctttatcaccagtggcagtctgcactgtctctccatcattagtgtttactgagctgatggagaccgcagtcaggcctgcttatcacagctcatcttagatgactttacatcactttcagagctacatggggcatccctcctcacttctttgaaatgaggaatccaggggtctcaaggaagctatgaagttattgtgtccatttttaaattttcttcccattctcttgactttctgatacatcccaagcaaaaactctagccctgtacatggtaccttacgctgtagtcatcccacagccactttctgagctaattagaaaactaccatctttactcctgttttacagatgtaaaaactgaagtataaaaggtatgaaccatctttaaccaatgagagagctgggatattaacctgagagctacattactttttattaaactaacaagaaattttaccctgcttctttttctccttcttacattcattattttccattttttcaatacccctcatgtaaatgattagtctgtccactatatttatgatttctactttctcatgtgacagaaaaatttttaccaatccgtcatctgaagtacaaagcaaaggtgtcttttcttctgaaaatgtgtttcagtgattcttggacatactttaactttctggattagggagttcgttacttatcttccttatcttttaagttgttttcttaactaatacaaataggtataatgacattataacaaacttaaaatatcagaattgctttattaagttcaaagtaaatttgaaaatatagtgtggtaggaatatgcaaagagaggatcatttacatatctttatattgaaataaagcaatgcttagataaatattgcaaatacaaaaccccagaaattttcactgtctacattagagaattttttggtaattttgtgtgttgtgggttttttgagttatagagcatgaggaagtgctgaaagtggtctcacttggaaaaggaaatttggcttccctgtttttgcctttgatctctgacttccatattatattccctgggtctgtcccctgtgtcactctccatcttctccagtaggcatcccctgctgagggaacagacagatacatagtcaatcagctgggtagccacaactgttacacacatagacagggattcatacatcatgtgttctggggaatttttccaacagaaattaaatcagtggtgcactatcttatgaggacattagagaagatattcatttattcaggaagtatttgtggatagttcagtttaacaaataacacagtaccagctctgtccctaggctacagggacatggataaacaagacccagcctctgcctacagggagtttaaaagtcgtggaaaatacaggcatgaaagtaatcaccccataatatgattcggcgaccatggaaaaagcacaacatataattggaatatatgatgtatacatcttaaggggaatgtaagtatcaaggaaggcattctggagaagatggcacctgatctgtgtcttgaagggtaaatagtaataagccagacaaagaggggttatttattatgttaaattgttattacattatagaagtcacattatggagggtaaactaagtgaaaggaaagaaaaggctatgaagtggaagaaaatatggtgagttcagagtaattcacatattcagtagggctacattgcagggcttactataggggagcagcaagaagtaacgaagctagagaggtaggcaaggtcagttgagattttatgtggaggacaatgtcaagctattgaaagattttagactaaaagagacatgatcagatggtgttttggaattatttctccagtaagaatacagggtaatgaattggaaaagaataattcttaaggtaagagattatttagaaacctgatgcattaacatggatgatagatggcaaaagatttgtcttagtctgttttgtgctgctataacacaatacctgaggctggctagtttataaagaacagagatttatttcttatagttctggaggatgggaagtcccaaattgaggggcctgcatctggcaagtgcattcctattgcatcaccccctggtggaagggggaaggcagaagatgaaaaggcaagagaaaaagggacggggccgcaaactcagccttttcataactaacccactcctgctatgatggccttaatccattcatgagggtagaaccctcaggcctagtcacctctttaaggtcccacctcttaacattgttgcattggggattaagttttcagcccatgctttttgagggacacgtttaaaccatagcagactataccaaggcagagatagtggggttggattcaagagatattaagaaagaatgatatagggagtacaggaaacgggcatcaaaagtgtttccaagttctttgtctgtactagtcacactgtggctatattaagcactgtgctaggatgcagaatcatctatgccaaatagaaccatatgttaaaatgacatttattaaaatgaaacttgacctgcacatcacacatgtgtattacagcttaattctaaatacaaacaactaaagaaaactatccaaattatttagttgaactagaactttatacagttttccttaggatatactgttgattcatagaaatctcttccagtataaagatatttgtagtaatattatttgatcggtagtacacaaatctaatcttagatattattctccagacatacctactagaagcagcaacatggactcacttgaatggcattttgttcgtgccctgtatttgtcccattcgggagatagagtgaaacaagagttctgttttggggttaacaggcagaattataagcagctaagcaacctaaaatagttcaaaacacaaaggcaaggaaggtgattctcaccctaagcaataagcttttgaatgtccctaaagtaactcagcttgttagtagtcattgtgaatggtttaatgaaagtaaaagttgatggtactaactgaaataaaattatggaattcttgtgtaagtttcactgagaattgaatctattgattttgcaagtagtaatcaacatctttgctctgtgtataatgctttcaccccaaattatggcaaagtaccagatggaccatttgcagcaactaagtaaattcaagcgctgtataaattcctataccttttttttttgagttctgtatcgcatatggaggaaagcacaaatatttattcaccatccttgtttataagtacagtgtgggaaatattttgtggaaattcacctctctgagaagttagaaaaaatattcaaatgaagattaaaataagtgaagaaggaagaagcaagtgatattttcataaaagtatactattcactcagatagagggtctggatcatgctttcttgacataaatgatgacactgatatggggatagtagggatggtttcaattagcttgacatttccagaagtcaaattcagccaaactagaatactagataagttcttaactcatcttttgggtgatttttcttctccagagagaaacacttggagactcaacattttgtgcataattctgaccaaaaggaagaattcatgggaaagtaaaaatttataatctttaaagaatgttatcatatcatattggaatttacacagcaaagaaagtaaacactaggcatagctagatgtttagttttaagaaagttaaatttttagacatttggagaaaatgtaggtatgatctcgtgaatagaaacctatcaaagggagtgtaatttatgatgaggggtgggagattatacaatataacatttgaactataaaatgctaagtaattttaacaaaaaataatagcaaacattcaatgacaaggtatattctaaaatgcgtgtgcacacacacacacacacacacacacgctattcactttcaccataacccaagaagtagatatcataatcttcatttttacaaattgggaaactgagtcacaggtagagtaaaataactcaaacaaggacacacagctattaaatggtgaagccaaaatttgaacctatttagtatgccttcacagcctgtgcttttaaccaccacactattgtgtagcattcagagaactctctgatgaggtcacgtagaagaagatgtattttaaaaatgaaagaaaagccctgcagtcaatcacagatgagtgcatatagcaagcacacaaaatgtccggggggcctgcaggtacagtgttggagacactaaagcctagaatgacttaatggtcatcagagatgttaaggaccacaaaatgcagtgtgtggctatgtttaggcacaaagagaacatcaaacagataggtccacagattggtgaagtagtgaatataatgttaagaaaaagcagaaccactctaacctctcttttgtttctgtcttatttagaaaggggcctgctcttcaaatgtaaggataagacaagttgtgataagaaacagctgtgaggaaagcgtcagatggcatctggcttctttagagtagaacttaaacagatcaaatccaagggtgttaaggaaatttgctgaatttgagaaattgtggagcatgtaaaaggtgacagaatacccagattacagcagatattcctattctcaaaacagagtgaagaagaaattctagaaactacagattaatgttagatagtgaaccaatatgatagttagcacatggaaaagaatatgatgagtgccaggagccaacatggttcacaagagggagaaaaactatcataggtgcccaaggactactgaaagaaaatgaacaggccttaccatggaagaaacacgggcactatgcatatgtccttgtagttaccagtcagagaccaagtcttgccacagtctcaaatacctttgtttggtttacaaattggtatgaatatgtatttttttaacttagctcttatgtcctaacaaatcaaggtttaccagtatcagcccactgtttctctgaaaatcaaatttgacttaatccagcaagggaacatgcaaaactttaagtttcactttttaaaagtgaatgttctgatgaatgagccttagaacaaagagagctaagcttttctgccttgataggtggttccttctcaatttcatacctttaacctaattgccaaaggcttgcttgaggcttggtggtctaacctgtggagcccagaaattgtaacacactgagtgtgctcatgggcatggactttgtttggaagatacattcagtcttaagctgaagcttttacagaataattgaaagcagctccaaattgagtgaccttgctaagaagtctgttttggtggggtctacatctttaacctgggattctagaaaatagtagagaaacccatggcatacttttctaaaaagttaaaaagtaaaatagtcctgtgaaacattttctgaaaggaatgttgaatcttctttgcaagggcatcttgtgtgtgttattgagaataagagcaattcataatgtgttcagtattcactaaatccaaaaaaaaagatactagagtttatgtagcaaaaataatgaagagaaaggagaaagcaaatcacttgcttccaaataaatattatttatatagattgtcctcccactcgtcctcagcctataggaacggtgccataatttgaatgtttgacttctatccctgccttggctcacagctagagagtggagtgcagtaggaacttgtttgctgtgaccaaatctttccttttcaaagatagtggtttgcgagcagctggttttttctttgctttgggttggtttgttttgttgttgtggtttatttgtttgtttttgtgtgtgtggttttttgtttgagttggttttgttgttttgtgtgtgtgtgtgtgtgtgtgtgtgtgtttgtttgttttagcagcagaaccctttcttctagcagaattttactgtaaagtctgaattgggtaacaaatcaaagtggagcctctctgactaaggaagcagggaaggcaagatggagagaatggagactgaaaaatgttaaattgaattaagtttggcccaaagctgcctctgtacatgttttaagtttgaccaaaaggtttctttgtacatagtgaactgtaacctaacttgatgtgcaaacagactagaacttactcttgtaacaggtagctgagtctcagccagtcacagcagccaagcttcagtcagtgataggcagccaactcttcaacccaggttcaaatgaggcaaacactgagctttaaccaagtatgcatcctttgtacatccctcccgttacatgtcacttccttttctctggctataaatataatctacacatgtggtagagcagagcattctgaaccatttttggtctgggctgctgcactattctagaatcacaaataaaagccagttgagatctacgtttgttgtaatttggtcttttaacagagattaggaactctgcagggcactttccaaaaatccttgccttagaggttgcagcattgcattaaaggtagcccagagatccttggtgacccttcatctcactacttcctggtccagtcttctctgagatttaaagtgccatagttcaaaaatgtctcaggagtagaaggttacattcattcatcaaggctcagttgggagaacagaaaccattttaggtatttcaagcaagaaggaatttaatgtagggaatacgatgttttagaaattgctgaaagggcttagacagccgttggaaggatacaaaaagcaaggaatctagctgctgcctttcaggataatcaggaaatgcagccggggatttcaccttcctgctgcgaggaagcagctgtctgcaggagctcttctggaagctgctgcaagcttctgatttgccagctgcctgagcatctttctgccactgtaagaagagaatcctgccttccctttctttttgccttacacagcttttgggagtacatctcaatggcagaatccaaacccaaaacccctactggcaagaagttgtagatgttcctatgcttccaggaaagtggctagaggtgacactgagttgacaacagacaaagcacaagggtatgttcccatttcactctgtacagtaaatttagtctagagtaataggaaggtgaacgtatttccaagaaagcagataaaataacaagtctcctgtggtagtaaatataaaaagcatctttccaaaataatcctgattcagctgttttaagccttagtggaaaacctgatttgtcagtgtttttatgtatatattaaaataatttataatccaatttctgtctcttcaggtgaatataacacaatttctatcatttgaggtcaaaacttcataggtatcataatggctgtttagattcagaatcattactgtcttacctttaccaccaggtaaaggtaatcacacttgagtgtgattacactcaagtaatcttcttcccttctcatagtgcctctttggtagaaaggaaataaacggcggtcaggaaataaatgctgactccaggccctgtttgagtaaggcagacatgatctctcaatcacatgaacaatttacaggctttggtgaatattctttgaattcctaaaataacccctaagttgcggctgggtgcggtggctcacgcctgtaatcccagcactttgggaggcccaggcaggtggatcacaaggtcaagagatcgagatcatcctggctaacatggcaaaaccctgtctctaccaaaaatacaaaaaaattagccgggcatggtggcgggcgcctgtagtcccagctactcgggaggctgaggcaggagaatggcgtgaacctgggaggcggagcttgcagtgagccgagatcgcaccactgcactccagcctgggcgacagagcgagactccatctcaaaaaaaaagaaaaaaaaaccctaaattgccttcgttaaagaacctagcttggcagacatcctttccttggaaagggagatgcctgtcattcttcaaaataatgttaaaaacactgatttatctcctcccacgctgctcctcaacatcattcctggctttcctaccaatctaccacctacctcatgcctgaaggccatctctaccactgaactggcgactggagaaaggcattctcccctttttatgtatgaaaagataaaatttgaacctgccctctgccttaatcccttttctctcctgcgtattttcactaatttaaacattgccagaatcctgtgctgttctcatacttctatgatgccttattttaagttcaaaatgtcatgatcttacccagtgtgtatgtttaatggattaatgtatcattttctttctggccattagccacatgaacaactaggcccacagctgtcagatttcttgcaaggtttttcgaggagtgagaggatgagtctaggaatctcactcttccaggatcctcaccagggggttcaataaagatcacttcaatgtgctgagcacttactgtgtgccgaaggttgttctaaatgcttcatgtgttttatatcattgaatccttacaatgaccctttgaggctgaaaatgtagtcacttcaataaacaggtttaacgatttccccaaggttatccagttagtaagtggttgaatcataatgtaactactactttctgggccaatcaaaaagaaatggttgtcaatccaaaagaagtgttgtatgtaagaatttggttcttagttaataggagaatactcatatccttttacttagcgaaaaatatttagattttgaagtaatatcctgaaattgtgtagtcaactgatagagatgattgcttctccatgtagcttactctcaactggcataaacacagattgattattaatcttttactttttaaaaattgattctggaagcatctatatgaactgttaattattctagggattatgtggcaaaactggaatggatgtgtgaatagtattcatgtgttactaacgtataaagacagaaatatagtcatatattattaaccttcacaaagcattagtcaatatgtgtatcacaccacctcatcaatcagcctgcacagggactgtctgacaccagacagattaaaggggaggtacttaactattatcttcaccccatgctgagaggtggccacacttgtcctcactgagtagaaattgtcttagcaagatttacacctgcaaagtctgtaccatgtgtcaactagttaattctctgttttttacttctaacatgcttcagaggagcccccaccaattacacagctactcatggtgatgatctatgtacttggtggcagggtcagcttcttcttccagataaatcagttgtccagatgttatccacatggcagtcagagtggccatggcttctaagattctgcctattttcctctgcagtctcgatggctctcagattttgcgatcaaatgtataaagctagtgtcattgtttcagtgcccacataaaactgtagatggagtgaaaaatactgggtttttaatttacaagaaaatacaaccccataaaaaagtgggcaaaggacatgaacagatatttttttaaagaagacatacatgcaggcaacaagaaaaaaaagctaaaagtcagtgatctttagagcaatgcaaatgaaaaccacaatgagataccatctcacaccagtcagaatagctattattaaaaagtcagaaaaataacaaatgctggtaaggttgtggaaaaaagggaacatttataccctcttggtgggagtgtaaattagttcaaccattgtgaaaaacaggtggcgattcctcaaagggctaaaaacagaactaccgttctacccagcaatcccattactgggtatatgcccaaaggaatataaatagttctactataaagacatatatatgtatgcaaatgttgactgcagcactgttcacaatagcaaagacatggaatcaacctaaatgcccatcaatggcagattggataaagaaaatgtggtccatatataccatggtagaccatgcagccataaagaagaacaagatcatgtcttttgatggaacatggatggatctgcaggccattatctttagcaaagtaatgcaggaacagaaaaccaaataccacacgttcttacttatgagtgggagctaaatgatgagacctcatggacacagaagggaacaacagactctgggccctacttgacggtgagaggagggagaggatcagaaaaaataactactgggtattaggcctatgcctgggtgacaagataatctgtacaacaaacccccatgacgcaaatttacctatataacaaacttacacaggtacccctcagcctaaaataaaggtttaaattaaaaagatacgggccgggtgtggtggctcacgcctgtaatcccagcactttgggaggccgaggcgggcagatcacgaggtcaggagatcgagaccatcctggctaacacagtgaaaccacgtctctactaaaaatacaaaaaattagccaggcgtggtggcgggtgcttgtagtcccagctactcgggaggctgaggcaggagaacggcatgaacccgggaggtggagcttgcagtgagccgagatcatgccactgcactccagcttgggtgacagagtgagactctgtctccaaaacaaaacaaaacaaaaaaagatactgggtttttgttacttattcaacacctttattgaggaggaggaggaattgccatgtattagcaattgtgtgtcaaacgctgttctaagcctttatatagtttctcatttaatcatcagaatcctatgggtcagataggatgatcctcctttcacaagtggcaaatctgttacagagaacttcttccaaatagtataatatatgagaaagtcggaaatatgaactcaggtcagtccgcctccaaaggaccaccttcctgttcactatacttggtacttacctgctggtttcagaaaacacattatgtgttagggatacaaagataaaagtgaggttgtacctgctattgcttaagaggtatgatagtctgttcttgcactactataaagaaatacctgagactgagtaatttgtaagaaaacagatttaattggctcatgtttctgcaggctatacagaaaggacagtgctagcatctgcttctggggaggcctcaggaagcttccagtcatagcagaaggaaaaggggagcaggcatctcacatggcaggagcaagaggctggatattcacacgctttaaacaaccagatcttgcaagaactcactcactattgtgaggatggcaccaagccctaagggatcctcccccatgacccaaacacctcccactaggccccacctccaacattgggaattacatttcaacatgaggtttagagaggacacctttccaaactatatcaagaaggtaatgagtatttcaacttagatccaaatttatgagtgatgcagctgcctcagaaagaaacccatgaaataaagcaactggaaaaagttaagttgaagaggaactccatatgggacttccaattcaactgctttagttctatttccgcttacttgctgtgtcatattgggaagtatgctttatttctgtttggttcagtttcaccaattttaaattgtcctaatgtttccaatttacccagtgaataagccgttccctaaggctctttggaagatttacatatacttaagctagaaggatcctgtttgaacacatagacaaatgttacctctctgccatgtaatatttttgcctctaaaattctgctaagcttaaatctgtgtcccttattcatccaaaaataccttgttaagtattggttaacacttttagatgctctttgatgcagggttttacagaaatacaaaaggcttacaaaagtccatggaaatctaatacagcaccacaatactgcttttcaacagaagaacaggagctgttcattagcccccactcccctacccaccctgtttctctttcatatccggcaggagctgaattggccacaccatatgcttttttagcaaatgatgagtttttttaccaagccttagggaggattatttggaataaaggaaaaatcaatcgtaatgtttctccccaggactgaaagacactgaagtctgtactatcaatcacaaggtataaaaaacatgtgtctaggctggtttgcactgtatgcagataggaccccaaagctaaacgtccttggggacctagggcttgctcagacttgttaccatcaagcactgtttcctgagtaaccagatgcaattttctctctgcagagctgtgcagtgtgtagtgtgtactcttggctcacgactggcctcttatcctgtggtagcctaagggaacgactatccatttctactttggctgttatttttgttttgctcatcagaatgagccttccatgaatctcctttgttctttctatatagtttgatatttggaacaattcttccatttcagacgctcatatccttcctggagctttagtttcttaccctgaaacagaataatgttccaggtgaatgaactatttggaagacattaagttaaaggcattgtgaaaatataatgaaaaaaatggttataaaactctttgatttgtccttaacttgaagataaaattcaacaaacattatcagcagtctactgagagtaaggaagagctatacactgagagatgccaggaagaagtagttattgtttttgttatcacagatctcacaatccactaggaatgctgtgggcaaatacagtgcaagatgaaatgtgctaagtccgtaggagagaggcagagtgttaccagggctcgaaggatggcccttagctttgttgcaggcacagtgcaaggtgccacatctcccatttggtcctcacaacaactccctaagttgtgtatttgaggaaaacgagacttagagttgttaagaaatttgttctagaggtaataaaaagtgcaagaataaattatattcctctgggaagcagcaggagaaagtatggtttcatagagatgaaaacgtctcttaagcagcagagtttggtttttactcttttttgggaggctcataatagtatattctcaagcgaatgttgagacatctaagacattaagctgggcagtgaatggaacaggtatatcttttcttcccccaagagttaatgtttgtagttagggtaatataagatatttcggaggaagcattctaagaaacactaaaaagttatattgtccatagtcttatgaccagtggttgggggaaggtgtaacacatgatcatgtaaataacaaatggtaccgcataaaagaaagtaggtctctgcctcctatacccaaatataaaacatcccctctgtgaaagttcattatacaaattgggtcattcttgtcatccccaactgaatcaaactcaagaggccacaggtaaaatcactctgtgtacattacacctgctccaagaattaaatgttccacaagcccagctgctgaaatggcctgctgtaactctaagaccagttttacctagaagctgcttaaacaacctgctgtgactctaagattgcttttatctaccaccatcactcccagtcagagcttgacagctaccagaagctcctctagggccaatgagctttcttttaaacaatatgtaatatttgtctttctcgtaagactcttaaccttctctttgttctttggacatgtcacaaaccacccattctctgtgtatgccccaaattgcaattcttactttccaaataaaatactttaaatttagacattcatctctatattttgtctgacttcaacacctccatattcaggaagcattttttaaatataaatatattaccaattatgtgactagaccatagaacagcacatataattaagacaccttctcccgatcctccagttccctcattcttatcccttttttccttcctgataatttcttccacttttctccatcccagttcttaataaatccctttcatctctcttcttcttctgtaaaagtgggcaaaagagagagagcagtgaaaaggcagggaatgattgctccgttattgagatgtaaaaggattcattggttggatgttgtgcttcagagcgtaggctttatttccacatctggctatacacatgtgtatgcatgcataggacctaatctgactaatgtgcattatgtccccatcctttgcaatcagaatatcaatgagcatggtggttttcaaaattaattgattttgctattaatagttcaaacctaaaatttctgggatctgtgaaaagaggtagttattacttggaggcagaagaactattgcttctgaaataggaagcaaaatgaagagagctttccaaatgtgtttcttagataaggcccatccttatgtagaaacatagcaaaagaacttaaaactagattatagatggtttggaagatgggaaagaacaagtaaatacatgaattgctagtagtggcagaagccaagtactgttgggaaaagagtagtagctttggaaaaagggactcaggaaaagagtgatcaaaaatagttactatgaaattttagtttggcgtaatgacttagttcaagaagaaaggacatctctattccaagaaagttcaaatcaaatgttaataagctggtatgtactttagcatgtgaagatcacccctctgttccaaaaaccggtaggcttcataaataaataatttatttcttaaacatgtatttagtgcctacagtgtacaaagcactggggtaaggaaagattagtttgtacaggtttgcaaataattcaaggcaataaataaaatgtagggacagtagtacagagaaattatgaagactgggggtagaattagctggcattaaagctccagcttggaactggagtattatggtgtctgacactcaactgtgatcccagtgttaggcttgatagcagcatatcccttaggcatttaaggagaggaaagaagttagatggaggggctcctgtcactgtccccactgactttgtaggcctcgtgaatccttaatatcacagacctaatgagcattcctatttttatttttttttaagtatttagttttgtccaggcaacaacatcaaaggatttcagagttgtcttaagacctggtaacatattgctatagaagttaggaaggtactattaatagttttctaaataggaaaactgaagattaaaaattaaatattttggggctgggcaaggttcctcacgcctgtaatcccagcactttgggaagctgaggtgagaaaatcatttgaccccaagagtttgagaccagcgtaggcaacatagcgagaccctttctgtacaaaagaattaaaaaattagccaggcgtggtggtgctcacctgtaatcccagctacttgggagatgaggtgggaggattgctgtcttagaaagaaagaaaaagagagagaaagaaaagaaggaagggaggaagggagaaaagagatggaaggagggaaggaatgaaggaaggagagaaaggagggaagcggggagggagagaagaaggaagaggaaaggaaagaacttattttatcccaagttagagtagaaaactgtgtggtgtctttcacctctgtacaaataggaagaggatttggaaatcattattataccaaaatttgatcttctaaaatgttttcaatgagaaaatctcatgggatcattcttcactgtctttttctatcttctagaaagtttgaattcacagtgttaacctttcctttcgtgccgagataaccatctttcccttttcaatttctcacttgcctgacagctgataccagtctaagctaatattgtaacaattttagataatattgcagatgcacaaggacatcctcatatgaatcaattaaagaagtcacagtgagttgccattgaaagtgtggcagctgcatccttgaaagcagatgctcttctgggtctgaatgagtccaattttaactaattttaagacctaaacagatttcagtctggttaatattaggatgtggaaccacttgagacatcctaatgtcctagtctgattacttctccatgacagtttgtatgttgactttccttgagagatgctgggtacttaatgccaggcatttttatgtcaatcgtaaagagagaccccaagtcatggctgcagcaaagtgcactgacaactcgtgaaattgaagtggcttctaacagcagcatgatttatagggaaagaacttggggtatagggattcaccagaattgctttaaactatatttctgttagattcctgaatccccagaaacaggctataatgaactacttccccatccctactctctctctagattatactcagaaaactaaggagaaagttagagttgtaaatggcaagttgctccttcttttttctgatttttctttaacaatctgttattatgttctttgtcatattgcattggtcagtttaattaaaaaggcattgattgagcttctgtaatgcctctagttattctgctggccttgaatgggggaaaatatatataatacataattctttcactgaagtaattaatgatctggaagggagacatagttaatggaatataccttctattctagaattgagaggggtaggggaacatccagaagagccattgacccttcctggggaatcagaaaagactttctgagccagagaaggcatgaatagttttgaaagaggagtaagagccatcaaaggtgtagaatcatgagacagcatgatatgtttaggaaatttgctttagacaggtggtaaatcaaacggcccagggttggagaggggatacgctgaagagaaaaaagaaagtggtaagagatggagaaaatctggagggttggacagaaataaaaaatcttggaaagctttgctaaggagcttagacttgatcatataagccttgggaaacactgatgttatttatacaagaaattaacatagtcaaatttgtgttttgggtaaataacttatctgactcatatttaattagataaaagggggccaggtaagaagcagagacaccagtcaggtaactattgcagtagtccatggaagagatggggtccaaaccaagaaagtggcagtagataacagaaaagaaaaaataaatattaagaaaatatttgtaaataaaattggtacaaatttttctttgctagagagagtcaaaaattacactcacgtttgcagctgggattcccagattgatgtatcacctataaaaagagaattcaggatagagaacagatgctaaagaaagataatgagtttagttttgaacacattgcatttgagatgcctatgggatatacaggtagcagtatcttgcaaatcattaatcaaataaggtttaggagccatcatttcatggataatagtgtaaacaatgaaaagggatgagctcactcagaacatattggcaagtaaggaataccactagaggaaaaagtccccagaaacaccggcattatggatggactaaaggaaggggattcagtgaaggaaactatggaagaaatgccagagagagaaaacaacacccagaagagtatgccatataagccaaaagaagatgatttcaagaagtaaagggccagtgaattcagagatagcagagagcctgcatgagatgaggactgaagagcagccagtagatttggcaattacagtatcattgatggctattaccagaaaagttttgaataaaaaggtgagggcagagtcagattgtggcacactgaagagttaataggaggtgggactggagaaagtcagtgttgagattcttttgaagtgtttgttgaggactaacagggagcaggtaggacaaagggcctgaggagaacagcgcgaatttggaaaaattgctgagaaagggaaggaggtagccaagcaccagggaaaggattgacaagtggtaccgcaagcttcttttgaaattaaaatccagaacgttttagtggcaacaatctatacatttttgtctttttaaattaatatattatagctgtacgtattttgggggtacatgtgatattttgataaatgtatacaatgtataatgatcaaatcagggtaactgggatatccatcacctcaaacatttatcttttctttatgttgagaacatcacaattctcttccatctattgtgaagtatacaataaattattgttaagtataattaccgtgtggtactgtcaaatactagaacttatttcttctaagtgtatttttgtgcccattaactaactttcccctcccccccccacccctttttatttctcagcctctagtaatcaccattcagcctccatgaaattccctgttcaggtcccacatttgagtgagaatgtgtgatatttgtctttctgtgctagcttatttcacttaatatgatgaccttcagttccatccatgttgctcgaatgacaggattttattctttttgtttgtttttgagatgcagtctcactctgtagcccaggctggagtgcagtggcgcaatctcggctcactgcaacctcctcctcctgggtcccggttcaagcaattctcctgccttagcctcctgagtagctaggattacaggcacgtgccaccatgcccagctaatttttgtatttttagtagagacagggtttcagcatgttggccgggctggtcttgaactcctgacctcgtgatccacccacctcggcctcctgaagcgctgggattacaggcatgagccactgtgccccaccaggattttattctttttatgggtgaataatattccattgtgtatatctaccacattttcttccaccattcatgaattggtggatatttaggctggttccctattttggctatggtgaatagtgctgcaacaaacatgggagtgcagatgtctctttgatatactgatttcctctctcttggatatacccagcagtgagattgctggctcatatagtagtactatttttagtttttgaggaaactgcatgctgttttccataatggttatactaatttacattcccaccaacaatgtatgagcattcttccttctccacatcctcaccagcatttgtcttttttataatagtcattctcactggtgtgagatgatgcccccttgtggtttttatttgcagttccctaatgattagtgatgttaagcatttttttcatatacctgttggccatttgtatgtcttcttttgagaaatgtctattcaggtcttttgcctatttttatagtcagattatttgttgttttttttgttttcgttttttgttttttgtttttgctattgagttgtttgagtcccttacatattctggttattcatcccttgccaggtatatactttgaaaataatttgtttcattatatatgttgtctcttcactttgttgattgtttcctttgctttgtagaagcttttttggcttggcgtaatcccatttgtttatttttgcttttgttgcctgtgcttttgaggtcttacccaaaaatctttgcccatatcaatgtcctgtagcatttccccaatgcttttttctagtaatttcatagtttttaggtcttatgtttaaatctttaatccattttcagttgacttttttaataagttaaaaaatgagcatctagtttcattctttggcatacagatagccagtttttccagtaccatttattaaagaaactgccctttccccaatgtgtgttcttggtgcctttgtcaaaatgaattggctgttaagtgtgtgagtttatttctgggttctctattctgttccattggtctatgtgtctgttttttatgccaataccatgctgtttgggttaccatagctttgtagtacaatttgaaatcaaagtagtgtgatgccttcagctttcttgtttttgctcaggattgctttaactattctgggtcgtttgtgattccatttgaattttaggattcttttttctatttctgtgaagaatgtcattggtattttgatagggattgcattgaatctgtaggttgcttttggtactatagacatttcaataatattaattattatttcaatccaggagtgtgcatatctttccattttgtgtgtgtgtcttcaatttctttcatcagtgttttataattttccttgtagatgtcttttactttgattaaatttattcgtaggtttttcttattgtaaattggattttttttcttgatttctttggtggattgattgctgttcgcatctagaaatgctactggatttttgttttgtttgtttgtttttttgatacagggtctgacgctgttgcctaggctggaatgcagtgatgcaatctcagctcactgcaacttctgcctcccaggctcaagtgatcctcccgcctcagcctcctgagtagctgagattataggcacccgccaccaagcccggataatttttgtacttttattaaagacagggtttcactatgttggccaggttggtctctaacgcctggtctcaagtgatttgcccgcctcaggctcccaaagtgctgggattacaggcatgggccaccgcacctggcctgatttttgtatgtggattttgtatcctgcaactgtactaaattcatttaccagtcctaagagttttggggtggagtctttaggattttctaaatataagatcatgtcatctgcaaacaaggataatttgatttcttcctttctatcttggatgccgtttctttctttatcttacctaattgctctggctaggattccagtactatgttgaataaaagtggtgaaagtgggcatccttatcttattccagaacttagtgtaaggctttcaatttttccccattcagtatattagctgtgggcctgtcatagatggcctttatcatgatgagttatgttccttctatacccagtttcttgagagttttgatcatgaagggatattgaattttatcaagaactttttctggcatctgttgaaatgatcatatgatttttgtcctttattctgttgatgtgatgtatcgcatttattgatttgcatatgttgaaccatcttttcatccctgggatgaatcccacttgatcacagtgaatgatatttttaatgtgttgtcaaattctatttgctagcactttgtcaaggatttttgcatttatattcatcagggatattggcctgtagttttcttttttattgtttcactttgtctagttttggtatcagcgaacaatatgttcttttgttttcctgtcaaatgatgagttgtagaattgactcaatgttacatgagttttaggacaattatagtgaaagaaaagtattcaagggagttgaggtttatggtcaaagagtagctcagggaatcaaccatgcaatccatgctgaggatcctaagagggactttttctaccaggagaaaatgaagggattacagcattaaagttataatggaaatgagggtgggagagagttgaaagaagaaaagtttttgatctgagaatatgatactagaatttaaaatttcagaggttgaaaacaggatttaacttggcagcaagttattaatatatatttttaatttgcagtgatttaaagaggtgtttgtttttctaatatagcaaaaagtctgaagtcaagcagttgcttcttttggccaatggtccaacaatacttagtccagcacctctctgattcttggtcttttcctcttaataggaagatgatgcaacttcagatacctcaatcaaatcagaaaagcagggaaagtgggagcaagtggtggccacagcctcaattctccttttatcaggaaaaacaaaagacttcccaaaagccacaaaagactctacttagggggtcagtggacagactatgacacacgaccacctctagcaacaaatagggctgagaatacaaatatttagccttccagaatctgtaatggagtgagcaagggagagaatggaactggaagtaactgttggttcgccaaaaaggcagtgtctgctccaaagaccaatgttcagcttcctttcgtggaacaatgtttatgtagtacagaaagccacaatcatcctgccacaaacagctaactaggtgacttaaagatgcatgctttatgatgttcccctccctgtgcccatgtgttctcactgttcaactcccacttatgagtgagaacatgcagtgtttggttttatgttgctgtgttagtttgctgaggatgatggtttccagcttcatcgatgtccctgcaaaggacatgaactcattcttttttatggctgcatagtattccgtggcatatatgcaccatgcctatcggggggaggagggcaaggggagggagagcattaagacaagtacctaatgcgtgcgaggcttaaaatctagatgatgggctgataggtgcagcaaaccacaatggcgcctgaataactgtgaaacaaacctgcacgttcagcacatgtatcccagaacttaaagtaagctaaaataaaaataaaagatggcatgctttatgcagtggtcacaggaggaacagacatactaggaatgatctgatgtcatccatccctagtattaggaaaacagctcaaagtgcatgtcttcataaagcgatcaagcacttacatatttaaagcccaatacgcgtgggctcttctgatatgaagggtaatactatagataaatatacaacaatgtagcctttaaagggtatgtacaaggttttgtgtgtgtgtgtgtgtgtgtgtgtgtgtgtttctagtaatctcataccttaactgtaacctcccaagcagattgtgttagcattgcttttttatagattttcatttgacattgaagagctagttaattgcttttgtggtgtcttagattgccatgcttagtatttctttgctcagtatattctttcttgttaagaaaactttgtaagtttcagtaagccctgaggagttcacaagccaactttctagtagagctctgggcataatttttcatgttgctttaataaaatgttatctttttgccatagattatggtcaagtgaaatgtacagtgtgctgttacctgaaactactttttacctcactcattctaagttttacctcagcagctaatcttgccatagacttactcaacttagatatttttttaatttgtaatttgacagtggtcaattgccacatgataaaataatgtatttacaaaataagaaatgcaaattttttaagtttcttggcgggatttgtccagaatgcctttgatggaatttggtctattagtatagctttggacctcagattaggagtgagacttcaaagtccaatttctgcctcttctcattgatacgtagataactctccatgctacagtcactatcacccaatagaggaactgaagggctgaaaagccctaaaatgttttgaaatatcatagttgtatagttgctttccctctagcctgttccatgaaaatattgcaaaagcagtgatcttgtcttggcgatcaaacaacatgattaatgctaacgttagagaggagatgcaatgtcatgcatctaggctccagcagatcaagttagtaaacatctaggatgataccaaggctggcaataatttaaaatctacattgctacattcccttcctcctcacccatcagttcccttgaactacattctttttttttatgtttgccatgttattttaatttattagagtctggttccacagaggagaacttagccttacatgttagaagcctggattgtctatccaggcccttttctggacttagcaaagtttaagaatggatatagtgctgaaaggtcataagtgtagacactacacactacagcaagatgttggctctctaccctataaggtgaatgaccttctgagttagtgatgcctcaccaattcccatgttccctaagtccagagagcctctttcttccaaaggactctttgaaaaagagaaggatgttcatacagaaaagcaaaacatatcagaaattgaataaagattgatggaattattttgtaagtatatggttgctacagcaaccattaagcttaagacctaacctggacaaatcacttgctaaagaataataataattgcttatgtttcttgcttatattaagttttatatgttgttattctaagtgttttgcctacattaattcatttaaccccatgatatagatactattaccctcactttacaaaataaaataataaggcagagaaaatttaaataattagctcttggtcacataaagtaaatgttggagccaggacttaaagccaaactttgaggctctagagagctaagaaaacttttgaatgagatcaccaaattattgttggttgggaatctttgagaaattgtgaggacatggggatacaatagaagtttagagataaacagatgtagttttttgtttttgttcagcttttttttgaagaaaatgtctaagtggtgctaaatattttaataaatcgttttggaaatatatagaaggtagctttatcaaattttccaaaaagaccttcttagggcttttagttggccataagctatatatgagttgaagtggaatacagcacactaccacttccacctcccagaatttagggaggtgtaaagcgtcatggcatctagaaaaagggaattgatcattctctctagactggtcagccccttctgtagtatttattctgttttgtcctgagttctacatttcaagggaaatagagaaaaattggaatgttttggtaggtaaattttgagaattataatttaattcaatcattagaagaatgggtgaagaactgtggacattccgcatagaaaagggaagacttcaaggaagccaaaataggtatcttcaatacttgtagtactgactcatgtgtgaaggattacaaagttaggtaaaattagagccaatgattagaagttaatgaaggcagatgttggcttgatgtaagatggtcaaatctttcggagatggaacaggctgccttgaaaggtattgagtttcctttcgccagcatttgtgtaagtgtgcagccagaatgtggacagccacttgaaggtgcacagaagatggaggcacagaccagatggttgggccacatgacagtgaaggcctcttccaactctgaggttctgtttctgtaggttggtgcaaaagtaattatggtttttgacattgaaagtaatacttttgcaccaacctaaatattattatatgaattgattcaagataagccactgcacttctatgtgtaatcaaatatagaaattgtctatcatgtcttggacttctaatgctgccaacactagtgttaaccaagctagtaaaaacaagatgaacagcaaaataatatgtcatttcagaaaaatctgtaggcatctaatgaaatgattggtgttttatccttacctttcagtgctttctcctgctcaagacagccacacgaacacggatctccccccagtgtcagagcagatcatgcagactctcagtgaacttgccaaatcgttccaggatatggctgaccgctgcttgcttgtcttacatctggaagtgaggtatgatacagccaagcccaggaccttgcaatttgaatgcactgcggttcataaatcacttgcttatttccaggcagtatcaccataatttctggctcatattattgatgttatccctttttacactgaaagtgatttttagctgtattcagtgattatttgagcgcacagtgtattgtgagtgtggtgattcagagctggcatgatctatgaaatcaggtcacctagattggaatgtcactatcaactggctaggtgatcttaggtcagttaattaactttacaaaccacagtttccttattttaaaaatggaaatgatagtttctaacttatagagattttataaatgaaataataattagcacaatgtcagccacaaagtaagtgctcaaaatatggtagctttgctattgtggtgactttattgtgattgatatttttactaaagtgctctgctagtcaagaagggagtcacatttgaaaaagtagagggaaacaggtaaaagaattatactaatatattttagttaacccagtatatccaaaacagcatttcaataggcaatcaatggaagtgattgaggtattcagcattttcttttgcactaagcttttgaaatctgcacattttgtacttacagcacatcacaatttggactggccacattttaagtgcttggtagctacatgtgcccagtactagcatagtgggcagttgccaagagtggctggggctgactaggaatgggattcttttctttaagataaaatggtcagaagaaatgtgacaaagtaacaagaatgatcagtctgtacaaagacctagaggaagagagtttcagacagaaggaggcacactcacaaaggtcctgagacaaaatcaagcttggcggttttaagagcagagaggaggctgatatgcttgtaggctgatgaacaagctgggtggggaggactgaaagaataaggcacaggagacaggctggagcccaatcctgtggagtcatgaagcctgacacattacagggtcttacagaccaagtgaatcattcagatgtcatagaagccatggaagagttttaagaaagggagagatatcaattaattaacattttttaaaggtcactctggctgttgtatggaaaagggattgcagggaaaaatacaaatggaagcagggtgaccagttgaaaacaactctgagcatcaaggtgatagaggtagagatatgagaagcataggatttgggacatatgctgaaggtagagctaatgaagtttgttgacagattgtattggacacaggggctggtgcaataagaggaaagactcaaggaaaaccactagtttggggccagagcaactgtgtgccattaactgaggggagaaacactgagggaggagaagggtggaaatcaagtatgccattgagagatgttcagtttgggatgcttattaaacaactaggtagcaatgtcaaaacatcaggatcagaaagtgcatggtgtggtaatacattctattctgtattgctttggaacatgattaacattgatagaatatttttcttttcatttgaagtctttactagatttagattttaaaaatgtaaataggactttgtttgataggtgacccttgggaatatgtttggactccagttagaacttggatttctttccagggtgactccttgtgtgtgctacttgctttttatccttcattaccattgcccagtgagttacttccttattgcttgtgagagccttgtgagtggaacaagagaagtaacattgcagatttagaatctgtgttacgtggcattattcctgatgttatttctcacattaagctgtccagaaataaagctctttctgtatattttctgatttgttttacaataattttcatatttggtatctctttatttacaagcggacagagaaatcaggtgttttctatgaacaaatatttgcaatagatggaaggaaatgaaaaataccaagtaatattctaatgccgctgttacctgagttacaaaggaaaacaagggaataccaaattagttactatcacaattcctggaatttatactattgatcgtgtgcttatacatattctacattcagaattgtttacttatgtgtagttaattccaagtgggatatttgcaacacatttgaataagatcttttaaatccttaacccctattctgcccttttgatacatcttggcaatactcttcttaatactgaacatgctttagtcattaatttacaagaaactatacagtgctatagcactggttgccatatcttcttcaacattagtctaaaaacagaaaaatgtcatttttaagaatgaatatcaaaaaagactgaattttagagccctggatgtagaattatctttccttgaatttaactcagaacacgaagcatgggatttttttaaattaaatttcctcacttcctcatgtaacatggttccaacactcaggttgctttctaatgagtatgctccattttgtctttgttccttttaaagtaaggtagatacaactagcagaatacaccacataaggctcggatagtgaatgtagatgcacttactctatcctggtcacgttaacaattttttttcagtttgcacagtgatgatacaaaatgaaaaagacagatttcatgccactctagtataataacgctagaatagaggtgtctgctaagtgctctgggggcgtgactgtggtagagaccatcgagcagctcttccaggtgtggcttgttcattgtgatggctggccctgaaacctaatatcctgctgtatataaggtgctcagtaaaaatgtgattaagaattagttggtttgaaaccaaacccagataaagtaagggctactttacaaaacaaaacctgttgtctttaaagaaaatgaattggtttgcagtttctgtttttacatagcagtccacttgtaagtccactgcattatcttaagaggtacagaggctgtgtggccaatatcattctcatcaactaatgtttgttttgttcccatcctgctgtaaaaaaagaattagaacgtaggcccggttgtccaggagctggtgtggtgaaaaagtggctggttagctcctgtctctggcacttttagccaagaaaccactgtaatagtacagatagaagaaaacaattcatggaaaaaagtaatgggatatgctagcaaaaagtccagaacaacttcagatgccaaaaattggtcttgttcccccaaatatctttatatccatagcccatatttttctttgacattgttaaaattcaaaccaaaaactgttttccaatccagcgcagtctgtgttgaaggatccatctaaggagtgtttgacattttacctgtgtcattgtaggtcacattttaaccaccaagcagcccctttccacagtttgaagcataaagcaaatgatacccccaagagatgaaagacatggtgagcccattaaaaactattgaggtttgttttttctatttgaactttagaagaagaaaattaagttgccatttgagtccaagatgccaagaatgtcacctttatcagctgatttttctcaccatcaggagggctctaagtaggttcaacagcaactgcctatcactgttgggatcctaagtgtgcactctctgaaaatcatccaccccactgtgtaatcagcagtgtttgcagaatacgttaatgtcaaagtcatagtaaggtcagcaacaacaggccagaatttaaatttaaaaaaatactttatttgaatttggcattcgctgatgactattttaatttcttttttttttttaatctctaatcacttgggaagaagataataccttaaagaaaggttatatgtcttctcccccagtagcttgaaggtctcataagctctcacctccagttcataagaatttcctaactagtcactctacttccagttgcttccattctctgctattaatccacttgtatactgtgccagagtgatcttgccaaagctcaggtctgattatattattcacttaaaatccccctaaggatccctatggcttctaggataaaggcttgattccctacatggccttcagagcctgtgctgacctggcctgtgcccatctccccaagctcgtggagtgcctgtaatgtgggatctgtgtgcagcagaaaagaactgctcaccagtcctcagaacatcctgcatttatagtctcatgctattttacatggtcttctcattgcctggagtcataatgtctgtcatttactttaaaaatactttagcatagatgctttaattttattttcaacaaagtgctacttcatttaaatttcaaccacagtagcaatcagtgtgctagtcatgaatcccattccagagttggtcaactttcattctgtcagaaagctcacattccagaggaggctacaaccagtgccattactggtattcttatcaaaattatacatttgtgccaattagtacttgaatatcagaatgagtttttattggtgaaattagtcattagttaattagcaactgttaagatgagcatctatcagtaaaaatgagcagtagtcaagatacttggattctcttggatgaactgcttataagaatatgacacatcccatataaaacttagcttaaaatggatcattcaactaaatgtaaaatctaaaactctaaaacttctagaagaaaacataggaaaaaatttttatgatcttttttaggcaaagacttctgaaatgtgacactaaaaataccatccaaaaataaaaaagttataaattgaacttcatcaaaattaaaaccatttttgatagacattgtcaaggttaaaatacaagccaaagaccaggagaaaatatctgcaaagtccatatctgataaaggacttgtatccagaatatataatgaactctcaaaacttaataataagaaaacaaaaaacccaatttttaaaactgggcaaatgatttgaacagatatttcatcaaagatatacacgcagaaaataagcacatgagaatatgctcaacatcattagtcattaggaaaatgcaaattaaaaccacagtgagatactgctctacatctattaggatgaccaaaaatttttatttaaaactgacaacaccaagtactgatgaggatgtggaacaactggaacttttgtatactgccagtaagtaagcaaaatggtacagctcctttggaaagcaattggtaatttcttacaaaagtaaacatacacttaccataagtgagatctagcaatctcacttccaggtatttatccaagagaaataaatgcaaagttatatgcacacaaaaatgtgtacatgaagtagctttatccacaaccacctaaacctggaaagaatctaaatatcaatgggcgaatagataatctgtgggacatccaattcagtggaaggctacccagcaataaaaagtaatgaacaacatgggtgaatatcaaatgctttgtgctaagtgaaaaagccaaactcaaaaggctacatactgtatgattccatttatatggcatcctggaaaagacaactgtaggggcagaaaaatagatgagtggttgccaaaggtttgggagttgagtagggattgactgcagagggacacagggaattttggaggagatgtttgtgttctgtaatttggttctggtggtggttatatgattgtacatgtttgttaaaactaatagaactgtacactaaaaggggggagttatactgtttgtaaattatttctcaataaacctgactaaagaaagatgacaggcaaagcgtggtcgcatcattagagataataatgcccaaggcttttgcagccattcatttgggaatatttcttattacttgatgccaactgtaaaggtaacagaacatagaccctggattatgtcatcatttcttacctccggtgaaccttccatgcaaggtcagacagagcacctaaaacaacagagttaggactagactgggcttatggaacagcctgtttgaactctgcctgccaagggatactattggtttgggatttttttttttttctgctacggtgggggattcaaaacaaatacctgcatgtagggcagaatttggactgaaacactttgattacaactttaaaaggctgtggcagtgcagccaatccatacccacctcagacttcctcagcagctactaatatctgccaaaaagcacctgagaattgtgtgtgaccagactgacacaggccattttcacacagaaatgccctccttcctcaagctgtcagatatgttctgtgagactcaagcatcaccttctgtcaggaccctttcctgataccccgtggcacatttccatggcacgtggatggatgtgcttagagtgagatgctgttctcttttagtcatttttttcttaatctaccccactaggttatgggtctttagggatacaaactgtcttatatttccagggcctagcacaatttcttacaaattcatagaggttccatacatgatttagttaactaataaattattgttaataaatataagactagtgatgacagccagtacttactatgcacgccatttgtgccagacactgctatacttaacactttacatgtagtagttactcacagcaccttatgagacaggtgttgttttcacccatatttcgtggataaggaactgagggatagagagataaagtaacttgcctaaagtcatacagctggtgattgaagccaaagtagtctccttacacttttaagatctataaactcggcctctcatcttcattgcaacaatatctgttgaaaattacaatgcttttcacagtatgcctacaaccctggcattgaagagaattttagaactccttcccaacactgtatagattaaacaagcaatgatcatagcagccagcttgccccagatcactcagttgttctatagaataactaagatggctttctggttaaaagaggggagggtgtttacattaaaatgtacaaggccacagctgcttcatattaagtgtagagcatagtgtctggcacaaatagggtacacagtaagtgttggctatcatggctagtcttacatttattaatgataatttattagttattttggtgctctgtcccaagatcattgccctccctggaaggatttattattaactgctctccctatctctctctttttcagggttcactgtttccactatcttatccctcttgcaaaggaggggaactatgccattgtggctaatgtggaaagtatggattatgaccccctggtggtcaagctcaacaaagatatcagcgccattgaagaggccatgagcgccagccttcagcagcacaagttccagtatatcttcgaaggtcagaccctgcttctgtctctgggagtttgggaggaagaaaggatgaaagttttcctgattttctgtattactgaagttcaagacttgtagaaaagagttgtttgcttgcttgcttgtttgaactaaatctgcaatacctagcctctttgtgtatgactaggtagacaacaatatggccgccatctgctccgggttgataaggagatttaatccaagataaggcagatggctgcctccctgacatgccattcatgagatttgagagaatgtgcagactgggccacaaattaactcaagaggagcttataaaagaaaaagaaaacacacatacacaatgaggagagaatcctgaaagatcactcattggctaaaattatcactggaacgggaagttttctcacagaatgttataatcatctggaaagaacagaagcctctgattagaggcaatttttaggaaggacgtgtccataaatgcctccaaggggcaggcaaggaagggtgtgagagacaggaagtgccatctaaagacattacccttcacaatttggaaaaaatgtgatggcacccaaataatttttcatggtgaatttcacccagaggatccctgttaggactccacattatgttccctttgtccatgttttggtttgtttgtatgaaaacttgtatctgtgttctctcacagaattaaactagtattatttaaaacaactaagaaggtacattgtccaaaggattgtggcaaactgacaatacatggccaatgtttgctttatgaaagttatattccagcaaatttgggccccccaaaatccaatccttaaatgtatatggagttataaagagatgtgttctgttggggtatatctctcaaagactttagccaaaaagtgtaagtgattgaagggttagctggcagttaaccccatggcactatgagtttggtggcatctgtaatattctgcagctttcagctgcagtgcctacctgagaattcacttttctgttattacaccgagtttcctctgtgctcttgactgtggctcttcccagcccctgcatatcaacatttgttttattcctattacaaaatgcatttaatatatttattataatatattattatttcttattctctacaaacagcataccccttcattgcccagtcttgcagaccacgttatattgtggcagcaaaaacaaacaaacaaacaaacaaacaaaaactgtacctaaagttacagacttgagagaatgacaccaaaacttggcctacagagatttttcatataaataagttgtctagttttaaatgtagaatctgcagttgtgtttttctttgaataaaaacttttcttcatattcaaatagtaacacatacaagtttgtggtcttgaagcaatgttgtttgagtgtagctgaagcaagacctgaatgcatctcctccctcatttctactttcaccttaatcaagggaaaactcattttgaagacatggggagccatggacctaaagataagccccgcactctgatctaaacctcagagtctcggggaagggactagacttcagaacaggaaaacaaccaatagcaaatggcttgcaactagtcagaccagtttacagttccaaggaaaatgtcctgctagcatccaagaataagaaagaaggaagaaacgtttactgaattccatttagaattaaaatccagcttttaaaaatagtaacccatatgtgcctcacgttgttctgaaccagtgtctctcaacttaattacatgggatatcctgaggaggacttattagtttgctgatgtcctgagctgccctttgctaaattttgcagaccataagacaaccctccagacctaagagcaaactacttgtgggggggccccaaaatgtccacaggtgtctcacgggaagtcaacagttaatgtatgatctgcttttccttcacccttttttctaattgtgtcttatacacccattgccattgttaaggtatattagcattattgccaataacccaatttcttattgatttattttttacttggcaatgttgaaatatattaacattattgccaatgcccagtgtcatattgattttatttatgtagcttcccaatcaacttttgagcccaaagtgtccttctctactttgtaggaggaaggagaggcaaaagggtcattgtatatgcctgtggtcttctctgcttcccaattgtgtataaagaaaagcgggatttcctgtgtacttcaacagtttataataacctggcctcttctctaaggccttggcatggtggcagtaggtgtacatggcaatgctggagatgtggctattaccaggctttgccaccaacatgaagtccactcatttgtaactactaggacaatgtagaaataccctaaaattattgtcagatcagcagatgcaaccatcagaggtagattttctttggtcgtttaaatgtatagaggattagaagacagcaattctgtgtgcaagtttctgcaggaatgcctctaatctgtcatccgttttctttgccccgcactgtgctgacccctcaggcctgggccacctgatctcctgcatcctcattaatggtgcccagtacttcaggcgcatcagtgagtctggcatcaagaaaatgtgtaggaacatttttgttcttcagcagaatttgaccaacatcaccatgtcgcgggaggcagacctggactttgcaaggtaggagggaaaactgggtttagtttcttatgccaaagctaagacctcgttgcctgtgaagtcatttttaaaaatagactcttggtgcagaaaaagcttagtttaaaaaaagaaagaagcacagatagatgtttttaggtcctatagagaaaataattccacagaattctattgaattttgttactttggcagatagtttttcctgatgtctaacccaagttcttcttaactacaatacttgaataactctttttttctgcatgtaaaagtatacatgctcattgcataaaatatataagataagatacaaagaagaatataaacctttgatctagaggctaagatatttggtatattttctcctggcttttttgcatgtgctgtgttgtttatgtgacttttcacacatattcaagcatgtgattgccctttttccaaaactggaactgtgttaatgcaattttatattaatttaattttgttttcccctatcaataacgttgtttgaaaacataatttttccacgttcgttaatactccttgaaaacgttacttttaatgatgcctgaataaatatttcatggtataaatgagccatatttattttttcatcacttgcaaatttttgaacatttgaatttttccctttttttctctcattgtgaataacatgtatctactgtatttttacaggaacctacttctcatttcttccatcttgttccaattgaaacccatctcttcttgttctcactgggaggaaagtgagaactcatcactatcctttctcttctctaagttttctgatcttaatttttttttaagtgacagggtattgctctgttacctaggctggagtgcagtggtgtgaacatggctcactatagccttgaattcctaggctcaagggatcctccgaggagctgggactaaaggcgaacaccaccatgcctggctaatttttatattttttttatagagacagggtctcactatgttgcctaggctggtcttgaactcctggcctcacgcaatcctccttcctcagcctccaaaagcactggaattataggcataagtcactgcacctggccttgatctcaatttttaatgtttttgtacaatacagtttttcaagatttgagagttaatttttttctctcttcatttgtcttaaccccatctaaaccttaattagaatatcaaacctttggtgctttaataaaagcttaagcaatttgaagatgatagatgataaatatgttatcttcatgctctattgccgtttatacctgagtggattattccgtaaactcccttattttccaaagcctttatggctaggaagtcctttgtttttaataatgcccaatgtttctgcctgagatttagtatttctgtggtcttttcacttgatttttttgattctttgagaagtgcaggaaaatttgaaacaatttatggagatgatgaaatattatattacttcaacaattgtaaagacaatatgctgtgatctttgttttgggtatgaaccatatatgttcatttttaacctttcttcctcaatctgttactccatttgttccattgctaccctgttcctctgcttttctgtccttctccttccctgtctctttctttctatttgtgggaaagtgagagagagagagaaagtgaatgagtgagtgtgtgtgttttcattaaattccctgttttaggctaaatttgatggaaagccttccttgctcagattagggaaaccaggtgtgactgaatgctgcatttatttggtcgctcttatggggaatgatctcattattgaattagtctagtcataataacattgacaaggagaagttaagaacatagaagcctgagggatacaaaaacccattactaatgctctaaggaatataattcctaaattcaatcatcctattttaaatgattttttttatttagctgaaataagtaaattaacacagtttttggcagacagtctggggcctgaaaaacctggcatctgaataatgcaatgctgactgggcaggattgaagttggcatcagcaggtcatgtgccgatgaagcatttcttcaggaactgagtcccaaccacgccttgcctttcacagtcggattggtgaattgtgtcccaggaagtaggtacaagtggcatgtgaccacttgggacatgtattgctactattattctttattctgacatggatttttgacaggaaataggctagcataaagatacagcactggatgaatctgttcttctgattctgctttagaagacatctccttactaagactaagctccaagaggccgagactcttttctcagtgcctctaccaaagtaagtgttaattgtatgtactgaatgaatgaaaagatatcaaatcaaggctaattttggtgtggatgaagaccttggatattgacaggtcagtttatgtttaattgcctgaaagtttaaagtagccggcatgggtcagttttcttataagcttgtaagaaaaagcgtatcttccttgcagttcgttctttgtaaaacagaaaccatattgtagccctactactcatagtctctttccctctcattttttcttgttttcatacagacacactttatagccttatttttcccccgcttcttgtttttggtagggacaggttttgtgaaaggggctccatcaattctaccatatttgaagctatgtaaaatacataaaacagcaataccaaaatagccagaaataatagactgcagcagtgtacctcagcattccttaagcaatgtttaatcaagcatggacagcatctgtatttccagcaaatctctataggaatgttatcttctaacacagtaattaatcactagttgccgtgtgtcagaaaacttatttaacaagaagttgcaaagtgcttgtagttttcttaccttctcagccttcctggccagtggaaaatataacacctttctgtaataaagaaatgaaggatctggagggattccattgatgttgattcttctactcatagtattgttatcttgtctctctcttttcatgcacaccttccctctaactaatctctaaatgagggtagatcttgggtgagcaaaggaaccagacaacttgtaacattaccagaagtacagagagcctctgtcctctatggtaatgatcatttaagctctcttacggttttaacccccctgttaattttcagagtcaaaaagatactttatccaggaaaatcagtgtagatgagttagaaggtggaagggctttatgagtgtgcttttttagttcctttcatcacagatcatcttaacttgagctgtcatgcacctttccacatgtgagtcacagaagccacctaggagtccagatggtggcagcataacaagagaggtctgaacgaacgatgattggagtccccaagatatatctgacaacctttctagcttgagtgacgccattgttcaaaaagaatatcccagagttttcttcccagttctcccctctttaccccattttgtttctttctctgcctcttcagctgtctcttttttctcctttatttctccaatagctctacttcctgctctcctccttcaaggtttcattgctcctcagtttttcccctgattttggttttttttggactggtatctttcattcttaaacctgcacaaggtaaggaaacaaaagctacgattcgggaagcggtagggcgaaaaattgtaacacccaagacagattcctcgcccggttattccttcatttcttcattccttcatcaaatatttattcagcgtatgttctctgtaggtcctggcctcatgaaacttgcattactgtggggcaagatgcaaagtaataaataagtaaaatatatataaagtatttcagatgataatatatgctgtagttaaaaaaaaaaaaaaagagtaggcatggggaggggaccagagggtgccagagtctaatggaggtaatccgaaattttagagtgttaatggaagtccttaatgagatggtaacatttgaggaaaaacctaaaggaagagtaggagcaagccatgcagctatctagggaaagagcgtaccaggaaagaacgtctaagggtgaagagccagagggaggcatacacttaacatctgaagaacagagcagaaaggccagcatggatgaagtgagtgagcaggggaagagtaagagatgaagtctgaggtttgatctaaggagctgagatctggaaagtcattgtaatgacactgagttttactttgcatgaggtaggaagctattagaaggtttggagcagaagagtgctacataatgtgaatcagtctggccgcgatgttgaaactaacatcacagttgttagttggggaggggaggttgtaggcaaaggcagaagcaggaagctctgttagaaaactgtggcaataatcttctaggtaaaaggtagtggtgattcaaagcaagatggtagcattggagaggatgagatatggtcagatgaggatatattttaaaagttgagctaacaggatttgctgaggaatcagaagtgaaccaaagactacaaagtttttgatctgaacaattcaaagcatgaagtttttatttactgtaatgaaagtgaaccagaccataggagaggctattgaagtgtgtggagggcggagagggggttcagatagagaggggataacaagaaatgtttgagatgcctgttaggcaccagaatagacataaaaagggagccggcaatacaacctggagttgagatgagagttttggagtcatcagcatataggtgggatttaaagtcatgagaaaggctgagaggtgagatctcaataggagcacaagtagatgaaaaagagaagctgtccaagaattggaccttgggtaccccactgttgagacgctggagtgctagcgaagaaccagcagaggaagttgaggaggcagccaacagaataggaaggtagctaagaaagggtgttgtcccagaagtcaagggaagtgttttaagagaagtgtgtcttcatctgtgtcaaatgctgttgataggttaaattagctcaagacagagaactggctactggtgggcttgacaagaggcctgaaatgctttggtttgcattcctttatctttcatacacaacttacctaaagtaggaatacgcttcaaatgtatatatttgggaataagttcctcactcctcaagtctacggtagggtttgatgtcatcagggcaaaacaaaaatgcaattagagtatttttagtgtgctatatgaaaggccaaattggcagcctctcttttctcaaggtcagtatcaacatgcataaatcatgttgacagtatgtctatgtgcccttgacatgatgtgatgaaaatggcacgttaccaaaacctattacctcaatctaatcatgagaaagacatcagaaagattccaatagagatacattctgtgaaatacctgatcagtactcatccaaactgtcaaagccatcaaaaacaaggaaagtctgaaaaactatcacagccaacaggagcctaggagacatgatgactaaaatgtactttgacctcctggatggggtcctggaacaaaaataacattaggtaaaaaccaagaggccctgaatgaactatagattttagttaaaataatgtgttaatattggttcattcattgtaacaaatgtatcatactaatgtaagatgttaataatagggaaactgggtacaaattatatgtgaactctgtactatcttctcaatttttctgtgaatccaaaactattctaaaaataaagtctattaataaaagtattaggcaaagtatttcagagaacatttatccaatgaaaatatacaggtggctaattcatattaagcatgaaaaatgctcaaattcatttgttattagggaaatgcaaattaaaaccacaatgagacatcagtctgtgcccagcaggattgctgtaacaataaaaaaaaagaaaagacaatgaaaatgttggcaaggttatggagaaactagaaccctcatttgccgctggtagaaatgtaaaatggtgcagctgcatcatttcctcaaaaagttaaacatagagttatggtatgacctaggaatttcactcctaggtatatacacagataaatgaaaacatacatgcgtacaaaaatacgcacacaaatgttcatagcaagcattatgtataatagccaaaaagtataaacaggttgggcgcggtggctcacgcctgtaatcccagtactttgggaggccaaggcaggcagatcacgaggtcaggagatcgagaccatcctggctaacacgataaaaccctgtctctactaaaaatacaaaaaaattagccgggcatggtggcagatgcctgtagtcccaactactcgggagggtgaggcaggagaatgcttgaacctgggaggcagagcttgcagtcagccgagatcgtgccactgcactccagcctgggcgacagagcgagactccgtctcaaaaaaaaagtacaaacaaccagatatccatcaacgtatggatgaatagaacgtggtacattcatacaatggagtttatttggccacagaaagacatgatgtgctgaatcttgaaacattatgttaaatttaagaagctagtaacaaaaagctattttgtatgacactattcatatgaaatgtccaaaatagtcaaatttatagagatagattagtaggggtcgaaaggaaatggggaaatagatagaggagtctttggggggtgatgaaaatgcactaaactagattgtgctgatggttgtacagccctgtgactattctaaaagtccttgagttgtaccctctaagtctgaaaattatatggtatatgaattatatctcgatgaaggagtttaaaaaaaaaagaggttgagttttaagacttgaaaaattaaatcattcatcataggaaatgaggagccaaagttttatcctcccattagtggggaaacttttaaaaggaaatatttggctcattttttagtttccctaatccatcctgagaggtagaagataaaggaagaatttttggagaaggaggtgatacttcatattagtcttcataggaattatccagaatagggagaaagtcatttggaagagaaagggtagttccggggactggagaagatgttcaaggaaggaggtggtgaaagaagagacctgagtcatcatcaggcctgaagtcagggctggctttgggtaagccacaaatgccaccttattaaggccttctctcctgcactttcaaaacatgccttcctcccccaccagcactccctattgtccttaccatgattttaaaaagcgtatatctgacatatttcgtatttacttatttgttcctcacctgtctacactgaatagaatgtaagctccataagcagggactcttttttgttcactgctgtagccccaggacctaaaccagtacctggtatgtagtagacattcagtaaatacttgtggggtgttaaagttatttggactttgtcctgtacgtaactgaaggattttaagcagaggagtgagatggtcagatttatattctaagtacatcatttcagcagcagtataggacttggatttgaggaagataaaactggaggccttgccaatcaactggaaggtgattgctaagaaagtggtagggggctaggcacggtggctcacacctgtaatcccagcactttgggaggccgaggcaggtggatcacgaggtcaggagatcgagaccatcttggccaacatggtgaaatcccgtctctactaaaatacaaaaaattagccaggtgtggtggcacgtgcctgtaatcccagctacttgggaggctgaggcaggggaatcacttgaacctgggaagcggaggttggagtgagctgagatcacgccactgcactccagcctagagacagagcaagactccgtctcaaaaaaaaaaaaaaaaaagtgatgtgtagggcttcaacaatgtatcagtgcttggtggtggggggagtggggatggaggagacatatttgagaagtgtgaaggagctaaaattggcaggtcttggagagtgattgaatagtgagggtaaagtgaaggagtcaaggatgactctccaatttctaacatgagtgtctagccagatcacactacagtcaagtaagataaggatacaggaggagagaggagtaggtctgatggagggaagatcatcagtggttgtggtgagtataagatggatgtgggacttccaagtggagacatctaacatgcaactggatatgtaaactggaagcttgagggaaaggccgggagtgaacaaacagatatggggaatcatcagcatggagctatttaaaaccattaacggagatcaaggctgtaggtagatggagagtaatcccctggggaagacccaaaagggcatgagaaggaagaggagcccctgaagaagatagggaaggaatggtctcatagcacaaggacagaacacagctcatgaagaccaaagagagtgcatgatcacatagctgcctgcacagaaatgctactttcaccataaattgatagagcatccttcttcccaataaatggaagcattttctcacgttaacttctccaactcttttaattaaactgtccagatactttcctcaagtgacagagtgataaagccagcctagcaactaaacatacagattcagacccctgctttatccttgaccttgtaccttcactaaggccaggaatgatctctggcatagctgagaatgttgaattcctcccaggggagctgtttacataaatttatttcctacaaacctgttgcaccgggaacattacttttgttttctgcaggaaaggttgtgagttttcctatttggaatgaccaaagtgtagtttgatagaaggggattagcaatgacatgctgccacctactggaactgcccacagacagccagactgagaatgtctgtggtctcctaaatctcccctcactcttctgaatcaagagtgggtattgcccctgaagcggacttcaaaggtgacttggcttgaaaatgtgaaatgccccacctatcaaataaaaatttatctgactgctttgctagaagaacaattttgtttctgagaaagaagcacaatatttgtcacatccttttctctgtttgcgtttcccagctttattctgccattggtcttgtttgccttcccaattctaggggcacctatccttttcccaagatttgcctttaataccccagatttttgactcaagattattagccgtgtagatttgggattaattttgtagaagagactagtctgctgccaaaaaaattctttttttaatgatgatgccccttaaaatgctgttaaatctcttaaatttaatagtgataaaaagctaaccctgattttcctaggggccagagtaaattgggaaatgcgatggtttacatggcttccactgccagatagaaagaaatataccagttgataaaattcagtaataaaaccaaatcttgtacggcctgatctgatggactttttaaagatctttatataaatagatttaaataatattacatctctccaattaaaccttcatttgaccttgctgtcccgtttctgaccatgccgcttttttctgatctccctttttttacatttacattaggtcccgtgcattgtaacaattaattgatctctaattaatcatttaattaggactccttgaatgcgggtgagcatgccttactggtctgcatatccttcacagagcacttcagagcaataaatacttctaagcctctcaaaaaaatctctcagtaactgacgtttgattccccataaacatatctcatgtgtgaggctttgattaagtaagatttcttttgattatgctcaattagtgtcaccatattttgtatatatatattgtcaatgtataatttagggttcctcgagattactggcagacagtgacactcttccctttgtagcacatgtgctggaattggaatgattcagagattagcatagatagcgagtattattattatccagtaaagatcccaaggaacagaaataagaagtgacttgtccagaatctgtcatcgaatcctgctgtttatatattctgcagtacctttgtattcatcatagttagttaattaacccacccagggaggctatttttctgccagggaagggttgcattgtactgaaaagatattaagcttgttctgtgactgaagcccaagaatgatcatttaccgactctattagaattctcactgaaaaatttgaggctggaagctgacctttcttgttttctaaataaagatgtagtgtttaaattttgatgcttgaaagtaggaaactggcacaatcgctgtcgtaaaagcagagctacagcccctgtaaaccacatcatgccagacttcccatcctgcccctccctttacctgctttatcatatacaggaagaaagcccttctcttcattcccacctcctgctttactgaacaccctttgctgatccaaacagaaaaagatcagagtactgaaggaaggtcacatggccacagtgaattctgtggccagcactccgctcaaggaccttttgttctctgaaaccttctccaatgtgcctggcccatatcacttgctctttttataatcctttttttttaattttctgtactctaaaattaatacctcattatgtgctatattgttcttcatttgttcccatcttttaatattttattcatctaatttttattaacatgttctctctctactgaattataaagttcttgtgactagttaccatgattgtattttgtttatttggtttctgggtggttttcccccttttacttctctgtaatagactacctgtcagcaatctgaagtatttatgaaaataatatgggttttaaaatatgtttgatatgtattactttcgatgtatgtttgtttttgttttttgtttgtttgtttttttgagactgactcttgctctgtcacccaggctgaagtgcagtggcctgatcttgcctcatgcaacctccgcctcccaggttcaagcgattctcctgcctcagcctcctgagtagctgggattaaaggcacgcgccactacacccggctaatttttgtatttttagtagagatggggtttcaccatgttagccaggatggtctcgatctcctgacctcaagtgatctgcctgcctcagcctcccaaagtgctgggattacaggcatgaggcacagcgcccagccacgatgtatgttttagagagcatctgtagctaaatacaaataggttaccaagaaatagtttttgtacctagctttacagacctttaactttaaactactttctctaaaacaaggaaagctcctgcaagacatgtgatttttttttacaaaccatcctagaggcctatattggtgactttctctcagtgatgatgatgatgatgatgatgatgatgatgacatattccaagtataatatgagtaattataattactgttatataatgatctcagcacatgacatgaacgttagtaaatgctttacctacattggttcactgaatgtccctgaaactctatatttagctattgctgcaaaaagatgagaaaactaaagcttaacgaagttaagtaaattcctagtttacataagaagagaggccagattcaaacttaggtcaatccaaccccaaagtctatgtatgctcttaactacgtgaagtaaggctaccattttggtcaatgttgggtctctcttttgcttatattaaaatatgattttatttttcagttattctcttagctatcaaacatttcttttttcctttattttctctggttgggtgtctttcccccttgatttccactgagctctgattgctaactgttttaatcagctttaatgggcagtttgacggcagaggggtctgcagactcttcctaccttggtggtgttatggggttggttttgctcagctgtcaggtgttcatgctgcttgtgggtcttctgctggccttccaaacaactgtccttggggagcaacacttagacccgagaccactctctcagaatctcaccacaaattagcacgtcatcaacagcactgagcagcaccatcattaatccaaatgcatacacctgtgcttttaagacaataagcagctaaaccaagtgcttcccaaagactagaaggtataagaatttccctatcagctacagggtctcttgcagggaaattgttttaagtggaaactctttgactccatccctaaaagttctgatttagaaggctgagggtagggcttgggcatctgcggcttaacaagtgctcaggagattatcatgcagaaataccggccctgacctcgttttctttgagattcatgcaatatccaggccatcgtctttcaacctcatgtttctcctttagtcccctttactcttatctcctactgcaggcagcaaaagtaaaaataacttgaaagcacttttctagattattttaaattattaaaatgacacacaaggtggtcaccattattactctcagttaacatgtgtagacattgaggcagagtcgggttgtattcttggaaatttgggagtaaactaaatagcatttcattcacctagtagttggctaataaatcaacctttaattgttgcatgaatttgagtaagtcacttcagctctcttggctgaagtttcctcatctataaaatgaagggtttgtgcctgaaatggcagcactttgggaggctgaggcaggtggatcacttgaggtcaggagtctgagaccagcctggccaacatggtaaaaccccgtctcttctaaaactacaaaaattagccaggcacggtggcaggtgcctgtagtcccagctacttgggaggctgaagcaggagaatggcgtgaacccaggaggcagagcttgcagtgagccgagattgcaccactgcactccagcctgggcgacagagcaagactgtctcaaaaaaaaaaaaaatatgaagggtttgattagaggatcaactatagggtctcttgcagattggacttgcctagagttccatgacataaagccagagagcggtttgagagatctagagccctgcctcaactcctagctctcaaaagagactatcacaggaaagctatctaagaggaaacaaattagctcccatccaattccataaagatactgtaaacatgtctgagatatgcagtatataacaggcattttaatatttgttgattggacaaactaatgcctgtgtgtatggatgaattaatgaggaaggaagtactgtaggcctgtttcttttcatagtcaagatcgtgcttaaagcatttgctcaccacacgtacaggagagtaaaacagatctagacgctggctactgcttttgcatgacctataaaggtcttataaggctctgaacagtaattcaaaatgtaaacgtgtaggtactcaaaaacataaatgtcacatctgctttagctcttcatctccattgctgtgctgtagttttccaattgatggaaaggttttattcagatcagccatttctctttttcctggaggcattcttaatctccgtgttctaacctttaacaatataggcttcagttgccgtgtgatgatttccattgcctggaatctacatgtttaaattcttccaaagaattgtgcaccttctgtttttctcagttgcagatggagtcaaaccagaaaaaaaaaaaaaaaaaaaaaaaagtggagtaggagaggccagctcttgattgacttctttctcttgacacacacggtcaggggaaggaatggatcaattgcctcaacttttcagcaggcattaacactgcatctcattctccttcaggcagtctgtttcgcagagacactgattaaacatttggggtattggggacagagggagggagggagaggttggggatttttagtggctagagccttttattgacaacattaaaggcttcatgatatatttgaccagaaattaattacagcccagttccccatttctcccttaggtgacagtcttctgttgatgtgtgctgctgtgaaagtaataataggtttcaaatgtttgtgaaaaacataaagtaattacttgctgtggtaaatcagtcatttgaagcttcagcttttctctgttctatgtgtgtggcagtctgtttcttttgttaactttaattatacaacatatgagaatttgtatttttcagttttcagaagttttgcttttttcatttcttggtgcatagttctccagggatataggtattgaaatgataatgacacataaccagcatttgaacaagggaagcacatgtgtgtgaggaagctgattgctttagttaagtttcgtagctattggctatcagctatttgccagttttctaatgggtcttaaatatttactgtctgttgtacagaggggaagaattggctttcaggcattttaaggctccttccaccaatagcacttgtttacattatgggccctcaagccaaagagtctgtaatagctctttcccctttttcaaattaaaaaaaaaaatctgtttttttctattaaaagctgcagctccttgcctggggttcttgccttccagtaagatctgtaaagatctgcctggataataccaacctctatgttgactcacctggacaaagagagagaaatttccttttggcagctgttttaacagggagccttgcccagacagaatagtgaggcctgtatactggccagcatggcatattatcacacatcaatttccttctgtctgcactaaggctagctcactcctcaaaataggaattgttcacatgtattttcaactcaaataattcatgttaatcttgtttctctattttgtctaatctctcttgttcattcctgatcagtgaagtatccttagtctgcatttcaaaggtttgcttaatttcccataccaagctgcccctcttaaaacaatgttttccccattcgatgttaacctctttctttgaactattatttatatttagaaccaaatataagaacagtaagaactggttatcagtaattcctctgtatggaaaattgtgctaaactaggactctgtgcttttacattgcagtgataattgggattcatgatgtttgcccgagtctagaatatcccatccattaccaaagaagaatactactacaattagtatagttagcattatatatattttgctgtattctgtctttgaaaaatcagtaactcaatatgatatatctgagaataagcaagaatatctgattaaaaatacccctcatgttcttttcatactgcatcgtagagtatttatagctctataattgtcatagcatttcatttcttccataagactaggtagtaatgacaaactgcttaaaataattttatattactttattatttttaatattaataactactatgaattgagtatttattttgtataacttatgtgatttacacacattgtcttatttaatccttatactaacctagtatgtttacgaattaactttttcattttgcaaatgggaaaactcaaactctgaaggattaagtaacccgggttctacactgtggtaaatgacaagaccatgattcaaagtcaggtctatctgcagtttagccattgcgctatacagcttatgacaatgtaatacattagtatttcaagaaaatgtaccacagcctcaatgttcttattgactgtattgcacagtattcctagtcaaaagaacttaaaggagggatggcagtgttttatcttcccagagaggaactgaaaggagatgttgtatagtcgacctgcagggtaaaacaaaagaagacccaagaagatgatgaaggaggattttagcacagtccctaaggcctgtctaggaatgaccacagtcattgatgggcccaacacaggcatgaagtggtgtaagacctcagagagacctggcatggcagcagtgttaggggtgcccaaatccaggaggaaggctggaccacaccttacagggagaatgagtccaccaagtacaaacctcaattcccacagtatcagtagagctcctacctagggtggtaccacagtgactgatgaaagtgtcttaaaatagctcttaaaaagttagtggccagatacggtggctcttgcctgtaatcccagcactttgggaggccgaggcaggcggatcacgaagtcaggagatcgagaccatcctggctaacgcggtgaaaccccgtctctactaaaaaatacaaaaaattagctgggtgtggtggcaggcgcctgtagtctcagctactcaggaggctgaggcaggagaatggtgtgaacccgggaggtggagcttccagtgagccgagatcgcgccactgcactctagcctgggttacagagtgagactccatctcaaaaaaaaaaaagaagctagtatgtttttaattaatttaaaatattcacaaaggaggagaaatcaagaagctctgtcttttgttatttcaatagaaaatccagtcattttaaaagaaaaagtagtgatatattattgacacttgtccatttttggctacccctcctctaaaatctatgtttaaggaattccccacaacctggtcttggagtgaaacaaagtgcatcttccatcataaacacacaaaagcccaagcttgcttactgtgtgggggacaacctcagcttcgcccatcagatgcatgcactctgaactctgatcggggagctaaggactccaagcacaagggtgacagagcaccacagaaggctccctcagcagcagtggtaacttctggttacctaaggtggcggcagtagtagtggcagtggtatggccaacatccacttctgctggcagcagagcaagacctggtgttctgtgtttagcagcagctgtggtggtatcttcacaaaactatctttgaagagtgattctggagagattttggccacaatcccagctgctgtctagctttgtttatttctgctccctttccaagtctcattctccagccttcctggctcatcttggagttgcccagtaccctttcaataattccttctctgcaactttgaaccctgattgttacatacatatatttatgtaaaatctagtaataattgttaatcttagcttttaattctggcagtccacagtgaagtttggagtcttacattattattattactattgaagtttcaacccacattgtatcacttatcttggtcaattatataacaaacttaactgtctatcaagagtttttattttttaaagaaaaagcaaaattgactggattgcatgccctgaagcaaggctacccagatctgggaaaagttagttattggatctacacatttgtttcccataaatcatcccaaagcgcagtacctaaaacaacaaccattatatgagttctcttagttgagcagattgactggggcccagctgtaaggttcttctctggactgccttgggttctctcctgtggctgcagtgggatggcagctagggctggagcatccggaatggcttgcctcatctgtctggtgatttggtggggacaactggaagcctggactcagctgggagatgggcatggctcagttcctctctctgtttctgtgtagtctcagagattccccctctccatgtagattttccatgtgatttcttcatcagggtaggcatacctcttacatggttacttggggctcccaaaagcatgaaagtagaagctatcaagcctttttaaggcctagacccaggacgagcatagtatcacttctgtcactttcttaaagcaagtcacagggctagcccagatttaatgtaggagaggactaaatagaggcatgaatgacgggaggcatgtttcattaggagttatctttggaatttagtcaccactatacttaaacttcagcctccagttatgtgcacccaacgcagtgcctcatacagtagacattccatctatttgtcagaatgctttcagtgcaaggagcagaaacttaattcaaatgatttaagccaataaaggaaatttcttgaatcatgaagctaagactttcaagggctggttggctttaggcttgctttaaccaaggattcagaccgtatcagcaagatcgcttcttttcttcctccaactcctgcttctatttgcatctgcttgtctttataactacatagcctgtctccccacgatggcaaagtagtagcccagacttatactcatagctggaaatcttagggaaagggaaatctctcttccagaatccacggaaggactcttgatgggctctgtctatttctgagccaattcctgtggcccagaggaatgcagcattctgatttgacaatttcaaatcacccacctgcacctgtggtgaaaagttgctcagtgtaatctggatctagaagaacattttctagagaaaaggaaggtttggttaccaaagaagagggatagatactagataaacaaaaacgagataatccctaagcccaatagcagtttgctgaatgaataaaatgtagcttataaatgagtggtgcagacactaccatactgagtttattaggtgtcaaagaagatagacatttaaaaacaatgctgttatggaaagatatttttatggaaagaggtagaagtgctgctggaacattattcaaagtgggttgaaatcgttagagaaaatgttgtagaagcagtttttgaactgtactttgaaaaaggtaagatttagaaggaaggaggattttataggcagagcaacgttgctttcttaaaaaacaaatggtgttaataaaagagaaggttacagagtataattttaggatgtttctgatcctctgaaactatacatgtaagaaaatcaagagtttggttgttacagtatgttgaactatatagttacagatttagttggttccaaaaagattttttttaacctgtatatgacaaatgggtgttttagtgattaaggggggggattcacacaaaaataaaactatcaaggtgattgctatcaaggaaaagaaaactcctttaaaaatatatagtatattcatttttgttgtcctttgtcactttaacagtagatgctgaaattaccagaaataacagtaatctgtatttatagtcctcctgtgaatctgaaggtttccataaatgtaaattaatttggttctactctcatgaactgtggaggaaacagaagcgaaatattcccaactaccccatccgcacttctgtctgagaaagacagtgaaagaaggactgagaatatgaggaaaaaagcagcaaaaactgaattggctggctgggcaccgtggctcatgcctgtaaccccagcactttgggaggccgaggcgggcagatcgcaaggtcaggagatcaagaccatcctggccaacatggtggaaccctgtctctactgaaaatacaaaaattagctaggtgtggtggtgcatgcctggaatcccagctactcaggaggctgaggcacgagaatcgcttgaacccaggaggtggaggtcgcagtgagccgagatcacgccactgcactccagcctggcgacagagagagactccatctcaaaaaaaaaaaaaaaaggaattggctgagctgactttgtagttctcatggggttagtgaaggagaaagaagcagagctcagagacgggatttgaatttggtaagaatagagtcctggttggctcagatcactagatcgtactgtcagaagctcagaaagtcttaattgagtaggaccttagagatggtatcttctagccccttcgtttatcaggctggagacttgctctgagagatggagtaactggccacaaatgatccagatagggctagaacccagatttctgaactcgtttttctgggctccctcctggagctctcaacaccccttacagactcatgtcaggagctctcagccttattcacattctccctgggaagagtgatgccctagggcaacgataggcaacccaggaagatgattactagaatcctctggaggaggagggtcattttgtggtgtgtttctgatacaatcctaagagtatcatgttaaccccattaaccataatatccaccttctctaatactagagtaacattgctgtggacacatctttacaaacaaaaattactatgtgatgataattatgacttctgttcacatactcaagtccttgttgctaagtaaatgcagaaagattattagttttattagcctttgatattgaaattgtcatgttctctcttagctatgaagacctgctctgcccacatcaacttggttattttttcgtaaggaaattaaagtagaaattataacacaattactatcaaaattctactaaactataagtcgaaacaaaatataagaaccgcaattatgtgagaataacatgtgggaaactgttcctgctgctgagatgcgtaaagtgaagtctttggaagaaggcatggagttactaggtagccgcagtgtggagggtggctggacttctctgtcgctagcaatgggcatggtgccattgccaatgcttggaagatgagtgtcttcacctaacttgttaagtgccaactagtcttctgcctccaatgaagatttctcctttgtgtgcacaggttcttctactgagccccaggagtttagggtcatcatgtgcccttaaagtgtggagtgataagagagaatctctatacctctgaccaatttggaggaaagcagagatttagtgttggggccacttacacgtaatcttctttttctcactttttcgctgagaggaatgtggtctaatctagacacctactggctgccttgaaagagcattctcagctatactggcagatctagcaaagagatgtgaaaggatcctcaggtggccccttcaggggtctttctgaggagtcaggaggaaccagccattgtgatgataagacacccacccaggtggttttctcttagtgtgataaaggaagctgaccctgtcgaggccaagatgttcacccagtgggttatccttcttatgcagagggatgacgtaccctcagtatccaaaacattctaatgtcttcattgtctgtttacattatgcctcctcctcactgtgggagttccaagaagttttgcgtctttccctataacttttataacttttgccaccaccctgactgatctcctacaacatacaacatgggtaaacctcaaaaacattgtgctaaatgaaagaagccagtcaaaagaaaccacgcactttataatttcattcatatgaaggtccagaatagggaaatctatagaaacagaagtagattagtgttcactttagggctggatggagaatagcggggaaggggatgagcactaaaggatatagggtttctttttggtggtctattgattgattgattgattgattgcttttattttatttattgcttcatgaatgacaaggttttactctgtcacccaggctggagtgcagtggtgtgatcacggctcactgcagcctccacctcctgggctcaagtgatcctcccacttcagcctcctgagtacctgggaccacaggcagacacaatcactctcagctaattttttaaaatttttgaagagacagggtctcaccatgttgcctaggctggtcttaaactcctattctcaagcagtcctccagtgtcagcctcccaaagggttgggattacaggcatgagccaccatgcctggctggtggcccttttaaagtagccttttcttaggctcttacatatctttggaaccatccactattgggagcttctctccactgctttctaaaatgagaatagccatgtacaagcatatgatttaaactgtttcaatatctggaacgtttcctaaagaagtcacttgcttgaggttataacagattggcaaggggtcagtcattccattcatacatcaaatatttattgaataaatgtgagagctagtcattcctggagctacaaagataaaaatatgattcctatttttacacagtatagcacagtagacctcagtaatgggagcagaactttgtgataagaattaagagagggaaagcattaaggtaagaaaggaggttaaaacctcgtaagatgccctcctaggtatatacccaagagaaatgaaaagcatgtgtccacacagagacttacatacaaatgtttatagcagtaggtagtattcataatagccaaaaggtagaaacaactcatatgtccatcaatgatgagtggataaacaaaatgtggtatatccatgcagcagaatattatgtggccatagtggacttgaagtactgatacgtgctacatgctgccaagtctgtcctgcagactctggccaagcgacagatggaagaagttcactggcacaggtattttgcctaacaatgcggctagaggaccccacagcttagcaccgctgatgagagtgcagtgcagccacagcagcccccataaggtggagacacttgcatttatttcgtacagatttaatgacaaaggcttggagcaaatacactttgtgggtaataaaccttgttgacccgcaccccccctctgcccccccagctcacccccccgccccgagtagagagcagtcctgcacacgactgatcaaaggttggtttctggagagagtaaacaaatttatctagataagtctctttacagtcctttgttatcgaccctttgctgtcaggctcccaataagagaatttggctgccttcagccaaattttcttttgaagcttttgcaaaacctcctggccttccaagaagttttgcatctttccctataacttttataacttttgccaccaccctgactgatctcctacaacatacaacacgggtaaacctcaaaaacattgtgctaaatgagagaagccagtcaaaagaaaccacacactttacaatttcattcatatgaaggaccagaatagggcaatctatagagacagaagtagattagtgttcactttagggcttgatggagaatagcggggaaggggataacagctaaaggatacagggtttctttttgaggtgaagaaatgttctgaaattcattatggtcctggttgtatatatctgtaaatagattaaaagccattgaattttacactttaaattggtgatttgtatggtatgtgaattatatctcaataaagctgttttttgaagaagaaaataagagcaaaaactgagagcagtggtagggaatagcagagagtttttggttttgttttgtttttgttctctctgtttctctaaaaggggaaacatttttatgggttatggaaagacagacgcaaggtttataaccctgcctggaagtaaggaaatggttttggtagtcttggtgattttagtgtcattactatcatcactgttgttattaagagttgattgtggagctaactaggactaaggagcttccaggtagaggaggagtagattacacttgggagggtagagacaagtattactagttcagaatctgacacctccatccagctggaagaagacttgcttatgctagaaaaggaactatgctgccataagctactgaagaaatagcaattccaaagttagaatggatgcatccaaagaagagaaggaaacttctatgcaagtgaatctaagactccattataaacccatgaagttaagaagagctaaagaagcatacagaattattttgtttgcaacaaagttttttttgtaagttttcatttgttgctgaatctctctcagttgtggttattttaataagcagtgagtttgtaaagtcctggtttaaaatactaaatgtctgatctccctattaaccccaagcatctgagattgtaaatcatgactctttgttgccacctgatgacaacaaagagtacagcccttctggaaatactagcctttctagaaacaaattaatttcttgaaagctgaaattagcaatcagtgattcagagatgttgacaaaggctttttataagttccttgaccttgatatgagaaagaggcctcttgtcataggcatcttaacgcatactgaagttttttcttataactacattacctagaaagcaacatcctccatattgaaagtgattttcaatatattacactaaagcattcagtgtgtattgccctaagtctgtcaacagtttctcctgcagttgtcgctgatgtcactgtccagtggctgcttctctcatgtctgaacagctgcaagcctgttcttactgttgctgctgtcatcaccatcacacacaaactgttgcccctgccaccatcttcctgctgctaatgggactgattggcacctctccacaccacatcaaggtgcaggagctatttcccctgccaggctcagagccatctgacacctcttactgccaccattcattatcaccctcacagcagtgaagccaacaggaactagctcagtcctgagctggggggcctcactggtgaagggagtgcggtggccacctttctgcctgcagaagcagctgggcctctcagactggacctggggactcaaaaaattctgtacttttaggggtcagcacattagagccccagcatgtctcttctgtactggttactggagatgaaagcaattagaaaattattctgtttaggagagtggacagcaccaacagcttcctcctcaccatgtgcctgcataggtaacaaataagcaatattctgccccttcctgaccactgggcaaagattaatgccatgcattgaaagttatttttaaatgtcctcaattagctataatatttttaacaaagcttgtaaggtttaggtaatgtgtagggtataagatggcagactcattactgtactttcacagagaaacaaaaaggaataaatccacaactgagaaagaataggaggatttaccaataaataaatgacagcaactttctggatgataggaagaagatggaacattgttaatggataaagtagttggggaaaaggaaaccctcagtctggaatgtgcaacgaggaccttggagaagttccatgttcataatcagcagttcaaaaaaaaaatgtcagagtgccaagagaaaccgaaaatagagactaatgaaaattttctagacataaaaatatatatcctacaggactattttcttcacccctccaaaatgttggtatccagaagttgttcttgaaagagccatcctaggaaatatttagggaaagtcaagacttctggtgtggatgtcagaggaccagaataaaacattcattttagcactggagggagaggtcccagcctgacagttggcatcccacctgctcatcctaaagagaaacccacctgttagcaccttctgcaccaccccacataacactcccaggaactccctccctctaagaacctttttagaaacatgatcttgcctatacttagaggcccaagatccaattggagtccgaggaaaagagaacagagaatgaaggggaggggaaattactgaagaactagtaaaaatgcttttctagaactcaggaagggcccaagtcttcatattaagagcctgttgggtgcccagttcagtgaatgaagaaatagcctcacctaaaacacagcctcatgaattttcagaatgccaaaagtaaacttataaaagctccagagagaggggcataaaaaaaagtcagctggtatcagacttatgatcaatagcactaagtgctaagaaataatgaagcattctttctcagctccaaggtagaatgatttcaacctagaattagacatccaaacagtgtatcggccaattttgagggtgcaataagggcatcttcagatttataaagacttggaaagttgacttttcatgctcttctttctagggaactttttgagaatgcatttaagcaaagcgagtaaataaaccacaaaaatcagaaaacgtcgtgtctaaaagagacttgatccagctcagaacagtgaaaaggtaaccatgaagcaggcttagagaggaaccagtccaaattgggataatgagatacagctgttctggagaaagttctctgggtgggaaaagactcaagaaaataggtagtatgatggagaggttgaaaaagaacctaagatgtgaaaaactcaagtagtacaagagaaaggaaaggcaattggaaatttttaggaaaaaaagcaactatacaggaaatgtgtggcctgcatgcaaagtgaacttctagaagcaccctctttgagaggcctcaaggctgtgatatagttaggctttgtgtccccacccaaatctcatcttgaattgtaatccccataatctgtacatgtcaagggagagaccaggtggaggtaattgaatcacgggggcagtttcccccatgtttttctcgtgatagtgagttctcatgaaatctgatggttttataaggagctcttcccccttcgatcagcacttctccttcctgcagctttgtgaacagggtgccttgcttacccttcactttctgccatgattgtaagtttcctgaggcctccccagacatgttgaactgtgagtcagtgaaacctgtttcctttataaattattcagccttggacagttccttatagcagtatgaaaacggactaatacaggttgtaagtgactgatagagaaggaaatataatccttagcatcactggccaagcactatttgtgtatatgtgatggcgtaaatgctttttattgtttttcgtgaatcatcatgcaaacaaagcatgaaagactccattgtgtttgcaggatagtatgtaaatgtttatcttcacccagcaaaagtaagaatgtagctgagagaaaatagaaggtgagagacagaaatatggtttggggtaaagaaggagataaaaaggttttttttcttttttcttttctttactttttttttttttttttgagacagagtctcactctgttggccaggctggagtgcagtggcatgatctgggctcactgcagcctccacctcctgggttcaagccattctcctgcctcagcctctggagtagctgggattacaggcatgcgccaccatgcctggctaattttgtatttttagtagagacagggtttctgtctgttggtcaggctggtcttgaactcctgacctcaggtgatccacctgtctcagcctcccaaagtgctgggattacaggcgtgagccactgcgcctggccaaaaagttttcttaaaagggtcattaatagtgtcatcgtaaaagtgggagtaggcaggagatttgttgaagtaaaaatagtggtttaggtagttaatttaaattacaaagaacagcattttcacacaaaaatgctaaaatataaccataaaatactagaagaaggagagcagtattacagatgagccatatctttgtcttccacatcaggagatttatcttttaggatacttttaactgcgtgtaacagaaaacactgacttaagtgactttaaactttttttttcaagttttctctcatctaatatgaagtcccaaggtagggtggcttgtgggtgggctaattcagtagcccattgatgtcatgaagaacccacgttcttgccatctctctgctcttccttccttaaggtgtgttggcttcatcctctgaagctactcctgtggtacagggttgcctgctgagtttccaggcatcacagagacacattggaagaagagtgtttccttctgggctttatcttcatcagcagggaaacatttcctagcagttcctcagctgacttcctcccatgtcctgttggccagaacttgatcacacattccccctaaactagtaactggcaacggaaatggagagctgctttcttacggccactcttcagcagatttgatttggtggaagtccctggaaatagcaatttgtatctcagcatgaacctaagacttaaacgtgacaactgttaatctcacctttcccttaattgataagtgttcataccagtagacctattacagacaagttgtctgtgctgcccctgtatgagtttaatgacaaacgtaattcagaaaaaaaggccacggtgactttctagtttccttgatcagtaattttcccttgagatatagaaagagagcatccttctctccagcttatgtatcataccaaaatcctcagagctgcccgggtgcaatggctcaagcctgtaatcccagcactttgggaggccaagatggatggatcatttgagctcaggagttcaagaccagcccagcaaatatgaggaaaccccatctctatcaaaaatacaaaaattatctgggtgtggtggtgcatgcctgttgtcccagctactcaggaggctgaggtgggaggatcccttgagcctgggaggttgaggctgcagtgagccatgttcatgccactgaactctagcctgggagagatagcaggaccctgtctcaaaagaaaaaaaagagagagaattctcagaactgctgaatgaattttttcttggattaaacagctttatataattcatagattctagaagtttcttcatctctgcaaatctatagattttacatttacatatgtagatattctgtagagacagaaggtttctgtgtcacttctcaaagtttccttgttttgcttggtgaggtggaaacagaatgcaaactagagcttgaatcccacattttactagtagctgcttagcccccagtagtttttaaccttttaatacttcggttaccttacctataaaatagagatgatttctttacactttagggtggttgtagataaaatgaaactgcaagtaaaatgcccagtacaaatagaagggggagattagtgattatttattcattcttattcttcctattgtaatgtgtaagaggattctagcacttagtttcccagtttttatatttttgatagtagcttcatgttattgaaaagtgagtcaaattagggggcaaggcagaggaatttaattctcattttaaacagcaatatagtaacaagaggagagatgaaaggcagcaaggataaagaccgaaggtacaagatatcagtggttttgacgaagttttctcaatcaaagactgcaagctgctcccacgttgcccagatccggatcctacagagctccattgaaggggatttcagtggaatggtttcctcacagaaggagaccagggtgactttatttcttcactgaaacactttgattataaaaagaaatcagatgatcaaaaagcatgagatgatgggtgaaatatgttatatgattataattcaataataattgaatttctctagcatttttcccttgtgggaggctcagagaagttcagatgtattatctgaattcgtttcggcatacattggtggagaggggccctgtgttaggctttccattcttcacaccctacccaggccatgagaccggagcaatgttcctgtagctttggtacccgtggctttataaacatgaacgtgaacattttaggcacaatttagaaggggattatccgcatccctcctcagggagagtccttgagtagaagtgtcatctttccagttccttctgaatccccttcgagcaattgctctaggttcaaacagttcatgaaacagaatgccacaatgaaactgaagacttcctatgagtttttacaagttcttatttcccagtgatgtcccaggagttcttgataaaaaggaccttttttctttctagtattccaattataagatagcgatcctcagcatcttgctactcaccaactcaggtgttctctgattctgatcccggggagttttttcaaaatgcctagaactgtgaataacaaggtgcaaacatagataacttatcttccactgtttacctttaaaaggtcaagacccagtgcaatctaggccccctatacctactatggaccactcagtagaacagacatcacatttcctgaggctagtctgagaagcatgggctaaggagtcgcagtatcgattgtataaggattagcatatctggcagatgggaactgtctgaactcattcaactgagaggcatctgcatcaggcggattggcattgctgaactttcacacggcaaattgaggattttaacatgcagcccaacttctcctgtggagatccagtgaacacataaaaaggtttcagtctttatgaattcctggatatattaggcattacagaataaaaatattttcccaagtgctgtattgatactctaggcacctatacttaacatttatgttcttcgggaaccactccatgtagtcagatattcagggattgttggactctcgtttcttttatatatcctttaattgccttagactgctgagcttcattatgtgggtcaattagtcttttttgagaaatcacttctaacacactaattttattctctattgcttccttctgattcctcatctctttcccagtctccaccctctaactcattctcatttttattttacttctcctgtttatttaccttatgttccttcgctatcctccacggccccatgccctcatcttcccagagagtgcttgaggcctagaccaagcagagcagccacaccacaggctgctcccagtctgtgtcacttaccattggcagtaactaggggctcttggagcatccctgagctatcagttggaaacaagctcttcctaggtcttgactaggtctaggtcaggatgctgagaatcaagatgaatggaagtttgcttacctagcagtctcaaagcactccaaatgcacatgtaaagagatacccatgtgtgtctacatggtaaatcccataacctgtgttcccacttctggagatcctgaggtttctgccttcattttccttgggggaacatggaaaggtccactcacctttactttgttcccctctcctgcttctgtgtatggtctgagttgacatcttgcttaatcagaaatagaaatgggtgaaagattgctatatgaggccataatgatcaatagatatagataatagataaatgtatatgtactcacgtaggtatggtatacacctacgtaaggagtataggagtataaaccatgtactcctaacttggagtgcatgataaagcttcagggagtgcataataaaccttggagtgcatgataaagcttcagggagtccataaacccccaaaattatatgcaaaatctgtgtttatatagatgtgaattttttctggcaagatagtccatgattttaccaaattttgaaaaggtgctgtgagattctaaatccattctctttggctggctgtatttactttcttgttcttagaattctgaacaaaacattagggatcagaacaggcaatcacacatactaatgctgaaataaaatcatatttccaggtctgctagtgttgtctccttcaccactgccctccatcatagtcctccattcagagctgacctctacccccagctggtcatattgcttttccttgctgccccagtacaatgagcaaccatgggaatacagtctcaggatacccaggttttcactatactgaagagtttacatgcaaagctcatcatcttctctcatacagcaggtccccatttctaactttgatagcattctcattcaggagggaagtcttggatggttgttcactcctgattctttttcctcatctgtatctggtcctagcaactctacttccaagttttcagatattagtaacagactaacagcttcattaacttggattttggttctctgtgaaagtagcctcaagatctgccaaatctgaatcttagttccatattccatcccttaaccttagatttcacattacacaaattgccaacacctctctatggctcacccatctgtcctgtcagcccttcatatcctgttaaacacatagacttgttgactctttcttcctccaaatctggaataaagcgacagtcccacagctgatgttcatgtctcttggtctcttcccttcagccatcctttgtgatgtagatagactaatcatcccaagatactgcttctctgaattttttgcccaatccttagagtgacttttttataaatacactatttggcccaaatttgtcagagttaaagaaaaacttgcctgataactgttctttcttaattggccagcatcttctctcattatttaaacttatgttcccactgatttgacagtcttctttacatgtgactcacggtgcaacctccatgcctttattctggctgttctgattcattcttcaactcccagccttcaaaacacatcgcactcccacccctcctctggaataattgactgctccagttgaccctcatttttcagtcttccgaagtcattgccatgttacttgaaacctccataatgaagcacatggcgtaaaacagatatttaataaatatttgatcatttcaaagatagttttccaaccaatggaattgaagagcaataaaggcatgtcttggggaaagcaggtagtgataatggcaaagtaatcagtgcacaaatttttagcaatatgtagctaattctgaggtaactaaagctcaattaacaatatttgtaatattgcatgtcagcaaagaaaaatatgtaagcaaagcatgtttcaggatgatccttctaaaggatagtcaatcacctgtggtactatcatcaatggtactagtattggtcaacatatgtggtataggtggtcgggccttctctttaactaatcagatgaatatttaatatagcttcccaagcctaatccttggctgaactgtgacacatgatcagctggtgtgtacctctaccctctaataaagccgaaccatgcattttccttcccctccccaaactgatggtaaaacccaccaaatttgcatatagcctcctctccccatgattatggcatcagatgtttatagatggttctgtttgagttgatcctaaataagggagacttttaccattgtaactgctgttcccaaagcgtaacataaactgctttagtcagcaaaatatatatatcatctttgccttggtagatattgaattgctgactctctcttctttagacccagtagtcatttctttacctccttaatttatgcatgaagccaaaagaaaaattacttcatattcttaataaaaatggcataaggtttagataattttttactatatgcagtaaaaatgcaaatgtgtgtggcttatttgcaaatgtagacattaataactgatatttaaacagtccagattagcaattttactgatatatttaagagatttttccaataatttgcacactcaaaatcaatttgaatacaacatgtaaattgaatttaattttttatataaaattgtggttatcagcttgaaccattaaatttactatttaatatatgctttccagatcacttggttagaatttcattgcaccttatctatataaatttaattaggcttgatatcatcagtatattatagaactaattaaagatttagataagtgctgagggggcttattgaaaactccataaagttccatttggaaaatgagatattcttccttcagttcattgtgagagaaggaaacagcaagaatgcttcttgcagtgtttctgaaaaattatttaactggatttaaagggcttattccattctttgaagagctttttaattactctctatctttgtgcagtccaacaacagttacaatctttatttaaaggctttaaaaatcctcatttccatcttctcccactgagccagctgtgttacattctgctgggcatatgtgcaggtaggtagtacagggtttgtgtaccctgattgcgatcatataatatgtagcagcatttgtggggaagtctatctagtcctcccaagcagaataaacattgagaaagctcagcgagcgcctgccacaaatgtcttaggaaaagggaaaagaaagaaaccctagcccaggaggatacctgggaaaaactgaggcttccactcaaaagatacagcgactttaagtaatcattttgcagaaatcacttttggattcccttgtatctgcatctctgctatagagtataaagcatattagtttaaaagactattatttcaactaagtgctttgtgtcttcattacaaagcacaataaagctttttaatacaataaagcctttattactttcaattgaatatgcctggaaataaagctttatcaaccacatttgccagtgtgctcaatgctcttgtcaaaagcactttttcttcattgcagattgagtgacacagagcatgctaggaaaaaaaaaaaaaggaaagtgaaaggacacatgacaaatatgggccatctacgactgggcacactgtcgattacgacagaggcctgaggaagccagggaaccggataaattgtcaagagcctgtgtggtgtaatagaaaggttacaggctttgggctcaggagatgcagatttaagtcagagccctgctgctgattagctgtgtgacctggacctcatcttttccacacctaaatcttgtttcctggaaaatggaaataatatcagtaatgctgccctggccaggcacggtggctcatgcctataatcccagcactttgggagactgaggtggtggatcacctgaggtcaggagttcgagaccagcctggccaacatggcaaaaccccgtgtgtagtaaacatgcaaaaattagctggccgtggtggcgcatgcctgtaatctcagctactggtgccgggggctgaggcaggagaattgcttgagcccgggaggtggaggttgcagttagccgagattgtgccactacactccagcctgggtgacagattaagactccgtctcaatcagtcaatcaatcaatataatgctgccccttcccccactgcagtctccctcatgggttcggatggtttttaaatgtcatatattctagtctactccatttttttttccagatatggaaactgaggtacagtgggattgtgtggcatgatcgtaatcactagttagctagtgctggggcaaggactggaatagatgcctcagagatgtcatgttatgtctgtgctgtcacacagcacataaaggagcagataattattttcttaatgacaccctggctgcatttggtaggggtgggattttttcccccaagcaactattactgaaacacatcactgctgttttcctgctcaaatggtttgtaaacatttacaccccccagcctgagaaaacatttgcagaaacatttgggtcacaaaccaatgtttgcttcaccaccacatttgaaatatttctctttgaaaacattagaaatgtttgtcagtaaaacagattctcaacagaagtataaatctggaaagggagggacacccacagccacctggtttggtgcattcagggtcctccagggatagcagtttcttcctggtccctaggaatgtgtgacacctcccagcatcaccgtagactctgacatttcttgggtgtaaactattaggggcacattgaggagtgcaatggtttcgggggaggtttggaggtggcaagtttgttctctcatgcagctgtgaatgtagggtagttgttgagaaggaagtgtaaagagaggaggcaggagattggccagggcagtctctgtgtagagaaggacaggctgaggcttacttgattcttcctcatcttttccctcattccccaacacagcctctacagctccaacacagttgtgctaattggaagtggggcctttaaaataaccttggtttgtagccctggcctgatcggtgatggagcatggtctaggaactggatcagcagtttggagtccaggcagagtgggttgaaccctaactctatttctgactcatggataatctcaactaatccaccttgccactgggtgaagcctagtggagaagagctcaaaggagcctgtgtagagtttgctcaaaagagtccttgtcaccaccttcctcccattttgttttctccaccaatatccaggtcatgagagcagcccttcctctgagccacagggaagtaatcaataaggccacatcccgctcactgacatccccactgaaacaggtgaagcacatgtggaaggtcatgagatttttgaaagcactagaaattaggagactaattctgaaggtagcaagtgtgagggaaatggaacctctgctgcgtcctgcctaccaccgtcttctgcaggatttgtaaaaaactaggttcaggtttccaggctatttttgctgctgtttgaacagtgtctactttttctactaggaatcagcatgtattttctttgacatctgtatctgctgagatcacaggccatcctggtcaccaccttgctgtctagaacagcgtcaactcaactgagcagtcatccattaccacgcataaagatctgaaggtccactctgtgaaagagcagacaatgcaaggcatctcctccttcgctttaatgtagcacacgttagcacaatgtgcacacttggagcagtcatctgcacctcagtttccagctcccccgatccaatgctgttaatatgttcttgccagacacttatattcacatagcactttacaatcgacatagggctttcacaaatatgatttcagtgagtctcttgatgagtcaacatttttgtctccccaagcattttctgatttgaactattttctcacagcctaactcagcagttttcctggaatgatgtgtgggaggtagggtatgatagtgtattgctatgtagtcaaactttaaccctgaaagtataaaagaattcaatactggtgttattgttaactagccaggtgaccttaggcaggtgttttgcctttggagcctcaggttgtgaggactaaatcaggtgtatgtgaaaggacctggtatatagtaagtgttaaatgctaattgttccatataattatggtcctccttaataataaacattaatagaatcattagtgaatctttggctgaattatatttctatcatacgtagagttgttcccaattctaacctatatttctcgtaagggttactcattactagttgttatcaatgtttcttgagaacagtatgtagggatggagaaagttcaaaggcatttagtacaaagatgctgggggtcagttaacttacaaaagcgtagagccctgagacatgactttaatacatttctggggcacttagtgaaaatgtgagctggtgaagatgttgccatatctgtcagcttacagaatcttctgtgcacttatcacaggagaacatggaactgcagcaaacatctcaattaatggatcaatcctcacaacagtattggctgcggacagatgtcttctgtatagttaagaagtcagggttccagtttataggatttgcatttttataacagctttatcaagatataatttacataccataaacattaacccttttaacgtatgcaattcattggttcttagtatagtcacagcgttgtacagccatcatcaccagctagttttggaacattttcatcaccccgaaaggaaaccccatatccattagcagtcactcctcatttcccccaaacgctacccctggcaaccatacatctactttctgtctctgtgggtttgcctcttctggatagatcatagaagtgaaattacacaatatttagtcttttgcggctagcttgtttcaattagcataatattttcaagatttataaaattagcacttgtcttaataacagggtatgagacagttaaaaatatactcaggtacacatcccaacacctggcctacagcctgctctctttttcatttcctttttctgtaggggtggggagaaggaagctaaagtgtttatatcgaagtatggcatacacacagtaaactgcacagatcttaagtacacagcttgattcctcttgacaaagagaatacacccttataaccatcactcctataaaaatacagaatgttaaaaccacctcagggccgggcacaatggctcatgcctataatcccaccacgttgggaggctgagacaggcggatcgcttgaggccaggagttcgagaccagcctggccaacatggtgaaaccccgtctctaataaaaatacaaaaattagtcaggcgtgggtagtcccagctacctgggaggctgaggcaggagaatcgcttgaacctgggaggcagaggttgcagtgagccaagatcgtaccactgcattctagccaggacgacagagtaagactatgtcttaaaaaaaaaaacaaaaaaagacggctcagatggtcccctcctaagtcatggccctcaccacaggcatttcctaattttatttgatttttttttttttctgagtttgtttccttgtgttatctattaatacaggtagtaagtacgtggtcccctgagcccgggagacctttccccagtactccaggcctcagttacctgcgttcgttaatgttggttcccagggaaaacaaagcagcaccaagcactcaggacccatggcctcttcttctgaacccagggactcccatgcctttgcattttctcctcgcttttgtccccagctgtccttctaaacaccagcaagctctcagcacaggtcattacaaaaaacagttcaggggagtggggcgggctgtagggggagcattaacccccgtcagggacaactgggggcaaatgttgcgctccaaaggcagatgttttgaggaggactcctaattgtgacaaaggcagcccctgcacactggatgctggccagcctctgccattaacacgcctacctcctcactggtgtgatcaaattggtactgctcttatgaaattatgtgtgttagctggctcttcagaaataaaatatcttttcttaaagaaattaaggtttcattttaaattgactttatggcctttgaaaaactttagtttttgtgtggtccaaagctataggttagcattagcatttaaatagaggcattaaacttgcctgaagaccttcctctcataatgtagccctttctgagaggttttttcaaatcagatactttttcgtcctaaaaaatgaatgcaaatgctctctatatttttcccctcaaaggccttttttctttatatgtagacttaggagagccacattgtggagcagcctcagtattagtctttttgtatggaaagggccacgtaaaaaaaaaattgctattctctcctacaatgcctgattttctctgctgactctcaggatgtatttgcctatggttaattttatcctattgtatgtcattccactccagacaccccccaaaggcacaaatccccattctacaactaagaatctaatgtaaactcctgctatgtaacagtgactctaggagttcccagtgtccccagcaaatccccatcactttagtagaatcagagcttgagcttttgaactggatgaactagagtttgagtcgtgtccatcacaaggaggttttgtgaccttctctgaccctttatttatctgccaaattaaggttatcaagcctttcttgtatgtttgtcaagagtttaaatgagatcatatttgtactcctgatttatactctgtgctcttaggtcctgtaacctaaccggacaggttcttcctgcctgctgcacaaataaagaccatggccttgcggtaaagaaagagtttaattgatgcgaggctggccatgccacacagtagatggagttgttactcaaatcaatctccccagaaattcagggatcagggtttttaaagataatttggtgggcaagggatcagaaagtagggagtgctgattggttgagtcacagatgaaatcatagggaattgaagctgttctcttgcactgagacatttcccaagtgggggccacaagaccagatgagccagtttattaatttgggtggtgccagcagatccactgagtgcagggtctgcaaagtatcttaagcactgatcttaggtttaacaatagtgatgttatccccgggagcaatttggggaggttcagaattttacagcctccagctgcatgactcctaagccataattttgaatcttgtaggtaattttttagtcctgcaaagacagtctagtccccaggtaggaaggggtttgttttgagaaagtgctgttgtcatcaaagtttaactataagctaagtttctctcaaagttagttcagcatatgcccaggaatgagcaaggacaccttggaggttagaggcaagatggagtctgttaggtcaggttctctttcactgtaataactttctcagttacaatttttgcaaaggcagtttcagtccccctccctcacatttcaaccagaccagttgaggagtaggttaggaggaacctttgagtaaagggtgtcctcttatttcttatgttctcactgctagccttctctttcctttcagccaccggcctcatctcagtaaagttgtgtgtattttaatggccccaggtcacatttgacctgaaggagacatactagaggtgagagcctgatgtgttgttctttactgaggtgctgccatccttctctctttgaggttgattttgtttagctacaagcttggggatgtggagttgtgaggaaaccttctagaagattggcgtggtctggtactagaaaaaaaaaatagccaagttgcccaacagtctgaaggctttcttaccctcaggtccatcctccatgctgcagctggaaaggtctttctaaaacagttgtcatcatgtgtgacttctttctaaaatcgtctgtttccagattcctccctgtcattggttccagattccagggtgtatgtaaactgaaactgattgtcctcatctatacgaaaattagaaaaataatgactgtactttgtgagtttctcataaataatgactaaaagtttctgagtttcccacacaataaaacatgtaacctttttgttctgagattattttctttccacttaaggagtgttaaaataccttcttttatcaaatcttggtaataataaatggtaattgttttgtttgaataatctaggcaaaataaagcttaattcaccttcatccttccactcacccatgaaagtccaaaatcttagcatggcccacaggtctgttaggctctaggcccagcttgccttgcccacctttccccttccttgctcttccccacaccccatgcactccagtgaggaataaaccacttgtcgttttccccaaataccgtattcttcctactgtcccacccagttcacacattctgtttcctttgctcgtggaggactttatttccttcatatttgcctcattgttgacaacttctccttctctattaagccttccctggctgctctcagaaacctacagcccttcctgcctgtgatcttagagaatctcctccagacctttattatggccactgtcacattgctataagtacatacagtgcctggctactttcacaccagactctgcatcgccagagaacaaggactatgttttacttacctctgcatccacagtatctactgtatactacctggtttgtcattgatgctgaaatatttgttgagcaagtaaacaaatttaaaaaggacttcgaaagggactatataagcagtgaggatgatacaaagagtcataagacacagtctttgacatcaaggagcctacagtctaggtgaggttaataaatactaataatggtacatccacacaattgagtactctgccaccattaagaagaatgaggcaggttgatatgaactgaaatggaaccttctccaggctctattgttaagtagaaaaagtaaggtgcagaacagtatgtaaacaccatttatccttagatatatttgtgtgtttatatacacacacacattcaagaaagactgcttctatatgtataaaatatatttggaaggataccctggaaactagtaatagtaattgtctctaggaaaggaaatggtgggagagaggctttacgctatatgcttattttgtaccattatctttttacgtaacaaaaaatattatgtgccaggcgctgttctaagcactttataaatattaacttgcttagtcttcttaacaattctatgagctaggtgctatcaatatcctcattttacagatgaggaaactgaaggcttacaggttaaataactttcccaagttcacaaaactagtaagtaaataccctagtaaccttttttattgtatcatcagctcaaaaagaatattaagagtttttttttaaaaaagatatgattctacaggataaatgttaagtgggttacccatgcagtaagtgacagagaagaaataaattgctcaggatagcttcatagagggtagaggatttagcgattttgaacatgaagtaggctctagatacttagagcccaaaagtactaagtattattcaggggacagtgagtagctcaatttggtttgaatggcaggttgaagcagggaagaactgggagaaaatgtggaatacaggtcaagtctttaaaaggccttggatgtcaatgttgaaagtttggacttgattctgttagcactagtgaacacacaaggttttttttttattattattaaatacagaatagtgatatgatccaactaagaactgggggttagtctaggaggagtgagtgagtgaggtggccagttaagaggcaactgtaacaatccaatgagaagagtgtaggatctgtgatagtgagattggaaagaagaaatgaatatgaaagatgttgcattgatagacctggtgacaactggaccaaaaaaatgaaggagagtgaagattccaggtgacactgagattttgaggttttgcaagctagttccgttaagcaaaattcagtggctagggaggccacctgacaagggcagctgatagaaatgtctgcagacaagtgaaaatgacgttttgatctactgagaaaccagatcttgagaaagacatctgagcattatatatatgcacagataagactttcagaagcagagagagaagaatggagggcccccacctgactggcaggaacacctgcagcaggcagacacagagccaatagcagaatcagagaagaaactcagagggagctgggagaagtgccttaaaaatgtggcttcatggggccaggcactgtggctcatgcctgtaatcctagcacttcgggaggccgaggcaggtggatcatgaggtcaggagttcaagaccagcctggccaagatggtgaaaccctgtctctactaaaaatacaaaaaattagctgggtgtggtggcacatgcctgtaatcccagctactccggaggctgaggcagagaattgcttaaacctggaggggcagaggttgcagtgagccgagatcgcgccgctgcactccagcctgggagacagagcgagactccgtctcaaaaaaaaaaaaaaaaaaaaacttggctacctgggccgatgcagaggctcacgcctgtaatcccagcactttggaaggccaaggcgggtggatcacgaggtcaggagatcgagaccatcctggctaacacagtgaaaccctgtgtctactaaaaatacaaaaaaattagctgggcatggtggtgggcacctgtagtcccagctactcaggaggctcaggcaggagaatggcatgaacccgggaggtagagcttgcagtgagccgagatcacgccactgcactccagcctgggcaatagagcacgactccatctcaataaaaaagaaagaaaaaaaaatgtggctccatgacagttgggttgaggatggaaaactgtcaaggaaaagaggacttaggaaaagctgctgtgcgtgtccatgaagacgtcattgacgacccttttcatagacacattggaggcttagaaaggacaggcagtgaatacaaatgatttgttcaagaaattcaacaatgaaaaggagaaaagacacgaggggagagatggagtggacatgggatcacataaagggtttggggtttgtttcttgatttgtttttccaaaatgggagaaggaggatgtttgaagcagacatgaaagaaccagtgaaaagggaagatactggatacaagagttaaaaataaaacaaaaacccagcagagtcttgaaagcattgggaggggtgaggatcaaaggcatagggttaatcttacaaaaagaaaaaaagaaaagaaacccctcttcttctgagtcaagagggaaggactgattttttttttttaatgtatgtcagcatggaggatgtgatacctcatacaattgtgagacccatagagataatatatacatgaacaatggccaatacagactacagaggaggatgcaaacaaagttagcagttagttttatcatttgtattatatcacatagcaggtgttctatcatatcatttgattaatcttcaaacctaatgtgatgtaatattatttatcccatgcttaaatgaaaaaactgaagttgagacaggttcagaaatttccagtcatgcatcttaggtaaaagatgtgggattcatgcctaaatctgccagagaatgaaaagctgagaaggattacagatcactagtgaaaacacggatctctgttgtctcccccttttccattagcgaccattatcctgaccatctccccccggagttacatcagaataaccctttgtgttttatacagatcaattatttcattcatagttcctcttttcccagtgtcagagaatcatagactgctttttagattgtatgccatacttaatgacatgtatagactatcagctgtctcattcattcattctttttcatttactcagcattcactagttaccgtcttcttaggccaaggggtaggagcaagttgaatatagaattcagccctgctctagagaatggcgtgaacccgggaggcggagcttgcagtgagcagagattgcaccactgcactccagcctggacgacagagcgaaactccatctcaaaaaaaaaaaaaaagaagaagaattcagccctgctccagtagaacctgcattggaggagggggaagcagatacttgtttatgtactaaatgcttctacattcttactctgtctagccactgctcttaatcatttaagccttggaacaaccctatgttactatttccttttctcagatgaagagaataaggcacagagagattaataacttgaccaaagttgtacaaataggaagaggcagaattgggtttaaatcccaggcaactggctcccgagtccatgatcttaaccattgtatatgctgatgaaagtatatctgattttatatatatatatttaaatatataattttaaatatattttggaaatatattttttagttggagatgaatgctaaaaagaaaattaaagctcatttaaaggacaaagcttgatgaggatggagcaagtaacatttaaaataaggtggtcagggaaaacctcacttactgataagcagacatttgagcaaaaattgaccagaatctcctttaatcttctattttcctccaacctcctgtccctttaatcccatctgatcctcttttctgattttctttcagttggcttacagtataaagcaaaagaagaactatgaagtacaacaaagacaaattaatgtcacttccttgctctatagctggtactttttattttaatttattttattttttaattattttttctaagatggagtcttggtctgttacccaggctggagtgcaatgccatgatcttggctcactgcaacctccacctcccaggttcaagcaattctcctgcctctgcctcccaagtagctgagactacaggtgcgcactaccacgcccagccaattttttatatttttggtaaagacggagttttgccatgttggccaggctggccttgaactcctgacctcaggtgatccacctgtcttggcctcccaaagtgctgggattacagaacttgtacttttaaaataggaaataagaaatgctctggttccatggcccttaacacccaccccaacacacccacctcctcctcgccacccagtgaccattcacccacctgttctaaggtttctcccaactattgaatgaatataggaggttagaatttctcctagacaaattcacttgggtttttctaagatgactcccctttcattacttgcttcccataattccagatttcctggagtccttgatgtgatttttcctttcttgttgccattcacagcccctccccgttcactaacattggcccctttcaccactctgtatcttcctgtgcattaatgaaggtattaagtgagatcagttctaaagccagcatccttagaattcactagatgcttcttttctgcatttgttgacttgccgttctcattaccctctgtttgtttttcagcctgtgtcctatcgagggtagccattcagaataaattcattttgctagttatatttttctagaggcactgcatcaaacggttcactgacattcaaatacgtatcagccacagtagtcttttcatccaccaaattcacattgttatccaaagctatccatcacgtttgtcagagtatttgggtctttaattaaacctgctggatattgttcatatttccattagctcctttctagttagtctattatttttctaattgacatctgttctgagtcacatgtccttgaatttcaggtggcccattttgtagctttggtttatttaggttttctctctttcataaattacctaaggatttagttaatacaccctcaagtgtttgccactgggacctgctgatttacatatgtttacgcttctcaaataatccagagttttttggttcttctacgaaatcattttcctttgaggcccttcagtcctgtaagaagtagtcttgtgtctcagcaaggcagagagatctcctacaatttcaagaactgtactagagtcactaaccaggaccagaaggtcaggaatcagggtttgagtgactcaaccaagtgatggctgaatagcagtccttgcgtcttaagactcccagaggctgtagtgggttgcagtgaactctccattcagcctcccccagccctgtcttaacatcattgtgaggtagctggctaggggcagagtcaacggccaaaaaatagaacgaattggcacctgccagaatcaaccattaccttggcctcactggcatcatgctcatcacgctttcgttgatgggagcatatgttcccatcaaagccatgaagtccattcctgttcccactgactgttctcctcacacacccacaggtagggcaagatccattattataaatacagaaagcccattacccattcacttcaccatctcatttccaaccctggtcgtcatttggagcagaagcattgtttttatcccttgtccagggcactccaactctttgtgcctttcttatgtaccaggagacaagggcaggcagggagactgccaagccctagttttgctttactttaaattaaaacatttgcttcatgccttgggtatttttggtctgagcctggattagattttaaaaataaataaataaataaagcttcttgaagccaaggactatacctttctatatcatattaacatttaaaatgttattagagtttcctaagcattagtaataacattaggttttgctttgaagaaatcctttgcattatttattgaaaaattaataatgtgattttattactaaaaattgaaaaagccgtagggcctctcagcagttgtttcccagattgctaatctgaaaaatatagataatatacactacaagagtcttgtgctaattgggttaaatgatatgtagctttgtggtcactaaagtatataatacaatgtcctttttatcaccctatgatattagataaattgtctttaaaaatcagaaagactctctaaagtgatatttgatgaactattttcttaaattgaaaagactctaaagtgatattcagctcagaatagcactccttaacctggactcaccttttgataatcaaaagaacatttacagaagtatgagacaaacacaattatgaaagtaaaatgaaggccctaaataaaaaaatcacagaacaagagggtaattctattcactctttcatatttcattatttgataacatcagaagatgaatccatcagaattgccttggcaagtgcaaacagaaatgtgcctgatcaatatttataaaaaccttcaaaatgggagaaggagttgagcagacttcttaatggactgaataattattcatacaaatggggtttgaccaaaggcagtgccagaccaaagagacacagttttaattgtactgaatttaaaatgcagatcttcctccagcccttttgtagaaaacttaatttaaaaaattatctgatgtagcagagagtgacatatgaatccttaagttgttgaagaggacatgtcaaccatagatatttataaatttagaacgtgttccaaaggtggggagcaaagttgctagctaagggaacaaaaagaaattttctccccatttcaatgactgtaactgagccaaggagtgtgtcatcatctcaacggtgatgggaatgtcctggaggagtttctttgtttcaagtggttttattatctgaagagaaataaagcaagtctctggctgctgctgtctatcaaaaatgtcaggatacgttcctgagaggagtgaaacagctgattttaactttcagcgtctccccaggagaacccccacccccgcagtactgctgaggcgtgatggttatcaggacaaggccaagaggtaactggtaactgccatttaaggatagtgccattgacaaagggtaggtgcgtgcatgtgtcactatatataaaaaacaggtaggtagatgaccgatcaaagaagaccgagcaagccttaaagaacagactcccaggctatctttacctcttgaatgattttcttctgccaccagctgagggaatataagcaatatgttttctaaagaccattattcacttctagcgtgtcctgatcagaacaaaaacctatacaatccgttgtgagaagtgtaaaaaaaaaacaaaaaactgtcctgatacagaatatatacctaattgtgccactaactgtctgaaaattatttagcttttctccaccttagttttctcattcctaaaatggaaataacttcagctcattttaaattagaattttcaatcatgtttgtaataaactttaagctcttcgaaggggaatacaaataagagcaattagattatactttttaataaactaatttattcttctgacacacaggattaccatccattttattattggtcggaaagtccatttgagctgagattacacttgttcagagtgttttcaagtcaattgctactgcgtcttgtctaccattgcttgaagaaaaacaacatcagctaattctgatgggagccccatgattttgaaggaccaagcaggggacgctgtaaaggtttaaaatccaaaaatgccagtgcttttatatagcatctactgtaacctttctgttttggacatgagaaatagatccagatagctggtggtatttgcccaaggtcacatggctagttagtagcgaagaatgaaagacttaaccagaatctgagtttagttgatctcttaaatatttacctcactaagttgttctgctataaccacaatctctcaattatttatgggatgattatctggtttatgggttattcttttttctcttgtcatttccctgttattatcatagataccattgagtggctggagaaaacaggagttcactgcttcacttgacaacttagtgacccatctaccattgggtttttattaaagtgctcaaaatgctgtagatattggctaaaaataatgttgggagctacagtcaatactaacttttattcagctcaatttttctccctctcaaatttgtatttcagaagtcagattcagcacagaattcacttgttgacattaatactagagctttatcttgggaaggactacaagagaaagtctttacaatgaaaataattatctcccttccccaaaaaagtactgaatcagagggacagtcaacttttggaaagaaaggttacttcatccattaccaacttgaaggggcaaaaagggaagaaataaaaagaggtgacaaaatgaaaaagccaaaaactcttgcttgtaaactcccaaattaagtgttaaatttacaacatgactgcattacttggtttagagcactgaattcccagatcaaatccagtgttgttcagatataactgcaaagtttgtacaaacgaatttgaatcaccacaatactggctcattgcattacaaagaaagagctgagtatgggaattttatttaattcatatttgtgtactcaagactcaaatgagtcagcgataaaaatattcttttcagttagttcttttgctttttatagtttcaaatatttttgtattaaggtggttttagagtaaatacagggctcaaaagtctttcattttgaggccttagacaaatcactaatactctgtagatctcaattttctcatatgtataacgtagataattgtagttcctatttaaaaggattgaaatgcacctaaaagctagacattattattaatattctacaatcaagacagatttcaaaacccagcatgagacgtagctgtatattttaaaacacagtttccattccgggatctaggactctgaattctaccaagtaaaggaaggcaaaaggcaaagctttcctcagagaccttggacagttccccagtcagggccttgctgtcacccctacaggcaaagtttatggaacgcctacaagtacaggaacaagagttgccatgggcgggaatagtttatgttagtgagtatttcttccctcaatttgcaaagaagggaactgaaactgtttctaatcactttcagagatgcagtactaatttttgcactgagtatgccaacttgggaggtagaaccagggatgagaaaactccctggcctcttgtctatgaaaatttatgaaaagctcttaaagagaagtcagaaaagcactaatactcaaagataaaaagatatcaacaattcatttatacatacacgcatacctacatacattaaaaacaaataagtagatgaaaaattgttccacctcatgcaaatcaaaagaatgtgagttagatgctgcccatatgttgttgataggaggataaattgatagagcttttttagaaagcaacttggcagcattgtcaagtgtcctaaataatatacttatcttttaactaattctgtttttagaaatctatccatgagaaagtaagtctttataattggaaacaattgaagtatccaattgtgtttcaacctaaatatttcaactataagaaagaaattggctagaacactacatgtggtgggggcgaactacaagaaaatatgccaaactgtggtttatctttatgatgaaattatgagaaatctttctgtatggcccatatattctatatggcatatgtattaactttccaatcagaggaagataaaattttgttttaaaactttaaaaagatctgcccacctttccaaaataccctgtatttccttcctggtagaaatgttttcagacagaatgtatgggggagaaagagtcgcagtgcaataccattaaaataaagcacaaaagaaaaagccacagagaacagtctgttgataaagcaaacatgaggaagataagagaaaatgatctgtttgcaccagaacaaagcataaacattgttatgttctagactctgcacatgagaccagtctgtgaagtcacacctcctcttctctgtcactctactccctcacctatctgcttataatactttgggaactgctgcaaaaaggcacacagcaaagggtaggagaagccacagcaaggtgcacatctccttccagaatgttccatccagcagggtgacttgaaactctttggtctccagaataagatatttggtgtacatctagcaattgactgctgaatattgtaggctatgaagagtctgtgaagggctacaaaccatgagccagaaaatgtctcaatcaaatgtgcattcactgatcccatccaggcagccccagcaaagtgtcatcaaatggaaaatgtgttgccctggaagccacggctgctattttaatgctcgatgatgaagaccaagctttcaatttcctggggcctcaataagtgctgataaattatttatccctattgggtgacatgatttcatttcagtctgacagtgtttatcatggaagctcattctaatggtatagtttggggcatttttctattttctctttaggacacctggtagcaccctttccccacctccaggtgaaactgttgctgtgtcagtttagtcatctttgctcctgggtaccattctgaaagataaatgaatttccttctgtctttaaatatttatgattctttatgatctaatatatcagcatggttatggaggaattttttctctctaactatagaaaatacaccatcaattacctgtcaattttgttgaataactcagctttgcaattcaggggcactgttcatacgaagctcttgaggactcttttagtctctcagtccacttcagactgtcattccgggatttataaaggtcttcattgcacagaggatattgaaacattaaggacttaagtggcatgccctttatcactcatcacactgtggaagatccaagagtagaaatgcaggcatctttgttttgttgtttgctcccagcgtggaacaatggcctctgtagaaaaccagccagtatccctggaaacaattcatcagatttttcaaaagaaatccaatttcatctggcatgatgggctcagtgttgcttcttaagataaatgataaaaatatcaacatcctaatacaaagaaatccagttcttttggtttaatctcagtgaaaagcatcacaaaccttttattgcttctgtagccttctctgatgcgtttaggtccttggttgaaggagacagtggttctgtaactgttggtctaccaaacagactctgactgagtcgtggctggttcagaacctttaagaagcacatatctggggatggggcctcaggaatctgcacttttcataggcgccccaaggtaattcttaggtaccctaaagttcaagaactgcgagtctagaaatcgcagctttcaagttccttctagctttgaaagaatcgtgagccccagattcactctcatttcatttggtaaatctcgatgcacgcatgagctcttcttgggcaattttaaaaatgtatattcttaggaagttccattaatagacaactccctccatcacctgtgcatctacaggaaacagaattagatgacatagggcatcatttcccaaaataggggccaatatcagtgagagccaggggacatgcagagctgtaggataaatattaatatgatgcttcttcctgcagcatcaagtttttcttagaaacagtgtgtttaaattacagcagatacattaaggagtagaatgcaaagttcacgtgagttttatgctaaacatgaaacttcaaaagatttactgatctggcactggggtctcacacccctggaagtggagttttatctccccttctaccaagtatttctgtctatattcagggtcaccctggaccagtgattgctatgtgtctggttctgtgatgccaaaatgaacactcgtttaaaaccactatagaaaattagccccctgtacacaaggatgctgactgatttgcttgcaggagagcttcattaacttaccaatctacaaagagcactttccatttctgccactatttagagtatattcacaaaagattattctctcccctatttttaaaagagtgtgttagttagaaaaggaggcttagcaggaggaaaagaagctaaccgtgtgaaaagacaccacaactcttcctgaccacattccccttgtaccagcaattcaataaaacaggcctgaaattatggagctcctagaatgtatttcttaccacaaagatagcttcatttccccataggaggttctttttttcaaaatgttcctgatgagaaagaaacaaattcacggccctgagtctaataatacaggatttctgagccactcatcctgctaggtctggaagattgcttcgtctccaagagttgccttgagtgcactgcctggttctgtcccctcgatcttggcaaagttacctttcacgtcagagagaagtgagtaacactcttcattttgctgacaagctgtgataagccttcctggctcagagtctgtgttgaacttgacctcctgggtaatttggagtggccatggaagtcacagcttcagagtccagtagactgagagatagcagtggcatagtattggtttaaagaatggtgagtggtcatcttctccccttcctgactcccaccttcatcttcctgctgcattgaagaatccctataatgcatatttctattacaggcacaagtcttcctccaccaaaggacagagccaggccaatggccttgccgttaagtggctctcaagtctcctctttctgctagaattgtaaccaatgccctgccagaccattctgcgtttgattgtcacagtaatcttccagaagcacaattttgaatggcacctctgctctctggaagaaggaagtcctttattggcttaactaggtctaaaatcatagcctgatgttcagaggctctaccctgtggcttcaaatgcctcatcccaggactctctgctattgctctgcactccccagtctaaccagattattcttccatgcctttgctcatgctcttccctccaactagaatttctttcctggaagccctgcctgacagaatcttaccccacaggaagtcttcctcagtcccacaccatcccctcagcatggtgcgatttctcctcctctgctattaacgcacggtactaggacctcacttatggcacacagaatattcttgtgagttgtcaagtgtccgtgaaaaaacagtcttgaacttagagtcagaaacctggggtcagatcctggcatggtcagtccctgtctttgtgatgtgggcaagccctctaacttctctgtgctttcgtctttgtatctgggaaaagggaggtgtagcccctgggtggagtgaggggtaagtggcacagtgctcgggaatgaacttggtcaacagcactggaatccttatgtctctgcttttcaggacctttcctccttgtctccgagctacttgaggaaaggggctgtgtcttgcccatccttatatactactattaattttattacattactgtcacacattagcatcattatagttctaataataataatctttatgaagcaccaccattctgagtgctttatacgtattaattaattcaactatttcaataaccccaagaggtaggtactattattaacccactttatggagcagaaaaccatgtacagtattttacaaaacctccaatgaataatgaatgaatgagggattgaatgagacaaaacctgttaacaatgccttctctccttcttcaggctatacccctacttttctttcctttctcccaaggtaaatgcaaaattagcaaaaaaatgtagaatgagctgagccacagaaaggtatgcggcctccctgggtcctcacttagacttctcctgaagagagctcccatgagctccaaaggacagagcttatggttgtcctgttctttattctgttggtggggcctagaacactgcctgctgatcaatcgttatgaagtaagtagaggaatcaatgtatagacagcgtatttgtcccctcgagacgacgttaccagtggggagccagtgagcagtgttctctcttgctttctcaggcagtactacgagatgctttacaacacagctgacgagctcctgaacctggtggtggaccagggtgtgaagtacacggagctggagtacatccacgctctgaccctgctgcaccgcagccagactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccctgggacagttttgtatgctgtatcttgtacacaggttgtaggttggtttattgccattttgttttatttctgctgtataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaaatgtttcatgttatttttcttgtgttctttattcagcaaatattccccagaagcctaatatgtgctccatgctaccacacacaagggcaaatggatagatgaagaggacacccttattatctaagagtgtgggaactggactggagccaaaaatcccaacagctcaaactcagggctgggtcagaatcaggtcaggcagtggggctgccgggaaggggattcagtgggcagctggaggttccaggggattctggtgggaaagaatgtagtcaatctgtctggctccaagggcctgactgggaagaagttgaatctctgtaggagacaactgtggaaaaacatactgccctaaacgatatcatgagaaatagtctaccctagaagcaggagtggaagaaggggggatgagaggagattagggttgcctaagctgctgcttcatggccgtgacccccagcattgattctgtacctttcctttttcttcctgtccactccaggcggagaacccggagtggtgacagtgatggcagcagagccagggtgagactgagagtgctcagactaattttcttggaagtagtggaaagctccgctaaaaaagaaacatgggtttggattgagcagaatgtcaagagccctgagaaccaaccaaaaaatggcagatgagctgtttcaggggcaacatttaggaaagtgaaatctctgctttgcttacaatgacgggactgaaaatggcaattctgcacaggaaagggactgtgggactcttccaagacatttaggacatccaagtttctttgaaggttggcacatcagtctttattcttccacaggtaaagaacagccagtgacacactcagtgggtggtcaatggctacctcacaacctatatgcatttgggacacagtgaagatttccacattttggtcctacttaggagtattttgtgaggctgttgtgctgtttacagccttgaccaaccagaaagtgctagagagagccagggtctgccaaggacagggcccacgaaacacatacacagttacgtaatgttcttgtgtgaagacctctccctaagtgtgctattgcagataagaaggccaacaaaggtcaggcatggtggctcacacctgtaatcccagcactttgggaggctgaggcaggcagatcaggaggtcaggagttcgagaccagcctggccaacatagtgaaaccccatctctactaaaaatacaaaaattagctggtgtggtggtgcacacctgtaatcccagctactcaggaggctgaggcaggagaatcgcttgaacctgggaggtggaagttgcagtgagcccagatcacaccattgcactccagcctaggcgacagagcgacactctgtctcaaaaaaaaaaaaaaaaaaaaaaaaaggccaacgaaatacgccttaccagaaggggtgctggaaacaaagcaaaccgttttctcattcttatacagaggtacaaatgggagggatgtgtggactgctgcctgcatcactagtcactgtgccatggagtaggcccacgggagtaggaggggtcctgagatgggaaatcaacatgaccatgaagaaggaaggctttggagtgatgtcatccaacttggttctcagaacagcagctcccagagagcacttccttctaacactgttatctactctctggtacttagcatgtgttcccatttagtcctcacagcaacccttatcataaatattactttcctctcttccatacccaagggcccagaaactactgaaagaatctctttcaagttagccttcgttggaataaattccttgaaaaagaggtagttcatcagctaggacccaactcttatatatatatatacacacacacacacacacacacacacacacacacacaggcaattgtgttcttggaagtgctggtggtggtttcttctatatttttggttacttttagctatatattattgcctgtcagtataccttccaatttataaatgaaactactctttgggtgatattgtgccccttaccccacaagcacttctttctacctgctctattaatacaggttctttcagggtctctcatcctaggcggtgtttttattcctacctcacagtagggctttgaaatcttactgcccaactagaacattttccccctccacactgatttcatcccaataattagacaaggattggttcctcaggttgctcttgctggttaaggacaagtcctgcttccaggctctgaaagacaagtttattttttagtatgtccagatcagctcaagtttagtggtaagaccaggcctgagctgctacagcccatactcttgaaacccatcctcttgaaactcttgacaccacactggaaaccttgtgaaaagcctctgcttttcatgacctttcctccttgtttctgacctacttgaggaaaggagctgatacagtttggctgtgtccccacccaaatatcatcttgaattgcagctcccataatcccacgtgtcaggggagggacctggtaggaggttaatgaatcatgggggtgagtttttccagtgctgttcacatgatagtgaattagtgtcacagcatccaatggttttataaagggcagttctcccacacatttctccttgcctactgccatgtaagacgtgactttgctcctccttcacctttcgccatgattgtgaggcctccccagccatgtggaactgtgagtccattaaacctctttttcattataaattacccagtgtcaggtatttcttcatagcagtatgaaaatggactaatataggggctgtatcttgcccatccttaggtactattacttctattacattactactaatctggtgggatcctcttccagcagttactgccctctgcagagtaaccccattccaagaagccccaccctctctccaagactttattcttgtctgaatgttttctgagcccgacggtccttatttatgtttcaaatagcttgggaggaaaaactccaatacagacaacttgaattggcaaccaaaccctaatgctacttactgtcaagtcatatccgtgaatttcgtagcactaatgcattcattcagtcagtcaaatagaattgcctgttacagctcaggttgatatgggagtcgggcaatgacaggcaaaagaaacagccccttgtgacacaaagcttatacttccactggcttcttacaactcctctctgatctacccttcccagagtccatatttcccctctcgattctctgtgaccaccctttcatttaggaagacagctcaaatttcagcctgactctgtgcactctcttctgagctttgcttctctggaagcttaggactctcacgatccactgtgccccactagctagcacacctagcagttcaccctttaccagttcttcttcttcttctccttcttcttctccttattctccttattctcctacttcctccctcctcttctcctcctccttctccccctcattctcctcctcctcctttcttccttctccccctccttctcctccttctcctcctccttctccttcttcctcctccctcttctcctccttctccgcctcttctccccctacttctccttcctccttcctcctcttctcctcctccttctcctgctcctcctccttctccttcctcctccatcctcttctcctccttcttctcctttcttctttcttcttctttgagacaaggtctcactctgttgccccggctggagtgcattggcaccatttcagctcactgcaacctctgcctcctgggttcaagcgattctcacacctctgcctctcaagtagctggaactacagaccatgcccagataatttttgtatttttagtacagatgggatttcaccatgttggccaggctggtctcaaacccctggggctcagcctcccaaagcgctgggactacaggcatgagccaccacacctggcccctttaccatttcttgatggaactaatggattcccaccccacagcctttatgaatggactgaggccattgaattcaggattcttactttggtgtgtagctgtggctgcctccctaggaccagggcacagaaatttcacagtaaccaatgagagagaccaggggccagctccaagccagagtcatttcattcagggcagatgtgatcagaagaccagccaaggggctgtccctctagcaggatgtgaaaacaaggagagtcctggtcaacacaattttgcttggaaagcaaagtgggtgctgaaatacctacacctgagagcgattgtcttaatgtggcaggaatgtaaaacaaattggacataatttggagggagggtaatgaggtaccacgaacaagaaaacataaagaatcactaggctcggcaaggtgtcaaccctgtcctaattaggcacagttgttataagaagtacataattaataagcgtgtgaccagatgtgaaatacagcagaggtttttcctgaaatggagggtgtaatgaactgcgcagctggaagtagttgtcctaatttggcgcaggcggaaggcctgcctggaattttgaagaggtgtagtaagatgcacaccacaggtttacacctgaaaacaactaatcctattccaactggactggggtgtaatgagatagagctacttatcaagagtgtaatgagatgcaaaagccattggaactgagctggaaatttctttaaaagtgaactaagacgcaaacaccaggaaagaatttctgctaatggaggtaggtgtgagtgtgatgaaacgtacaccatgtgaggagaggctgctttaacatgtctgggccaaagacgcgtctgtaattaaaaatattgccaggacatttacacacctggagcaagagtccctgggaacctaagaacgcaatgacttgtaaaagccacatgcatactattaagatgtatgtgaccacttatgtgtgtacaaataactggaaaaaaaataaaaggaacttaggtgttttcgggtgagtgcagttcccattttccttgatctcatttagaaaggtgacctcagattcctgctgactttgcaatagatactctagcaggaacctgattccaaacagaaaacccagcaatcttctcatcccaaactgatttaattatcaccagctcaagttttctttcacacaaggatttatttactgtgtgagagagatcaggaaaccattagtagctggtttttgtggttgtttttattttatgattgctactacgttattctagacaccatttatggaacacttcatgtgtatcaggtgctgtgctaaatgctttaccacattatttcatttaatcctcacaataatcctacaagatgtatattattatcatccctactttacagaggaaactaaggctcggattaagggctttgcaccagatctggtaagtgagccagctctgcccaacaccagagttcattctggaaccgtagccaaatccaaagctcataccactcgtctcacaacagccaataagacaagacatactcaactattctttccaaataaaggaaagtgactttatttcaggaagccagcaaactgagaagatggcagactggtgtcctaaaggaccatcttcaaaggtatgaatctcaagcttctttttatattgggtaaagggaacaaggagggggttaaggtcaggaggtgacaggtgaccacagacatctgggtgtcagcaagagtctgagggagtttcataacttctttttctttgttcaggtcacagcactcctacaagtctttagcataacattgttcttgggtgtatgcccttcttatctcctcaggggttagtttggggaaggccctattatcatccttgctttaaagttaagctatacactaaattcctcccatagttagctgggcctacatgcaggaatgagcaaaggcagtttgcttgggggttagaagcaagatggagtcaactatgctagatttctctcactgctacagaacccccctctgtgctattttgagccaaacccccttgtctagtgtggcaaaggcagggactctcacatgctatatttgagccccaagtgatactggtagtctgactcatccattcaccctgtcctctcctgtaacctccagcaggaaccatttctggaccacatttggggccaccattgcccactctcctctctgcttctcctccacccacagctgcctgagcccatccctgtgaccagtacattgacagaaatcttggaaacacaaacctttggttcaggggctgaccccccaccagttggaggctggagataaccccaagaggttgaagctaaatgctcaggttctagaatctggtgtatcttggctcaacatgttgccttagccttcataggggaggcaacttatcttttccttctatctatcttaggttcattgtctggaacccctgtaacaaaagacagattaagaagaagaaagcatactaatttatttaatgtaagttatacatgaaaaaaaatgaagacctgaagaagtaattaaacctgggtggggttttgctgctgtttgtggtggtggtggtgatggtgttttcgaggcagggtctcgctgtatcgcccagcctggtctctcacaggagggtcttaggcctgcttcaggggaaggtcagaaaagtcttcctaggttttaggacctgctgcagaggggaaagaagaggaatggccaggggaggtcagagaaaccttcctgaacatgctgtttctcaaattccttctgcttaaactgttcgctatgctaaggtgccagatttgggagtagcgtgtcctgaagaccatcaactttgcaggtggtttgatgtggttacaagtgcttaaaaatgccctctgttgcctcatctttgaaatgggataacagtgatactaatagctcctgtccaacagaggcattcagtgcctggcatgtcattagtattatatatacataacaaataatatcctgtctgtttctttgaggagtttcagacacactatcaagaaagcctgctgtgttgaagtgtaagagtgcagccccgcttacagcgcttcttggttagaaaggcccaggctaggctgggcatggtagctcatgcctgtaatcctggcactttgggaggccgaggcaggtggatcacttgaggtcaggagtttgagaccagcctggccaacatggtgaaaccccatgtctactaaaaatacaaaaagttagccgggcatagtggcgggtgcttataatcccagctactcaggaggctgagacaggagaatcgcttgaacctgggagatggaggttgcagtgagccaagaccatgccattgcactccagcctgggcaacagagagagacttcctctcaaaaaaaaaaaaaaaaaaaaaaaaaaacaacaaagaaaggccccaggctatggcagggtggacccaagactgttacttgctgtatgtggacacctaaaggcccccagaaccatccatcctcatcatagaaactggacgttctgatcttacacgattgtttcagccccctccccacacatgccgactgccctcagtgtctgcttccttaagcctgcttccattttagctattagcgagggttttgcatctcgttgcctgccagcatattatgtgcatctcattaactctgaaggctccactaccctttagggaccagaccttcacagacgtaatggccttctgcctgaggtttgagtttgctgttactctttctaccttggctgaggaatgtcagcccatggatttctaataagttcacaaattgctctatgaaattgaggtgagaaaaatgtcacattctttttttttttaatttttaaaaatcaaatctggcttggagcccccacttaaccattctcagcagaagtccgactccagtcattgtgatttactcacaggcaggggatgggggttttggtgagaggcttcccctccttcaggttgcaccaacaccctgctgctgaagcaggtcaggagagcggggtgagcactacgtcatcagggcatcctgatcactctttccccgggctccttctgcgacacagtgaagactctaaacactgtctggtgctgtcgtcaggccctgccctccacaggcagagtcttttctagtgtgcccaggctttgttccggggacctccaggcctcagtgtccatccaccacaggcatccctcacagttgcctgacacgaggtcctgccctctgtgggcactgtgagctggatgtcgtggagctaccgtgcatgctacagcccttgtctcttctcagctttgggggacccaacactccaggttgggcagttctctcctctttcctcctgaccccagagtctctttcctttctgccactgggagagcaaaccctccttccctgggcctagacctttcaaaacaataggctgctggagggattatctgagtgaagataagttttctctctctcctcccctcccttcttctcccctttcttttcttttgccctgaaacaagaagcttgttaaccagacttctgaggataaagagagcctggactcaagagcaatccccaggtaaccctatagggtggcagtgggaatcttttatcctaattttgggtggggggttggcatcaattactttctcaataacacctgttgtggattcatagaaatggatagaacctgagagagcttccgtcccaaccatctcatttttcaaaggagccagaggagcaaagggaggaggcccaagaggagagtggggatgcctagttcatgtctgagccaggaccagcatccaggtctcgactgccactcccaggatcctgcatttgggagcccccaggtgaatcatgctgttagactgccaagtggagggatagaggcaaggtcctgccttcaaagacatgaatgtcgcatggaaagaacagggcaacacacacgaatccactatggagtatcgtaagccagtgtaccactgaaggctcacggagcatttctgaggaactcagtaaaacgaataatgattgtagactatcgttagtcaaatacaacttaactgggaaaatggaactggaccatggtcttgaaaaacaagtggagctagagaatcaatgtgagggctgagatgaaggtatgcagtttgtcaacctccacagtataaaaaaaaagtaagcaaagaaagtgaagcaaaagaaaactcaggagtatgaggaggatcagcacagtgcagtcatgaaaactagccaaggcaaacctgcctagcaggaggcctggcacattttggatgttcttgacttcttttttcttaccttgctggcagtcagcagatacatgggatctttgaaccctctagaattacatgcatacagcatgggtgatttggggtgatggtgtataagtgcattatatgaaatcaggtctgaggttttcattaggttctcaatatatcttgctctccctcttccaggaatatagtaggattgcatttctgagcctgtattagtccgtttttacacagctgataaagacatacccaagactgagtagtttataaggaaaaaggggtttaatggactcacagttccgcatggcttgggagacctcacaatcatggtggaaggcaaaaggcttgtcttagatggcagcaggtaagacagaatgagagccaagtgaaaggggaaaccccttataaaaccatcagatctcatgagacttattcactaccgcagaacattgtgggggaaactgcccccatgattcagtcatctcctactgggtccctcccaccacacgtggggattatgggggctacaactcaagatgagatttgggtggggacacagccaaaccatatcagggctcttctgtgtttgggtggtaccatgggattaggtggccaataagttatgagtagaagggtgtcacttcccaaccaaagccatttaattacctgtgtgaaaccctccagagctcagtgccccctctgtcacaatggccagcaatgttccagatagtgaccactcactcagctagggttccagagggaggaagatgcagagcagagccccagctgacctgcagtggacatatgaggtaagtaagaaatacatctttgttgtttaaagccattgacattttgagattgtttgttactgcagcctaaccctccctatcctgactgatacacacaacgaagaggctgatcacagtgaggagagcagaaagagcaagggaatttcaatgagggatgaaattttgactttaaagagaactagttgagtggaggattgagaataagagccaaatttagaggctgaaggatgagaaaagatagtgatttcccaacaagtcctcagtcagtacatgtctgtcctaaagacagaagcaacaaggctgggcgcagtggctcacacctgtaatcccagcactttgggaggccgaggcaggtggatgacgaggtcaggagatcaagaccatcctggctaacacggtgaaaccccgtctctactaaaaatacagaaaaattagctgggcgtggtggcaggcacctgtagtcccagctactcgggacgctgaggcaggagaatggtgtgaacctaggaggcggagcttgcagtgagccgagatcacgccacttcactccagcctggggaacagagcgagactctgtctcaaaaaaaaagacagaagcaacaagtatgtgttgttcactcaaggagtgtattagccagggttttccagagaaatagaaccaatagcatatatatatatctctctttaacatatatgtacatatccaacatataaacaaaaaatatataaatatatatctaacatagaaaaaactatcatctataattgtatatatatatatatatgtatatctcaataaatgaacaacaaatattcttcacttttttgtgctaaccttgttagaactcagcagatacatggaatctttgcacccctagaattacatatacagatgatcaatgacttacaatggttggacgtaaaattttttggctttacaatggttcaaaagcaatattcattcagtaacactccataacttacatcctgataaacccatcataagttgaggatctgcatatgtgtgtgtgtgtgtataatagagagaacagagcaagagagagagagatgaggagacagaattatgggagttggctcacatgattatggagactgagaagttccctaatctgccatctgcaagctgaagaatcaggaaagctggtgatgtaattcagcccaggtctggaggcctgaaaacgagtagagccagtggtgtaactttcagtgggggagttgaaggtgggggactggtctaagtctcagagtacaaaggctcaagaaccaagagctccaatgtttacagacagaacaatatggatgtcccaactcaaagaaagaaggaaagacttgtccttcctccacctttttattctatcagggccttcaacaaattggatgatgcttacccacattggtgaggacagatctttacacagcctactgcttcaaatgctaagcccttccagaaacaccctcacagacaaacccagaaataatgtcttaccagctatctgggcatcccttagctcagtcaagttgacatataaaactaaccactgttgcgggattcaggaggacgagagagacctcaggttgaaacaggagaatctttattgagtgcgctcaggcccagctgactcacctccaaaaaattgggcccagaacaaagaccgcacctgaattttatacacacttcacaaaagggggtgggctagcttaaagcaagcttacaggggcatgaaagcagggatacagagggaggacaaagacaggattgcacatgactgttgccaagcaacccagatgtctgttatctaggtttgtctgagcacaggcttatcctgtaaccttcactatggtgcccaggcagctgtagttcaggcctactcaggctcctcatgaccttcattgtacttcttagataaaacagaatacttgaagtcactagttacagagaataggaatctataaactcattccataaaacaaaggaaaatttgtttttcttctccttatgttgagggagtgctgggagagtctccagagcacattagataatattatcaagacttttcctggatctggctgtgcctgttgctgcctctgggacaagtcagcctaatacaggaaaacttattttgctttctttttaatttgatttttctttaatttcctgcatcaaccatcacagtgagcaatcctggatccccccagtttatttatgtcttttgctttacccccctttttcatttatttgaactcctgtagtattagtgagctcagatacataggtcttaattcagtgtctctgagtactcacaggaaagcttctatgtaaatccaacacataaacagaaaaaaaactataatagttaactatatataatattatatctataatattatagagattataaatctgctgtctataataattaactgttattaaagcttaaaaccccctacaagttgccacacatccctgctccaaaatcctgatgtctaattatctcactggaccagcccctttttccttaggaactttctatttcagtaccatttattacccatcctcagcagtaagtgtttaccctctaacaacgtaggcccaatcaccaaaacatgaaaaagattggggaaaagaatatatttttctaccctcctccccaacagcttagagttccttgtatttctctgatgtcccagtggatgtaaatgttaatggttttgaatgagatttgaagttgcaatcttaaaatgaggaaacataacacttaaatgctgttaattcagctagctttaagagactaataaagcacaaggtactaggcctcttggcagttaaagagcaattcactcatctatgataacagcaaacattaaattattttcataggggatatagaacttcttgcatcttgcagttgtattaactgtcatcattttcttagattttcatttccatgttttctggatgcccctgagatgcttacacactgttccagacctacagagttcagaagggaagtaagagtagctacatcattcgccccacatcccaccctccatcgaggactgatctagggcaatttgacattcctgctgtccaaattcctttagtaaacatcagtagccttctgccataagcagagatggaagcaatgtgactcctcccctcaactttgctagcaggaagtgtgctacaaagtaagcagtccacagacaacattcattagcaagagaacgtaaacatcctcttccaacctgctcaggaagcactctctgtcccttttctctgtccagcaccttattggaaagtttcctctgaggcaagcacaactatgttctgtcagcaggatcagacccaccttctagtttgatctagagacagagttctgcatgcattctgggtgcttgaggacccagagtgctgtttcatagctgtcaaatactaggtttacttatttttttttaagtcatttgcaaaaagttgctaaagcccataaagtcttaccagcccaccacatgtcttgaacaatttcagcattcatttcttaccccttttatgctgattaaccatccctccagtactattcctgtttagatggcagcccttgaaaggtttgccacagccacctctggagagtgtgttctggaaggaggtgcctgagtctggtctttaaggatgtcatttctcagggagctgcccggttgggctatcctgtccctcattaataaatgccctgcccttcagatgcagtgtcagttcctctggtcctccacaataggacatctactaaccatcactttcctagttgtgggcatgagtttgcactgagccatccacatgtacttggaaacttcaatgcaaatttgcaaggcaggacccaggtgcagtcccagcctgcctcagagcacaaggatgctaagcacattcaccagaaacaccctcttgcccgcaaaacctaaccccggatgctagtccaaacaggctccctctccaaggatacagagccttggactctgatcacgccaagatctagagtccatccagcttatgctattaatagctggggccatgctaccagcccatagcttattaataatgtatagctgcagcccctgacttagttcagctataaacattcctcatctgcatgattagctcttaacttactgattagaaagtttcatcctgccacaaaacctaccctttctgaatgaatggctcttttaaaggcagccaagttctctaaaatgtatctcaaacccaaataaaaaatagtctacaacaaaaacaaaattctactattttcttgatggaatgagaaaaaaaggagcttaagaaggtttttaaaagttcagctccatgcttactgaagggactaaaagtagttgtgagtacaactggggacttggggagataaggttggagaataattcagtggcgagtaggagatattaataagtttgttgttgttgttgttgttgtttttaccttgagggatctggtgtaaccactaaggagttttaagcaagtaagtagtattgggttttgactttacaaatatcaccctggaagatggataatggattggaaggcagatggcaggaagactagtcagtgatcaaggagaatgacggtagtggcttcaactagggtggtagtaatacggatggagggaggtggacagattcaggaaatacttaaaagaacaatggccaggtgcagtgtctcatgcccataatcccattcttttgggaggccgagacagggttgcttgagcccaggagttcaagaccagcccaggcaacatagcaagaccctatcttaaaaatatatatatatataaaaattagccaggcatggtagtacccacctgtagtctcagctacttgggaagctgaggcagaaggactgcttgagcccagaagttcggggttgaattgagctatgatcgtgctactgcagagggcaacagaaatgagaccctgtctctaaaaaaattgtaaacacataaataaaagcatgattgctccctcacctcctttaggtctctgctttaatttttccttctaaatgattcctttcttgaccacctatttaaaacagcaaccctggccaggcatggtggctcatgcctgtaatcctagcactttgggaggctgaggcaggtgaatcacctgagctcaggggtttgagagcagcctggccaacgtggcacaaccccatctctactaaaaatacaaaaattagctgggtttattggcacatgcctgtaatcccagctactcaggaggctgaggcgggagaatcacttgagcccagggggtggaagttgccgtgagctgagattgcgccactgcactccagcctgggtgacaggtgacagagcaagactccgcctcaaaaaattaaataaataaataaataaaacagcagccccttccccacagcctatactttctctgcttaatttttctccatagtttttattgccatttgacattctgtataactcaatcattaatttgattattgtttgtcttccccaactaaagtatacactctttgagggcagaggtttttatatcttttgttctctgtagccccgatacttagaacaatccctggcacataatagatggtcaataaatatttttagaatgaatgaataggtgaaagatgacagaattgacaggacgtgatcattggttgaatgggagggcgtaagaggaagtggtaaagcagcaaaggtaggttcccaggtttctagctaggttaactgaggggatgacctgctattcagtgagataaggaacacaaggcaggatggggagaagcaggtttggaggtgaagggttggaggtgaaggaggtgatgataaacttgaggcacttgtgggctgtgtacagaaaaatgtagaggcgacaggactttgagctgaaagaatagattgtgcaacctttagagtccttatacattcaaaaaatatttgttgtgaaccctctttgttccagaccctacaccaagcatgttcaatacacagatgagtaaactgaggttgttaccagaaagtggtcctgatccagaccccaagagagggttcttggatctcacacaagaaagaattcaggggagtccataaagtaaagtgaaagcaagtttattaggaaagtaaaggaataaaataatggctactccataggcagagcagccctgagggctgctggttgcccattttttttttggttatttcttgattatatgctaaacaacgggtagattattcatgagttttcttggaaaggatgggcaattctgagaactgagggttactcccctttttatatagggtaacttcctggtgttggcatggcatttgtaaactgtcatggcactgataggagtgtagcagtgaggatgacctgaggtcactcacatggccatcttggttttcgttggttttagccagcttctttactgcaacctagtttttatagttgttgttgttgttggatactgagtcttgctctgtcgccaggctggagtgcagtggcatgatctctgctcactgcaacctccacctcccaggttcaagcaattctcctgcctcagcctccagagtagctgggactacaggcacatgccaccacacccacctaatttttgtatttttagtagagacggggtttcaccatgttggccaggatggtctcaatattctgacctcatgatccacctgccttggcctcccaaaatgctgggattacaggcatgacccaccgtacccggcctactacaacctgttttatcagcaagctctttatgacttgtatcttgtgctgacctcctgtctcatcctgtgacttagaatgccttaaccatctgggaatgcagcccagtaggtctcagcctcattttatccagctcctattcaagatggagttgctctggtaaaggcctctgacaaggtcatgcaaatggatgacattacatataaaatcacagttgccacacagttgataacagccagtgttactgaggggacagggagtaagcactctcatagactttggaaggaactggaaaagggtggaatctttctggaatacaatttgacagtatgtatcaaaaagtttagaaatttacatatccgtgactcagtaatttcccttctagatacatatttgctggtcataagcacaagatttgctattcaccaagaggacaagggaggttcctacctgggtatgatcagcttgtgtactaagcaggcacctaggagccccatcaagtgatgcaccagcaggacaccctaagaggggttatatgggccccatctagatgcagctgcagaaaagtcagggtctacctctagtcccttgctcatgtctaaggcagactctcacagaagggcaactggctccctgttctggttatttgtctctgcataacaaactaatccaagacttagtagcttaaaacagttattctatctcatgataccatgggtcaggaatttgaggggcgatcagctgggtgattcttctgttccatatggcaccaactagagtcacctgatggtactaagctgctacctgggccagtctggaacatccaagatggcttcagtcacaagcctgacaccttggtgggaacagctctcaggctgtagtctcagagcccctccatgtgatctcttcagcagggtagtcggacttcttaaatggtgactcagggctctaaaaaaaaccaaagcagatgtgaccagtccttttaaattgtagtcctaaaactagcatagcatcactttgaccatgctctaaaggtcaaaatgtaataggccagtcatagatcctacctctcaacaggaggaatatcaatgaatttgcagtcatctgtaatctgccacactctctggttcaggattttcaagggggcaaggtctgatgcatacatccaagttgttctccttctgctcctctactgtgtgggccaatttttctctagaagtgtcttgcaaagtcaaaatctctccacttctttctttataggaagtgaggcttattatagcaaacagaaaggatcccttatgctatcactctaataccaaggctgtctggctccagtgagatgctaagctggctctcctgagaaggccgtttgctgtgaaagagatgtaatcagcctggaaacatgactcatccaagggtgtggagtttctactgatcagttatcacactggtcaccagcaataactggccattctgaaggcagttgcttctaagccagacttgcagaccttagttataattcctgaatattctcgtgaaagtcattgagacttccttatttttcaatagtgaagagatatagctcttgccagtgttacagacagtttaaaatctcttagggcatcatgaactacacaaaaagtgcctgaggagtggccaaaagtgagaagatagctaccaattggtggggcaccatcaaggcaaggagaagagtgactagtggcactgagaaacctcgctgagaaagctgatcagagagaaggtcccaagaggctggaagatcctctcatctcaggctgacattgggactccccttggattatctttgtatcaggagggcctcagaaggtttctctgaatgtagatgcctttctaccttgcaaggcctggcaggtggttacaaagggcacaggctttccaagtgctcaaagagaggacaaaaacttctggaaaagcatttggtgcagccgtaaaaaaaaaaaaaaaaaaaaattcaccaaaaggacagcctccccacccccttaattccattgctaagcctctgttaaaagaaaaacttcagccaaattaaatttaaagggtttaattgagcaatgaatgattcacaagctgggcagccttcagaatcacagcagattcagagagactacagtgatgcctagtggtcagaacaaatttatagacaaaaaagggaagtgacatacagaaatcggaagtaaggcataaaaacagctgggttggttacagctgggcgtttgccttttttgaacacagtttgaacactcagctgtatatgagtggttgaagtatgactgctgggattggccaagactcagctattgttacaggtgcatactcctaaattaggtttttaatcttgtccacctatcaagttaggttgcagttcatccacaaggactcaaatattgaagtacagactccttctcaggccatgtttagttcactttaatacatcataactggtaattgcagctctaggtcaggttgagaggttggagacttccagaatggtgaagtaataaccttccaaaaatccactcttaagaatacgtggccaaaaaaacaaaaacaacaaaaaaaaaaaaaccaactttttttaaactctggaaattaaccaaaggcttgcaaaaaatccaaggaggatttatgcaagaaaaactgctgaatcttggtaagaatagcaaaatgttgtaacattttaacttgcactattcctgtactcctcactcccactctgcagaaatcttgaaaacagcagctctgcaattatggaagctgtgcaaatgagcagccttacagccactggaggtataacctggatttagagctcccccaaaagcacatctccttagaattgtcacattttacctgtctttcagctccctgggaaagctccattcacaggatgttgttgtcattatttgatctgattcacagctcattgcttgggatctggggtgtaaaacttatccctagggtgtttgtcaaaaacaaccaatagcaatgatttaacatgtggctgcctgaggctgcaataccagttggggcaaatgggagcctggcaaaatatttaaaaggaagatcttgggaatgggttattcacagggggctttgaaaaagctccaacatatcacaagggatctggaaggccatacacatggcagagctgtgtgtgctcaggaaagacctaagtggaacctaacttctcacctctggctgaccttgcaaccaggaagtcgtactggagcattgaaagtgtgccccaacacacagctaacagtaccccttggctaaggctagagacttattagttccaagaacttaagaaaatctctgttcagtcattagctgaccactaagttaactgagtaggacttcagtcataaaaggaaatacttatttacagaatttgtcgaggaaagttactaaacaaacagtaaaaacaacaaaacagcaataacaaaccctggatacacagggaacaggttgagcatccataatataaaaatctaaacttgaaatgttccaaaatttgaaagttgagcactgacatgatgccatgagtggaaaattccacagttgacctcatgtgacaggtctcaatcagaactttgtttcatgcacaaaattattcgaagtattgtaaacaattcctttcaggctctgtgcataaagtatgtaggggagcaaacataatttcttttcctttcttttttaagttcttaattgagacaccctcctgaaaacaaaagtaagattaacagaagaaaaacaagtagaagtttagtaatgcatgctgtacccatcacagggaaaggcctcagttcaaaaatatttccctctcaaggcagtggttctggggccttgcttaaatagtattgttacaggagaagggtcctgatccagaccccaagagagggttcttgggtcttgggcaagaaaaaattcagggtgagtccacagtacaaagcaaaagcaagtttattaagaaagtagaggaataaaagaatggctactccatagacagagcagccacaggggctgctggttacccatttttatggttatttcttgatgatatgctaaacaaggagtagattattcatgcctcgcctttttagaccatataggggaacttcctgtcattgccatggcatttgtaaactgtcatggtactggtgggagtgtagcagtgaggacgaccagaagtcactcttcatggccatcttggttttggtggattttagccagcttctttactgcaaactgttttatcagcaaggactttatgacctgtatcttgtgctgacctcctgtttcatcctgtgacttagaatgccttaaccatctggaaatgcagcccagtaggtctcagcctcattttactccacccttattcaagatggatttgctctggttcaaatgcctctgacatttcccccctcccttttaaaagacaaccctaacttcaaggtttgcagagggatgaagatctatcttctgtaactacttcaggcagaataggggtgatgatgttcctgcctaactattagagtctcttgtatttggggtataaaacagctcagtcagaaagcattggtacggtgagggacattcataacttttgagttccaacaaaagatggtatctggaagattaataagtgttcaatttaagaaaacattgagtaacctcatcctctttcctacacaaagagtacaacagcaatatattacacaatagtaaggcaaaatacgtaaaattatcccaagtaagctaaattagaaggctttccatgaactgggcagctgttggaaacaagctgatatggggttgctagatgatttcaatatgtgcccagaatattgatccagatttttacattacccatgcctcttgtttcttctgagcagcagtcagagatcactagttggttcacagggataagcaggattagtcttaattacaggaaataaactcataaacaactgatgagactagaatttaataacaagtgtaccatagttcttgaaacataatttttctctctccagtttcccatttttattaagacaaatcatggtaagactgatttgtttcattttacttggcctgattatttgtataaagtgcagcaagaataattatttttcacataagctctctttaaattggcattgatgtaactctgttccatagaaggaatcttagacaagacttttttagagctgagccctgccatgggtttgtaccctcaaatacctataagttgaataaattcctctcctcttgaggttccaagataacttagctctcctaggcctgatagaaagtgacattctttacttatgacatgtcaggaaccctttgcagggactgtgtagacaaggtacaaggccagttttcccaaggggcttttattggctctataagtcaagtttaattccttaaaggaaaacacaccattccactcaaagccttggtaaaataaccagtttttccaattatgtcctgttacaaaagaaaacagattcttattgcacttatgcaaataactatattgccataaattaagaatactcacaagtagtttccaaattctggagaaactaggtaaacaaatatgctccaaattgtgttcataggagtatactttacctaattgttaaaagctgtaaatagcttaaaagaattgttttcttgtctttgaaaaacaaaacaaagaatcagcaacattttaacctaaaagttaaaaagatcactttagacttctactagtttactccatgcagttaacttctctcctgtttgatattcatgaacatttcagttctccatgagagttctgaaagttgtttcgtctattctaatgtcacaatttccaaagttatcagaaaactgcatttaagaacacctgttggagttctacagctgactataaaccaccttttgaagaggattgaaacaagaaaacaattgtttttgcatgacaaaaggttttaggacagccacagccaaaaacatgattgacaaatttggttacctctgtggcatacagtgattttatgtaacaattataattattaataacctacaataagttttattatatttgtcagtgcttcttgtatgactttactataccaaataaggcaaattttacctttgtgttagtgtactattaccattaaacccaattcttaataaaaccttataaataaatctatccaatcttaaaccatttgaccataagataagattttcataaatcttgtataaccctttacaattttttattaaagagcagattataagcaggtttttgctttaagaaaaacctgttgtccttttattccaatgttcaatttacagaaaaactgagtaatacccctttaacttcagccaatatgttcacacacagaatctctttcacaattaatttttcacaaaccttccacaacttgctgaaatcttcagctttaccttatctaacttaaaacaatcctttaacactttaggcataaaaaaatccacattcctatgacttcttataatcttttaccaaaaacacatttcactttctttacacaccttgcatgtaaaactgttttttaatagtctcaaatacatgttacactattaactcttagcaactcttacttctggtgaaaagccttgttagtaagccattttaattatgtactagtgtggagcctaggacccacagaagtgcagataagtcctgactctttccaacatctaacttcacgtgtcccaagccttacctagctgtaaagcaggcaagttgtacggttaagcatcatagtggtattctatgaagcatttaggaggcctaatcacctttaaattatacatttcttgcataaattccctgctatgggaattgcgtgacctacacagactatctacgacatactttgactttgtgactagtcctaaacatccctttttttaaacaaccaattattttactttaggacaagaatttaccatataagatcctttcttacataaagtctcttttctttataaacttctttgcatagctatggggtatggctaattccacatgtccccaggccttatctagaatctaatgcttcaaagtaggtaaactgaacaatttttaaaagtcaaagaagcagtttatgaccttaaagcatttagtaaacttaatatctgacctgcataatttagaagaaatgtttacattttggaagatattttgattttaccgataattttaaaaactgtctctatttcccaaagattactaaagtcacataatgtaaaaggcattacactttctacttttctgacaacgtatttgatttaagcacttatttttaagccaattaatcaaagctctttcatatataaccacacacacaacacacataaatacactgacagacagaagataaaggactcattctctaagccaggaattggaccctgaacccaggccaccattgtgaaaagagaaagcacagccacatagttacaaggtcaagctcccaaggacatacttggaaacctcatccagtttttttcagggacctgcagcaaagtttgtaactgaccagtttgttgggccatcttgaaaagcccatgctgtatcctaaggtacccctctttatgacagaacaatacagaaaaatgcacaaagcacaccagatttgctacagcttaacactagcctctcaaatcctttttccattaatcagaactttacagaggagataaaaagttatttttaccattaattcaactggttagcatagagagagacagagagaaagcatttcctgaggcagggtggggaaggcgaagagctcagcgagaccagagaaagatccccctgttgctctaacattcaggcagccacttgttggtcatgaagggatcttttccagcagtttcatcagctcttaggttttcccttttagggaagaagacactccccatgtcccatgatcccgtacatgcctgatcctgtcacccacagccgtcagcaaagagtacaagacagattaatccaaagagaatagcagttagcatcccatagtgccaaacccatccttagccagaagggactttaccgagaggggcctctaacccactctgtcttaggagagactctaactcctgtaagttgagcctctaacccaatcccattctttacccaggtatatgcaccccacttacccaaagtcagccaaaattggtgcaagcagatgattttcagttgagattagggggtctcttcagtatcatccctttgtggttgccagaaagatgttacaggaaagcggtcctgatccagaccccaagagaaggttcttggatcttgggcaagaaaaaattcagggagagtccacagtgcaaagcaaaagcaagtttgttaagaaagtagaggaataaaagaatggctactccatagacagagcagccacaagggctgctggttacccatttttatggttatttcttgatgatatgctaaacaaggagtggattattcatgcctcccctttttagaccatataggggaacttcctgtcattgccatggcatttgtaaactgtcttggcactggtgagagtgtagcagtgagaatgaccaaaggtcactcttcatggccatcttggttttggtaggttttagtcggcttctttactgcaacctgttttatcaacaaggtctttatgacctgtatcttgtgcagatctcatatttcatcttgtgatttagaatgccttaatcgtctgggaatgcagcccagtaggtctcagcctcattttacgcagcccttattcaagatggagttgctctggttcaatgcctctggcagtattttcacaaagacccataaatcttatatactgacaagacaaagaaggcttccaaaaggcaggaaaatgtggaaagtaaatttataagcagagtaaagtctgctccagatcttctagtagcactgtttctgagctctgtttctcagttgataagcaagcattatacaggggcctatctttaggtgggaaaggcagagagcaggggcagagtgtacccctgtgtttaaaccttttaaaagactttaactaaaatccccagtactttatagaggaatatttttgtttccttcagctgtatatgaaacataaatgaatttcatatttagacttgggtcccatccccaatatatctctttatatatatgcaaatattccaaaatccaaaacaaatccaaaatctgaaacacctttgttcttaagcattttggataagggatatgtgactttgtctgatttccagagttaactacattacattattttaaatgtccagttttgaattactaggtgtggggtttctttttgggttgatgaaagtgttctggaattagtggtgatgcctccagaaccttctgaatatactaaaatccattgaattatatgtacactttaaaagggtaaatattatgtatgagacatatttcaattaaaaaaatttaaagaaaaaaagtccaatttttaacaaaaaaacttatgagatgcacacagaaaccagaaagtatgggccatccacaggaaaagacaagtcaatagaaattgaggaagtccagatactggacttattatacagatagttttaatcagccaatatgaatattttcaaagaaaggaactcatgtctaaagagttaaaggacagcataagaataatatctactcagcagaaaccttataagccagaggagacttggggcctattttcagcattctcaaagaaaagaaattccaaccaagaatttcatatcccaccaaagtaagcttcatgagcaaaggagaaataaaatcttttccagacaagaaagtgctaagggaattcgttaccactatactagccttacaagagatcgtgaagggagttatatacgttgaaaccacctggccaacatggtgaaaccccatctctactaaaaatacaaaaattagccaggtgtggtggtacaagcctgtaatcccagctacttgagaggctgaggcaggagaattgctcgaacccaggaggcagacattgcagtgagccaagatcacgccattttactccagcctgggcgacagagtgagactccatctcaaaaaaaaaaaaaaaaggaaaccaaagaatgatacctactgccagaaatacatacttaagtacatagcctacagaccctatgactgtatggagcaaaaacacaatagaaattacaaagcaaaaagctaacaacttcaccattgaatcaaaacctcgcacgtaaatattaaccttgaatgtaaatggtctaaatgccatttacattggattaaaaaaacaagacccttccttccatgtgctgtgtttaagagacccatctcacacataatggtgcccaaaggctcaaagtaaagggttggggaaagatctgccatgcaaaacaaaacaaaacaaaaagcaggggtcactcttcttatatcagataaaacagagttaaaaccaacaacaggaataaaggacaaagaagggcattacataatgataaataatccaattcaacaagaagacttaattattctaaatatatatgcacccaacattgaagcacccagattattaaaacaagtacttatagatctacaaaaagattttagactgccacacaataacagagcggggcttcaacaacccactaacagcattacacaggtcatcgaggaagaaaactaacaaagaaatcctggacttaaactcaacacttcaccaattggacctattagatatatgcagaatactccactcattaaccacagaatatacatttttctcatctgtatatggaacatcctccaagattgatcacatgctcattcataaaccaagtatcaataaatttttaaaactcgaaattataccaaccatactctcagactacagtggaataaaaatagaaatcaataccaagaagattcttcaaaaccacataattacatggaaattaaacaacttgctcctgaatgacttttgggtaaacaacaaaatcaagacagaaataaaattatttgaaataactgaaaacagagatgtgacatatcaaaatctctggcatgcagcaaaagcagtgttaagaggaaagtttataacactaaatgtctacctcaaaaagttataaagatctcaaattagcaatctaacatcacacccagaggaactagaaaaacaagagcaaatgaaccccagagctagcagaagaaaataaataactaaaatcagagcataactgaaaaatattgagtcccaaaaatccatacaaagaatcaacaaaaccaaaagttggttatgtgaaaggatgaacaagattaataatctgctagctaggttaacgaagaaaagatccaaataagcacaatcagaaatgacaaagatgacattataactgatcccccagaaatacaaaagatcctaagagactattatgaacacctctacatacacagactagaaaatctgaaggaaatgcataaattcctggaaacacacaatctcctaaaactgaatcaggaagaaattgaaacactgaacagaccaatatcgagttctgaaattgaatcagtaatttaaaaacctacaaaccaaaaaatatcccagaccgggtggattcataggtgaattctaccagacatacaaacaagagctggtaccaattctgctgacactattttaaaaaatcgaagaggagagactcctccctaactcattctgtgaatccagcatcagtattgataacaaaacctggcaaagacacaacgaaaaaaggaaaactacaggccaagatccttgatgaatatagatgcaaaaatcctcaaacgccaatcattaaatgcaaatcaacaaatgtgattcaccacataagcagaattgaaaacaaaaaccatatgatcatctcaataaatacagaaaaatatttcaataaaatccaacatcgattcataataaaaaccccaacaaactaggcatcaaaggaacatatctatgacaaactcgcagcaaacatcatactgaatgggcaaaagctaaaaccatttctcttgagaagtggaacaaggatgcctactctcactactcctattcaacatagtactagaagtccaagccacagcaatcaagcaaaagaaagaaataaaaggcatcccaataggaaaagtcaaactatctctctttgtggatgataggattctataccttgaaaaccctaaaaactccaccgaaaggctcctggaactaatacatgacttcagcaaagtttcaggctacaaaatcaatgtacaaaaatcaattacataatttctacacaccaacaatattcaagctgagagccaaatcagaacacaatcccatttataatagccacaccaaaaacaaaacaccaacataaaaaatcctaggaatacgtataaccaagaagatgaaagatctctacaaggagaactacaaaacactgcaaaaaagaaatcatagatggcacaaacaaatgggaaaatattccatgctcatggattagaagaatcaatgttattaaaatggccatactttccagagcaatctacagattcaatgttattcctatcgaactgccaacttcatttttcacagaattagaaaaaactattctaaaattcatatggaaccataaaagagcccaagtagccaaaacaatcctaagcaaaaagaacaaagccagaaacattacattacccaacttcaaattatactataaggctgcggtcacaaaaactacataatactggctcaaaaacaaacacatacaccaatgaaacagaatagagaacccaaaaataaagctgcacacctatggccgtctaatcttctacaaagttgacaaaaataagcaatggggaaaagacttcctattcaataaatcttgctgggataactggatagccatacgtagaaaaatgaaattggacccctacatttcaccttataaaaaattaactcaagatgcattaaagtaaatgtaagaccccaaactttaagaatcctagaagaaaacctaggaaacaccattttggacatgggctctgggaaataatttatgactaagtcttcaaaagcaattccaataaaaaaagtgacaagtgtgacctaattaaagagtttcttcatagcaaaagaaactatcaacagagtgaacagacaacccacagaatgggagaaaatatttgcaaactatgcatccaacaaaggtctaattttcagaatctataaggaacttaattgaacaaacaaaacacattagaaagtgggcaaaagaacagacacttcccaaaaggaggcatacaacaaatatatgaaaaaatgttcaacatcactaatcatcagagaggtgcaaatcaaaagcacaatgagttttaataaaaggaagaactttacataggaagagtagcccacaatggaataagtcacattttaaagtggtgtgctgcttttcacttaaagacttcagtcaaagatagagggccatttatcacaatgttgaatgtgattttcttctctactgggtagaggattttttagaagaccttttgtattagtcagcgttctttaaagggacagaactaatgggatataggtgtatatatgaaggggagtttattaaggagtattgactcatatgatcacaaggtgtaagtcccacaataggccatctgcaagctgaggagcagggaagccagtccattccaaaacctcagaagtcaggaagctgacagtgcagccttcagtctgtggccaaaggcccaagagcccctgacaaaccactggttaagtccaagagtccaaaagctgaagaatttagagtctgatgttcaagggcaggaagcattcagcaggggagaaagatgtaggctggaagactcagcaaatcaagtgctcccacgttcttctgcctgctttattctagcctcgctggcagctgatcagatggtgcccacccagattgagggtgggtctgcctctcccattcactgactcaaatgttaatctccttttgtaacaccctcacagacacaaccaggaacaatactttgcattcttcaatcaagttgacactcaatattaaccatcacaactctgttttcaagttgacttataacttgacatctgccaccaccaccatttttttacagaaaaaaatatgaagtagtatggaattatgatatatacacattaaaaagatacaaattttaaaaaatagagatcagaaaccacatggaagacttaggagagtagcaacaattaaaattaaaaatttgagctcatggaagttcaaagaagaaaatccaactcccaatgattggagatgttgatttagtacatctggagtggaaccgggtaatatattctttttttaagcctcttatctaattctggttagagatcaactgtctcagactgtctctcccagctcttggtcatctcctccatgattttgtcaggggctaaacattacccaatttaaggtaagctaaagagtattcctgttacagatagaaaaaaaaaaaagttcatgggtagcagttcccagaaggtgggtatgaaaagcctagctctctccctaatggagaaaagcaaatctcaccatccattattcacagagactttttgtagttccctgaagcaaggctgttttaccctgcccaacttgggaagcattctccttggttcacgctaatggaaaatggaggagaaaatggtttatagactattcttgctgagacaaccgtctgggtgacccaaaacaaaaatcaactaatcaatcccaaggcttcctacacattgactggaaatctacccccacaacttgatgtgggagggaaacacccaagttcccagaaaatcccatttatccataagacccttctcctcattatttcagcctccctagggatagacactaaggtgttacagctctggtccattgcatgaagagttatccagggcctggaagatgttcatggtggcatcaactgaccacctcagtcataaatggtcctggaaatccgacttggatcagtactgccttctgatcaaaacttagatgatcagtgatatccaaggtccctaataactactggattctcagattccagtgtgtgagcatgagacaatgaaggcaaatgggtaggacctggcacacacacatcccaagcactgtcacgaaaggaggattcacacatatcaacataaagtctgagaccaaagcaaaga

SEQ ID NO: 61 - DNA, 4788 bp, Homo sapiens
aatctgtaggcatctaatgaaatgattggtgttttatccttacctttcagtgctttctcctgctcaagacagccacacgaacacggatctccccccagtgtcagagcagatcatgcagactctcagtgaacttgccaaatcgttccaggatatggctgaccgctgcttgcttgtcttacatctggaagtgaggtatgatacagccaagcccaggaccttgcaatttgaatgcactgcggttcataaatcacttgcttatttccaggcagtatcaccataatttctggctcatattattgatgttatccctttttacactgaaagtgatttttagctgtattcagtgattatttgagcgcacagtgtattgtgagtgtggtgattcagagctggcatgatctatgaaatcaggtcacctagattggaatgtcactatcaactggctaggtgatcttaggtcagttaattaactttacaaaccacagtttccttattttaaaaatggaaatgatagtttctaacttatagagattttataaatgaaataataattagcacaatgtcagccacaaagtaagtgctcaaaatatggtagctttgctattgtggtgactttattgtgattgatatttttactaaagtgctctgctagtcaagaagggagtcacatttgaaaaagtagagggaaacaggtaaaagaattatactaatatattttagttaacccagtatatccaaaacagcatttcaataggcaatcaatggaagtgattgaggtattcagcattttcttttgcactaagcttttgaaatctgcacattttgtacttacagcacatcacaatttggactggccacattttaagtgcttggtagctacatgtgcccagtactagcatagtgggcagttgccaagagtggctggggctgactaggaatgggattcttttctttaagataaaatggtcagaagaaatgtgacaaagtaacaagaatgatcagtctgtacaaagacctagaggaagagagtttcagacagaaggaggcacactcacaaaggtcctgagacaaaatcaagcttggcggttttaagagcagagaggaggctgatatgcttgtaggctgatgaacaagctgggtggggaggactgaaagaataaggcacaggagacaggctggagcccaatcctgtggagtcatgaagcctgacacattacagggtcttacagaccaagtgaatcattcagatgtcatagaagccatggaagagttttaagaaagggagagatatcaattaattaacattttttaaaggtcactctggctgttgtatggaaaagggattgcagggaaaaatacaaatggaagcagggtgaccagttgaaaacaactctgagcatcaaggtgatagaggtagagatatgagaagcataggatttgggacatatgctgaaggtagagctaatgaagtttgttgacagattgtattggacacaggggctggtgcaataagaggaaagactcaaggaaaaccactagtttggggccagagcaactgtgtgccattaactgaggggagaaacactgagggaggagaagggtggaaatcaagtatgccattgagagatgttcagtttgggatgcttattaaacaactaggtagcaatgtcaaaacatcaggatcagaaagtgcatggtgtggtaatacattctattctgtattgctttggaacatgattaacattgatagaatatttttcttttcatttgaagtctttactagatttagattttaaaaatgtaaataggactttgtttgataggtgacccttgggaatatgtttggactccagttagaacttggatttctttccagggtgactccttgtgtgtgctacttgctttttatccttcattaccattgcccagtgagttacttccttattgcttgtgagagccttgtgagtggaacaagagaagtaacattgcagatttagaatctgtgttacgtggcattattcctgatgttatttctcacattaagctgtccagaaataaagctctttctgtatattttctgatttgttttacaataattttcatatttggtatctctttatttacaagcggacagagaaatcaggtgttttctatgaacaaatatttgcaatagatggaaggaaatgaaaaataccaagtaatattctaatgccgctgttacctgagttacaaaggaaaacaagggaataccaaattagttactatcacaattcctggaatttatactattgatcgtgtgcttatacatattctacattcagaattgtttacttatgtgtagttaattccaagtgggatatttgcaacacatttgaataagatcttttaaatccttaacccctattctgcccttttgatacatcttggcaatactcttcttaatactgaacatgctttagtcattaatttacaagaaactatacagtgctatagcactggttgccatatcttcttcaacattagtctaaaaacagaaaaatgtcatttttaagaatgaatatcaaaaaagactgaattttagagccctggatgtagaattatctttccttgaatttaactcagaacacgaagcatgggatttttttaaattaaatttcctcacttcctcatgtaacatggttccaacactcaggttgctttctaatgagtatgctccattttgtctttgttccttttaaagtaaggtagatacaactagcagaatacaccacataaggctcggatagtgaatgtagatgcacttactctatcctggtcacgttaacaattttttttcagtttgcacagtgatgatacaaaatgaaaaagacagatttcatgccactctagtataataacgctagaatagaggtgtctgctaagtgctctgggggcgtgactgtggtagagaccatcgagcagctcttccaggtgtggcttgttcattgtgatggctggccctgaaacctaatatcctgctgtatataaggtgctcagtaaaaatgtgattaagaattagttggtttgaaaccaaacccagataaagtaagggctactttacaaaacaaaacctgttgtctttaaagaaaatgaattggtttgcagtttctgtttttacatagcagtccacttgtaagtccactgcattatcttaagaggtacagaggctgtgtggccaatatcattctcatcaactaatgtttgttttgttcccatcctgctgtaaaaaaagaattagaacgtaggcccggttgtccaggagctggtgtggtgaaaaagtggctggttagctcctgtctctggcacttttagccaagaaaccactgtaatagtacagatagaagaaaacaattcatggaaaaaagtaatgggatatgctagcaaaaagtccagaacaacttcagatgccaaaaattggtcttgttcccccaaatatctttatatccatagcccatatttttctttgacattgttaaaattcaaaccaaaaactgttttccaatccagcgcagtctgtgttgaaggatccatctaaggagtgtttgacattttacctgtgtcattgtaggtcacattttaaccaccaagcagcccctttccacagtttgaagcataaagcaaatgatacccccaagagatgaaagacatggtgagcccattaaaaactattgaggtttgttttttctatttgaactttagaagaagaaaattaagttgccatttgagtccaagatgccaagaatgtcacctttatcagctgatttttctcaccatcaggagggctctaagtaggttcaacagcaactgcctatcactgttgggatcctaagtgtgcactctctgaaaatcatccaccccactgtgtaatcagcagtgtttgcagaatacgttaatgtcaaagtcatagtaaggtcagcaacaacaggccagaatttaaatttaaaaaaatactttatttgaatttggcattcgctgatgactattttaatttcttttttttttttaatctctaatcacttgggaagaagataataccttaaagaaaggttatatgtcttctcccccagtagcttgaaggtctcataagctctcacctccagttcataagaatttcctaactagtcactctacttccagttgcttccattctctgctattaatccacttgtatactgtgccagagtgatcttgccaaagctcaggtctgattatattattcacttaaaatccccctaaggatccctatggcttctaggataaaggcttgattccctacatggccttcagagcctgtgctgacctggcctgtgcccatctccccaagctcgtggagtgcctgtaatgtgggatctgtgtgcagcagaaaagaactgctcaccagtcctcagaacatcctgcatttatagtctcatgctattttacatggtcttctcattgcctggagtcataatgtctgtcatttactttaaaaatactttagcatagatgctttaattttattttcaacaaagtgctacttcatttaaatttcaaccacagtagcaatcagtgtgctagtcatgaatcccattccagagttggtcaactttcattctgtcagaaagctcacattccagaggaggctacaaccagtgccattactggtattcttatcaaaattatacatttgtgccaattagtacttgaatatcagaatgagtttttattggtgaaattagtcattagttaattagcaactgttaagatgag

SEQ ID NO: 62 - DNA, 1424 bp, Homo sapiens
ttccagttttgttatcagtttcacatgcttttatagaatcaaagaatgtattaactttcatttcttatcattggttgaagattgtagctttgataaaatttaccagttaagtcatctaatttcagtaaatttggggagagataagtcttttacatttttcaatttttttctacccatagtgatctgtggtcactaatctatgaaaaatttccaacttttgttttgtcaatgtgaaaatttacattattttttgtaccatatagaatttcttattttggcataaaattttatctaatttttaagcacttgactatctttaccataatatttctcaccacccccactcccatttttatttccaatgtggtttacttgcattttctttttatttccttgagtaaatctggaagaagtttgacaatatttttaattttttaaagtcttctattggttttatttttggtgtgtttattttaatatgttttttattctattctatgaatttctgtgtttttgtttataagtttctctttcaattttccttggatttatttatttatttattttttttttagtttcttgagtttcatgcttatctattaatattttgataatgctgaatttggatcaaaaattatatttattgtattctctgctatattacaataaggaatataaaatatttatctttctatataattctttttgctctaaacacactttgttattaatatatggctattactccctttttaaaattgttgttgctggtattcatccagtggatacatctaactcttcatttcttacctttctgtaacatttcattttttattgacctatttgtttatttattttataacttgcatatagctggatgtttgttaagccaatgaataagtttctgtttaataggaacatctaatttatttttcttgtgatcacttctatattttattttctttttgcactttcattttatgacttcttttttttgtttatttttacttattttaaggtcaaactgattatgtttcactatctactacaaaatagtttaggtattcttttattacaattctgctaatgtatatatttgtataaacatactgagttttcctatcagtttcaaagctcaatatctatagcctttataagacccccccatttgcacatgtacaatagagctttaacatatttattttcctttccctttgttctctgcaggattttgttaaaaaccaagaatttaagttcttgattgtcattcttttacattatagatattttactttgactattattttaacatgtaactacttataaacaattatttattcagctttgtatacatattacacaacttgcttaccactattacttaatactctgtctccttttgttttgaattcatttttgatttt

SEQ ID NO: 63 - DNA, 1269 bp, Homo sapiens
taagttgatcagggagataggatcagaaataaatacgtaaggctggattttgaaaagagaggcgacatttcttcctctgacccaggagagtgagcgaatgactggctgggtaaaagtctggatggactttggtaataaacggattcagaagcaggtgtgctgcagtatgcaagttctttgactggaaaactcttgattttggcctgatgcagcaactcacgcctgtaattccagcactctgggagcccaagtgggtggatcacctgaggtcaggagttcaggaccagccagaccaacatggagaaaccccgtctctactaaaaataaaaaaaaatagctgggcatggtggcgcctgcctgtaatcccagctactcaggaggctgaggcaggagaatcacttgaacccggaaggcagaggttgcagtgagccgagactgcaccattccactcagcctgggcaacaagagtgaaactctgtctcaaaaaaaaaagaaaagaaaagaaaaaaaaaaagaaaaagaaaaagaaagaaagaaagaaaagaaaaaaagaaactcttgattcttccaatcctatcatatcccatctctttttgtgaataaactgattttgatgaatagtaaaataattaagagccactgccttaatcattctagacagtaaaaataaataacttctctcactgatggatgattccagagttttatctaaattctgtggaatggttgaaaattgcagaataatttttttcctgaggttctttttttttttttttcgagacagagtctcgccctgttgcccaggctggagtgcaatggcatgatcttggctgactgcaatctccacctcctgggttgaagtgattctcctgcctcagcctcccaagtagctgggattacaggcacccgccaccacgcctggctaattttttgtatctttagtagagatggggttggccaaactggtctcaaactcctgaccttgtgatccgcccgccttcgcttcccaaagtgctaggattacaggtgtgagccaccgcacctggctcttccttgaggttcttactcagagttgtagtttcagttatgtttatgtcaggtgtgctcacatatttggaagaatatgaatccttacttgatatctgacatcttatctctaagagataaattttatctctaagagataaaaatttctatacatttttaagacaacattgaaagttgaaaaaaatcatgtcctgaaaattcagtttgagaaatttttactct

SEQ ID NO: 64 - DNA, 11392 bp, Homo sapiens
gcacatgcatgaaagataagaagtgagatagcatgatggattatgagagaggttgtatcaggttgaagcatagaattcaaaatgagagggttggagtgtccagagatgagattgggtggggggcggtaagtaaaggccagatattagaagaaattaattttaatcttcacctgcagaaaatcaaaaggcatcagagagctggaagtgaaaaagcaagaagggggcagatttgcattttagaaaaatctctctgcttgtagtatagatgacagattgaagaaagggatcctgtaaatcagaaggtaatggatgtttcaattttacacattattgtacatatattcccactgactagttcagtgcttgaaatacagtaggcattgatttattaatgtattctttcatttcattccatatgcattagtcacttaactgctgtgttagtcagtttctccaaagaaagaaccaataggagatagatagatagatggaaagattagatagatagatagatagatagatagatagatagatagatagatagatagatggatgaaaggagatttattgggggaattgggtcacatgaccagggaggctgcaaagtctcatgagaagctgtctgcaagctagagaccctgggatgctggtagcatgtctcagtacaagtatgcaggcctcagaaccagggaagctgatggtgtaactcttagtgtgaggcagaaagcctaagaacctagggggccattggtgtaagtcctggagtccaaaagctggagggcctggagtcccaatgtctgaggcggtaaaagaagaatgtctcctagctcccagagaaaaagagagagtccaattcacccttttttctaatttttttgctctatcctgggtctcagctaattgaatggtgcctggccactttgagggtggatcttcccccaggcagtcctctcagactcataagctgagctcttctggaaatactctcattctagatattccttaatccagtcaaattgacacctaagattaaccatcacaactgctctctataatactccatgctatatgcaaagaagatagtaagtactaaattagactggcatggtctaagccataatgggtctcatgggagagggagataaacaataaattaatgaataagataattatatattgtgctaaactccatgaaagaaaacaaagattgctccgatagagaacagcatgtgctacttcaggtaaggttgtcagagaaaacctgcttaaggaggtggtagccttaagatagaaattggaaaatgagtattttagaataaaccgcaaaaagtaaaatcaggtgggagctattacaaagacccaaaaaggatatgataagtatcaatacaataggtcataattgtattgtaggtcagagaactcataattaagtagggggtggaggcagactaggggaatatatttgtagtacaatgtgaagaataatagagttatgtccaaaatgctacaagagaatataggaataaatacttcttttggatatatatagaggaagtcttcacagagagggtagaattagatctgcttttgaaaaataggtaggacttcaccagagagggaaatgcatgaagttcagtgaggaatggccagtctgagggctgagcttgagtaaaggcatgagagatgcaacaaaaaagcatggtattcctgggaacagtgacaggactagatgggctttaacgtagagtctgtagcagacagagggcttgtgatctaccttgctctgaaaggatattcttactctgctaacccagaaatacaccttataatggagctggactaaaatagacccgttttatgatggtgcctcatttgacttttccatggtctgactgcaatgctcaaagtttgtcactccatatttgttattgttttgtataaagtccactcaaaccaccatttttgcctttaaatagttgtctggctttccagagtaaccaacataatacattactaaacatgtccattaataatttcaatttagttttaagagtgtaaagggatctcaaagtcttctaatttggtctcttccttaatgatagttagtcttaggataatcaagcatgtatttatttttccatctatgtcagtatttctctttttttgtcttttctctctggcctttgtctcttttttctcaaccactctctgttttctttctgaattgcttttctccatcatacttcctaatattacaaatctatagctgcctccccaaaaaacttgcccttgcaagaagcaacaaatagatgtgaataacgttctagagacatcctgatttttgtgcccttactcttaggtcttattagaatagtgttcctataagcagtggccttttaaacatattttaataatatttctgatattttaaaaatgtgttttatcattaaaaaaattaacatcaccaccaaaaatcttctcctttatgatgtgcttatttcacagcacatgcctgtatcaaaacatctcatatagcccataaatatatatacctattgtgtatccacaaacttttttttttttttttgagacagagtctcgctctgttgcccaggctggagtgcagtggctcgatctcagctcactgtaagctccgcctcctgggttcacgccatcctcctgcctcagcctcctgagtagctgggactacaggtgcctgccaccatgcccggctaatttttttgtatttttagtagggacggggtttcaccgtgttagccaggatggtctcgatcacctgaacttatggtctgcccgcctcaacctcccaaagtgctgggattacaggcgtgagccacagcacctgaccaaacattttaagaaaatactgtatattctagaaaacttgttctaaaattgttctgtaaatctgactctatgtatgtattagattatatatatgtatgtatatgtatgtatcagactctagtatgtattagatttgtccagttgaaaaatgtgctaataccattgtgccttaattttgttttctttttaggtaaatgttatcaactgtagagactgaaaattaggaatataccaaacatcattaagaattttaatgcttttttctttcatttaaacaatatagtttaaataagcttatatccagtttataaatctgaaatagataattagtggtaaaaaaaacatagtagacttctgctttgagaacagcatcaaacattgctgtttcaaaatgccacttaaaatcatctgacctacattgtcatcttcttttgaatggtttttattgccatgttaacagcttgacctgaagtttgtcttctttggcctccagtggaaaaatatcattcggttgactggttcttagaaaagtttattaaagttggctacacaatttaacagtgtaacagaaactggggctaatgcaaactgtggctcgaaggggcagcatttagcatggaagagtcctgttcctctaaactgtaaaacattcacagcagagtcaccgtgtactttcaggagccacctcacacgctgaagtcaagttatcactcaataaattgttgagaacatttcattggcagtgaaatcttttaagaaagcttttccagctaagcaccacctgctggaggccacctgttttctgagcaacaaggtacccaatcaaggagcccaacttggtttgggtttctaaggcatctttccagattctatagcattgaaaagctagagacaatttggtgcaggtgaagtctaaatattatgaacaaagattatttattgagactccattagtaactccattaatagacatatatgtctatcactatgttataaaaaagtggataagactggaggagccttgtgggatctatacttaatttgagaagacaagcatatataattacctagttatattgattcttatatttaaagagtgcaaatgagccataggtcagtgaggtaggagaggagaaagcaaagtaatgaaaatttctcatccattatgacacacagaatacctactagaataagttaacctttgtgtatgttcttgttggaaatctctgtagtgttgctgctaaatggtagtgtgttcattgtcaaatttgttgcccagagagcaataccttgagttggtgcattgacttcacttgcgttcttctcgactgataacattgttttatttaccgataaaaatcatgattcataaacatagcacaggttcaacagagggctgaattaatattttaaggcatttgtctgagcaactaataacaacacagcctgtcttgaaaggtctctaatattattatgctctcataatatttagaataagaggaagattatgccaacaatagagtcattcatttattcaaatcaagagaggaatgtaggtgcctactgtgtgccaggcactggggtaggagctgaaaggcaacatttactaagacatggcctttcttttgtgtgttttcagcaagaatatgcatgcagagcccatagtctatatgaagtgatagataacattcttaattacaatataaaatgaaagcattaataggtacaagtaaaacatgtctggggagcatcaagaatagaggaatatttgcaaggtgaaggcttcccagagaggtgactttagaggcttatcttgaaggaagaatagatgttgtaaggcagataggctgtattacagtagtagcaaaatcattttatcatgtatattttgccgactattttgttacacatatcttttttctttgcaatacattttattaattatcctaataactctgtgattcaggtaccattgtcatctccattttagagaatgaaaaaagtaccaagtatagagaggttagtaatttgtcaaggtctcccagcctgtgtgtggagagcgatcactgctgagcctgatctcttatccacctaaatgaaaccatgtgtcactgtgctggtgagaggaatagacacaagggttgtgaaaaacttagcatgattttctggccctggttattagaattcagttttggtgagactgtgagatcgagaataaggtccagatcgtatgattcttttacatccctttcaatgccctatataaatttcctagataattacagacatgaactctttttatgtgtatgtgtgaaaatatttttgaagcagaaagtcatttacagatacaaagtacaacttttaaaatatttgggataaagatgttctctgaagcaagttccttgccattgattcatgagtattgagtctttactaaggaaactttgcaaaatcataaatgatacataaataagtgatgtgcttgcaagattctgacaaagtcagttagtatcaaaaaagagacataaataaattagttccttgttgaataaaatgtatgaaaaaaatcagaagaatgaaccttaaaggattcagatcctcacttaattatatgggtagtgaaatctaactgccataaaacgtcagcttctgtgaatacatccacaattccagatataacagcctgccttttgctgtgacattgtttatcaatttctggaggctcactaggtgcatttaatatttaaatacaagggaaaccgagaagagaagacattcttcctgccacacgtatagattataacacatcgttgtggaaataatatgataaagacaacatcatggctgcaccaccattaaatctgttctcttagttctttagtggaaagatgtggagtcacctacccacggtttgcttgatttcttcatctttgaagagctaaattatgttatgttttagaaatgattttttgatttctcttttctccaaatcccttgattgctcaagcctgggttatttttaaaagctttagattttctttgcactcatttctcatttagagtttgaaatgatatgatcaagtacatctgccttaagaaatagcatttaaatcaagatctggatgaatttgaagtagttttttaaaagtagagagcattttattaactaagtttctgcccatgggaatattttaaatgtgtgaggataaagagaatatgttatcttcccagcagctggtgtgagaaagcttgttgagaagaggctttgataaagccaccagggggtgagaacaatactttggagtcttgggtagaacttatgcctaggtttcatgtaaggaagagagtagcgctgaaaaatgaagaatgaatgaaataagagttagaatggtcagtgtgtgggacagcccagaacggcggttttgaaagtgtaggacatatcccattagtaagtcatggaatcagttaatggatgtcaaccagccacttaaaaaaaaagggggaggaagagaataggaaatattggtatgtaagacatagtgaagattaataatttttaaggaaatatttgcatgtcacatatagtgaagattaagtattgttttgtaaaatgtttcaattttatgtgtgtgcatatgtattgggtaaatatatttcttatagaatcttggtaaaaataaattacaaaaaatgatctacagagaaagggaatgtgaattaatggtaggacaggggctttctttggggaagaataaagctaagagtttataaaccctttccatctctctggcaaaaacttcagtgaattctaccttgttacaaatacctccaataaaatgaatcttgttgttttgtgtgtgtgtgtgtgtgtgtgtgtatgcacttgtgcacacatatgggagtgtataagcttagtattaggaacagggaaggtatcaaggaggtagaaaagaacagatgaccgtgagtacgtagaattacatatctgtgtatatggatatgtagaattacatgtgtgcgtgtgtccatatttgagtgtctttaatgtatccacatatcatggatactgcatttaaatttttggatacatttaaataatatcatctgtaggtgagaaactaataaatttcaaatagctttattgaaaatggaaagcagtgtaaatataggtagttacttaattattcaatttaattttgaattctgtcacttgaaatgagatgtacgattaactaaatgtgtattatcaggtccaatgccaaaagtcactttatttttaagaaatttttttcacattgctgattttcaaggtactatcagaaagattgtcagagtatgctattttaatattttttcacaaaaacattagtctgaaaagtccacctatgtgcaagagtgtgagttcctctgcatatatatcccaatattttgtgttagaatttaatgtcatgttttactctgttttctacaattcattatcttcatctgtagattaaataattttaggagtatttcagaaactgctgaatattttttagcatcttcattaagacaaatatttttcctttttccttcctcttacccattcttcctttatattctttccttcttttcatatataaactgagtttctcccatgtgccataagctgggaagacagacactgtccctgtcctcatagagttacagtaaaggggaaggacaaggagtgagagcgcacatcgttgggcatctagcatagaagtaggggtttggaggaagtccctgggtcaaatgacatctcagatgctacctcaagtatcagaaatgcatgaccaggcaagtcagagctgggatgaggtgaaagtgttataggaagaagaaatagcatgtgcatagggtgggtgacaagatgaacatgggagagagaggtgagagacgaccacagagaggtgagaaggggctacatctcgctatgaaatctactgaaaccaggtaagagtctggttgtgtcgtaaaagcaatggggacttgctgatggcatttacgccagctccacttgagtaggaatatatttctgaaaacaacccaaagccactcaacatccagtgtagacttagaccagaggtcaagaaattttttttgtaaagaatcagagatttttttaaaaattatactttaagttctgggatacatgtgcagaacgtgcaggtttgtaacataggtatgcacgttccatggtggtttgctgcactcaccaaccaatccgtcacctacattagatatttctcctaatgctctccctcccttagcctcccacccgctgacaggccccagtgtgtgatgttcccctccctgtgtccatgtgttctcattgttcaaatcccacttatgagtgagaacatgcagtctttggttttctgttcctgtgttagtttgctgagaatgatggtttccagcttcatctgtgtccctgcaaagggcatgaattcatccttttttatggctgcatagtattctatggtgtatatgtaccacattttctttattcagtctatcattgatgggcatttgggttggttctaagtctttgttagtgtgagtagcgctgcaataaacatatgtgtgcatgtgcttttatggtagaatgatttataatcctttgggtatatacccagtaatgggattggtgggtcaaatggtattaaataatttaggctttgtgggccatgtagtctctgtcacaactactaaactcttgttgtgctatgtacacagccataaaccatttgtatacaaatgagtgagatgatgttctaataagatattacttacagacattgaaatttgtatttcatataatttttatgttccacaaaatactcatctttttattttttctcaaccatttaagaatggttcttaggtcacagaccacacaaaagtaggctctgagtcagatttggcccacagactctagtgtgctgaaccctactctatagagaaactcaggtgtgtaacctaggtagcaacatttgggtggtgcctgaggacacctacagagtaaagcacctggttaatccttgcttctaactctaattctaatggctgaatgcaaaggtactttaagtattatgtacaattgtaaagactcttaagatgatgccttggagggacaatacatattttttatctgttctgatatgtttaaggagaattaatgttttctaaaacaaatcaagtcttcaagtgttttcacatgctaatgatggaaacaggcattataagaaagacatacatggtaaatgtattagtttgggttctctagagaaagtgaaccaatagaacatgtatatttctgtgtgtttgtgtgtctgtgtgtgtatgtgtgcatgtgtgcaaaatcccaagatctgctgctggagacccaggagagccagtgttataaattccagtctgagtctgagtctcaaggcagaagactgatgtcccaactaaagacaggcagaaagagagaggaaaggagagacagagagagagagaattttttcctacttaccttttttaatccattcaagctgctgatggattggttgaggcccactcacgttggaaagagcaatctgtttttctcagtatactgattcaaatgttagtttaattgagaaacgcccccatagatgcaccctaaaataatgtttaaccaaatatccgggtaccctgtggcccagtgaagttgacacataaaattaatcatcacaaaaacaaatgagtttctaagtcagaatgagataattggaaggtctggttactctgaagagtaacattaaattgggaccttcagatgagtgagttaggtagcggagtcattgggggtgttgaaggcaggtaagagaagtttagatgggggagttatatatctttgaatctagtacaatattagagcgtaggaaagatcagaagaagtaccttatttctatctagtaatgtagaaagcccaggaactcttggtgtctctctattatctggccagagtaaagccagctgtaagcaacatatagctgtaagcaacttacagctggctctactatggccaaacagtagagagatgccaatactcaggtattgtaaagagtagatcaccggcgctattcagtttttcaaaaacaagaactctttttaagtaatgagcttcctgcacctttgtacacacttatgccccagtcttatctaaataacatctaagagaaaagaataatccacaagaaaaactttccatctaagccatatttatgtcctgattttatccttcagagcccttgcttcttgaaaaacactccaggaagaagtcatgatgtttttttcacatcattctttccattagattgaggtagggtagacctgtgaccgaccacaggcaagtagtttaaagacttttcatctgcaagctctaacttggtttcactgacctcaagacatgtgtttgagagaccatgaacaaaggatttcatgccaaaaggaggaaacaataaaaagttatctctataacagccttgaaaaatgccaattttttttcaggaatatcactaaaatatacttgcataagaacagttattattgtggaaaaagcaaagcaatttcattgccttggcaccacctctttagcatcaacggaataccctttctccgccacatatttcatgtgctatagtaaaagaaatctactgagattctgggtttacatttgcagtcttcatacaccacatgcacattctgatattctttcatagatgttgtacccattataactcgtgtcccatcacaagaaagtgagttttaattttaaatattttaaatatgaatatcataatttactgttttcatgtagtattaacattgttccttagagcccaggcatataatgtagtttcctgacattatagcagatccatttttaagggtggaaaaaaacccagtatcttcattacttatgaataatttgggccctccagaaatccagctgtgttcccatagaaacctcattggcctagatgtggtgtcatcggccaagaaaagctaaaattcaaccactgtattacaaattgttaattcaagtaaatattgaatcatctaattactgattacagataaaactttccccaattctttaagaagttcagaaaatatccattaaatatgattggtcaataatgaaataccagagtgaggtgggaagtgttggctgaaatggtgaaatttactatttttttaaatgcagcaaacaatttctgaaaatatatcttagtgacaaaactattttaatgatggttataaaagctaagtacaacttgctaaattagttctaatcttatcctaacaacagaaggggcttgtagctattatgttttctagagaaaactcagaggatgccatcataaggcaactttatttttcacaatggctgttatctttaaacttgcattaaagagtaattaataattttcttctaaccttaagtgacagaataagcttgacagcttagata

SEQ ID NO: 65 - DNA, 4096 bp, Homo sapiens
aaaactctacagactaatgaaatgtcttccattttacggaaagtcacttccattctgacctacacagtcactatcaaagaataacactaataataagaatgttgagaatggtaagaatctcaccaccaccacctatctgtccaggctgggagattagcaacaggcgaagatgcatttccagcatctgcctaaatgctgagttctgtaagtacctcccctgtgccatgccccctgcaaggcattatatatctccaatctttgataaaactgatcagctctgaaaggtggtattattacctacatttccaatggtggtggaaattgacctcagtattaagtcacttgacaaagatatagtaagtatagaatctagaggcaaaccttttttttttctgattccatagttcagactctcaattttcacattgtaacatgtttgcttaatagctacattttactgtaaaatttctaatttatcaacttctatgttaaagtccccagctttatttattctattttggatagtgacacagaaagataaagtttacctgtcagcaggccctccaggacgaacacatgttatcacaactggacgagatttatttctatcatcatgtgctccccctagcaaagaaaaggaacagagcttaaaactgctttcattgttggcatttaaaaaaaatcacctacaagatatcagctgagaaatgtcctacttgatgtacggaggaaaatatgtaaaattttccttgaggcatacaaaagccttaaaggtcttgctcattttatatagaatatatttttgaagtcaccatttctccatctttcaataaatatatggctgtaaccaggtaatatataaagtatttaacaactggaatggcaagagaatcaaccgattatatcaagtactggcccgatttgaacagctgtcagttatacagtacagatgtgtatatctgtgccaatcaaactgatctaaaatactggtcagtaggtctacaacctaacataaaggaaacaaaaaccaaagtaaaagaaaaatcctagtactaaaaaagaaagccaaaaaaaaaaattcaagtgaccaagtggctttcattaaaagtgagatgttcaaaaatttggggcaaaattttcagactgtgtcaagccagctgcaatccttgaatgggaattttaactttctgttagaaaacttctccacaagaattcatagaaacatagatgtttcaagatggaaggtaatttattgtaaattttctttttaatccatgacccttttgtacaatttccttaatctgtgctcccccagcgtctgcatgaaatgcacgcgtgctggcctacttactagatgtgaggctgctcactccacatttggacaccaaggagtgttagaaagttcttcctaatatttaactgatatctcttttcctttaactttcatccactcgtctttgttctatgatccagagcagtaaaataaaaatgtatgctctcttttacaaaaatgcttttccgaaagttgaaaacagagattatacgctggctaaatctcaccttcttaatgttgaacaatgccagtttccttatctattctttatgtgacctgatttctttgcacatcaccatcctgactgtccatctgggagttttctagtttgccaatatctgataaatataaacctattgtcaattattgctcccttaatgtttgcctgctagaacagatggacatttcccaaacctggcataggccgaaaggtcaacttatagaaaatagcctaagagaaaaattaaaaggcattcacagttcctcaggaaggcaaatgcttcttttgtgctcacttctacgacaagtgatttgtttagtgtgattgattggtaaaagctctcattcagtattttattcttgcattgtgtttagcttctttagaaattcctctttaaaataagaaattcaccactttctcagaaaaaaattttaaaataaaaattttaaatgttaccacaaatgcttgcccatatttatgtaaatactgttacataatttctcttttgcaaggtgatcataaaggataggtttgcttttccctaaaggaaaactgattgagaaaaggatgggggtcaaagatagcaagaaatcgttccataattttggtttgtatttacaaatttcaatatgtaatatcgaatgcttgttaaagtgtgaggtagttttatatttcttgatatgtggcattttactgttatttgtaatgaaccaagttccctgtgtgacttacttaggttctggaagtttgcagcagcaaggccaaacaggaaccactcagagaccagtgatattctcaatcctggtgtacattagtatcaactgggatgctttttgaaaatatcaatgccagggccacagtgcagaccaaatctgaacatcaagcagcatatgttaaatgactaggcccacctacaattttacatttgagaattactagagaaggtttccttgtctaaagtgtaaagcaacttcatggcagagtgcctttcctatcagtccaactcatctcttctggcttgcttgcattaactgaaatttaaccctccaaggtttaggccagaacatcatttttattctatggatgcaagcttctattgtttagggaataaaggttttagaacctgtgacttatagcattagaaatataattccattcatcagctaaaagcttaatgttgcaagttccattctattaggttagaacttctcccatactaaacagatatgctccatctgcaatatcttctctttcctgactgtcctagtattttctattgatctaagtttagctcaactcccatctatgccaaaatatcttatctgccatactaatatttactcacagcactttctcattctgattaaccagtgattcttaagtgatgggtagtgaccaccttttgaacagggaaaatcctccagatggacctctaactaatctaaaaacagaaatcctatatttgattctcattgagaaattattcaaaactccaaaaacttttatgttcaaccaacatattaagggagttattaaggcctataaaaatgcggtcctcataaactaatactggcttattgtaacttaagttttttaaaatcagtataatactatgaagtctgatgtccacacaaatctaggcaacattcaatcattcacttattaagtgcctccacataccaggcagtattctaagctcacattataaaactcctggatatacacacagatagtggaaattcctgcaaactgtgggaagggtgttttactaacattacatcatcagttgtcttgaggtggttgtgcatttcagttgcttctattctgtttatttcttgataataaattactcttggtttagctctttcattagtaatttgattcgctattgactaaccatacagtcactatcaatgaatatctgcaacagcagtatattttggtacagtgtttcaataattaggctatgtatgcatgtgattcaagaaccttctcgttcagatctgtattgcaaaacagatttgtatatatcacccttcagccaaaaattacttgtacagtgacttttcactatattcatctagttattttaaacagaaatttaggaatggttagggtaaatgatcttgggctctgttgctccacctaaaaataggccttggtcagaaaaatgtaataactacaagtctaaacctctcaatgagttcctagttccacatcctctctactactcacttgagcactctatcaacttttgtcttaaattcactggactgtaattccttgtagatcaaggtattgtcttatgactccatagtacttctttccatgctgacatgttgacatgtgcttaataaacatttgattgattgatttgttaagtgactggcacaaaatgaaagctactatttaaaactcaatcacttaagacaaatccaaatctgtacaagtttatccacatctcttttattctttgatgcatacatatttattaagatgtttaattttaattaatgttttaataattttgatagaatttttac
